United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 13

SEQ ID NO: 36336 - DNA, 945 bp, Triticum aestivum
  Clone ID: PAT_TA_36336
ctcgtgccgaattcggcacgagccacccccgaactccaaaccctagcagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgctgcgaggagatctgcatgtccggcggcctcgtccgccagaagatgaagtacctccgcttcctccgcaagcggatgaacaccaagccctcccacggccccatccacttccgcgccccggccaagatcctctggcgcaccatccgcggtatgattccgcacaagaccgcgaggggcgaggccgcgctcgccaggctcaaggcgtacgagggcgtcccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagagaaaggagaaggccaaggtctcctacgacaggagaaagcaactggcgaagctccgcgtcaaggccgagaaggcggccgaggagaagttgggaactcagctggagatcctagccccgatcaaatactaagagagattagagcttccgtgcgccatcagttttgggaaacctctgtcctcttgtctttgagtagtttggtaactctgtgatagtacaacctggttggtaaacctttgttatgcatgcagttctgctaccctcatttgaaattttctacttggtgaactgtttcgtttatcaaatgtgtgcatttggagattctagatgaatgtctatcaggtgattatatgttgctgaggctgttctctttacta

SEQ ID NO: 36337 - DNA, 1753 bp, Triticum aestivum
  Clone ID: PAT_TA_36337
gcacgaggcgctctccgctccattcgattcgatctcggcttcctctccaagccacgcgacgcgagaccagagctccggccatggcggcgacgatccagtccgtgaaggcccgccagatcttcgacagccgcggcaaccccaccgtcgaggttgatgtgtgctgctcagatggaacctttgccagggccgccgttcccagcggtgcatcgactggtgtctatgaagctttggagctgagggacggtggatctgactacttgggcaagggtgtttccaaggctgttaacaatgtgaactccattattgcacccgctttggtcggcaaggaccctaccgctcaaactgagctcgacaactttatggttcagcagcttgatggaaccaagaatgagtggggttggtgcaagcaaaagcttgggtgctaatgcaatcctggctgtatcactagctgtttgcaaagctggagccagcgtcaagaagattccactgtaccagcacattgccaaccttgctggcaacaagcaattggttttgcccgttcctgcgttcaatgtcatcaatgggtggatcccatgctggaaacaagcttgctatgcaggagttcatgatccttcctactggagctacctcattcaaggaggcaatgaagatgggcgttgaagtgtaccacaacttgaagtctgttatcaagaagaagtacgggcaggatgccaccaatgtcggagatgaaggtggttttgctcctaacattcaggagaacaaggagggccttgagctcttgaagactgcaattgaaaaggctggatacaccggcaaggttgtcattggaatggatgttgctgcttcagagttctacaatgacaaggacaaaacctatgacctcaacttcaaggaagagaacaacgatggttcccagaagatatctggagatagcctgaagaacgtatacaagtcattcgtgagcgagtaccccattgtgtcgattgaggacccgtttgaccaggatgactgggtgcactatgctaagatgactgaagaatgtggagtggaagttcagattgttggtgatgaccttctagtcaccaacccaactagagttgcaaaggcaatccaggagaagtcatgcaatgctcttctgctcaaggttaaccaaattggatccgtcactgagagtatcgaggccgtgaagatgtcaaaacatgccggctggggtgtgatgaccagtcacaggagtggtgagaccgaggacacattcattgctgatttggctgttggtctgtccacgggtcagattaagaccggggctccgtgccgctcagagcgtcttgccaagtacaaccagcttctgaggatcgaggaggagctgggcgatgccgcggtgtacgctggcctcaagttccgtgcaccggtggagccctactagatgggatctgcacgagtttttgtgaaaatgggtgtgtttaacctccggaatgaactctggttgaagctcttaggattgagcaataatgaatgccgcgcatgttttatgtgaacggaacggatatgtacccccaaacttgctccaattttggtccttgtggatatgtacctgattcggccctgaaccttttggatgtgtaatactagtttttggcgcatcatctttgccgttattgtgttagtttacttgttgcagaaagcatgcttctgagaaacttgctttcatctttgtttgctattctcaaaacactggttttccaaaaaaaaaaaa

SEQ ID NO: 36338 - DNA, 1560 bp, Triticum aestivum
  Clone ID: PAT_TA_36338
tcggcacgaggcaccccccgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacggccccatccacttccgcgccccggccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaagatctcctacgacaggagaaagcaactggcgaagctccgcgtcaaggccgagaaggcagccgaggagaagttgggaactcagctggagatcctggcccctatcaaatactaagagatatcagagctttcgtgcgccatcagttttgggaaacctctgtcgtattttaagtagtttggtaactctgatagtacaagctttttttttttttccagaaacttcacagataagataatcatcgccttagcgaagcagtgcacgtgagcgtgcagtgaaaccaccccccttccttccaaatcaagcaatgggtgacagccagggatcacaacaatctcagagtactcacaattttatttgccaaatacactagtagtagtagtagtagtcaggatgatgaactgcaggcgggacggccaaaccgcacgactcatttattggcagcactagcagtactacaaactacacaaaggacgggcggacgagattaaccggagcggacgcggatcggcatgcgccggagggggtcggatcagttggccgccggcttgaaggaggtgagctggcgggtgttggtccaggactgctcgtagacctcggcgacgtagggcgcgctgttgccggagccgtcggccgcgtcgacgaagaggcggtagttcatgccggagacgacctgctgctcgccgcgcgtgacccggcggaaccgcagcccgtcgctggccagcctcgcgtgctgctccaccgcccacccgcccagctcctggatgtgcgcgtccctcacgtccgggatggggccccacccgccgacccgcgcgccgcggccgcccagcgccaccgccggggcggcggccgcgaggcccgcgacgaggagggcgaggaggaggaggacgggtccccgcgccatggagatgactggagactggtcttgggggttgggaattgggagcggtggtggatctgctggaagcgtcgaaggaaggattgcgtgaag

SEQ ID NO: 36339 - DNA, 2285 bp, Triticum aestivum
  Clone ID: PAT_TA_36339
gcacgaggctgcgtcgtccctggccttggcactggcgccggtggtgctggagtactactactactcctgctatctcgttgcgtcccgacaaccagaaaggagaggggagaggggagaggaaagggggaagccaacccagccgcaacacagggcggagcgagcggggtagccgagaatccagcgatctctcggcaaggaggagatacaccaaaacacctactgcttctgtgaattgatgcgctgctgaatcggcgtctcttggcttccgtaacagatggcttcagtaggggttgctccgtctgggcacaagaacagcagaggcaccagcatgggtgctgagaagctaccagatcagatgaacgatttgaagataagagatgataaggaagtggaagccactattattaatggcaagggaacagagactggacacataattgtcacaactactggtggcaaaaatggtcagcccaaacagaccgtgagctacatggctgagcggattgttggtcaaggttcatttggtattgtattccaggctaaatgtttggagacaggggaaactgttgccattaagaaggtccttcaggataagcgctacaagaaccgtgagctacagaccatgcgcctgcttgaccacccaaatgttgtagctctgaagcattgtttcttttctacaactgagaaggatgaactgtatctaaacttggttctcgagtatgtgcctgagactgtccatcgtgttgtcaagcattacaacaagatgaaccagcgcatgccactaatctatgtgaagctgtatacataccagatatgtagggctctggcttacattcatggcagcattggagtttgccacagggatatcaagccacagaatcttttggtaaacccacatactcaccagctgaaactgtgtgactttgggagcgcaaaagttcttgttaagggagaaccgaacatatcatacatttgctcccgatactatagggctccagagctcatatttggtgctactgagtacactacagccattgacatttggtccgctggatgtgttcttgctgagcttatgctagggcagcctctgtttcctggtgaaagtggtgtggaccagcttgttgaaatcatcaaggtccttggtacccctacaagggaagaaattaaatgcatgaaccccaattatacggagttcaaattcccacagattaaagcacacccatggcacaaggtattccataaaaggatgccacctgaagctgtcgatctagtctctcggctcctccagtactcgcccaacctaagatgcactgctgtggaggcacttgttcaccccttctttgatgagcttcgggacccgggtacccgccttccgaatggccgctttctgcctcctcttttcaacttcaagcctaacgaactgaaaggaatcccagcggatgttgcggcaaaattgatcccagatcatgcgagaaagcagggctcccatgcgtgactatgagatgcttgtctcatgagtcgttggaattgcatcgacaagtgcgcatttcccctggggatgttggttgggcagcatgtgagcgtgatgaactattatggttgttggaagacctgatgtatgaccactccaccctgttgacctgtgtagctgagtagtagttgtgtgctgcgatgcaagcttgacaatgtaaccggttcaccctcccttgtactaaccctcgcctgagaattgggattgccatggctgatctgtaatatgttctagagaagtatgaatgtatttatggtagttgatcctagtattgggtcctcaagattttcctagtttcttgatcgtcggactcgtgccaccttgttttagattcctgttgttgaaggctacctgttgctactgcagtggtgctatgtactatgatctgaccaatttcccatcatgcgaggccaagcgtgttcttgagaggctacacaataagagggagagggaaagtgctgctagtaggaactgaattgatgtcattcttctggtcccttggatggcagcgctgccaaaggctttggacatcactgttggcctccaccattgtcatgatatcttccatgtcgtagtttttcagtattgtggacggtgaaatcactatatacgacatatgtcaaatgtccctctgctactgcattacgaattagatgcttgttttccctctgttttagaaggtgtaggttatcatacattaattatgtgtcggtctccatatttttggtgtatcaaacgctgttgttacttttgt

SEQ ID NO: 36340 - DNA, 2477 bp, Triticum aestivum
  Clone ID: PAT_TA_36340
cccacttccgcaaaggagatcgacaaggcgaaggcggagaggaagaagcctcagagaggagaagctcaaggcgaggagaggagagggatcgtcgtcgtggcgatggatcgggtccgcggctccgcgctgctgctcggcgtcctgctcgcaggatcgctgtttgcactttgtgccgcaaaggaggaggccaagaagctcggtacggtgatcggtatcgatctcggcaccacctactcatgtgtcggtgtgtacaagaacggtcatgtcgagattatcgccaatgaccagggtaaccgtatcacgccctcatgggttgggttcaccgatggcgagaggctcatcggtgaggctgcaaagaaccaggcagctgtcaaccctgagaggaccgtctttgacgtcaagcgtctcattggaagaaagtttgaggacaaggaggtgcagagggacatgaaacttgtcccctacaagattgtcaacaaggaggggaagccttacatccaggtcaagatcaaggatggggagaccaaggtcttcagccctgaggagatcagtgctatgattcttgggaagatgaaggagactgctgaggcataccttggcaagaagatcaatgacgccgtcgtcactgttcctgcgtacttcaatgacgcgcagaggcaggcgaccaaggatgctggtgtgattgctggcctcaatgtggctaggatcatcaatgagcccactgctgctgctattgcctatggtttggacaagaggggcggcgagaagaacatcctggtgtttgacctgggtggtggtacttttgatgtcagtatcttgaccattgacaatggcgtctttgaggtgttggccaccaacggtgacacccatcttggaggtgaggactttgaccacagaatcatggactacttcatcaagttgatcaagaagaagcatggcaaggacatcagcaaggacaaccgtgctcttggaaagctgaggagggaagctgagcgtgccaagagagccctcagcaaccagcaccaagtccgcgttgagatcgagtccctctttgacgggactgatttctcggagccactgacccgtgccaggttcgaggagctgaacaacgatctcttccgcaagaccatgggaccagtgaagaaggccatggatgacgctggcctcgagaagacccagatccacgagattgttcttgttggtggcagcaccaggattcccaaggtccagcagctcctcagggactactttgacggcaaggagccaaacaagggtgtgaaccctgatgaggctgttgccttcggagctgcagtgcagggaagcatcttgagcggcgagggtggtgacgagaccaaggatatcctcctcctcgatgtggcgcccctgaccctcggtatcgagactgttggaggagtcatgaccaagctgatccccaggaacaccgtcatccccaccaagaagtcgcaggttttcaccacctaccaggaccagcagaccaccgtctccatccaggtctttgagggtgagcgcagcatgaccaaggactgccgtcttctcggcaagttcgacctttctggcattcccccagctcccaggggcactcctcagatcgaagtcaccttcgaggttgacgccaacggtatcctgaacgtgaaggcggaggacaagggcacaggcaagtcggagaagatcaccatcacgaacgagaaagggcgcctgagccaggaggagatctaccggatggtcaaggaggcggaggagtttgccgaggaggacaagaaggtgaaggagcgcatcgatgcccggaaccagctggagacgtatgtctacaacatgaagaacaccgtcggcgacaaggacaagctggcggacaagctggagagcgaggagaaggagaaggtggaggaggccctcaaggaggcgctcgagtggctggacgagaaccagacggccgagaaggaggactacgaggagaagctcaaggaggtggaggccgtgtgcaaccccatcgtgtcggccgtgtaccagaggtccggcggcgcgcccgggggcgagggcgccgacggcggcgtcgacgacgaggaccatgacgagctgtagatggttttaagggaaccaatttttgtaatggggttagtagggtgagagaggagacatggataattggtaccgctgctgcttactttgggtctgcggttgttggaggtggttgagactgctgttattagtctgttgtccgagctgtagagaactctttgctgctgctgttacttccttctgatgtttaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaaaaagggggccccccaaagggttcaagcttaatttccccttcaaggcaatttaaaaccccttcaaaggttcccccaaat

SEQ ID NO: 36341 - DNA, 872 bp, Triticum aestivum
  Clone ID: PAT_TA_36341
ttcggcacgaggatctccttaggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaatgaggtccgcgccaagtccaagttctggtacttcctgaggaagctcaagaaggtgaagaaggccaacggccagatgctcgccatcaacgagatctttgagaagaaccccaccaccatcaagaactacggcatctggctgaggtaccagagcaggaccggttaccacaacatgtacaaggagtaccgtgacacgaccctcaacggcggggtggagcagatgtacacggagatggcgtcgcggcaccgcgtgcgtgccccctgcatccagatcatcaagactgcgacggtggacttcaagctgtgcaagagggacaacacgaagcagttccacaactcgaagatcaagttcccgctggtgtaccagaaggttcgcccacccacccgcaagctcaagaccacctacaaggcgacgaggcccaacctcttcatgtgagcgggtccctactctactggcctgtgtgttttagcgtgtaagagtttgaagatttttgcatgtggaagttttggttaagcactttgatgatgttttcggtcgctaaggatgctgctgctttgatgcaactcttgactttgtttggtattagtaatgcgcagcagatccatcaactgctagccctcagctgctatgttttggtttggtctgctttcaaatgcagtcgacaagtctgatgcctaaattattccgtgcgcccaccctttagggc

SEQ ID NO: 36342 - DNA, 795 bp, Triticum aestivum
  Clone ID: PAT_TA_36342
gccggccggtccgggactattcgcccttccgcatccagtttggtcgccttccgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgtggcgagagggcctaagctgccccctccgccgacgccgttagtgagtcggaatgtgttgattctggttgtagtttgttcctaattgctgtgctaggtctctctgcttttgtgtagaagaaatatggttgttggtacaagcaagacgaacttgttatgtgatgatgttacttttggtttgcgatgaagcaaacgtatgtcgaagacctcagaactgctgttgttgttagcaacgactcagctcttgtcgtgtccttgatcccatcgtggtgttctgtcttgattcctgcgtggtt

SEQ ID NO: 36343 - DNA, 1136 bp, Triticum aestivum
  Clone ID: PAT_TA_36343
aattcggcacgaggattcccctcgccgccgccgccactccgccgctgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcctccggtgactacgccatcgtcatcagccacaaccctgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgcgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcatcgctgccaggaggactggtcgtctcagaggccaggctgccgcctctgctgccaaggccgacaaggccacttagagctatcgttgctgtttatctatgtttgctgcctctagattacccgtcaaggacatgtattgcaatatggatgtcgtttttgctcggtactttggtaacgtggtgatatttgttatcagttttcgctgtcgtggtctggattcgtcggtccacataaagaagattgtgcttggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataatggggggggc

SEQ ID NO: 36344 - DNA, 988 bp, Triticum aestivum
  unsure (1)..(988): unsure at all n locations
  Clone ID: PAT_TA_36344
tactaaagggaacaaaagctggagctccaccgcggtggcggccgctctagaactagtggatcccccgggctgcaggaattcggcacgaggctccttcttaggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaacgaggtccgcgccaagtccaagttctggtacttcctcaggaagctcaagaaggtgaagaaggccaacggccagatgctcgccatcaacgagatctttgagaagaaccccaccaccatcaagaactacggcatctggctgcgctaccagagcaggaccggttaccacaacatgtacaaggagtaccgcgacacgaccctgaacggcggcgtggagcagatgtacacggagatggcgtcgcggcaccgcgtgcgtgccccctgcatccagatcatcaagactgcgacggtggacttcaagctgtgcaagagggacaacacgaagcagttccacaactccaagatcaagttcccgctggtgtaccagaaggtgcgcccacccacccgcaagctcaagaccacctacaaggcgacgaggcccaacctgttcatgtgatcgggtccctactctactggtctgtgctgtgttttagcgtgtaagagtttgaagatttttgcatgtggaagttttggttaagcactttgatgatgttttcagtcgctaaggatgatgctgctttgatgcaactcttgactttgtttggtattagtaatgcgcagcggatccattgttgcttcagtatgtttcgctacctggtagcgtcaactgctagccctcagctgctatgtggtttggtctgctttcaaatgcagatgtcaagtctgatacctgaaattattnccgtgcgcccaccctttcgggct

SEQ ID NO: 36345 - DNA, 897 bp, Triticum aestivum
  Clone ID: PAT_TA_36345
ccggccgggccgggaagtgcccgaagccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggttggtttaggagggttttaggtggactcttttggccgctggatctgtgtccggcggccatggttatcttcctgtgtctgctgctatcttactgtttgaatgagatgaactccgctatgaattatccataatttgtgctcgttggcttcaaaaaaaaaaaa

SEQ ID NO: 36346 - DNA, 1868 bp, Triticum aestivum
  Clone ID: PAT_TA_36346
gggaacaaaagctggagctccaccgcggtggcggccgctctagaactagtggatcccccgggctgcaggaattcggcacgaggcacccctctcgccctcctctcgattcgatctcggcttcctctccaagccacgcgagaccagagctccggccatggccgccacgatccagtccgtcaaggcccgccagatcttcgacagccgcggcaaccccaccgtcgaggttgatgtgtgctgctcagatggaaccttcgccagggccgctgttcccagcggtgcatcaactggtgtctatgaagctttggagctgagggacggtggatctgactacttgggcaagggtgtttccaaggctgttaacaatgtgaactccattattgcacctgctttggtcggcaaggaccctaccgctcaaactgagctcgacaactttatggttcagcagcttgatggaaccaagaatgagtggggttggtgcaagcaaaagcttggtgctaatgcaatcctggctgtgtcactagctgtttgcaaagctggagccagcgtcaagaagattccactgtaccagcacattgccaaccttgctggcaacaagcaattggttttgcctgttcctgcattcaatgtcatcaatggtggatcccatgctggaaacaagcttgccatgcaggagttcatgatccttcctactggagctgcctcattcaaggaggcaatgaagatgggtgttgaggtgtaccacaacttgaagtctgttatcaagaagaagtatggccaggatgccaccaatgttggagatgaaggtggttttgctcctaacattcaggagaacaaggagggccttgagctcttgaagaccgcaattgagaaggctggatacaccggcaaggttgtcattggaatggatgttgctgcttcagagttctacaatgacaaggacaaaacctatgacctcaacttcaaggaagagaacaacgatggttcccagaagatatctggagatagcctgaagaacgtatacaagtcattcgtgagcgagtaccccattgtgtcgattgaggacccatttgaccaggatgactgggtgcactatgctaagatgactgaggaatgtggagtggaagttcagattgttggtgatgaccttctagtcaccaacccaactagagttgcaaaggcaatccaggagaagtcatgcaatgctcttctgctgaaggttaaccaaattggatccgtcactgagagtatcgaggccgtgaagatgtcaaaacacgctggctggggtgtcatgaccagccacaggagtggtgagaccgaggacacattcattgctgatttggctgttggtttgtccacgggtcagattaagaccggggctccctgtcgctcggagcgtcttgccaagtacaaccagcttctgaggatcgaggaggagctgggcgatgccgctgtgtacgccggcctcaagttccgcgcaccggtggagccctactaaacggggatctgcatgagtttttgtgaagaaaatgggtgtgttttaacctccggaatgaactctggttgaagctcttaggattgagcaataatgaatgccgcgcatgttttatgtgaacggaacggatatgtaccctcaaacttgctccaattttggtccttgtggatatgtacctgattcggcctgaaccttttggaagtgtaatactagtttttggcgcatcatcttcgcctttcttgcgttagtttactctctttgtttcaagaatgcatgcttctgagaagtgttgacctgttttcatctttgcttggtattctcaaaatcttttactcttaaagaaaacccgcttctgatgtcaaaaaaaaaaaaaaaa

SEQ ID NO: 36347 - DNA, 1035 bp, Triticum aestivum
  Clone ID: PAT_TA_36347
tgcggagatgatccaccagtgagctttattgaactatagttttgtttctggagatgatccaccagtgagctgtattgaactatagtttttatctggagatgatccaccagtgagctgtgctgaaatgaaatatagttttgtttctgctgatcatcatcaaaaaaaaaaatttctactattcgcctttccgcacccacactaggtcgccttccgattcgaacctcccccaaatccgcagcagtccacaggaggcgaagccaccgcgatggcccgtacgaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagccgtcctccccgtcaacgccgttagtggatcggaagtggaatgtgttgcttccggttgtagtttgttcctaattgccgtgctaggtctatcttcttttgtgtagaagaaatatggttgttggagtaagacgaacttgatatgtgatgatgttccttctggtttgcgatgaagcaaacgtatgtttatgatgcagaccgcagaaccattgttgtaggcagcatcactgctgtcgtcgtgtgtgattgtttgctgtttttctgagttgctttcatttgggttgtgctgttgtgacagggatcaggtgacatgcacctttgcatgtcaccttgcggcctaaattcatatttaaaaaaaaaa

SEQ ID NO: 36348 - DNA, 592 bp, Triticum aestivum
  Clone ID: PAT_TA_36348
ttttttttttttttttttttttttcgtacgagttgcatatattcacggataaatccattcattttatcactggaagcaacgcgtggcatgcatcatgctacgtacaccggtgacgcgccggcgggtgcgcgccacgttttattacatctcctgacagaggcggcgagtgggtacatggtagttaagatacataggtgaccggcggcgccatggacgggccgggggtggtggagctcgccgcgcggagcgtctgccctagcactccctctggcaggtgcagcgcctgaatttgcagtagccggccgtccattttgcgccgtgctcgccgaggcacgtcttggtgcagctcttgtccgagatgcacgggaacgagtggtgctggctcttccccgtgcaaatgcgcgcctccgccacaccgacgcctccgccgtcgtatgaggaaagcaggagcagcaccagcatcaccgcgcacacggtcgccttgggcttgaactccatttgcttctgtgggggtaggtaggtggatggagcaaagccttttgttctctttaggtggaacaagctagggcttctgatccagcggacgcgtggg

SEQ ID NO: 36349 - DNA, 916 bp, Triticum aestivum
  Clone ID: PAT_TA_36349
gccggccgggtctgggacagagcccgaagcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagatctccgtggttggtttaggagggttttaggtggactctttgggctgctggatctctgtccggccgccttggttatcttcctgtgtctgctgctatcttaccgtttgaatgagatgaactccgctatgaattatccattatttgtgcgcttggcttcatatctgtttgtcg

SEQ ID NO: 36350 - DNA, 2103 bp, Triticum aestivum
  Clone ID: PAT_TA_36350
agtacttgcatttaggtactcacatttcctcttttattcatctactagtatgttgttttacaagcaggtttcttatctacaataataacaacaacagagagatgacagaaaacagtggtaaattaggaatggcgaacaaaaagcatgctttctgcaacaagattaaagtgacgccaaatacgatgccaacagccaaacagtttactacagatccaaaaggtaatcaggcgtacttgctcgctcaccacaaagaccaaaattggagcaagtttggtacatatccgtcccgttcacagcaacatgcggtacattattgctcgacaagtcctaagagcttcaaccatagttcattccgcgagttaagacacacgcccactttcgcaaaaacaagtgcagagtggtggtgtctcagatgcagatcccatctagtatggctccaccggtgcgcggaacttgaggccggcatacacagcggcagcgcccagctcctcctcgatcctcagaagctggttgtacttggcaagccgctctgagcggcagggagccccagtcttgatctgacccgtggacaaaccgacagccaaatcagcaatgaatgtgtcctcagtctcaccactcctgtgactggtcatcacaccccaaccggcatgttttgacatcttcacggcctcgatactctcagtgacggatccaatttggttaaccttcagcagaagagcattgcatgacttctccttgattgcctttgcaactctggttgggttggtgactagaaggtcatcaccaacaatctgaacttccactccacattcttcagtcatcttagcatagtgcaccccagtcatcctggtcaaatgggtcctcaatcgacacaatggggtactcgctcacgaatgacttgtatacattcttcaggctatctccagatatcttctgggaaccatcgttgttctcttccttaaagttgaggtcataggttttgtccttgtcattgtagaactctgaagcagcaacatccattccaatgacaaccttgccggtgtatccagccttttcaattgcagtcttcaagagctcaaggccctccttttgctcctaacattcaggagaacaaggagggtcttgagctcttgaagactgcaattgaaaaggctggatacaccggcaaggttgtcattggaatggatgttgctgcttcagagttctacaatgacaaggacaaaacatatgacctcaacttcaaggaagagaacaacgatggttcccagaagatatctggagatagcctgaagaatgtatacaagtcattcgtgagtgagtaccccattgtgtcgattgaggacccatttgaccaggatgactgggtgcactatgctaagatgactgaagaatgtggagagcaagttcagattgttggtgatgaccttctagtcaccaacccaaccagagttgcgaaggcaatcaaggagaagtcatgcaatgctcttctgctgaaggttaaccaaattggatccgtcactgaaagtatcgaggccgtgaagatgtcgaaacatgctggctggggtgtgatgaccagtcacaggagtggtgagactgaggacacattcattgctgatttggctgttggtttgtccacgggtcagatcaagactggggctccctgccgctcagagcggcttgccaagtacaaccagcttctgaggatcgaggaagatctgggcgctgccgctgtgtatgccggcctcaagttccgcgcaccggtggagccatactagatgggacctgcatccgagacatgatcactctgcacttgtttttgtgaaagtgggcgtgtcttaacttgtggaatgaactatggttgaagctcttaggactagtcgagcaataatgtaccgcatgttgctgtgaacgggacggatatgtacctacgtgctccaaacttgctccaattttggtctttgtggtgagcgagcaagcacgcctgattaccttttggatctctagtaaactcgtatttggcgtcggtttagttttgtgcagaaagcatgctttgttcgacattcctattttaccactgttttcaaaaaaaaaaaaaaaaaaaaa

SEQ ID NO: 36351 - DNA, 1072 bp, Triticum aestivum
  Clone ID: PAT_TA_36351
gactcactatagggcgaattgggtaccagggccccccctcgagtttttttttttttgcatatatccacggataaatcaatttattttgttaccaaaagcaacgcgtggcatgcatcatgctacgtacagcggtgacgcgccggcgggtcgccgcgccacgttttattacatctcctgacagaggcggcgagtgggtacatggtagttaagacttaagatacataggtggcttcgtttgacagacggcgccatggacggggcgggggtgggggagctcgcgcgcggagcgtctgccctagcactccctctggcaggtgcagcgcctgattttgcagtagccggccgtccattttgcgccgtgctcgctgaggcacgtcttggtgcagctcttgtccgagacgcacgggaacgagtggtgctggctcttccccgtgcaaatgcgcgcctccgccacgccgatgccaccgccgccgctgtaggaggaaagcaggagcagcaccagcatcaccgcgcacacggtcgccttgggcttgaactccatttgcttctgtgggggtaggtaggttgatggagcaaagcctttttttctctctttaggtgaaacaagctatggcttctggctgttgttgctgttgttgctgctgctgaggttgggtggaagtagcttgtaccaattgttgttgttgttgcaaaataatggcgtgcacgacgttgtggatggcctcgcatcttgactgcttggggatcgcttttagttgctgacagcactgctcccacattaccaagcagctgctatgttgcaccacctgtgaccggaggaatgacatatcagcaactgggctacactgttgtaggagggcatccctgcatgggttcaacttttgatgtggaactggatgttcttgtggctgcggagttggttgatgctccggagatgatggatgttgcggctcccaagcactacggaatgcagtaaagggttcggcggccgtggtggtcgccgcgacaacaatgagggcaaggacgaggaatttcttcatggttgatttgtgttagataatgtttgttctcc

SEQ ID NO: 36352 - DNA, 1027 bp, Triticum aestivum
  unsure (1)..(1027): unsure at all n locations
  Clone ID: PAT_TA_36352
gtgcggcgctcgaggcggccgggttgcgcagagcccgaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgtgtcgtcgatctaaataagagagtcgtgtgtcgtgtcttcccctggtccgtccgatgagatctccgtggttggtttaggagggttttaggtggactctttgggccgctggatctgcgtccggcggccttggttatcttcctgtgtctgctgctatcttaccgtttgaatgagatgaactccgctatgaattatccgtaatttgtgctcgttggattcagtacctgtttgtcgcgttctttctttgtctggtgctcctgactccaatgtgttggagcccgtgtgctttttctagtgttatctactcgattttcgtgccgattcgnatctnaaaacttaaattaa

SEQ ID NO: 36353 - DNA, 1282 bp, Triticum aestivum
  Clone ID: PAT_TA_36353
agctcgaaattaaccctcactaaagggaacaaaagctggagctccaccgcggtggcggccgctctagaactagtggatcccccgggctgcaggaattcggcacgagcgccactgcgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgtcggcaacgtcctcccgctccgctccgttcctgagggaggcgtcatctgcaacgtcgagcaccacgtcggcgaccgcggtgtcttcgccagggcatccggtgactacgccatcgtcatcagccacaacccccgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgtgtgaagaggaactcgtggcctaaggtgcgtggtgtggccatgaaccctgtggagcatccccacggaggaggtaaccaccagcatattggtcacgcttccactgtccgccgtgatgcaccacctggccagaaggttggtctcatcgctgctaggaggactggtcgtctcagaggccaggctgccgcctctgctgccaaggccgacaaggccacttagagctatcattgctgtttatctatggttgctgcctctagattacctgtcaaggacatgtattgcagtatggatgtcgtttttgctcggtactttggtaacctggtgatgtttgttatcagttttcgctgtcgtggtctggattcttcggtccacataaagaagattatgcttggatatttggttgtccagttacttgagttagcccctggtgcttatttttgtttattgtttctgttttagtttagctctattggtggatctataaacttgtttggttgaatcaaacgtatagcagcagtatgtttgcttctatctgatgtttctttggaattttaaccttagagttaatataaaaaaaaaga

SEQ ID NO: 36354 - DNA, 841 bp, Triticum aestivum
  Clone ID: PAT_TA_36354
gcctcgtgccgaattcggcacgaggcgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctcgtcaagaagctgcgcaaggcgaaaaaggacgctcctgctggtgagaagcctgagccagtgaggacacatcttcgtaacatgatcattgtccctgagatgattggcagccttatcggtgtctacaatggcaagaccttcaaccaggttgagattaagcctgagatgattggccattaccttgcagagttctctatctcctacaagccagtgaagcacggtaggcccggtatcggtgccacacactcctcccggttcattcctcttaaatgagttatgccgctttctactttgaaagaattcagtacgggccatctggtggcatgtccatctagctgtctcccttgttttgaaccagttatatatctagtatttggttctgtttagctataatttcgttatgcacaatgagctgttctacctaaatgctctgagaatcttgtttccattgtgaaggttcattttgattcatgctgtgcttgtcagtttgtgagatttttactatgaaatgcacactttttgattggcaaaaaaaaaaaaaaaaaaaaaacaccccacaccgcc

SEQ ID NO: 36355 - DNA, 2443 bp, Triticum aestivum
  Clone ID: PAT_TA_36355
ccacgcgtccgtgctcccttcggctcctctggcccaccttcctcccttcaaccttcgatctcctgtccccccgattctctagggtttctcccgacacccgccccccgcagcccccaaccccgccgactccgacccgctccctccctcccgctcgctcgccgcaggttttagcgatcagccgtagctctttcatcaaaggttttgtgcaaaattatgcgatcttcatgggctgattcagttgcgaacgccgaggaatcggcgcccgcgactggtgctgctcccgcccctgttgccaatcaccagaactcgcgtcccactcgcagctcttacgtccctcctcacctccgtggcggtggccgctcaccagagaatcaagtgccagctgctgctccaacaccagctggcgcatacccctcaggtgctgtgcagccttctggtgggtacgcagctgctgttggtggtactcgctgggctgcccctcctggtgctcctagcgctggcgtaggcgttgtccgccagggtggtggtggacgtggtgctgttggtggcggtggtggcggctggaactcccgccctggtgggtggggggaccgcagggaccgtgaaccaaacccttttggcgatagtgagccggcggctgtggatgttgactttgagagtcagcagaacacgggcatcaattttgacgcctatgaggacattcctgtggagacaagtggccacgatgtgcctgcagcagtcaacacgtttgcagagattgacttgggtgatgcactgaatgagaatatacggaggtgcaagtatgtgaggcctacacctgtgcagcggcatgccattccgattgtcattggaggcagggatctgatggcctgcgctcagactgggtctgggaagacagctgctttttgtttcccgatcatcagtgggatcctaaagtcaaggccaccacagaggcctagagctaggactgcatttcctcttgctctgatattatctcctactcgcgagctatcagtccaaattcatgaagaagcaaagaaatttgcataccagactggtgttaaggcttgtgttgcatatggtggagcaccaattcatcagcagttgagagaactggaaagaggtgttgatatactagtggcaactcctggtcgtttgatggatctgctggagagagctagagtatcactgcaaatggtgaattacttggctcttgatgaagctgaccggatgcttgatatggggtttgagccacagatacgcaagattgttgagcagatggacatgccccctcgtggtgtgagacagaccatgctgttcagtgctacttttccgaaggagatacaacgcctggcatcagatttccttgcagactacatcttccttgctgttggaagagttggttcaagtaccgatttgattgctcaaagggtggagtttgtccttgaagcggataaaagaagttacctcatggaccttattcatgcgcagaaggctaatgatgttcctggaaagaattctcttactttggtcttcgtggagacaaagaggggcgctgatgctctggagaactggctgtatacaaatgggttccctgcaacaagtattcatggagatcgtacacaacaggaaagggagtatgcgctgagatccttcaagagtggagcaactccccatcctggttgcaactgacgttgctgctcgtgggcttgacataccagatgtcgcccacgtcatcaattttgatctgccaaatgacatagatgactatgttcaccgcattgggagaactggaagagctgggaagtctggtttggccaactgcatttttcaatgagggcaacatgtcactggcccaggccattgtgtgaactgatgcaggaagccaatcaggaggttcctccagtggctggagcgctattctgcccgttccctcgtttggaggcggcggaggaggcagaaaccgcaggtcaggaggcggcggcggtgctcgatttggtggacgtgacttccgtcgcgacacgaggggcggcggcggtggaggaggtggtggctaacggcgttgttggcggttacgggggtggtggaggttatggtggcggcgcgtctagctcgtgggactgatgggttcaccttggtaatggtgagaattgaaatgaaaccgatggatggatggtattctattgacttagctgaaaacagatattggggtttgtagtcaccgtggtgtgggtatggtgcccttgcccccatttaccttattttgtgcctggttgttgtcaccgcacttgtgtttcccgtgtactgggttattttcctgactgggcatcaaaatcccgggtggggctaattccctgttgctgctgctgctgtagtttttggatgatgttgattgttgggtaggtaggttgatggtcattgttgcgcttctgcttctttatta

SEQ ID NO: 36356 - DNA, 2516 bp, Triticum aestivum
  Clone ID: PAT_TA_36356
aatcagcttccccttccccttctctgagatctcagcccgagcctgcgcgccgcgacttccaccggaatccttccctcctagccgcaacatcgccggatcgattcaggcattcttggtggccggagaagcagtctttggtcctctgcttgagatcatcatcagacatgtcgctgctatcgaaattgcggctggttactgtggatgtgactggtactctgcttgcttacaaaggacggcttggtgattactactgcatggctgctaaggctgctggaaagccatgccctgattatgatcgaatgcacgaaggcttcaagcttgcatacactgagatggcaaggaaatacccatgctttggatttgcggcaaagatgccaacgattgaatggtggaggatttgtgtcaaggattcatttgttaaggctgggtatgattacgatgatgagacatttgataaagtgttcaagcgaatttattccgcctttggctcctctgcgccatactctgtttttcctgatgcacagcccttcatgagagggctgagggaaaaggggatcacagttggaatcgtcagcaatgcagagtaccggtacaaagaggtcatcttgcctgcgttagggctgaatcagggctcagagtgggacttcggggtgttctcaggcatcgtcggtgtcgagaaacctgacccaaaaatctacaagatcgcgctggagatggcggggaacgtcgcaccggaagaggcgctccacattggcgacagctaccgcaaggactacgtccctgcacggagcatcgggatgcacgcgctgctcctggaccggttcaagaccgccgacgccgagagctggaggcagtccggcgcgccggtgctccctgatctcgaagccgcacaggcatggctcaccaagaacccgaccgaggaacccgctgaggagccactaggggccgcactgctgcgcaggaaggccgagaagctctgaatctcgcccctgggatggttcctgttgtgctcttgctggggagtgagggagccaaggagaagcgatgtgttgtagcgatggttcactggccagtttagctagctggagcccattacgagttctatcaggtaaagccaatgattaagaggcattggggacgcaacgtcctcgacctattctcaaacttttaaataggtaggatggcgcggctgctcccagatccatatcgacatgcccacgctgtctgatgaggataaagatgttatgaaaaaatggggtgctccaaacaagattgacttcctctctctttcttatacaaggcacgcagaagatgtgcggcaagcacgggagttcctctctaagttaggtgatcttagccaaactctgatttttgccaaaattgagaatgtggagggcttgaaccattttgatgagatcctggaggaagcggatggtatcattctctcaagagggaaccttggaattgatcttccacctgaaaaggtgttcttatttcagaagtctgctctgcacaagtgcaacatggctggaaagcctgctgttgttactcgtgttgtggacagtatgacggacaacctaaggcctactcgtgcggaggcaactgatgtggcaaatgcggtgctggatggtagtgatgccattctccttggtgccgagactctccgtgggttgtatccagttgagactatttcaacagtgggcagaatttgtgctgaggctgagaaggtcttcaaccaagatttgtacttcaagcgaactgtgaaatatgtgggagaacccatgacccacttggagtctattgcttcctctgcagtgccgggctgctattaaagttaaggcttcggtcatcatttgcttcacctcatctgggacgggctgcaaggctaattgccaagtacaggcccaccatgcctgtcctctctgttgtcattcctcgtctgaaaacaaatcaattgaagtggagcttcacaggtgcatttgaggcaagacaatcactcatagttagaggcctctttcccatgcttgccgatccacgtcatccggctgaatctactagcactacaaatgaatcagtgttgaaggttgctcttgaccacggcaaagcatccggtgtgatcaagtcgcatgaccgcgttgtcgtgtgccagaaagtgggagattcctctgtcgtgaagatcattgagctggacgactaggcaaaattagtctttgctcagggcttgccagatttttgactaggccaaaacgttgcttggtggctatgtataattctatctatagttttgcaaaacgagcagtttttcctatggtgtcatcataggatccgcggttaccattcgaaaacctacgctagttattatggatatgtcctcagattttactgaagtgtagcgagtaaatgatctgatggaataatgatatcaaaactttgtgacccttgcttatcatcttatgactgtcagttggagaattctggtatatagatattttttttcgcggcaaaaaaaaaaaaaa

SEQ ID NO: 36357 - DNA, 433 bp, Triticum aestivum
  Clone ID: PAT_TA_36357
cgggtcgaccggtgggaacaatggtagtgagataatgtgatgcaacactagaggtgccacgtggagcgtttaactggtcaactagtcatgtcatgagcaaatacagagttgtacggtgagcccgtgactgtataataaccactaaacgtaaatggtgaccgtaatgagtggatcctgaagtccaatgtgcgtatcgtgctttcgcttcaaatacaatgatcgtcattgcatatatcgtgagagaaagatgaaacatgcgtgaattttctgggggcttacttttagaggacctggagatagttttgtgtgcatacgtgaaaggggcgtacagggggtatgcgatggagagagagatgctcttcgtttctctttattatgactaactttgtatatagtatataaatatacaaattcacagtgcggaataaatatc

SEQ ID NO: 36358 - DNA, 666 bp, Triticum aestivum
  Clone ID: PAT_TA_36358
gccggccggttcgggacacaccgcaaagaatcttctctttcttcaaaacacccgagcaaacctctccgatctcccatcccggcgccccccgctcctcccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtcgcgctgcgcgagatccgcaagtaccagaagagcacggagctgctcatccgcaagctccccttccagcgcctggtccgggagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaggacatccagcttgcccgccgcatccgcggggagcgcgcctaggcgcctcgcttgccattgctaggtgtttaggatctgttcccgtcgtgttccatatctgcgtcgttcctgtgtaactagcttgttgctgtgcttcgatgctttcaatgaaatatggttaccagtaaaaaaaaaaaaaaacaactcgaggggggg

SEQ ID NO: 36359 - DNA, 1363 bp, Triticum aestivum
  Clone ID: PAT_TA_36359
gccggccgggccggggtttctcgttcttcatcaatcaatactgcttccatctcttcgcgctgccagatccaatcagtcgcgacacgatagcttcatacaaacatacgataaacagacagacaccatggcctcaccacagaagctccgaactcccatcaccgatcttttcaagatcaagcatcccgtcctccttgcgggcatgaacgttgccgctggtcccaagcttgccgccgctgtctccaacgctggtggtcttggtgttattggtggtgtcggctatacccctgacatgttgcgcgagcaaatcgccgagctcaagagcttccttgacgacaagaacgctcccttcggtgtcgacctgcttcttccccaggttggcggtagcgctcgcaagaccaactacgattacaccaagggtaagctcaacgagctggtcgatatcattatcgaggagggcgccaagctctttgtctctgccgtcggtgtgcctcccaaggctgttgtcgacaagctccatgccaatggcatcgtctacatgaacatgatcggccacgtcaagcacgtccagaagtgccttgacctcggcgtcgacatcatctgcgcccagggtggcgagggtggtggccacaccggtgatattcccacgactgtcctcatccccgctgttgtggacatctgcaagaagcacaagtcccctctcaccggtggtcctgtccaggttattgctgctggtggtatccacaacggccagctccttgctgcctccctcatgatgggtgctggtgccgtctgggtcggaacccgcttcattctcactgacgaggccggtgctcccaaggctcacaaggaggctgttcgcacatctggtcacgacgacaacattcgcaccatcatctggacaggccgtcccatgcgtgtccgtaacaacgactacattaatgactgggagaccaaccgccaggcagaaattaaggagctcgtctccaagggtgtcattccctacgaggccgatcttgacaagctcgctgaaagcaccagcgagagcgaaaacgacgacgacgaggacatccttgacaagtaccgaccttacctcatgggtaagtgtgctgctgttgtcaacgagcagaagcctgccaaggctgtcgttgatgagtttgtggacgatgccgttgcttggttgcaaagaggcaacaagatgattgccaagctgtaaagcagccatgccatttacatatgagataccttgttatttagtcattattttgtgatctacacgtagattagaagcctttgcttggttaagttgaactttacacatcaaactcattgttgcaacacaaaaaaaaaaaaaaaaaaggcccta

SEQ ID NO: 36360 - DNA, 1007 bp, Triticum aestivum
  Clone ID: PAT_TA_36360
gccggcgccggccggaaaaccatctctcgctccaccgttcttccacgaccttctctcctataaccctacttaatacgcccaattccttctagaacttgcacatacttcttctctaaaagcttcactattactatccgccaaaatgcctgagatcaacaccctcctgttcgactgcgacaacaccctcgtcctctctgaggagcttgcctttgaggcttgcgctggtctcatcaacgagatctgcgagtctcgcaaggttgacatgcgattcactggcgagactctcatcaaggagttcgttggccaaaacttccgtggcatgctcaccaccctccaaaagaactacaacatcgacatttccgccgaagacctcgaatcctacgtccgaaaggaggaagacgccgtcatcgccaagctcaaggaggccctcaagccttgcgttggtgtcgatgagcagctcgagaagcttgctgcttccggaaagtacacaatgtctgttgtctcatcctctgctcttcgacgagttcgcgcttccatcgagaaggtcggccaggacaagtacttccctggcgacgttgtcttctctgctgccacaagtctcgagaagcctaccagcaagcctgaccccgccatctacctccatgctcttgagaagctcggcaaggaggccgaggaggcagttgccattgaggacagcaagagcggtactctcagcggtacccgtgctggaatcaaggtcattggctacgtcggtccttatgctgaggacaagcaggccgagatggaacaggtcttgcgcgatgctggtgctgtggtcatcatgcgtgactggtccgagttccccgctgctctgcaaaagattgaggctggtgaggtttagatgagagaagagtttgttgctatgacaatctactttgaggaatacccaaattcacatataagccatatagcgagagggatgttcaggattttttttcctgctcaactactacagttttgatgaatct

SEQ ID NO: 36361 - DNA, 2434 bp, Triticum aestivum
  Clone ID: PAT_TA_36361
aaactacccgatctcccccgcttcttcccctcctctgcccccctcccgcttttatctcccgatctcacgcattttgggaagacaagggagagagaaacagaggaggccattctttacaccttcctgggaaaagaaccgggaggaggaggagaaggcgagcgagacggaagggagcgaggaggaggaaggcgcgacgagatgagggagatcatcagcatccacatcggccaggccgggatccaggtcggcaacgcctgctgggagctctactgcctcgagcacggcatccagcaagatggcaccatgcccagtgacaccacggtcggggttgcacacgatgcgttcaacacgttcttcagtgagaccggtgcgggcaagcacgtgccgagggccatcttcgtcgaccttgagcccactgtcatcgatgaggtgcgcaccggtgcctaccgccagctcttccacccggagcagctcatctctgggaaggaggatgccgctaacaacttcgctcgtggccactacactgttggaaaggagattgtagatctatgtctggatcgtgtacgcaaattggcagacaattgcaccggcctgcagggattcttggtgttcaatgctgttggtggaactggatcaggactgggctctctgttgttggagcgcctctcggttgattatggcaagaaatctaagcttggtttcaccatttacccttccccgcaggtctcaacagcacccgtagaactgctctgcatgtcggctcggccgagaaggcttaccaggagcagctcagcgtgcctgaaatcaccaaggctgtatctgggccctcaagggtgatgcctaagtgtgaccctaggcatggcaaagatatggccggcggctacgatgtgccatgcagatgtcgttcacaaggacgtcaatgcggccgtctgcgggcgccaaaactaagagaactagtccaagtacggtcggatttggtcgcccctaccggggttcaaaagtggtccgccatcaaccctacccagccccgcccatccggtgtgtacccccagggcgggggtgcccaccaaaggttccagcgggcccttcgtgcatgatcaggcgaccaacactggccgttgccgaactgttcttcgcgcatcgaccacaagttccgacttagatgtaacgccaagtgcgcgttccgtgcactcgggtacgtccggcgagggcatggagggaaggcgacgttctccggaggcccgttgaggacttcggccgctctggacgaaggactacgaggaggttggcgccgaaggcgcagacgatgagggcgacgagggggatgactactaagtagctggttaataagtagttggctggttaatgattggctttgatctgtatactcagtaagtatggttccattgcgttacatattgattgctgttatgcgtgtttcctttccttgtaatgtactgaagttgttgttagggtggccatgattgttgataccccatttctgcatgatgacatccgaggttactccctcccagattactgggcgtgctatcaatgttgccggcagactgttgaaaacgagactccaacctacaccacgtttcaacagcatgatttcatagaatgcatccgttctttccacctacaagacgttccatgagtgcctcccagtgggttatctcaccgttcctggacttacctctgctaccttaacggcctagtgtgtccctgcgcatggccaaatatacctcctgctgcttgcgggtaccgtgttgatgtagctcccctcggacgtcaaataccgcagtcgcagccatcaaaacccaagagaactgtccactacgtctgactggtgccctaccgggttcaagtgtggcatcaactaccagccaccttccgtcgtccccggaggcgacctggcaaaggttcagcgtgccgtgtgcatgatcagcaacaacaccgccgtcgccgaagtgttctcgcgcatcgaccacaagttcgacttgatgtacgccaagcgcgcgttcgtgcactggtacgtcggcgagggcatggaggaaggtgagttctcagaagcccgtgaggacttggctgctctggagaaggactacgaggaggttggcgccgaaggcgcagacgatgagggcgacgagggggatgactattaagtagctggttaataagtagttggctggttaatgattggctttgatctgtatactcagtaagttttccgttgcgttacatattgattgctgttatgcgtgtttcctttcctgtaatgtactaaagttgttgttggggccgccttccttccccttgcccccttccccccccttggcttccttgaatccttgatgatgccactgctccattgcgcaccctcctgcctctgcttgcttatacccaaaccgcaaagaaaacgaaaagctac

SEQ ID NO: 36362 - DNA, 1885 bp, Triticum aestivum
  Clone ID: PAT_TA_36362
ggggggcgctttgtcgcttccgccgctgcccccgtcgaggacggccttcccggactgcgtactatccccgcggagggaaggggtgccttggaccgctctctttttgccgttcacctagttgacaccgacaggaacggcctccccggtagcaagagacgggtcggcacatggtaacgtgtatgaggctgtccaggggagcggtgaaaggaaacgatgaggaggcgtcgctacggagagggtgttctgttaagtgttcggctgccctcgtgatggaggaaggtaggtcaatgaagctctacaagaggtgactgaggttcagctacgacacgcctttgggcctgagggtacgtgcggtggtatgatccgatgaccttgtgatggtgcaattagctcagaggctatcttcgaagtggaattgatgaaggttctttgtttctctgaacctctggagaaagaagggaggcacaagcatcgcggcggctgttatgtgccatgcttggcagagcgcttgtttgcgatgactccatttagtgcttgttgttctcagccacatatccgtgaccattcatcacttaaagcagacgtgtatacatacagctctatacttgaagcatctgcatccgcccaacagtgggaatatttcgaaaatgcatacagacagatgactctttctctacaccatctagatcaatgcttaaattcttggttgctcatcaaggcatgcagggctggatagccctatttggtggagcatgcacttgatgcaatacttgaaagaggagaaatccctgacgtagagctgttcactgaaaatatttgccaaactattgctgatagcgaccatgcaaggacactgcatctcatgaatactatgtctgcgtcttcagtcgagatgaatgaacagcaatggagcgatctacttcagcaaaattcacatcgattcagggtggatgcgttgaaagacctgataaggcacctcagtactagtgatgccatcaaaacagatcccggacttggttttgtaagagcattgcagtcccaatgtgcaacaatgttgacgaaagacgctgaagagcctcaagcagataattgttcacatagcaatctgatggaacaggatgagctctcttgcaaggactcattgggtagtcatgaattatctgattccagtactgatatccctgtatcaggtgtcaaagctggttcgggtggggacattgtactgcatggtccgcattcagaagatgaacatcgtaatcttgcgcattggggcacacaggtatctgccatcgacaaagtgcttgattccatgaactcatttggtaactgtagttcatatgaaaagatgccgacagcattagaaattctcgaatcatgggagcaggagtgtgttgaggacatatttgctccaaagaagggaagcagagaaactatgagagataaatgaatgaagcactcaagcatgttgttcgatgttattagtgtaaaattctgacatcaatttgaactggcctcaggcctggttaatgcggaaataatggagtcccgcaggctttggttgcttctggttgttgtgatcccaccagagttctgtagaagagtaaaccaacctgtgagtatttatttgcacacatgttcttttgttgcacaaactatttgcggataagtgctgctctggggtaaatatgtgtggtagtttaggggcaaacctgtgtattaacttcatttgtaagaagtggatctgtaccattggatcgcgaaggatacttaggcacatgttctagtaggaactgtaatagaactcgcctttttgcaaaccaatcaccgtcagtttgcaacattgatagtgggtgtcgcaatgaaatacgagtgtatagccgcacac

SEQ ID NO: 36363 - DNA, 675 bp, Triticum aestivum
  Clone ID: PAT_TA_36363
gccggccgggtcgggaccaccgccaagcgaaatcccaatctcctaacgccacagcgcagcagcagccagatctttccccatccatcccaatggcccgcaccaagcagacggcgcgcaagtccaccggcggcaaggcgcccaggaagcagctggcgaccaaggcggcgcggaagtccgccccggccaccggcggcgtcaagaagccgcaccgcttcaggccgggaaccgtcgccctccgtgagatccgcaagtaccagaagagcacggagctgctcatccgcaagctccccttccagcgcctcgtccgggagatcgcgcaggacttcaagaccgacctccgcttccagtcctccgccgtctccgcgctccaggaggccgccgaggcgtacctcgtcgggctgttcgaggacaccaacctctgcgccatccacgccaagcgcgtcaccatcatgcccaaggacatccagctcgcccgccgcatccgcggagagcgcgcctaggtttgcggtcgccggcgatcctggctagtggctgttcttgtcttttgatccgggtgtctgtcgggtgcttctgtttgttggtgttgatatgatgtttcgtctgttcctatgtatcgtcatgctcgaatgaaattgcaatggaaaagttcagttatcgtgaaaaaaaagaaaccta

SEQ ID NO: 36364 - DNA, 399 bp, Triticum aestivum
  Clone ID: PAT_TA_36364
ctgatagtgcgaatcgccggtggattgggcgagcttgatgtgtcggcgggttgggcaagctataggccgataacaccggcgcatggccccacgatgatgaagaagtcgtgtcgccatgacatgagttctcctccgatgcgtggtggggagatgggggtctatgctgggaagggagattggggactggcggttagagctcaggcaagacaaagaacggtggcaaggtcaggaggacgaatttggggatgtgaggccagccgggatttaccggacatggggtggagcggtgacccccacttggatctacgagacgactagggagcaacttttttgtagtctcatacgatggtggatggttgcacgggacgggagtgtacagtagccttcgcaaatgcacca

SEQ ID NO: 36365 - DNA, 1356 bp, Triticum aestivum
  Clone ID: PAT_TA_36365
gtttcaaaggggagtcattcccggccgggccgctcctcttcatctttggatcacggccttgccttctagtcactccttcaataacgctacgcgtttacaacattctcttagaccaacttacaacacagtccttcacaggcaaaccaaagtattccgaaaataccccaaaagtaacgtcttttctcgaaaaacaataaagatgaagttctcttcttccgccgttctcctggctgccgccatcggtgcctctgctcaccccagcggccacgctcaccagcgtgctcacgccaagcgcgacttcatcgtcgccaacaaacccgtcactgtctacgagactcacgttgtcactgctcccgccgctcccgccaccgctgttcctgaggctcccgctgctcctgctcccgttccctctcagcccaaggctgacgaggccgtccccaagtcctgggccaccggtccctggacctccgacgttcccaagctcaacaagggcaagaagcacagctccggctccggctacaagcctttctgcggtggcaagaaggccaagcgtgccactcttgaggacattgctgctaccggcaacactggtgttcccggtgactacggctgcaacatgatgaccgtcgactccgacgtcgccgacaagtacacctacaccaccactttcaagaacgaccacagcgaggacaaggagtgtgcctgctggaacaagatcggtcctctgggcaagatcgacggtttcttcgccaagaacatccccatgcacttcactgtcggtgccaagagctcccaggtcgttgctttcgacgagaactctcagggtggctgtgcttgctcttccaaggaggttcccaccaccatcaacggtctcgttgccggtacctggctcgagtttgatttcggcagtgagcgcaacggtggctggtctggggccgacgcttcttgcctcgtctctgctaaggagaagctcaacatccccggtctccgtgtctgtggccacaacacctgctccaccatcaaccccggtggcactggtaccaacgcctacctcggcggcatggaggctgaggatggtgtaggtctcaacattaacgacaaggaggtccgccttaccgtcgacatcgactacgagggctaagttatgccataaagcatggtttggcctttgcgtaaacttgatttcatagaattgggcttattctatctatacatgcggtttacggtgcgcggaatttaacagttatccatagaacttggatactgcctttgggatcttactacctcctcctaaataaaattttaaggaaaaaatttcccctcccaaaaaaaaaaaaaaaaaaaaaaaggccccta

SEQ ID NO: 36366 - DNA, 567 bp, Triticum aestivum
  Clone ID: PAT_TA_36366
gccggccgggctccaggcacttctccccttccggcgcagctcttcgacggatcacctcgttcgccacatcggcagtagatggcagatcccggcgccggcggtgacctttaggcggtccttggacgcgctctgttcatgttggtgactttccctttctccgatcgcagcgtcgtacggcgtgttcttgctgcgcaacaagctcaagcgtccgaagcagaagaagatgaaggaggagcaggatctccggcggcacgagcttttccggcgcgagcaggagctccgggcacaggtggccggcctgcaggccgccctttcccggaagcacgctcttgccgttgccggtaagtgatggaggaggttttgctctgtgtttttagttctttgttggtgcttggtgtgtccgtgtgaacctcagttgtgcacgtctgacgattaatcgtgtgccctaggagtaggaagcgatgccccttgcttgtttagaagcatctgatgtctgtcaccaacttgatctagtttattagtatgtagtttgaactagccgaaaaaaaaaaaaaaaaaaggccccta

SEQ ID NO: 36367 - DNA, 1830 bp, Triticum aestivum
  Clone ID: PAT_TA_36367
gccggccgggtcgggattcctcggtagtagctaaatccaatcgggctcgagctaccataactacaagagaagaaaaacactcgcaaacttccaagcggggaagacgacgatgggcatggggtggaaagccgtgaacgacgcctagccgtacctggcgatggtgctgctgcaggtggggttcgccgggatgtacatcgtcgccgtggcgtccctcaagcgcggtatgagccacttcgtgctcgtcgtctaccgtaacatcgtcgccaccgtcgtcatggcgcccttcgccctctacttcgagaggggactgaggccaaagatgacaatcaccatcttcatcaagatcatggggctcgcattactcgagcctgtgcttgaccagaacctctactacatgggcgcgaacctgacctcggcggggttcgccacggcgctggtcaacatcctcccggccgtcaccttcgtgttggcgctcatcctgcgcatggagaaggtgcggctgcggagctcccctgcacagtgccgaggcaaacgccggcacggtcctcacggtgccctgcgccgtgctgatgcacggccacggcagccgcagcgaccagcacgcgcgcgccaacggcgacggctgcgacgccttcgtcggcgaggcggcggcagccaatggccactactagtcgaaggggtcgaggggcagtaactatataatcgcatacataccatggtcgtgcggtgtgtccatctatttccactccatcacgctcctggcgcatctgtggctggaggcagtgctagttttcctaacccggccgcccacgcgcggcgctccccccctggccacgaagcggccagcaagtgctgcgggaggcgaaggccaccagctatgccttggccgtggcgactacgccggccaagggcacttacgtgtctgggcggacgttctgggtaactatatcctccactgcataggatcagcgatccgtcaggccattcaagccccgctctactggatatatggccgctccgatcaggtatgatggtccattttaccagcatgttcctatcctgggtcagcttctcgctagctacgatccaatcatgtcctgtgatagtgagggcatattacgctcggggtggccgtaccacgtgtaacggatgagaccagtgatgtaggtctccgggtcgctcgcgtacttcaatcacccctgcttggttataacagccgtcatgggctccatcattctcaaggagcagatcaccctcggcaagtgtgactggtgcagtgaccatcgtggtagggcgctactttctcttatggggcaagagcgaggacaaagccacccaggtcgcctccactttcgcagctggggcaagcgcaagggcgggttcagcaaagccggcggcagcagcaagggcgccggcgagctgcccttaacctcagtgaccaacggccacggcagcggcaagcaagagctcggcaacggcaacggcggccatgtcttcgtcgtggagacgccggcagccaatggccactactagtctaagggatcgatcggagtagctatactccaatacatacgatcatcgatccgcctgtctatatttttcctgggtataatgcatatatggtccatcgatcatgtatggaggcgaatttttcctacattttcctcttctcgtcagcttctcgctagctacgatccaatcatgtcatgtgagagtgaaagaagatcagcgagtggtggccgtacaaagtgtaacggatgagacaagtgatgtacgtgtccggatcgcttgcttaatttaatcacacctgctttgcttaaaaaaaaaaaa

SEQ ID NO: 36368 - DNA, 622 bp, Triticum aestivum
  Clone ID: PAT_TA_36368
gcacgaggcacctccccgcccaccaacagtctcgccgtgtagcggccgcgctcacttccttcccatcgcatggccggggcaagcgcgcagccggcgtgggcgcaggcgctcgcggcggtgggcctcctcgtcgcgtcgcgcgccgcgacgcgccttgcgctgtggctctacgcggcgttcctccgccccgccaagccgctgcgccgccgctacggcgcatgggccgtcgtcacgggcgccacggacggcatcggccgcgcgctggccttcgaactcgccgccgccgggctcggcctcgtcctcgtcggccgcagccccgacaagctcgccacggtctccaaggaggtcagcgctaggttccccggcgccgaggtgcgcaccttcgtcatcgacttcgccgccgacgggctcgccgccagcgtggccgcgctggcggagtccatccgggggctcgacgtcggcgtgctcgtcaacaacgcgggtcacggctacccgtacgcgcgctacttccacgaggtggacgaggagctcaggacgaacctcatacgcctcaacgtgggaggcgtcacccggaggacgcacgccgtgctccctgcgatggtggggcgcaagcgcggcgccg

SEQ ID NO: 36369 - DNA, 1216 bp, Triticum aestivum
  Clone ID: PAT_TA_36369
gattgcatacggtgctctctatctgctcttggggtctgtacacaacggcgaataatagcatcctcgtagtcatcattgttcttctcgtctcccatgccttcctcatcgtgatggtctccatactaatgctgcaggccgtccggatagtgctggcagctggccggctttggcgacctgatcccccctgttgctctggggtccgctggttgtgtgggtttggcagtgtatcctccaactggacctgaattgtccactaagcctccttctgtggataaattctctccaaaactatgtgcttcgtccgtcatgttgttttttaatgtattttttgtgttgttatatgcaactgatgttattaaatttcaagacttgctaaatagagaggagatggcactaataaaaggtgaagaaggtagacttgccctacggcttcttcttcgtgaggaaggtggtggcgcacctcgtcaccttcctcttctactgcgtcgtcatcccggcctacgtgctcgtcggcggccaggacgtgcgcctgcccaagtacgtggccatgtacgtgcccgccatcatcaccctgctcaacgccgtctgcaccccgaggtcctggcacctgctcgtcttctggatcctcttcgagaacgtcatgtccatgcaccgctccaaggccaccatcatcgggctcgtcgaggccagccgcgcaaacgagtgggtcgtcacggagaagctcggctcggtgacctccacccctgccgcgacgaccaccatggccaccaacaagggggcaatgaagaagaagaagagccagagcagcatcctggcgcccgagatcgtcatggggctatgcctgctctactgcgccgtctacgacatcttcttcggccacgatcacttctatgtctacctcctcatgcagtccgccgccgccttcgtcatcggattcggctacgtcggctcccaatgaagtgacgccaacaaaacaagaacaaaaaaccgtacctgctggctgcctctacctagttataagctatctgcaacttaatttgcattgcatactagctagatagcttgttgtttttcagggccaaccgaacaatacatacatatatacctgtaggcaccagcttaatttccaaggcaggacaattacctgcttcattatattcattcatccatacattttgcatcatgtacagaaccaaaaataatcgcttcagaacag

SEQ ID NO: 36370 - DNA, 507 bp, Triticum aestivum
  Clone ID: PAT_TA_36370
gccggcagcgagggaaaaaaggcggaggagaactgaagggggctacaaatgatggcacttatgaataacaccagggtgctgtgttggatagctattattcttatgtccatcacttccttgtcctgccatgctgctgcgaggagcacacatacgatggactttggacctattcttgggtgtgtaaagacggaaacaaaatgttcggtcgttgggtgcacgaagatatgttccgaccttggctggaatacccacagatgctattgtgccgatgctggcagttgctgccactatgcggatggaaggccattaaattgatagtataatgtattgtcatgagctcttcttttacaagggtgaatgtcaatcatctatgcgactaccgatcatagatttaataaacttctaaagtatgcagttggattatatttatgaaaaaaaaaaaaaaaaaaaaaaaaaaaaaaaaaaaaaaaaaaaaaaaacccaaaaaaaaaaaaaaaaaggccccta

SEQ ID NO: 36371 - DNA, 1068 bp, Triticum aestivum
  unsure (1)..(1068): unsure at all n locations
  Clone ID: PAT_TA_36371
ggcgaccaccagcgcctcccactgcgcgcctcccactgccagcctcagctcacccgaagcagagccaacgaccaccagcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaggtgagggagattaaaagggccaacaacgccgtctctacatgtcggcttctcttcattcttcgtgcctttggggcccctggaacttgtgtcagccgggtacggggcccccccctgggcagacatggttgcgccgcagtaaccggggcccccaccaaggaaaaaaacccttggcggcctcggccccccgcccgtccccccccggaaacaaacacgccccttggggcccttnggcncaccaaaattttgnttccccggcaaagtngaaccccccgtcaaggttaaggctttaaggccgacaanct

SEQ ID NO: 36372 - DNA, 886 bp, Triticum aestivum
  unsure (1)..(886): unsure at all n locations
  Clone ID: PAT_TA_36372
gcacgaggcgtcacgctcccgacccccgagtccctcccaccatcgccccactacagccaacccaaccggccgctccacccctctgtcgcccgccccaccaccagccggcccccccgggtatcgatcagtcagtccacctccactccactcaccagcaccagctagtgacccggggcgagcctcgctttccacggagcgctgcctgccgccggagcacgcgccagcctagccagccagagaaagaaagaaacggagcgagaggggaacggagggaggccgggcatggcgacgccggagcgcgcgcgagcgggccgcggcaacgcgacggccaccgccatcgcgaccaaccggtgggggccctactcgggcgcgggcgacttcgcgggcaacatggccatcatcctcgcctccctgctcgccgcgctcgccctcgccctcgcgctccacgccggcgtcaggtgcctgctccgccgccgccggcaacggcaggggcaggggcggggcgtcgacggcgcggctgaaggggacccggagaagccggccgtggcggagccggcgccgccgcccccgctgcctccgctgctggtgtactcggcgtccgggacgcggctggcgggcgcggcggcgcacgagtgcgccatctgcctggctgagttcgcggacggcgacgccgtgcgcgccattgccggcgtgcggccacggcttccacgcgcggctgcatccagcgctggatgcccgttcccccccctcctgaaagaactaccacaacactccccttctatttctctaaaaaccccttcccttaaatacaatatttatacntaaataaaaaaaaaaaaaaaaaaactatacaactaaaaactaaaaatcattaaaaacaacaacc

SEQ ID NO: 36373 - DNA, 610 bp, Triticum aestivum
  Clone ID: PAT_TA_36373
gccggccgggtcgggggggcggtacagtcgtctcctacctcacgcttcaggatatctaccagagtgtggagaagggattcaccaagagattcaaccatgtagttctatatgcagccgatcaaaagtgcttgaggtcgttaacgacagtgacatccctacggagccccttccattatcctgttgcggctccgcctgctggtatcgagcagaatcaacccccgttgaaagctacgacggtcaaatttgtgtggtcggagctcagagggaagattccccacaagcctcgtcacaatccgttggaaagatggatccaagagctccagtatgggcacgcaggtacgttaggaatcaagatattcaatccaaaaaattagtagttcaagtcggcttcagcgattgcggtcatatatgtgattgattgcaaataagcagagtacagtcaaggaagaatagccgccgattgtgaccattgagagatttagttatgtgcaaactgaaaattggaaggttttattagtaacttaggtaatgattgtcaaaagcatgatttgtctgttaaatcaagatttgcactattggtcaggaaaaaaaaaaaaaaaaaaggccccta

SEQ ID NO: 36374 - DNA, 546 bp, Triticum aestivum
  Clone ID: PAT_TA_36374
gccggcagtttcgaaaaatttctatctaatcttcatatacactactcaagatgtctaacaacaagatcgttcctctcacaattatcaagggcgctggccatgagcacatccctatcccagagggagagtgcgcaatcattgccgacttccactctgtcaagtcccagagctcacactctacaccttacttgacaaccggcttctacagagttgtccctggacctacacgatacggcgagtacgactatgaggagaccaaatatgtcctcaagggccaaatcgatatcaccgatgaagctactggcaagacacaccaccttgttgccggtgactgggccttcttccatgttggatccaaagcccagttctcaaccaagactgaaggtgtcgcattctacgctgtcacccgaccaatgaacgacggccaccctaaccttgttggccgtgaggagagcacctccaagttgtaaaagccatgttattatagactttaatgaattaagatacatttttaacacataaaaaaaaaaaaaaaaaaggccccta

SEQ ID NO: 36375 - DNA, 420 bp, Triticum aestivum
  Clone ID: PAT_TA_36375
aattccatggatatgtccggatcttcttcaagtccggggtcgagagctcggccgggatcctctggctgcggagaggggctgttgaactctttcacagcctttcttagttcctgttttttaaacagcaaggtaaataattgtggtcaagaaggtaaggacgagtagagtcgaataacaaataacaatttacccagcttcgggggttgtacatggcaaatccatcctgcggtttaatgtggaggaactcctcttcttctcccttgtacaattcagatagtatcctcgccaaagatgtggcggagtctggacctttgcgaccgcagcgggaggcatcgtcttatccattgaagtgccacatgggtttcccttagattgaagtggttgcactccccttataatacatattgacatgacttcaat

SEQ ID NO: 36376 - DNA, 1003 bp, Triticum aestivum
  Clone ID: PAT_TA_36376
gccgggccggtccgcccctcctcctctcccctcctccggccgccgcggcctccacctcgagctctccttcctcgtcggccccgtcctcctcccccgctcccttctacgggagcagcgcggagcggcgatccatccggttgcctgagcccttttgttgaaagcgtaggcagagagcagggtgaaatggcagcattcctcaggtccaagtgttcgtcagttggacgtgctatgctgggaagccttggaaacaatctgtacgggggcgctagctcgtctattgcaacagtggcaagacaatctcgttctgatgctgtctgcaagccaattagaacatgaatccagctgagaacaaacctcaaggtgcatgcagactcggaagccaagcaagggaggtgggtacagtcccttggggagcggaaaggtgcgaggctcggggccatgaggataggctctgacaggggagcggagcctcgtggttaggtcaagaaaggggacgtggtctatgggggggtggtccgtgctggaatcaagatggggggcattgacggcagcgaggccaagttagacgagaccgcgatggtggtcgcgaaggtccaagttgagccgatcagcgcccgtcgctttcgtgaagaacaataggtgcgctggatgagcacccagcttcagatgtccccgtcccccgatgagctcaggtaggagaaccatctgctgaattgtatctctggatgccgcagaatgatatggatttctccctgattacctctatcttgctgttagttccgctggaaaatggacatctcaaggattgtacctgagatgttttggttctctattgctactctattctacctttcctttggttatttctatttgccaataatctctattctctgatggaatcatagtgagctgttgacaaaccagacaaggatatgtgtacttagtctccacattgtatccttatgttcttttatgttcatctaaaagaacgtagtttgagata

SEQ ID NO: 36377 - DNA, 715 bp, Triticum aestivum
  Clone ID: PAT_TA_36377
gccggccgtgattcggacgagaaacaaacctccccaattccatccccattccccaaaattttccccaccggcgacgccgccctccccaaatccgatccgccgttgacgccagccatggccgccgcccgccgcgtcctgctgctcctcctcgccgccgccgccgcggccctcctcgcggcgccccctgcggccgccgcgcgcccctgcggccgcgcgcagacgctgctcatctccttctcctccttctcccgccccaacccggacccggccgacccctcgccgctcaccaccaccgtcgtcaccgtcctccgcgtccgccgcctcggcccgcaccgcttccacgcccacgaccagaaccacctccagatccgccgccccgccgagcccctccccgccgccgtcgccacccccgacgccgcctcctccttccaggagcgcgccaaggacatcctcgtcgtcgcctcgggcctgctcttcggcttcggctgcgccgcccgccccgccgcctccatgtacctcctctggtccctcgtcgcctccgccggcgccgccagcccctacgaggagctctacagcgaggacgacgtgtcggacgacgacgacgcctccgacagccccaagaaggccggctacgtcatcatccacggcgccgaggacgtcgtcgccgccgccggtaagaactaactagggctgggccttgccgtcgccggcaggc

SEQ ID NO: 36378 - DNA, 891 bp, Triticum aestivum
  Clone ID: PAT_TA_36378
gccggccggctcctcgctttcatctccttctatcccctcgcctgcaagtgcttccccccgagcgctgcagattcaattctgaataaaccttagtttcccctcttgattccttgccgtgatcttgctcgtcctcaactgcacgcacctttgcagctcggctcactggtgcggcgacggcgtgaccatctacggcgcctggtttttccccgatgtatgcctcctcaatctctcatgctggtcaacggcggcagaggggcagcatggctcgtcgagatgctgcacaatggaggagaggcgcttgtcgatctgaactgggccgttgtagtcggcgtgcttcgagatcgcatcggtgttgttctcgtctgcgacagccaagttggacgcacatcttatcgttgttggccccgagaattcggggcctccatgttctatcgctcctcgagacaagtagcccagttccgcaggctgattctttcccctatggctgtagcgctggttgtgagccgcaaacatgtgcgaatggtcggccctgttgtgctaatctcacggtactatcgtgcgagtctggttcttctattgcagatgatggtgaagctccgggaggtgagatgctcacctcatggaatatgcgacacacaattgagaagattggggcactcgctcgtgagagttctttttttagagctcttttttaggaaaacctgatggagccgatggcacaatcgaggaggatggcacaatcgtggagattggggcactcgctcgtgagagttcttttttagggaaagccatcatggtgatgtatattgatttggaataatagtacatcatcggcaagaacggcaagtaaaaatttggagggttgcttgtgatggtatgagtcgaacctat

SEQ ID NO: 36379 - DNA, 1011 bp, Triticum aestivum
  Clone ID: PAT_TA_36379
gccggccggtggcggcttccgccccccttcgacccccttctatccaggcgtctcgcaaccctcgagggcacaggcagggaacacagggagcgccccgccgccaccgagaggagcgccccgccgccggatcttcaccgccccgtcgccgccaaagcgtcgacgtcctcctccggctgttctccccgagtgacctagagcttatgctacaaataatccatgcttagtatttgttgagcattgagggtgcttgagataaagatgctgaagaacgtcttgagtcagtcatggaggaggggagcgcatgtcctacgggaagggcatccagctgaagcaatgtatgcttgttcaagtcaatttcacagcgggcaggtgttgaggtcggcgaggagcttcttcggcgtggaggacttcatggacgaggacaacagcaagccctacacgtacaagaaggagaagcggtccaagaacccgcacaagcacatctcgttcaagcagcggacgattgcgcacatggagcccttcaccctggacgtgttcatctcgaagcggtttgtatcggcgtcgctgacccaccggtcgacgtgccggcaggtggcggtggcgggcaccaactccaaggacgtgaaggcggcgctgatgtcgcggtcggacgtgccggcgtgcctgtcggtggggcggttcctggcggagcgggccaaggaggcggacgtgtacgcgtgcacctacacgccccgggagcgggaccggttcgagggcaagatcagggctgtcgtgcagtcgctcatcgacaacggcatccacgtcaagctctacctcgactgatcctttttttttcaatttttttttgctgctgttgtgtgcctgttggcgctctgctttctacgcctgctgctgaagaagagtgctggcttgcttgaatgcgctgtgctgccgtcaatcctgtgacttttgctggttgtcccatgtctgctacaagaaatttcgcagacaaaaaaaaaaaaaaaaaaaaaa

SEQ ID NO: 36380 - DNA, 580 bp, Triticum aestivum
  Clone ID: PAT_TA_36380
gccggccgggtcgggattcattccttcccctacctctcgtttcttgttggcagcgagtgcccagctcaaaaacaccatagaaatcatctctgcttccttcactcccatgctccgcacgattttttcacatccatcgggatgagatggggctcgcagccggctgcctccgctgccgacgagagcactcagggggctgctgtcgtcgtgctggggactggccgtgggattcacttcaacccgacgacaatggtgttgggcggcaacggcggtggccgccatggattttttgctggaaatttttttcgttttgctacaatctgagagagattgtggggtgtcgctgccatgatttttttgctacatcaatctttttgctggaaccacttttgtattttgctgcaatgagcgaagatgtttgtgggcgacgacgacagtgctagccatgaattttctgctggaacctctttagaattttgctggaaccgttttttaattttgttgcaattcaagaggatggtggtgccgccactgccatgatttttgctaaaaaaaaaaaaaaaaaaaaaaaaaaaggccccta

SEQ ID NO: 36381 - DNA, 1095 bp, Triticum aestivum
  Clone ID: PAT_TA_36381
tcaatttgttgttttcttagcaacatttttttgccggcaacttttttttcttttattttgtttgatttcttgcttcccaaaggaaacacacagaaaactctcgtccaaacattcacttctccagcgtaacaaagagtggtattgttatcttctgcacatattacatcctgcttgcggaatttggcacatcgtgctcgagtacaaatttgaaaagggagcaggagacgaaaagaatgacatttctatagtatataaaaaggtaggagagagaaaaaaggtaaaactatggatccgcgctattgtacagttatgctattagggggttggttattcacaagcagtgtcacaagatgctgcctaccaaccataggtgcaggaagagccaatacgccaagagtcctagccttgctcgcggccggttcatcagaatttggctccctgagacccagatgccatcaactttgtcagcgatgtgctttccttgtgctggaatcaagccagatgtatgcaatgacttaatacgccctttgtcatccaaatcatgtgcagcaattagtcgttcagactctgagcccatattaagaacaagatggtcggatgaacccttccgcattactctagcatgtgcagcagtagggacagatgaaaccgatgccttccccattggccccaaatcttcaatctcggatatgtctgaaccaattgccgaggaagatgcgtcaaatgctctgtcttgactaacctctggctgcacaagctgagaatgatacaggtcctcaagcatcttaacttttgctgataactcatcaactgtcttttccctggcctgcaacttcgatcccagctcctgttttacagacttggcattcccagattccatacttgaggcgattattagtttttccagctttggtaagagtgtttgtgtgcttgcaggtttattatcttccagcgcatcttttccagcaagatatccaaaccgctgaatcattcgctccatactgactgttacctcaagcagttcactgctttttgattccaactccctacgatttgaatcagtgtttctgcaaacctccttgagctgttccccgc

SEQ ID NO: 36382 - DNA, 798 bp, Triticum aestivum
  Clone ID: PAT_TA_36382
gccggccgggttcccaagcaaaccacccacaaccaccgctcctcatctgagctccgtcgagaaaccaagcgagaatccaaaaggtgtccaagctaccatggcgaaccacccattcgcctccgcctcagccggggcgacctcgaggtgcgcgggcgcggctcccagcaccggcaagctcacctgcctctgctcgccgaccaaccacccgggctccttccgctgcacccgccaccgcaacccgcgggggcgaccacagacgtcgtcggccggccgcgcgtcgcagcagcctgctgcaccgggagccagcgcgacggtgcgcgtcgagggaatcatcaggagcggcgccggcggcagggcaaccaccaagggccggtccgtcctgcgcgcgcacctgctgcggctggtgagcgcgccatcctccgccggccgcgaccaccgccgctgccgcgacttcatgccccgcccgtcaaggctgggccgacccgcggtgaccgcgtgacccggctgctctgcttcgcggcccgtaccagggagctcaccagtagtggcggacggtgcgcctctatttcgcgcgcaccaacgcatggatccgtcccgtcgtggctagcacacgagctaggatcgggtactgctctggagaatggaatcagtgctctttttaatgctgtgatgaactgatgatgggtgctgataaattggataattactaagtactaatactctgggatctgtacacacttcctttgtaattttgccgaggaatgaaatgggagcatttgtgtgaccaaaaaaaaaaaa

SEQ ID NO: 36383 - DNA, 823 bp, Triticum aestivum
  Clone ID: PAT_TA_36383
cgcatgagctccccgcgatcgacctcgaggccatggcgttccagcacgacctccaccagcagggcatggaggaaggcatggccgcggaggctgcggcggccgcggcggggacggcgcagttcccggtgctgccggccagggcgtccacgctgggccacacgcccaccacgtccgcgctgagcctgctgctgcagtcgcccaagttcaaggagatgatcgagcagacgtcggccgccgagagcagcaccaccacgtcctcgtcgtccatgtccacgccgccgccgccgcaggccaccagggacgacggcgcctcgccgcagtgcagcttcccggaggacatccagaccttcttcggcagcgacgacggcgtggcctacaccgacgtcgacggcctcttcttcggggacctgtccgcctacgcgtccccggcgttccacttcgagctggacttgtgatcgcgccggcggcgtacgtggccaggactgatgatacgcgccattgattggtttcttccaatggggatgggggattttgtcaataggataatcagacggagaagcaacgaagacagagcaagataacagagaattgttacagtgcagctagtgaggactgaaaattatttgaagattatttattgtttttgtccttcttttggtataatcaggggtatagcgtaagcaagagagattgtttcatttgtttcaggatccttgacagtcaaaataaggagctaatatatacgtatattgattcaaaaaaaaaaaaaaaaaaggcccctacttgtctttctttacggaagattcttccatttccaattatc

SEQ ID NO: 36384 - DNA, 409 bp, Triticum aestivum
  Clone ID: PAT_TA_36384
atgatctactcacatgtcttcgaggcgttccaccagatcaatttccactagcgcaaggtcaacacatgcagcagaaaatgaggtgtcaccggtggccatgacgcagtggtgggcttggtgatgacatccgccttgccgaactcgtggtcttggtctcgttgcatcggaatggaaacctttgagaggatccctccgcgctggtccttgcctccttagcacaaaggaggaaattgttccctctatgcccattggtgcccgcctggccttggttatcatgactcacgtcatcgtgagcctcgtgaggcggggtacccgcatagaagtcttcactcctcggtaggcagtctcggggaaccactcctcgtgaggtcttggcgtagtccgcctcgcgaggccggggggccctcgc

SEQ ID NO: 36385 - DNA, 693 bp, Triticum aestivum
  Clone ID: PAT_TA_36385
gccgggattttacggtagctagaacatacaggccagttcaggaacttttagaagaagaaaagaagggacgtgtgagtagcaacagcactcacttaagaccccttgtattggatgattttatacaggcaaaagccaaggtaagcccgtctgtttcttataacgcaacaagtatgaatgaattaagaaaatggaacgaacagtatggcgaagatggcagcaggacaaaatcgccgtttgggtttggcaactgatatgttatagtagcaatgtgttgtttgtaaaatcaataggccgcctatttagtgacaggaagccagtcctcatttttcgcccagagcctatttatacagcctctcagtgatcctgtacaaatagcaaaatatcaaagtcaaacaacaaatttccaagttttccagtagctggtattaccggctattcacaattttccgacattgtaatgctgagctgcaaatttgttccagctcagcacgaggctgatccaggtgtaagcagcaccagaaagtttcagttgttgtatggtactaattcctaggacttgaactcaatgaagcagaattttcgttatagccctcaagtgttccggatcatgatgatgataagagtattacctgtgtgggtgtgtaataaagataacattttgagtcacaaaaaaaaaaaaaaaaaaggccccta

SEQ ID NO: 36386 - DNA, 789 bp, Triticum aestivum
  Clone ID: PAT_TA_36386
gggtgcgcgccgcggtgcgcgccaacggcggggaggtgacgatgcaggcgctggccgagatgccgctggtgaagtcggccgtgtacgaggcgctgcggatcgagccgcctggcgatgcagtacgggcgcgcgaagcgggacatggtggtggagagccacgactacgggtacgaggtgcgggagggggagctgctgttcgggtaccagcccatggccaccaaggacccgcgcgtgtttccgcgcgccgaggactacgtccccgacaggttcctgggcgaggacggcgagcggctgctccggtacgtggtgtggtccaacgggcccgagtcggcgacgcccacgctgcaggacaagcagtgcgccggcaaggacttcgtggtgctcatcgcgcgcctcctcgtcgcccagctcttcctccggtacgactccttcgacgtccaggtcggctcctcgccgctggggtcgtcggtcaccatcacctcgctcaagaaggccaccttctgaggcatcgccacgtgtacttagtttttcctctgcttttctcgatcgatgccagtactacactatgcatgtgatacacttgcatggagtgatgaggatttgtgtaacaaaattttcttttcctagtaaagatgagaccggtttttcccaaaaaaaaaaaaaaaaaagggccctatttgccaattagtcagtgagatgaaaggggacatgtactcctactaccttactgatcaagctggttatccaccgtgggttggtggcactttctacaaggaccgatcaagatct

SEQ ID NO: 36387 - DNA, 859 bp, Triticum aestivum
  unsure (1)..(859): unsure at all n locations
  Clone ID: PAT_TA_36387
gcccggcccgggttgcgaaaaattccccaacaccgatggcccatcttcttcggcgttctattctacgacctcttgtcgcttcaaaaccatttgtaactccaattgctactcatcgcatcacaagactcgcttctcacttgtcaactgctaaaatggctcctgttccatctaccatgaaggccgttcagatcaacaagaacggcggcgttgaggtgcttgagcataacgatgtccctgttcccaaagttggcgagggtcagattcttgttcgaaaccagatcgctggtctgaactttatcgatacatactttcgctctggactttacaaggcacctcaattccctcttacactcggccgtgaagctgcgggaaccatcgtcgatatccactcctccgtaaagggctttgagaacggctctcgagtggttttcatgggcacagttggcgcctacgctcaatacagcgttgtcaacgcctctgatgcagtcaagatccccgacgacgtgcctactgagcaagctgtagccgcttacctgcaaggtctcacagcatggacgtttatccgagaggccggccaggtcaaggaaggccaatgggttctcgttcacgcggcatctggtggtgttggtaccttgttggttcagctcctgcgaactgtcggcgccaagatcatcggaactgctagcacagacgagaagcttgagctcgcaaagaagaacggtgctgagtgggttatcagctctcatgacgatgtagttgccaaggtcaaggaaatcaccggtggacatgggtgcggatgggtatctttgatgggtgttgnaaaggtgacctttgatgccgatctcgagntgatcgctcc

SEQ ID NO: 36388 - DNA, 1106 bp, Triticum aestivum
  Clone ID: PAT_TA_36388
caagcgcgggcgcaagccggcgaacgggcgcgaggagcccctgaaccacgtggaggcggagcggcagcggcgggagaagctgaaccagcggttctacgccctccgcgccgtggtgcccaacgtgtccaagatggacaaggcctcgctgctcggcgacgccatctcctacatcaacgagctccgcggcaagatgacggcgctggagtcggacaaggagacgctccactcccaaatcgaggcgctcaagaaggagcgcgacgcccggccggccgcgccgtcgtcggggatgcacgacaacggggcgcggtgccacgcggtggagatcgaggccaagatcctggggctggaggcgatgatccgcgtgcagtgccacaagcgcaaccacccggcggcgaagctgatgacggcgctgcgggagctggacctggacgtgtaccacgccagcgtgtccgtggtgaaggacatcatgatccagcaggtggcggtgaagatggccacccgggtctactcccaggaccagctcaacgcggcgctctacggccgcctcgccgagccgggcaccgcgatgcaaatccggtaatgaccgaatgccatccaccaggtagtagcaatgaaaccgtgatcctattactcaccaccgtatgatcggcgtcgtcgtcgtcgccgcctcgttatagcccgatggacatcgagatggagaaaagaaggcgacgatcgtgccatgttgttgttgtaaaatctctctttaggaggatggatggatggatgcatgtgtacatcatcatcatcatcatcatcatcatcatcatcatcttgttgtgtttttgcaagtagtgtgttagcagaacgaagcgccggatccgtcgttgttaattactgtatctcatgaccctgtgatcgacgacggtgtatcgtcggcgtagtgctgttgaactgaaactgtatataggacaaagatggattgcccgtcgccgttctcctctaatgttgttgttgctgttgtgtgtatgcatgcatcgcttctcgtcttggcagagcgagcgagcatggatgattgatatggtatcgcttgcaaaatgaaaaaaaaaaaaaaaaaaagttcccta

SEQ ID NO: 36389 - DNA, 1717 bp, Triticum aestivum
  Clone ID: PAT_TA_36389
gcacgagggcaagaagcacggatgaagttaaagcaggaatctttcagactcgggaacattggtgttatgagagctgggactgtcatatctgaaacatgggaggatggtcaggcaataaaggaccttaatgcgcatcttaaatcattgctggaaactaaagaggctgttgaaagacatcgtaaatctctaaagaaacgacaatcatctgataagggtgatggaagtgatgctgaaactagcatgtccgaggaagatttcctcttacaggacgagatatgtaaatctcggttaacaagtatcaagcgggaggaagaacagtatctgcgagaaagagatcgatatgaattagaaaagggtaggcttatacgtgaaatgaagcgtctcagagatgaggatggatcccgctttaataacttccaaattcttcaccatcgatatgctctgttaaatcttcttggaaagggagggtttagtgaggtgtacaaggcttttgacttggtggaatacaagtacgtggcctgtaagcttcatggtttgaatgctcagtggagtgaggagaaaaagcaaagctacatacggcatgcgattcgtgaatataatatccataagactctggtgcatacaaacattgtcaggctatgggacatattccagattgatcacaacacattctgcactgtcctagaatattgcagcggcaaggatctcgatgcagtccttaaagcaacgccaattcttccagaaaaggaagcaaggatcataattgttcaagtgtttcagggccttgtttaccttaacaaaaagacgacagaagggatccactatgacctcaaaccaggcaacgtcctcttcgacgaagttggtgttacgaaagtcacagactttggccttagcaagatagtggaggatgacgttgggtctcagggaatggaactcacttctcagggagctggaacctattggtatctgccaccagaatgctttgatctcagcagaacacatttatttcatctaaggtggatgtttggtcagccggtgtgatgttttatcagatgctatatgggaggcgtccttttggccatgaccagacccaagagagaatacttcgagaagatacaattatcaacgcacgcaaggtggaattcccttcaaagccaactgtatcaaacgaggcaaaggaactgatacgccgttgcttgacatacaatcaatcggagaggccagacgtactatcaatagctcaagatccttatctctcttatgcaacgagcgagtccgcccacgcgtccgcacgtctacactacaagacgaaggattttttggaggttgggcagccactcccaaatggtgtaactgtacatattgtaaatttcgggttggtctcgtaaactgcgatgatccaatgtctgctcttttcagtttagaggaagtagggcatcggttttgaggggcatgcacttctcttgatgctcttgtgccgcccctccttgcgtaatgtgatgtttgtttttgctagaccctgctgatggttcctttaaaggctgtatttattcgtacggaccactagggaatgtgctctgccaattcatcagagataggagccgtcgatgttcacaaaaacctttgtgatgcactatgtccgcccggatatgcacgttctatctcagttgtctaaattgggtgtggtcagttaaaagctttgatcaacaactacttc

SEQ ID NO: 36390 - DNA, 1281 bp, Triticum aestivum
  Clone ID: PAT_TA_36390
cgctccgagccggcctggccgggaacctctcacgaaccatccatcaactttcaatcccctcagcgaagaagcaccctaatcccttggtcagggccctttattttacgatactcccaaagtcatggctacccttcgtaccgatcttccaggtcccatcggggacaagaagctggagaagaagcccatcaagttctccaacttgcttctgggcgctggtctcaaccttttcgaggttaccaccctcggacagccgttggaagtagtcaagactacaatggccgccaacagaggcgacagcatggctaagtctttgggacgcgtatgggctcgtggtggtcctctgggattctaccaaggtctcatcccctgggcttggattgaagcttccaccaagggtgctgtcctccttttcgtcgcctccgaagccgaatactacgcccgtgccgctggtgcctccgagtttggtggtggtatccttggcggtgtcactggtggtgtcgctcaggcttatgccactatgggtttttgtacctgcatgaagacagtcgagatcaccaagcacaagctcgctgcctccggtgtcaagcctcagtccactttccagactttcggagagatctaccgcaaggagggtattcgtggtatcaacaagggtgttaacgccgtcgctatccgccagatgaccaactggggtagtcgtttcggtctcagccgtctcgctgagggctggatgaagtctctcaccggtaagaaggagcatgagaagctctccgctggcgagaaggtcattgccagcgctcttggtggtggtctcagcgcctggaaccagcccattgaggttatccgcgttgagatgcagagcaagaaggaggaccctaaccgtcctaagaagatgactgttggcaacaccttcaagtacatctacgagagcaacggtatcaagggtctttaccgtggcattgccccccgtatctctttgggagtttggcagaccgtctgcatggttgcatttggcgatatggccaaggcttacgttgagaaggtgaccggcgaggccgttaccgctaagcattagaaggcgttttgggaaatttggtttcaaaatattgctcgtggtgagcttgatgtatggattgtctaatgtttggttcgaaaatgtttgatataatgacatgagcttgtaaaatggcacgcgtcaaaagggtcgcggatatgacgtatgatctttgagacgatcaatcgactaagaaaatcgaaaaaaaaaaaaaaaaaaggccccta

SEQ ID NO: 36391 - DNA, 240 bp, Triticum aestivum
  Clone ID: PAT_TA_36391
gccggccgggttgcgatctcgctatgtaaatttgaagcgttatttatcttagcataaattataagataaagacgttcaacgactataaggtgagttatatgcacagtttgcgaggaagagccagctagccgatatataaagctagttgcttttacttgcaggctaaacaataatccttttttacacccaacattattattatatatatatatagaaaaaaaaaaaaaaaaaaggccccta

SEQ ID NO: 36392 - DNA, 653 bp, Triticum aestivum
  Clone ID: PAT_TA_36392
gccggccgggctgcggaaaccccaccacaaacccgcgccggccgccgcctccaccgattgatcgatcgccgggaaactgacctctgccgctgctgagttcggagccttcgtcgacgatgtctggagccggtgaggaggacaagaagcccgcggaggcgggcggcgcccacatcaatctcaaggtcaagggacaggatggcaatgaggttttcttccgcattaagaggtccacccagctgaagaagctgatgaacgcctactgtgaccgccagtctgtggatatgaatgccattgcattcctgtttgatggccgcaggcttcgcggcgagcagaccccggatgagctggagatggaagacggcgatgagattgacgccatgcttcaccagactggaggcagcgttcctggcgcctagatgcagccgttgcagagcctcttttgctgcgccatgctccgccttccctagcagtaaactaaagaagtctttttaaggaacttgtgatgctctggcaccctgtgccattgctgagggacatcattagccttgtttagtatggtttggtacctttgtctgtcatatgactcgtttatctatcctctaatatatcccgccatgtttgtactccaaaaaaaaaaaaaaaaaaggccccta

SEQ ID NO: 36393 - DNA, 592 bp, Triticum aestivum
  Clone ID: PAT_TA_36393
gccggccggggccgggatcaccgtatcaattgaccactccaacatcctcaattcctcctaacccaactcaccgccaccatgtctctcgtccttgagctccccgctgaatacggctacgttctcgttgccgctacatccaccttcttcatcaacaccctccacgtcgtcctcaccagcaaggcccgcaagcaaagtggtctcaagtaccccatcccttacgcttccaacgacctcgccgagaagaacgccgaggcctacaagttcaactgcgcccagcgttcgcacgccaacttcacagagaaccagatctccttcctgggtgctctcctgatctctggcctgcgctaccccgttgcctctgctgttctcggtgctggctgggctgtttctcgcgtcttctacgccattgggtactctgctggcggtcctcaaggacgcatgggtggttccattggctctgccctttgcgatgtgtcgctgaagttcatggccgcctacacctctatcatgtatgctatgggtaactgagttggccgtaaatcgaatataatataatattggttcccaaaaaaaaaaaaaaaaaaggccccta

SEQ ID NO: 36394 - DNA, 663 bp, Triticum aestivum
  Clone ID: PAT_TA_36394
ccaggtagccggctttgccctttccgcctctataaatgccggcccacgctctcgtccacagcaaaacccaacggaactataactacagtcactctgctctctcactccacctgcacacactcacagagggacgcagagaagcagcaggggagtccgggagtgatggctatggctcagggaagaggcagtgcggcgcagggcttcgccctcggcttgctagtgctgtgcctcctcctcggcgccgacaccgccggcgccgccacctacaacgtcgactggtcgttcgcctccggcagctggcccatcggcaagagcttccgcgcaggggacgtcctcgtgttcagctacaacccggccgtgcacaacgtggtggcggtggacgccggcggctacaacagctgccggggctccggcgcgacgcacacctacacctcggggagcgaccgcgtgaccctcgtccccgggacgaactacttcatctgcagcctcagcggccactgcgggctcgggatgaagatggccgtcactgcaaactgaagctagctgcagcttctggtttcagaaaagctagctgcgactgcgatgccatccgtgcgcatgtgaaaacatcaataaagtgctgtggaactcaaaaaaaaaaaaaaaaaaggcccctaggcatgc

SEQ ID NO: 36395 - DNA, 1036 bp, Triticum aestivum
  unsure (1)..(1036): unsure at all n locations
  Clone ID: PAT_TA_36395
ctcaanttnacngtgtntactnanccctcacatgtggccaaccggcgtgtgttgtgctncgtagttgacncctcccgcgaacaatggctgtcttngccggccggtgacgtccttttgacttgtgcagtagacctggggatccatggggacggaggcgaaagtgaaggtgttcgggccggcgagatccacctgcgtggcgcgggtgctggtgtgcctggaagaggtcggcgccgagtacgagctggtgcacgtccacctccccgccggcgagcacaagggccccgcgcatctcgcccgcaccctctgtatttgccttgcagctctttggccaggtcccggctttccaggacggtgatctcatccttttcgagtcgcgcgcgatttcgaggtacgtgctccgcaaaggcgcatccgatctactccgagaaaacagcctcgccgagtcggcgacggtggacgcgtggctcgaagctgagtcccacaacttcgacagggccatgtcggcgatcaccttccagtgcttcgtcgtgcccatgttcatgggcgggacgactgaccacaaaatcgtcgaggagaacctggagaagcttaaggtggccctcggagtctacgaggagcgtctgtccaggttcaaatacttggccggagatttcatcagcctggcggacctcagccattgccccatggctcactacctgctggccagcccctgcgcgtcggtgctcgatgcgtatccgcgtgtgaaggactgggtttgatgggatgatggatcgaccgagcgtgaaaaaggtcatggagcttatggatgcgtcatgaaaagagcggtgtggtgtgtgctttgtggagtcgatgtgagctgtgctcggtgcaggtgctggggcttgtttgtaataactccttccatttttggagagaaaactttaaccgaacaaggcctagagggttcaattccgacatcaaagtataccaatttatgtgcaaantcttattatttacgccaacttttgtatattggccatttnaancaanaaaaaaa

SEQ ID NO: 36396 - DNA, 1307 bp, Triticum aestivum
  Clone ID: PAT_TA_36396
gacgggtgacgcggcacgagggtccggctccggtctgggcgcctctcattccccctcctcatccctcggcggcagctggcccgccatctccccaatcctgtcacggcctggttgtggcttttgcgaacaaggcccggcctactctgttgcacagtccggggacccatccggtcggctctgactgttcgtccacacttgctcgcatgtcctcctgccaccaacgccgtggctggtggagccgcttcctgttgctgctccagggagcgtggttgcaggcttttcgtgatggaccaacaaacaaagtgagagcaagaatgtctgttgcttcagcaattatatttggatcagtgttctggcgaatggggaaaactcaaacttccatacaagataggatgggacttcttcaggtggctgccataaacacagcaatggctgctctgacaaagacggtgggggttttcccgaaagaacgagctatagttgacagagaacgagcaaaaggttcctatgcacttggaccatatctctcatctaagctgctggccgagattccgattggagcagcatttccgttgatgtttggatccattctctatccaatggctaaacttcatccaacaatttcgagatttgccaagttctgtggcatcgtgactgttgaatcgtttgcggcatcagccatgggtcttactgtgggagcaggccgtcctacaaccgaagctgcgatggctcttgggccatcccttatgacggtgttcatcgtctttggaggatactatgtgaaccctgataacacccccgtcatcttccgctggatcccaaaagcatctctgatcagatgggcctttcaaggactttgcatcaatgagttcaagggtctgcagtttgagcaccaacattcttacgatgtccaaactggagaacaggcccttgagagattttcgctgggaggaatccgcatcgccgacacgctggttgcgcagggcaggatcctgatgttctggtactggatgacctacctcctcctgaagaaaaacagagcggggtaccagcagctcctgccgccctccgaggaagatcaaagtaagcagcagacggagtaggcgtaatcataatgtgcgtcatatttgttctgtgaagacatcatgtcagggcaggccgtgtgttgtagccagtttccttttttttctgctttgtgacattttaagcatccctctttggaagaatcaagagaaataaaatcgtgggagaaccatcacgtggatgattcttcttcccttcaaaaaaaaaaaaaaaaaaggccccta

SEQ ID NO: 36397 - DNA, 659 bp, Triticum aestivum
  unsure (1)..(659): unsure at all n locations
  Clone ID: PAT_TA_36397
gccggcttcaaacgaggccgatctccgatcagctctccggcgaggtcgaccttcgatgagctctccggcgatggcgacagcctcgtcgccgagcccgggagccgcgatcgccatcaccgctgccgacgacctcgccgactcgatcgacgcgctctaccgctcggaggtgaccaaggcggtgctcaagtaggtcagcacgctcgcgcacaacaactggatgtggtccctcgaccgctcccgccatcaactcgccgccccgcgctcccgcatcaacctcctctccaggccaggtggattgcggcgctagcaacagcgctcaagaagacagcgaactgctaggcattataggttttccatccactaggtgctctaggctttccacacatgctttgatccacctggctatcaattctgcccaatcatttgtaagtacatgctgggaaatcatttcgacgtacatgctatgatactttacataactcaagtgtgatgctgctactcacaacttgttttaatcaatttaaggtacatgctatgatttacatttaagtaatgcaagtgttaaaatgatgttaaaataaaaaaaaaaaaaaaaaagaaacctagagatacagtgtgtcgactttgtaggtaaactgtcaaatatnataagcacatgc

SEQ ID NO: 36398 - DNA, 820 bp, Triticum aestivum
  unsure (1)..(820): unsure at all n locations
  Clone ID: PAT_TA_36398
cgggaaaaacnnnnnnnnnnaaaaaaaaaaaaaaaaaaaaaaaaaaaaaaaaaaaaggatcttggcagaccttgcattctcaattgaccaatcgattactcgttgtctcaagctctcagacaatatgcgtctcagccttctccccttggttgcctttgttggctgtgctttcgcatctggagatactatctctacggccatcgacaacatctccaatgccactctagctctggacaagtccatcacaaactggcctcagaccctagtcggcatactccccatcaccacaaagtcaacactgctcctcacagccatccacgacggtactcttgccgctcgcgactctgagcatctatccgtcgacgagactcttcaagttgccaaggccacttctgagttgacaaccgacgtcacccaaacaatcgacaccatcattgccgccaagcccaagttcgacaaactgatggtcagccctgtcattctcctcaacctcaagctccagcgcgctctaagtgccgacttctccgaagctatcctagcaaaggtccccaaggacctgcaaggaaacgcaaaggcactagtgcaagggatcgacgacagttttgcaaaggcaatcaaaaagtacagctctctacggggataaatcgggggaaacgagggaacgagttatgatgtgaatagaaccgcgacgacgttattacctttcttgggcgggccttttttagcagagattttaattaccatgagttgagttgtcgagtaatagagagaatcaattgatatgtcagtttttgaggacaaaaaaaaaaaaaagccccta

SEQ ID NO: 36399 - DNA, 862 bp, Triticum aestivum
  Clone ID: PAT_TA_36399
gccggccgggtcatcgtgttggtacggagggacggactccatcctcccgtacctagaagccgtcgtgaaggagaccatgcggctccaccctgtggtaccccttctgataccgcgggtgtctcgtgagcacacgtccgtagcaggctatgagatcccggtgggcacacgcgtgctcgtcaacgtctgggctatcggccgggacccgactgtgtggggggagacggccgcggaatttcagccggagcggttccttgggagcaaggtggatgtcaagggccacgacctggaactgctaccttttggtgctggtcgcaggatgtgcccagcccacggcctcgggctcaagatggttcagctggtgctggcaaacttactgcacggctatgcgtggagactccccgacggcgtggcggctgaggagctgagcatggaggagaagtttggcatatccgtgtctcgcatgcaccacctccacgctatccctgagcccaagcttctggatcacctctatttcgggccatgaatgttagtcccttcattcctaaatataagtctttttagacattccactatagaaactacattcgaatgaatatggacgtcttttagagtataggttcactgctgctccgtatgtagtctatagtggaatcttttaaaagacttatatttaaaaacagagggagtactagctctagtttgatgtttgctcgagtgcatgttcacgtattggtttactttcacctcggatgtttatgggttgtactatgcattatggttatatgcagaggccgaaactgatctcagcatgattgtatcgtcctgatgtaatgatcagagcttaataaaagcttccttatct

SEQ ID NO: 36400 - DNA, 392 bp, Triticum aestivum
  Clone ID: PAT_TA_36400
gccggccgggcctgggacaatatgtcatgtttaccgagttgtctggtcatagtggcctacgcataaacacttcacctcctagtacactcacctggcttctgcgcatgtttgatgctgagcttctcattgaagatcatgatcttcaccaccgcaagggttggaagacaagcggcaattacggaaaacaaactctgttgtgggataaggtttttggaacttgtattgataggattgagttgaagaaagagaacttggactgggaaacgcgtatcgacctgccgttattttaacagacgaatttgttagatgatagtcatgtttgactgaggaactggggaggggtatatccaacgcatttgtaatttcaaaaaaaaaaaaaaaaaaggccccta

SEQ ID NO: 36401 - DNA, 832 bp, Triticum aestivum
  unsure (1)..(832): unsure at all n locations
  Clone ID: PAT_TA_36401
gccggccgcgctcagagcttcaagtacaagacttcttacacaattatatctcttccaaaatgtcatccgcagtttctaaacgcctcgaaggcaagactgttctcatcaccggagcatcttccggcattggaaagtccacagcgtttgaatttgcccgcacaagccccaagaacttgaagctggttcttacagctcgtcgaatcgacagcctcaaacaaattgctgaagaaattgtcaaagaagtcggcgatggcgttaaggtgcacccagttcaacttgatgtcagcaagcctgatgaagtgcgctcttttgtgagcaagcttcctgctgagttcagcgagattgatgtgttggtaaacaacgccggtcttgtcaagggtgtcgacaaggcacctgagatcaaggaagaggatatcaacgtcatgttcgctactaatgttacgggcttgatcaacatgacacaagctatcttgcccggtatgctcaagcgcaacaacggcgaaggggctggcgacatcatcaacattggtaccattgctggccgcgagccttatcccggcggcagcatttactgcgctaccaaggccgctatccattccttcacagagagtctgcgcaaggagcttatttcaaagcgtgtccgtgtgatcaggattgatcctggtcaggtagaggctgagttctccgttgtgagattctacggcgacaagtcaaaggccgatgccgtatatgccggctgtgagcccttgacaccggatgatattgctngaggcattgtctttgctgctggcagaaggggaaaatgtgtcattgcggatacgttgatattccc

SEQ ID NO: 36402 - DNA, 1185 bp, Triticum aestivum
  Clone ID: PAT_TA_36402
ccccaagcgtccgcccacgcgtccggcaggagaccgggacgggacgcagcggaagatggctgcggcggcggcggtgggacggcccgacggcgggcgagctgaaagcggccggcgcggaggcgattccgggcggcgtgcgggtgaagggctgggtcatccagactcacaaggggcccatcctcaactccgcatctgtgagcctatatgaagataaacttcagacgacacatttacctgagatggtgtttggagagagttttgtgtctattcagaatgctcaaactggtgtcaaattacatttcaatgcgcttgatgctctcaaggcatggaaacaagaggcattgccacctgttcaagttcctgctgcagcaaaatggaaattcagaagtaatcctgctgatcaagtggtacttgactatgactatacattcacgacaccatactgtgggagtgatgtggttctgaaccaagacgctacgcaaacaagtttagatgaatgtagcaatttgtgttgggaggacactgatgacaggatagaccttgttgccctttctgcaaaagaaccaattcttttctacgatgaggttatcttgtatgaagatgagctagctgatagtggtatttcattccttacagcgcgagtgagggtgatgccaaccggttggtttctgctcttgcgcttttggcttagggttgatggtgcgctgatgagattgagggatacccgtttacattgttcttttggaagtaaggaagcaaagccggttgtactgcgtgaactctgctggagggaagcaacatttgctgccatgtctgcggaggggtatccttccgattctgcggcatacgcagacccgaatcttgtcgcccgcaagctgcccgtcgtgatgcagaagacccagaagctgaagatacccagttaacctgccaagacacctctaccgtgtgttcggtacatccatgagtgttcaaccgtggtcacaactctatttgcatgtgttgtagatgttgagctaccgttgctttacccatttatcttgaagcccttgcgactggcaagtgtaatggtaggcccattgtagccctgggcttgtgaactttgacagataagaacgacgccctgtcagtttcggcaatcctcattcatgactgaataagatgtttacaggcttcagttcgtttttc

SEQ ID NO: 36403 - DNA, 638 bp, Triticum aestivum
  Clone ID: PAT_TA_36403
gccggcccgcgtccgcttgttctctatcagattttggtcacaaacagtcaagatgtttgtgcttactaccgattcgtcgataagatgaagactctcgatgtgttcttcatgacagaacattatgcccttcattctcccctccactagcccttcaccagtctgagataaatctaccgatacggaactcatgagccgagtcgtcaatatgtgccatatattgccagacgtatgggcttctgcccatgacgggccaggctgaagccttcttttgttgcgtcgtattgcgcgcttacactagataaattcggaactacaacgccttgaccctcggatctgttaccatcgatcgccgaatctagttttaccggacctccaggattgttcattgatatagtcgtgccataatactggagaattcgctgccctttcgtcaaagcaaaaaaaaaaaaaaaaaaggcccctaatcagtgacaaccctagactcaatccctgcatgaatcccaccccacgtcgagcctgggtccaacgatgttgcgtatcacctcgcctttcatccatggctgatgtgcgatagaacaacagccatccatagtcacgctcgaagatcgctacgagactcattggtggtactactcatc

SEQ ID NO: 36404 - DNA, 499 bp, Triticum aestivum
  Clone ID: PAT_TA_36404
gccggccgggctccgttccaatttcttcttcccctgctgttcctcttcctctctccttgcgcccccttgctgctgatcttctccacttactgctgctctacttccttgcctcctttgctgctgctcctctctccagcgccccattctgcttctcctcttgctgctgctgcccccaacctcctgctgctatctctctatacttcccctgctacccttcttctctgaacctacctactgcttctctctctctctctgaaatatctgtgcaattgagatgtttgaggctttgtaaggttcagactttgtaaaattcagaattgagatgtgtatggtgtgtaatgttcagatttgactagtgcaagcatcttgttatttgttcagtttggtactggtataatatagtacttgttatgttggatctgactagttgaggccttgttaatttggcagattattgatctattagaatttgcaaaaaaaaaaaaaaaaaaggccccta

SEQ ID NO: 36405 - DNA, 1386 bp, Triticum aestivum
  Clone ID: PAT_TA_36405
gcagtccagcacactccgctcccccttccttgcgcgctcgaggctggtccgggctccgcagcaccactcctccctccctcccccgacgcccaccccgaggcgggtgatcccgaatgcaatcgcgggcaggaggaggaggaggatgcggaaggcgtacagggactccctcaaggtgctcgaagctgacatccagcacgccaacaccctggcgactgaatttccgcgggtgagcgatggggcgtgcctgcaggtgcggctgtcgtttagccccgccgcgcacatattcctcttcctggtacgctggacggactgcagcctcgctggggctctcggattgatgaggatcctcatatacaaggtctacgtcgatggcacaaccaccatgtcgacccatgagaggaaagccagcatcaaggaattctatgctgtaatatttccttctttgctgcaactgcaaagagggatcactgatatggaggacaagaagcagaaggccgtgtgtatggagaggtacagaaggagagatgaagacgaaacaagcagcttatctgatgttgatgctgagcgggaggaggaatgtgggatctgcatggagatgaacagcaaagttgtgttgcccaactgcacacatgcgatgtgtctcagatgctatcaggactggaactcgaggtcacagtcctgcccattctgccgcgacaacttgaagaagactgaccctggtgacttgtggattcacgtccacacatatgacgtggtcgacatggagtcagtattgagactcgaccgtcacagtcctgccctgtctaccgcgacaacttgaatgaagactgaccctggtgacttgtggatttatcgtcgaggacgacgacgtggtcgacatggagacggtatcaagagagaacctcagacggctgttcatgtacataaacaagctccctctgatcgtgcctgatgtcatcttcagtgtctacgattcccacataaaatgaatggtgcggcactccccttatcaaggtcctcagccaagtgcccagctccttttaatctatttgggaagctcccccaagctctctggtttccatgcctgtacccaagcccttcgaagtgcctgaactgtcgcatttgtagtcgcaaaccttttgtttgtgctttagatcttatttagtgcgtacctgcatgcttaagctaagcatatccagccagtttgtatatatctcacatggctctgttaatagagaactgtagctggccccaaatggaggcggtgctgtttaatatccttccatgtttccccccctttgtataactgtcttcaggtttgagcactgaagctggtactgtttcttaaggatttttcttcgcagttccgccgctttttcggggggg

SEQ ID NO: 36406 - DNA, 770 bp, Triticum aestivum
  unsure (1)..(770): unsure at all n locations
  Clone ID: PAT_TA_36406
gccggccgggcctgctatccttgttcttgattgttcttgagctggcctcttgttataaaagtctataaatcgtcaactaccgtctacttctctatccgaaaaaccacaacaacaaccatcttttcctgtcaccatctcttcttacacacaaccatcaacatgaagtccggactctttgccctcgtcatcgccgctgtggctcctcttgccatggctgctcctttccctcctaacggccctcctggaggtttcttcccttcccctcctacaaacggcagtcttcccggagctggacctggtgctcctggtgctggtgcccctggcgctcccggaggtcctggtggttggatgcctcctatgcctcctatgcctcctagcccccctgttggtggtcagcctggtggtcaacccggtggtcagcctggtagtggatcgcctgctcctccccctgtggtccctactcccgtccctggagctcccgtcgtcactcctgttgcccctggagctcccgtcgtcactcctcctgccgctgctcctgctcctccggttgcccctgagcagcccgttgtggtccctactcccagccccgttgcccgcatctagggcgactacgacacgacacagcggtttgatcgagcttgcttctttttatgttcttgtacattgaataggatccccaacgagaaaccagatggatagactagaggttctcttgttgtatatatagaatgccgctagacggcaaatggaaaagagctttgtttgngttc

SEQ ID NO: 36407 - DNA, 563 bp, Triticum aestivum
  Clone ID: PAT_TA_36407
gccggccgggcctgggacactgtcattatcatccaaatcatatcgaacaaagctacagcaacaatgtcacaagccacttccaacgccgaggagtttcgatctctctaccagacatacattgaaagctgcaacgcacgagactatgaagtcatgaaatccttctacgcgtctcctgtcaacgtgatggacaaacgacaagaaccggacgacattattgcccggtgcaaacttttgttcgagtcgttccccgactggaaatgggaagtgcggcatatggtgattgaaggcgactacatgacggtacgctttaaggattcaggaacacatcagggtgaatttcgaggatatcaggcgactggacgcaaggtggaaacaaccgaggtgaccctttatcatgttgttgatggcaagtttaccgaaatttggccattgatcgatttcgacacagtagttgagcagatcaaataagtcagatgaatctataatagtgtttgttcagaaatacaaccacacatgctacttgttaaaaaaaaaaaaaaaaaggcccctattctccacacacc

SEQ ID NO: 36408 - DNA, 1145 bp, Triticum aestivum
  Clone ID: PAT_TA_36408
atttgccggtcttggagttatctcttcatttcattcactactggctagtatttattcacttctctgtcgctcattactttactatctatacgctattatatcttcatcatgcgcgctgctgctatcatcgctcttttcgcctcagtggcctttgctgctccagccgacagccgttcttgctctaaagccaagaacacatgccctgttgtctttgatggccgggtccctgcgaacgcctctctcaccgacttcgacaaggagaacggtggcggctggaacccttacaaccctggcttcgtcaagggaaacaacatttcctggtccgagatcattaagcttcctcagaccactccatctcgtttcgatgtctcgggcaagaccctccctctcgaggtcactatcagcgataagagtatcttcatgaagcagcttggtttcagacgtgctggtctccagttcagcaaggacaagaatgaaggcagtcctggctctgagggtatcaagacccttcacttcagtcttatgcaggacaagggccgacctcttaacctcagccacgagtacattaatgtctggcacgaaacggccgatttctccggaaaccagttccagttccagtctggtaccatcatcggccagaaccacaccgccgcgacctggaaactgtttgacgagaagatgaagttgctttgggagactcccatgcttgagggcaagtggcagaactttgccattactctcaactttgacaagaacaccatccaagcctactactctgagggttccaaggctctcaaggccgctactcagcccattgctcgtgacttgagtggacaaggacagtaccagatcggcatgctcaagaagcccactggaactgatgatgttgccaatgctggattccaggaggccaacctgaacgagggactgatctatggtggtattttccttgaggacagcaagaataactgtgtttctctctaaacagttctggtaatcgatcctttagggcaacaaggctgcagtattccaaccaggttttattgtagactgggtagttagcttgatctggcgcagcggcccattgtctagtacaacaaatactaccattctcaaggcaaaaaaaaaaaaaaaaaaggccccta

SEQ ID NO: 36409 - DNA, 635 bp, Triticum aestivum
  Clone ID: PAT_TA_36409
ggcccggtcgggggctcgaggcggctatcaactaaaaaccatctatctacatacctatacttgtcattatggcgccctccgagtttcacgtgcgtctccagaggggaatcacctccggctttgcaccacccacaccaaatctgatcattcttatagacgccagtaataacaatttaagaatatcaatttcaaaacgcgaggatggttccccagatttagcaccgtcagcttcaaacacggtagcgatcgcggaccatgaggctgtcatcgatgagctgcatggtattttaaaggaagtgcctacggagcaacctcccggtagtgaggatatttacggcctggacacaagcatcgcttggcaaagccatgacctggaatggtggaatggtgggcctcagggctgcggtggtggccaaagctttgtacaggcgcaggatgaagaaaagaagaagttcaagagggcagttgagattatcaaggagatcgctggtgagaaataaggttaggctgcattaagggtgtcgagaacataaattgaaagcaccacttattcatgaaaaaaaaaaaaaaaaaaggcccctaaaacgggattatgggtgcgcatgcctcagtttccttccccagaaacgcatcat

SEQ ID NO: 36410 - DNA, 697 bp, Triticum aestivum
  unsure (1)..(697): unsure at all n locations
  Clone ID: PAT_TA_36410
aaccgtagatccacgacgccttgcacaaaccctagatccacgacgccttgctctgacagacctgatggcgcttcgctctgccctcaggaagatgcctgccctcggtaggtcgctcgggatggccccccgtacgggcctcgtgcacgcgctctcgctctcgctctcgccgccggcgtgttctcgcctgatgtcccatgtcccacagccacaggaagaagagctgttttattctgatgaagcgcgcgccaaacggcgcgaggaattcaatcgcactgaagcaagttttgagcagagcatgaaggatatacagaaagatttggattttttgaaagaacttcacagtcgtgaatggcctgatcctgaagaaaatttccgcaaggagcttcgcaaatttgagaagaaatgtgatattgctcttcttgtactcgtgcctacaactgctgtgctctttatgagtataccatattacctttagcgggttataagaaacacactatcttagttttagctatcctggttgtagtgatcgaggctttaggcattattaagtacgtagctatgtattatcctggtttgactcgtgtaatctgaatgcacctacttacactaaacagtggatgctactcgtcgaattcccatggctgtatactcgttctctccttgttggatctgacatatnacgttgnaatacattccc

SEQ ID NO: 36411 - DNA, 1254 bp, Triticum aestivum
  Clone ID: PAT_TA_36411
cgagggttcagtaaattttattatgtttgaggtatttgtacttttggtccgggtatttcgcagagaaaatgccggccggtggagtctgctcgttttccccctcgatctcttctcgccgccggcagctaaacccgcacccccgcgatgcagaagacggcgcagtcctggttcaccggcggcaccgcctcccccagcaccgccgcggactccctcccctccgcgactcgacacgcacagccgcgtcccagcccacctcaatctcacctcgccgccggcagctaacccgcacccccgcgatgcagaagacggcgcagtcctggttcaccggcggctccgcctcccccagcaccgccgcggagtcgcagccctccctgctcgccgactggaactcctacgcagccacccggtcggacgtctcctcctcctcccccctcccgttcgacatcgaggccgccgtccgctcggccaacgacaccgtctccggcaccttcaatgtggtgtccaagggcgtgcgggagctgccggggagcttccagggcgccaccagcagcttcccctcggggaaggcgctcacgtacttcgggctcttcctcgccaccggcatcttcttcgtcttcatcgccttcacgctcttcctccccgtcatggtgctcatgccgcagaagttcgctatctgcttcacacttggctgcgctctcatcatcgcttcgctcttcgcgctcaaagggcccgccaaccagctcgcccatatgacgtcaaaagagaggctaccatttacagtggggttcaccggatgcatggttggcacaatttatgtctctatggtgcttcacagctattttctgtcggtgatattctcaatccttcaggtccttgctcttgcttactacaccatatcctacttccctggaggctctagtggtattgaagtttctctcgtcaagtctcctgtccccagtatcaagaatttttagctcgtaaccctagtagaacaaatatgtatgtgatgatcacactcatgcccttgtaattcctgaagtatcttttgtatgtagttgctgatcgaccaaaagtatcttgtcccgatcgacccatgatagagatatcagataccgtgaccccttccttcactcctttccactgccatttacagatgttaggcatgcgttgggcgtggatcgaaaaaggtttgttgagctactgtatgtgtcttgtgcaaataaagttatattacggacctatttacgggccagg

SEQ ID NO: 36412 - DNA, 520 bp, Triticum aestivum
  Clone ID: PAT_TA_36412
ggcggccgggctggggacaacataccagtgacaagagtattgcatagtgctttctattgctctctgtgaacttaggcgatggcaaataatagcatcctccaggtcttcgttgtttttctcattgcacaagtatgcttactgatgatgatggcagcaccggtagcacaggcagccggcaggcttatgggatacaatcccgtttgctgccctagggacatctactgttgtgggtttggtggtgtgatggccaatggaactgcatcctccaccaatccttgatatgttgtctcactctcctccgagctataagctagggcatataaaatgtgcttcaagttggtcgtttcgtttcttatatgcaatttgtgctactagtttcaagaaatattatgtgtaagctattttgctaataaaagtgggaggagattgttatcaaaaaataaaaaaaaaaaaaaaaaaaaaaactaaaaaaaaaaaaaaaaaaaaaaaaaaagaaaaaaaaaaaaaaaaaaggccccta

SEQ ID NO: 36413 - DNA, 545 bp, Triticum aestivum
  unsure (1)..(545): unsure at all n locations
  Clone ID: PAT_TA_36413
ccccgcgtccgcccacgcgtccggtgttttctattgctctctgtgaacttaggcgatggcaaataatagcatcctccaggtcttcgttgtttttctcattgcacaagtatgcttactgatgatgatggcagcaccagtagcgcaggcagctggcaggcttatgggatacaatcccgtttgctgccctagggacatctactgttgtgggtttggtggtgtgatggccaatggaactgcatcctccaccaatccttgatatgtcgtctcactctcctccgagctataagctagggcatataaaatgtgcttcaagttggtcgtttcgtttcttatatgcaatttgtgctactagtttcaagaaatattatgtgtaagctattttgctaataaaagtgggaggagattgttatcaaaaaaaaaaaaaaaaaaaaaaaaaaaaaaaaaaaaaaaaaaaaaaaaaaaaaaaaaaaattaaaaaaaaaaaaaaaaaaaaaaaaaaaaanaaaaaaaaaaaaaaaaaannnnngggggggggccggttttaa

SEQ ID NO: 36414 - DNA, 1246 bp, Triticum aestivum
  Clone ID: PAT_TA_36414
ctcgacccccgccaacgtgaaatccgtccaggcactcagctcaacctgcctatctttgacattcaccatgatggtgacatatggggagctaatgcggaggagtttgatccttcggggtttgcagatggcaagagctatcacctcggtgcatgctgcccctttgggcgttggccctgccatctgcgttgggccaagaatctcgcgttttcaatggcaagatgaacggatgcaacttgtcttacgtgctatgcgtaccttctactttcctgctcttcaggtaggtgccgacaaagaagaaccgaagaaggcatcgcctaaacaaggaaattccttattcgctgcgcagattgattgagatgcgtcgaaacaagggtgaggattccaaaaacctgcttggcttgatgctatcagccagcaaaagctgacaatgagtttaaagtgggaatccgaagagatcattgatgagtgcaagacattttactttgccggtaaggaaacaactgcaaatttgttggacttggggcaaccgcttctgctggcaattgcatcaagaatggcaacacaaggcccgagatgaatcccttcaacgtgtgtgggcaaagaacgagcacccaaatgcgggaaccctgagcagtctgaaaattgttaatatggtgttgaaggagacccttaggctgtatcctccagctctgttcgtcaacaggacagccactagggatgtgaagctgggcaaacttgacatccctgcgggcacacaggtcaatctgcctattgttgacatgcaccatgatgtcggcatatggggagctaatgcggaggagttcgatccatcgaggtttgcagatggcaagagctatcacctcggcgcgtacttcccctttgggattggccctgccatctgtgttggccagaatctcacgatggttgaggcaaagctggcgcttgcaatggtcctccaacgctttgcgtttgatgtctcgccgtcctatgttcatgcgccgatgatggcaatgaccctccaacccgagtacggtgctcaagttcttgtccacaagatctaagccttccgtggcgctgtatctggaatcgggaggtgtgacagcaaggtatatgtgaatgttccatctccggtctcctgtatccctgtggattttgagcaacttgtaagagcaggctttgaacttgtgtgaactttgtcctgaaagtcagaaagtgtgtatagaaagtgtatatgctttgcgacagt

SEQ ID NO: 36415 - DNA, 1658 bp, Triticum aestivum
  unsure (1)..(1658): unsure at all n locations
  Clone ID: PAT_TA_36415
gccggccgacgctgccgctagtccatagtcacacaccaccaccaccttccccccaagcgagcaaacacttaatcatggcgactctgcggcggtgctccgggctgctgctcgcggtggtggcggtggcgctggcggcggggatggcggcggcgcaggggccggccggcgcgccggcgccggcggccgggttcagctcggagtgcatgaccgcggtgctcaacatgtccgactgcctgccgtacgtggagagcgggagcaagacgcggcacccggacacggcctgctgcccggagctggacggcctgctgcagtccaaccccgtctgcctctgccagctgctcgccggcggcgccgactcctacggcatcagcgtcgactacaagcgcgccatggcgctgcccggcgtctgccgcctcaccgcgccgcccctcagcgcctgcgcagcttttggagtccccgtggggccttcttcggcgccattaacaggagtctctccatccgctacagggccacagatgcctgagaacccgccatccgcaacgccgtccaagtccaagtcccacgccccgggccgcctcaccggccgcggcctagtcgccctcgccgcacagccgcacgtgcctcccgactccgccactgtctaacactcgatcgcttcgatggcgactctgcggcgtgcctccgggctgttgctcgcggcggtggcgctggcgctggccgcggttctggcggcggctccaggggccggccggcgcgccggcgccggcggccgggatcagctcggagtgcatgaccgcggtgctcaacatgtccgactgcctgccgtacgtggagagcgggagcaagactcggcacccggacaaggcctgctgcccggagctggacggcctgctgcagtccaaccccgtctgcctctgccagctgctcgccggcggggccgactcctacggaatcagcgtcgactacaagcgcgccatggcgctgcccggcgtctgccgcctcaacgcgccgcccctcagcgcctgcgcagcttttggagtccccgtggggccttcttcggcgccattaacaggagtgccctctccatccgctacaggaccactgatgcctgagaacccgccatccgcaacgccgtccaagtcgaagtcccacgccccgggccgcctcaacggccgcggcctcgtcgccctcgccgcgctgccgctggcgatcacggccgccgccatgttctagggcagcaagagttcgcggacgtgtggcattgtgccggtctcacacgcttggcccgatgagatcacattcttctccattcttgcctcacattctcattgctgtacacgagagattatttttctggttgatccatttccttgtcgcaattcccttacctgtgtgtaatctgctagagatggttgacatctgtgtattacgtagatttgcattgctgctactaaattaatctttcgttatgtgtctcttcctctatatataatacaacaagagccgtgcattgcacggaacattaagattnnaaaanaaaaaaaaatcnagggggggccgtaccaatcgccntatgatctataccgcgccacggcgtcgtttaaactctgacggaaaactgggtaccactaacgctgagcaacccttccagcnggtan

SEQ ID NO: 36416 - DNA, 911 bp, Triticum aestivum
  Clone ID: PAT_TA_36416
acacacattatcatgacgcttcctgctgttgagtcatctgaagactggtgtgaccctgcgaaaaactacagtatgttcctacaaggtattgttgacaatgagatgagatttattgatattgtcactggatggccagggagcatgacattctcacgcttgttaaaatgctctgggttttacaagctctgcgaggctggaaaacgcttgaatggtcctgtcagaacatcaggggaggattcagaaataagggaattcattgttggtgacatgtgttatcctctactgccatggcttatgactccgtaccaaggagaaagtctatctaccccaatggtcaactttaatgcccggcaaaaaactgcaaggatgcttggaacaagagcattggcacggctgaaaggctcctggaagatcttgcacaaagtcatgtggaggcctgataaaaataagttaccgagtatcatcctggtgtgctgtctgcttcacaatataattctggactgcaacgacaaactgcttccggatattcagcttccagatcatcatgataatggttataatgaagagaactgccagcaagagaatcctaatggcaaagtaattagagagatcattacaggatatctcccgacttatgaagaaacatcaaactgaattaagctggatggaagcatagttggagatgtgatgatgtgtctttgttctattgttatttacctcagttatccctaatgttcatgttctagtttaatcagatctgctggttacagtaaaggttctgcatgaatggtgtgatttattccttcagcaattagctactttgaaacacatgttgagttaattttttcctgatgatgacagtccaaaaaaaaaaaaaaaaaaaagaaaaaaaaaaaaaaaaaaggccccta

SEQ ID NO: 36417 - DNA, 1312 bp, Triticum aestivum
  Clone ID: PAT_TA_36417
gccgccgggttgcgcgactgagcgctgccgtggtccacttcttccctggccgccggccacgaatccgcgcctccgagaccgagctgctgctagctccgaatggcttcggcggaggctccgacggcaaggccgattctctactcgtactggcgcagctcctgctcccaccgcgtccgcatcgcgctcaacctcaaaggtatcgattatgagtacaaggcggtgaacctcctcaagggcgagcagtctgatcctgaaccaagttcatgaagcttaatcctatgaagttcgtccctgccttggtcgacggcgacgcagtaatcggcgactcttacgcaatagcattgtatttggaggacaagtaccctcagcgccctcttttgccccaagaccttaaaaagaaggccctgaatatccagatagcaagcattgtgtgttctggtattcaacctcttcacaatctcaccttggtgagatttatcgagcaaaaagttggaacaggggagagcatcccgtgggtcaaacaacagattgatagaggtttcacagctgttgagaacatgatcaaaggctgtgctgggaagtttgctatgggagatgaagtccaactggcagatgtattccttgcaccccagatttttgctgcggtgactcgttatcaaatcgacatgtcgaactatcccaccctcgcgaggctctacgatcaatatatgacacaccctgcatttgaagctgcgctccctgaccggcagccggatgccccttcctctgcctagacataggccgggagtgaatcagtagttctcactgctttgtctgtacctgtgtgtgtcctgtcccgttacttcaaactctgtaacaataagcacacgaacttcctgcaccaagtgtaaagtaactactgtagtctgtatcaaaacagtgaaataattgtgatcactagcctttggtatgacaggaattaaggacttacgtgaaatagcaacaagatgaaacatcagtgaattacagttcaattggcacttcttaagaaagaacctgcaggacatttcagttggcctttttgcagctttggcacccgttctctaggcagcgggatagggagcggcttgacagcatgatggcggggatgattgcgggttgcggcagcacgccgccttgcttggttgcatagccactgatttgtcagttacttggcggccttttttttttttttcttttttttttcttttgaaggcatgtttatgttgttgccccagcagataatactatctttactttctcttagacgtggtggcttttatctaaaaaaaaa

SEQ ID NO: 36418 - DNA, 1113 bp, Triticum aestivum
  Clone ID: PAT_TA_36418
gccggccggtctgggaagccccctttcgctctaggaaaaaaaaggggacgattctgctcgcgccgccggttccccgatggcggaggactcaggcgccatcctccgccacatctcctccctcaaggacatgcttgacaaggtcaatgaagagattgaacagaatatacaaaggaccagggaaacagagtcagaaatagtgaagcattctgaaactgaaaaggactatctcgtgaaggagtctgagctaatgaaaggagtatcggttgctgagtttgaacttgatgggcttatgcaagtggaagctgctggaacagattcacttaaagcgatggagggcaatttggaattccggaaagctactctgaatgcaattaggaaactattctacgataaaatggaaaggttcatcgcggaatctagagacttccaagttaacatgcttggaggttcaattgaggatttgcttctcctactaaaggaaagagattcactagagaatgagagtgagaacttgaggatgaagatcaacgccatacaaagttcattaaaggaatacattgctgagattcttgaggaggtaaatgtggaaaattcagttctggagtctgatgtacagtataggatttcggaatacatggaaattctcaaggatataaacaacctgaagattctatttagttcgagcaattcttaagaagggtcttcattgttgcaggctcatgacccatcaaagttgccacatgtttcttgtgtcttcagtatgccattttggtttggctgtcaagaatcttcagcaagctcaatggaagtaccttgtacatgtttcttctgtcgagaaggttacaccagatctagcacgaatttactgcactaccaaacatgtattggtcctggcttgtatatacagttcagttaacctctgtactgtagatttcaagctgagggatagtaggaaaaggcaaagtgcctaggaatgcagattggaaaaacagcagtgtcttttgtgggcaattgttgtttttcaaatctgatcgaggagatgtgagaacgtcagatattgcgagaaattgttagtaatggaatagttggttcatcttaaaaaaaaaaaaaaaa

SEQ ID NO: 36419 - DNA, 947 bp, Triticum aestivum
  Clone ID: PAT_TA_36419
ctgtgcgcggctggcgggggcgcccagatcagatcaaccaatccactttgcacttgctcacacgatcgatcactacgacgaacaagtcgtcccaaggtaataaatgggctcgtgcatctcgcgctcaccggcgtcgtcggcggcggcggggtccgggcgggcagtggccaccaagaccgcgaaggtggtggacgtagacggctccatggcgcagttcgcggcgcccgtcacggcgcgcgaggccctggatagtgtacaagagcgccgcccaggcgcgtcggtcttcctgtgcagctccgacgagctccgcttcgacgtgcccgcccgtgccctggccggagacgaggcgctgcagcccggatggctctacttcgtgctgcccatgtccacgctccgccgctcactctccgggccggagatggccgcgctcgccgccagagccagctcggcgctggccgttgccagcggcgttgcgtcacccccgcggcgcaagaacggggtcggggcgcccggcgccaacagcaagcgacggaaggcggcggctcgtgtggcgccactcgttgtcgctgacgagatcgccggaccagacggtggatcggatcatcaccatacgtacggcaagtacgccggcgatgagccagcggcgaaggcgtggaagagacagtagttggggttggaaagccgcagcagcactcgccgtcgtcgccgtgcatctggctccccaacgctgatctcccttttggaggccggatgacttctggcggttccattcttaggagtggttagcacttttcttgattaccatgcattagtttagttcagttatttcgtccagtatgttgagttgctcgaccggtgtatatactgcatacgagttatatgcacagcatgcttgtttcttgatgtgtgcgtttacaatctgtattgtgaaaactcatatatataca

SEQ ID NO: 36420 - DNA, 547 bp, Triticum aestivum
  Clone ID: PAT_TA_36420
gccggccgggtccaaattctgcgtggtggtagtaccagtctaccagtctcgagcggttctctgcccacacacggctcgctcgatgcgtagcgggacagccgccgtgtggtggttgctcgtcgccgtcgccgtccccgcgctcctggtctcctgcgcggcctccgcacgtcctcctccagtgctgccgcgaggtggtggcgacgccgggctggctggagggagagagctaggggccatgggagctgcgaggcggttggggcagaggacgccggtgaacaagcctccctcgcccaacccccacggcgcgtcgtcgatggccgtgccgccgccaccgtcgattactagctagggccaaggtcaaaggcggaagtagcgatggtgcctgtgatcgcctagctaggcagctagccagagtagaacaactagcagttgtgcacgatacttgttttgctactgataaattattatggaactgtatacaccaaccgatgactttttttttctttttcttcgcaaacaccaaaaaaaaaaaaaaaaaaggccccta

SEQ ID NO: 36421 - DNA, 710 bp, Triticum aestivum
  unsure (1)..(710): unsure at all n locations
  Clone ID: PAT_TA_36421
gcggggccgatctcacccaccccctgcagcctcaagctcgtcgaccgtagcctctgcgggctcatatggctcatcatgcgacggacgtccatcagtggctctcccccacgggttgcgctcctgatgaaggaccttcgccatggctgtcgccgggagataacccggctgggggtggattgctccgtgggttcaaatggagacacgtattatatgccacctgacacggcacagaagttggatgacaccgtcaaggaggaaaatctttccggaaaaactctattggagaaaatttggagttttgctaaggtggggcgtgaagagaaattccggttgattactcctgtatcccccctggactagtgtttggtacaaacttatttcgtcattgtgaactttatataaaggtatcttttaaaatactatcgtataaggagttaagaacataacttataagaataaagccattccaagtacttcctccgtccccaaaagtaagacgttttttgccactagtgtagtgttaaaaaacgtcttacattatgggacagagggagtatttgttattgtctgttttcgctagctcaagttgtttcttanattcattcagactgtttggccatgatatcctgctgcatattgtgtgtgctactgtgcttggtctannnnnnnnnnnnnnnnnnnnnngannnannnnnnnnnnnaggccccta

SEQ ID NO: 36422 - DNA, 719 bp, Triticum aestivum
  Clone ID: PAT_TA_36422
ccggtccggaattccgcggtatttccaatcctgtcggcatcaaggtgagtgataagcttgattcatcggagcttgtgaaactgtgtgagattttgaatcctcacaacaagcccgggaggctgacacttatcacaaggatgggggccgagaacatgcgtgccaagctcccccatatgatcagagccgtgcgtcaagcagggctgattgtcacctgggtcagcgatcccatgcatgggaacaccatcagcgcaccatgtgggctcaagacaagatcattcgatgcaatccgggctgagcttcgggctttctttgatgtacatgagcaagaggggagctaccccggaggggttcacctagagatgacagggcagaacgttacagagtgcattggtggatccaacacagtgacctttgacgatctgagctcccgctaccgtacgcactgcgaccccaggctgaacgcgtcgcagtcgctcgagctggcctttgccattgccgagaggctaaggaggaagagagacaggacatggactagcctgatatctaaagtagaagcttaagatatcaatcttagatttcttccccgcaaaactatcttcagctactagaggacataattttgcattctttagtttttttagtagtatagatgccgtttgattttggaaatgccgaggaaaaatctccctcaaataataggatatagctgttttgggtgc

SEQ ID NO: 36423 - DNA, 1553 bp, Triticum aestivum
  Clone ID: PAT_TA_36423
ccgggtcgaccccgcgtccggctggatgacttctgctcgatcaccattgatcggacgcgtgggcagcgcctgcagagcatcgtgcgacagcgggaggagctgcagcaggtcgagatcgacctgcgcgcacaggccatcgcccacccacagatcatcgaggtgcagcgccgattcggggaggctaccaaggagcatctagtagcagctgaaaagctcaaggaacaactacatgaacgggagaagtacattcttgagctggaaatgaaattggatgatacacatagggaattggatgctttgaagattgaccatcaaacggtatgggctaatcaagatcttcttagagaacagaccaaggaaatcgcaagtttcagaagggagcgtgataattctgaagctgaaagagcccaacatcttaaacaaattcatgatctgcaagaacatctgcgagaaaaggaaagccagtatcttgcattagaggaacagcatagggttgctcaagacaacattctttataaagatgaacagttgagggatgctcatgcttggattacacgagttcaagaaatggatatcttgcagtctcaatcactacaagctgagttgcgtgagcgtactgatcagtttggtcaatgttgggccactttccagcaacagtatgttgaaatgcagcaaggttttctgcatacaatacaacgactccagctagaacttattgagttaagagaccgtactggagaacaagaagatgtttcgcaagctgctcaggagggttcagctgaagcgtcatatgttcaaagcaagggaagcaacatggctgcaaatggttagtgcattagcagatggaaatcagtccacaaatgactcctttaagggaaataatgcccatgctgtacctgttgttccatcactattgggactaagtggttttgttcctcctgggcagatggctgggatgcattcatatatgctgcatcctcaaggcattcctcaatctttagcctcacccaactctggtgttcctcaatttggtacttttcagcctacaatccaacccaccatgcactggcctaatcaacaggaagcacaagctgcctcacaaacacctgatgccacaaactatcacccatcacaatcagatcagaatgcattacagccagctgcattgcaaccagctgctagcaacaatgttgagctgccgtctgggcagagtcaggtgacccatccagagaatcttacagctcatggcgagcaagaacaacgttccacgagtgtggttgctgaatcaactcaagaaccaaaggtcatggaatccaatgttaccgaacatttttacaatgaagagcaaaaagcccatgattcatcttcgaatgccagctctactggaaagtttgaacgccaagaagaaagatcggaatcaaagggcgagaaagttgcatctggcaagcagcctgtggagcatgtacctaggaagcagaatcaagcttcagattctgctgggtcaacaacccagatccacatgaacaatatggcgccagagttaaagtctaatg

SEQ ID NO: 36424 - DNA, 2044 bp, Triticum aestivum
  Clone ID: PAT_TA_36424
ctagactttccaggaatccgggatcctctgctgccaggacctgaacctgaagaggcagaggaagaagaatgagaataccaaagaagtttatcgtggaacggtggacctaaggtttcagggaggagagtgggtgatcgcagcaggaggggcggctgacagccggccgttatctccaagccgttcgttcagaagattcttaacgagatgagcaaggcggcagggatcggaagggagatctgcggggactccgccaagtgcgagggtgcctcccggagaaattctcaagattttaagaaggatgagtggatgttttcgggaattgccatcaaaggaaaaacaagcactgatcttgcagtctgctgaacaatggaggaaagcaaagtcagacgttgaaaaaacattgaaccagatcgcggaactgcagctccaggacccatgctttttctataccgtgcaaaaggatgaagacggcatgcttaggagcattttctggactgatgcaaggtcaacgatggattatgagatctttggtgatttcgtatcgtttgacaccaccttcagcacaaatagacacaacatgcctttcgttcctatcactgggatgaataaccgtgggagaacaatcgtgttagggtgtgccttgctgcaagatcgaaaagctgaaacctacaaatggatgctcgaaacgtttctgcaggagatgggaggaggtcaaataccaagatcagtcataacaagccaggacgaagccatggcgaaggcaatagccgaggtcatgccacaagcaaggcacaggttctgcagatggaacgggaaagcccaggaaaagatggcggcctttgtggcagcaagaggcaacatgaaagcagagctggacatcttagttgacagttcactgacagagacggagttcgaacaaggatggagtgcactcattcagagacatgatgcaagtgaaaacgagtacctacagttgctgtgggagatgaggaagacctgggctcctgtttatttcatgcaggatttcttcccttttgtcgtttcagccagaggcagccagggggcattctcactgttcaaagagaatgtgcttcccaaggacaagatagagaatctgattgaaaagtacgaggagatgcaggataagatcaagaaaacggacgaggaagatgtactggaagcggcgaccgagccttcatgcttctcactgcagccaatagaaaggcacgcatcacgcgtctacacaaggcagatcttcctgaaggtccagaaggagctcctccactccacagcattcaaagtgcaggagatagaaagaggcaccctgtacaggctggacaaggcctacagctacgagaacccggagtacgaccgggactccttcgaggtgtcaatcgagcccggcctcaccgacacgtacacgtgccagtgtgccaagttcgccagggacgggatcctctgctgccacgtgttcaggctcttcacgcagtttggcatcgacgagataccggagaaatacatcgtggcccggtggaccgacggtttcagggaggagcagctggagcggcgtgaggaggggcggttggtggtggcggcacaacgcgaggaggatgcggcgaggtacgcggcactgatgagcaaggcggctgggatcgggagggagatctgcggcgacggcgccaagtgcgacgcgttcatgctggagctggacaggatccgggagaaaatggcgacgatggcgatggcgaatgatcacgtttagacggtaagtgctgagtttgggctacagtggacgtgttcagcagcagaagtctctaggtactcgggttggggagttgatgttgctcgtgtgcacaatgtagagtagctggtaaggcttgtttttcctgtgtaacttgagagacgagtgctacgtagtctattgttgcattcatgattcatgcattgttaactgtcaaggatttgccgtcgtgattctgctatgttagtagtacctgcatgcagttcatgagatgtactctggttgtgctaaaatgtatccatg

SEQ ID NO: 36425 - DNA, 1763 bp, Triticum aestivum
  unsure (1)..(1763): unsure at all n locations
  Clone ID: PAT_TA_36425
cccggccccaggtccggacgaggccgccgccgtgccctccctgctggacgagggccactagcacttttgctgccacgggccgatcaaccatggccttcgcaggcagcggcgatggccagagcggctccgcgagggcgcacttcgtgctggtgccgatgatggctcagggccataccatccccatgaccgacatggcacgcctgctggcagagcatggcgcgcaggtcagcttcatcaccacgccggtcaacgccgctaggttggaaggcttcgccgctgacgtgaaggcggcgggcctggcggttcagctcgtgggagctccacttcccggcagcggcagttcggcctaccaggacgggtgcgagaacctcgacatgatccaatcaaagaatttgttcttgaacttcatgaaggcctgtgccgcgctgcaggagccgctcatggcgtacctccttgagcagcagcgcttgcctccgagctgcatcatatctgacctggtacactgggtggaccggtgacatcgcaagggaactcggtggcccagggaacaacaagaggttatggttaccagagatgctgtggagacagcagtgaacaccctgatgggtgaaggggaggctacagagaaacgaaaatgagctcatcacaatcacggggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcccttgagcagacgacaaagaagaaggtctgggcggtcggaccaatgtgcctctgtcaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgttgagctgggactgggacttgaaacctccaggaaaccgtttatttgggtgatcaaagcaggagctaagcttccagaagtcgaggaatggctcgcagacgagttcgaggagcgtgtcaaaaatagaggcatggtcataaggggttgggcgccacagctcatgatcctgcagcaccaagccgttggaggattcgtgacgcactgcgggtggaactcaacaatagagggcatctgtgcaggtgtgcccatgatcacatggccgcactttggggagcagtttttgaatgaagaactgctggccgatgtgctggggattgggaggggagttggagtgaaagttttgnggcccccctttggnggaaaaaaaannaaaaaaaaattcccgggggaaantttggggggggaaaaagggggggttttttttgggggggggnaaaagggtttgggggaagaactgataatagagcgttagagcagagttggacgaccggttttgccaaattatgggccctagaactcctcttggtgccgccatttgccacggctgtgcatagctagagcaaagggtggaaggagaaacgacttggcacacacgcactagtcggatgctttgccgccactggcgtccatcccactacaagaaaaagtcattcgtagccgagtgcttatactaacgtcgaatgttatttgtcagatactcttttatagacacctaaaccgagtaccctcgaaaaaggggtccagcgc

SEQ ID NO: 36426 - DNA, 748 bp, Triticum aestivum
  unsure (1)..(748): unsure at all n locations
  Clone ID: PAT_TA_36426
gccggccggtctcaggctcagccaagtccaatccaaaccaacgagcccttccttcttctacccacctgcgtgatcagcagtcaacaatcatccagcttccagcgctcgatcgatcagcagcaccgcagcagctagccatggttgccgccgccatgcaagccctctttgaccagaccgacctctccctctccctgtccctggctcccaccgccgcgccggcgctcaacaaggacgactacctcgccatctgccttgccgcgctcgccgccaccggcaagggtgggcagcagcagcaggatcaggcgagcgcgtggcgcccggcccccgcgccggcgcaggagctgcgcttcagctgcgcggtctgcgggaaggcgttcgcgtcgtaccaggcgctcggcgggcacaagtccagccaccgcaagccgccgcccaccggagagcggtgcgtcgtggtggcgcaggcgtccgcgggcgctgggtcggaggcgagcgcggcggcgtcctcgggcgggagcagcggcggcccgcaccagtgcaccgtctgcgggcggggcttcgctaccgggcaggcgctcggagggcacaagcgctgccactactgggacggcacctccgtgtctatgtccatgtccgtgtccgtgtcggcgtcgtcctccatgctgaggaacttcgacctgaacctgctgccgatgccggagacgccgggttgaanaagtgggccgaggaggaagaggtgcagagccctctg

SEQ ID NO: 36427 - DNA, 835 bp, Triticum aestivum
  Clone ID: PAT_TA_36427
gccggccgggttgcgatcctcagccgagtccaaagttccaacaaaccaacgaatccttccttctgctacctgcctgcgtgatcgaagcagtcaacaatcgaccaagcttccagcgctcgatcgattatcagcagctagccatggttgccgccgccatgcaggccctctttgaccagaccgacctctccctctccctctccctggtccccgccgccgcgccggcgctcaacaaggacgactacctcgccatctgcctcgccgcgctcgccaaaagcgggcagcaggtgcaggggatggaggggcaagcgagagtgtggcgcccggcccccgcgccggcgcaggagctgcgcttcagctgcgcggtctgcgggaaggccttcgcgtcgtaccaggcgctcggcgggcacaagtcgagccaccgcaagccgccgcccaccggagagcggtgcgtcgtggtggcgcaggcgtccgcgggcactgggtcggaggcgagcgcggcggcgtcctcgggcgggagcagcggcggcccgcaccagtgcaccgtctgcgggcggggcttcgcgaccgggcaggcgctcggcgggcacaagcgctgccactactgggacggcacctccgtgtccatgtccgtctccgtctccgtgtcggcgtcgtcctccgtgctgaggaacttcgacctgaacctgctgcccatgccggagaacgtcaatgccgggttgaagaggtgtgccgaggaggaggaggtgcaaagccctctcccgccaagaagctcaggcttttgctgtagataaaaaaaggagagatggccagtgctcaaccgtccccttgatgattt

SEQ ID NO: 36428 - DNA, 1130 bp, Triticum aestivum
  Clone ID: PAT_TA_36428
gcgcgaggcttgcgtctgccctgccgcccgcgaggcggaggacggcggcgtgcgtggggggggggaggacgggcggattgctctctcgcctctggggattgccggcgtgaacgactcgagcggatcgagtccgcccgcccgcccgacctcgccgatcagccgcgctgcaccgcgagacctgccatctcaacgaactggagctggagccgctggaggtcaaagacgcgctgcgatgcatcttgcatacaatattctttcttcgaaccctcactcttcttcggccccaggatgtcgactgcgccctcgttgagatcacatatcttctttgtggacttgcagatctagaaagggaggtcgatgtaaagatcgaccagttcattgcttgggctcaagtgcatcccattcggaaaagccaggtctgcctctcgttcttcgatgagaagaacaagcacccaggctggttcagcagcaagactgagagggtttactgggaacaatggttcatcaatttgcatgtcacaagcccttaaagggcaaggcaaatcacgtggctcccaaagcgccggcgaatactaaaggacaagcattggaagagaccagctcaagacgtgatgcgctgagcttgctgatccaagaagtcctgttccagatcattaactacgccaatgagaaaaaagaccatattcctccaatctctgatagaatattcaatcatgagattttggtccccagctcttctgattctgtattcgggtggaacgccgacgttcttcggagggcattgagtagtggacattcgtactcactgaactgaagatctttgttagaaactgcactaaacgaagatgttggtatcggtgtgctacctttcgcagtgataagacgttgcccctttctcacctctccgttgatcgtttggttataagacgtcgtcagagctgctgactcatggaagcaatgctgtgtacagaataatctagaactgccagtgaactgactctgttacccatccaatcatgtaattcctacttgtttagttgtaaatatttctcttgacaatctgtgtccaaaaattattaccatgttattatgcaagatgtgaaaaatatgtgcattccggaaaaaaaaac

SEQ ID NO: 36429 - DNA, 551 bp, Triticum aestivum
  Clone ID: PAT_TA_36429
tcgaggccggccgggctgggctgcgtcacactctccactcatctggccatctccacctcctcctgtagcgatgacgatgacgccgtacgacaagggttttcttgatggcttttttgccggtgtgttgttcatccctgctgtcgtgctcgcggggatgttcctcgtctgggtcggcaagatctttgtgaggggtgttcaggcttgccgaggcggcggcggcaaccacggagctggcggccaggcagaaggcgcaggcggcgccgcggtctgagctgcatcctacctcgacggcatgtccagatcgatcggctccagggccctggaaggtgtgcaagctagtatgtatgtagtgctgcgttgcgtgtgtctggttgttcgatctgatctagctgtaatgaactgcccgatctagagtttctctagctatgtgttgaccgcacctacacatgcatattagtatgtttttaataatctccggccggttcgcctttttctccgagaaaaaaaaaaaaaaaaggcccctagagagttgcttcgaaaaaaaaaaaaaa

SEQ ID NO: 36430 - DNA, 739 bp, Triticum aestivum
  Clone ID: PAT_TA_36430
gccggccggttcggggaactcttccctcttatttactcctccaatcacgaatctacgactcttcttctccatatacataatcgtcttacaacttaatcacaatggccacctccatcaagtctatccgagctcttgctcccctccttgaccgtgtcctcgtccagcgcatcaaggctgagactaagaccgccagcggcatcttcctgcccgagtccagcgtcgagaagctcaacgaggccaaggtccttgcagttggccccggtgccctcgacaagaagggcaaccgtctacccatgggcgtcaccgtcggtgaccgtgtcctgatcccccaattcggtggctctcccgtcaaggccggcgaggaggagttccagctcttccgcgacagcgagatcctggccaagatcaacgaataagatacccatatatcaaatcaaatcaaacaataaccagcctgtatcatactgtaccatatcgcaagcggcgaacgtgagagatgagactctactgaagttgcttgagaaggggaagagagcggagttgattgtaatgtaggcgcaaaaagacgacagaccaattatgcaagaagatgtgcatgcgattagtatgagaatgcgtaggaaaaagaaaaatggtgctgatgtgttgggttggtcgcgcaagacagaatcaaatctccactccttaccctttcaatatcatgatttacatcgaaaaaaaaaaaaaaaaaaggccccta

SEQ ID NO: 36431 - DNA, 1423 bp, Triticum aestivum
  Clone ID: PAT_TA_36431
ctcgattttttttttgcctcaaagtaatatattgatgtaaattctggttgtttcaaaatgtacaagggatatcacttaacgatgatgatatagctatttactcccaaatcccatatatcaatttgcagcaagataaagacaagacaaacattgtcttaatttagagctattcacatatagttcactcaagtaaagacccaagttatcctctgtcatagctctggctatatcaagaagaatgtcttatgcaaaggtatgtacatcacggcaaccaagaaccattggttgtcatctttctttttaaccaccgagatctggtcagtttctgaccatggccttctcagtaagaaagctctccatctttagcaatgcctcaatagcgatggcacttggtgtaagtacattcacatcattatgtccttgtttgagtgcaatattttcaagggatactcgggcatcagcattagcatatgaatccattctttgttcaaaaagtgctgtaagtttggcataggcctttgcataaggatcaccagattcctgatgcaggaggggtcgtgaagcagtacccaccgcagcaatccttcttgcaagggcatccaatggaacatctaaccaaatagtgagtcctttcttcatataactccaattgattggtcgtatcaccgcaccacctcctgttgcaacaattaatcggtgcattgacgacaaatcccttagtacctcactctcgttatctcttgaagaatgcttcactgtggacctgaaaaattcagcgaccggacggtatgccaacagactgctcaaccagcttatcactgtcaaagaatgaatagcctagtacttcagctattatcttcccaactgtagttttgccggaacccatcattccaactagataaacacagcggtcattcaggtaagggagcacgtcctctgctttttgctttagtacgagagcctcatcagcagaatagtggactttctcagtacctgccgatttgtggcagcacaggcccttgaggctggcgccacggatgggatcggtgctccggctccccgcgtcggtgcgcaggaccagcggccgccgcgccggattctgatcaagcctcgccgccggcactgtcgccggggggaatccctgcggcttccgtcgtccggcccatgcagcaccgggcctcggccggagacccacgccggcgtccatctcctctccctccggccagacgaggcgagtggcaggaagttattaacaggagccacgtgtatcatccgtggttagcagaggcggggctgggtgttgagtatgccggcggccatcgcgggaacggtggtggatgcgctacgcgggtggcgtggcgggcggcgccgcggcggagggaagaagagacgaagcggacgagagcccacgcgtccgtcgtgc

SEQ ID NO: 36432 - DNA, 544 bp, Triticum aestivum
  Clone ID: PAT_TA_36432
gccggccgggtcgggaagatctcagcctcagtgcaaacttcaaaacaaccttaacaaatacaaataccacaaacctatcaccaccaccaaccaccatcatgaacaacaacaagagcaacagcgccgctggcaatgtcggcgacacagtcggaggagccgccaacttcctcaccagcaccttgggcaacaccgttggtggcctcggtcgcacagtcggcaacgttactggagccgcgactcgcggtgttggtgataccgtcactgcggcgactggcagcgctggacagcccatcggcgatgctgttggcaacatcggcactggagtccagggcggacttgacagcatctccagggcgtcgaggacgctggacagtggaagaagcaataaactatgatcaacgacaaacaccaacaaagatgataccacgatagcttggggaggattgactgaagaatgtaatactgggaataacacccgaagtgtatcaataatcaatataacaacacaattacctgttaaaaaaaaaaaaaaaaaaggccccta

SEQ ID NO: 36433 - DNA, 1219 bp, Triticum aestivum
  Clone ID: PAT_TA_36433
tccggctccagggccgtttgaaaaactatgggagaaattcttcgagggtcatgagggaagatataccatatatgttcacgcctcgagggagaagccagaacatgtcagtcgcttatttattggtcgagatatacacagtgacaaggtacagtggggtcagatttctatggttgatgctgagagaaggttgttggcgaatgctctacaagacattgacaaccagcattttgtgttgctttctgacagctgcgtacctttgcacaaatttgactatgtgtatgactacctgatgggaacaaatctcacgttttattgactccttctatgatcctggaccacacggaaattttagatattcgcaaaatatgttacctgaggttagagatgtctgacttcaggaagggttcacagtggttctcagtcaagcggcaacatgcattgatgacaatcgcggacagtctttactatgcaaagttcaaggctttattgtaagccaggaatggaaggtggatgcaattgctatgccgatgagcattatatgccaacactattcaatatgatggatccaaatggaatagcgaattggtccgtaactcacgttgactggtcggaaggaaagtggcatccaaaagcttatcgggcacaagatgtcacttatgggctcctgaagaatataacttcaattgacatgagccaccatgttacaagcgatatcaagaaagtggttacacagaacccttgcttatggaatggagtgaagaaaccatgctacctgttcgcaaggaagttctaccctgagtccatgaacaatctcatgtacttattctcgaattacaccctcttttgagtgtgctgtgctcatcccacatactacaggaatttacaggagatatttttgctatagaaacatgtgtacatttggaaggacattagatctattgacaaattggtggatatagaagaaatacggagaaggcattcgctgcagtaattgaggggttcccaatcccatctccatctcaggccattttaactcactccaggacatcacatatttaggacgaccatgtctttttactagtttctttacagatttttagtcacagattctgtgatgtatagtaagattactgtaattcggaaaagccattagatgatgtccattattggttatactaataccactgagtctgctcaaagttccgtcgtatcatttcgc

SEQ ID NO: 36434 - DNA, 664 bp, Triticum aestivum
  Clone ID: PAT_TA_36434
gccggccgggtcgggaattcctcttcctcgttctcttcttaattcttaacatgacttctgaaactgtcgctcctgataactctaccatttcgtcaccccccgccaaacgagtcaagaccaccacaatggaagctcccccaacactccagatcaagaagctctccgagaagggccgtcttcctactcgcggcagcgaattcgctgctggctacgacatctactctgctcacgacacaaccatcccagctcgcgggaaggctttggtcgatactgatatcagcatggctgttcctgctggaacctatggtcgtatcgctccccgatcaggtctcgcctccaagcacttcatcgacacaggtgctggtgtcattgatgccgattaccgtggccaggtcaaggtccttctcttcaaccacaacgactccgactttcagatcaaggagggcgaccgcattgcccaactcatcctcgagcgcatctacacacccgaggttgttgaggtccaggagcttgaggagagtgttcgaggtgccggcggctttggaagcactggttaaataaagcaagaagatagagaatgccaactcttcttccaagtaaaatagaatttaatattaaagtgcttgactatttactacaaaaaaaaaaaaaaaaaaggccccta

SEQ ID NO: 36435 - DNA, 1252 bp, Triticum aestivum
  Clone ID: PAT_TA_36435
gcaatatacgctctcctctctgtactgaacccctggtcgcctcccccccacgcccgccgccgccaacccgaaaccctagctccctccctccctcgcgcgctcagatccgcccaccctccctccctctttgcgctcagatccgccctccctccctcaatcttcgcgctggaaaccctagccgccgggccatggtgatagacggcgacgacgacgacggtggctaccttgacgacggcggtgcggccagcagcagaagcaccaccatgccctcccttcctccaaccctagcgatcgggccatgttggcggcggccagatccgcatcgggacaggacctgcttgtgctcgtgaggagaggcacgccatggagcagctcgtcaaggacagatatgcatccatggtgaagttactatataagtatagggtcaagcactgcccagaagaacatcctattttgaatttatcccctgtgtccaatgctaatgttgctggtagaatcggatgcaccatcattgatattgaaataagactaggaagatggataacagagttaagtgcagtagggaggctctataatataggaatacagacagtatggctgtcataaacaggaccaagagagcaatctattgagtgagatacatgataatgtggctttacaagtagtacttgtgaccatcccacttaacttcctcgtagccacagtcagtcagatgaggcgttttaatcccctggagagccaccgcattagtggctgctgtcctcccgggccgcgtagtccgaggttagtgcctgtctcatccctcgctgatcgtcaggcttactacgccagcgccgatgatctcggtgatgcctcgctaccgctcgaccttcgtgagacttgaccctagttcgcatctccaaaccagcgcttggtctcccccgagtcgcactgttaccttcatagttttcgtgtgctgatacgctctttctggttctgggtatcatttctgtacgtgagcccctttttgttgtatactactacatgagtgggcttgtgccacctagatgagtaatagagggcatgccccaagaataagatgagccaataataggtttacagcatttagctcggttggcggaagcatatctcccgttgatgtttggttgttgatttgcgaagattcagctttgtttccttgctgcacgcacatgcatctgtctgcttgtgtgcgaccagtgtgatgctttaaaaaaagaaaaaaaaaaacctc

SEQ ID NO: 36436 - DNA, 456 bp, Triticum aestivum
  Clone ID: PAT_TA_36436
ttttttttttttggcccaagcatggacattgccacttctgcctcgcatgattcaaacaacttcgaaaagctttcttcccgagactccactaaaaaggcgccacttctacggcaatatcctaacagaccaaagctaaaaccgaaagcttagtagagcagtggtaatccctacacctaacacgacctaatagactcctactaaaactactttctaacaagttctttctagtagtagggcaacaactaaatagaggacgccaagaaaaatccaggagtacgttacaacagactaatcaacggcacggccgaaaaagatgtacactacccgccgcggggaggggcggctagaacgaggccacggccggcgcggcggcggcctcgatgacgacggggacggggttctttttgcggcgcatctccagcaccttgcggtgggagttggagtgcagcctcgtgc

SEQ ID NO: 36437 - DNA, 645 bp, Triticum aestivum
  unsure (1)..(645): unsure at all n locations
  Clone ID: PAT_TA_36437
catccgccgtgggggtacccgtccccggtcccgcgcgccgccgctccacgtaccccacggacctcgccgccgccgctgccccccgacccgtgggaggggtcggcttccgggtggcccccgggggccccggcgcccaggacaagcccacccaccaggggctccacgcgctctccccggccggggagccccgcccggccttcttcaaggggcgcggtttcctttgtggcaccccgggagccccccgacgttggaggcacaaaccagatgctgggaggagctcccacgagctgtgcgaggcgcgggagtccggcacggccttcatcatggggcactcccacgtgaaggccaagcccgggtcgtcgctgctcaggaggctggccatcgggtacggctacaacttcctgcgccggaactgccgcggcccggacgtcgtgctgcgcgtgccgccggcgtcgctgcttgaggtcggcatggtctacgtgctgtgactcacagacacggggcttctgttctgtctctagcttccggacatgctgctgtaaattgtaacgtgacggcgtggtgcgcgatggaaatattatgttttgatttgatgaaatgcaaaaatcaaaaaaaaaaaaaaaaaaggcccctangggggccgta

SEQ ID NO: 36438 - DNA, 658 bp, Triticum aestivum
  Clone ID: PAT_TA_36438
cggcccgacgtggccaccctcaccacgcagtgcccgcagtccggcgccagccagcccgtggccatggaccccgtcacgcccaacaccttcgacaccaactactacgccaacgtcgccgccaaccgcggcctgctcgcctccgaccaggccctcctcgccgacaacagcaccgccgcgcaggtcctcggctacaccctcggccacgcctccagccccggcaccttccagaccgacttcgccagcgccatggtcgccatgggcgccatcggcgtgctcaccggcaaccaaggcaccatcaggaccaactgcagggtcgtcggctgagctcgtccatcaaccacctgaactgaatttggttctggtatagagtgtaagaagctgtttgatcattcatttggtcgatctgtactagctagctagcttagcttagccccaccctcctctctcttcctcttcttcatcttgcagcatactttctttctctgcttttgtattctcttaattagccttctgtatgtatgtattactgtctagcgactggactaagaactgtatgtaatgacatgatcacagcatgattaggatgggtaccaatgtaccaatataaaaaaaaaaaatactactaaaaaaagaaaaaaaaaaaaaaaaaaggccccta

SEQ ID NO: 36439 - DNA, 458 bp, Triticum aestivum
  unsure (1)..(458): unsure at all n locations
  Clone ID: PAT_TA_36439
atggttggatggagctggagctaggagagtttgtctgcgagggggatgaagatggcgacgtttccttcggtctggcggagacgaaacgtttgaacggcaagggcggtctcatcatgcagggaatcgagataaggcataagaattaaaacggactaattatgggaggagcttctgggattaaaccgatcgtatccacggtttaatccagtatataagggaaactgaggcatcatattttcttgtaatgtgtgtttttaaactgctgtcttgggtttcattctatttctttttatgccaccgatgaatcatttttgcaagtttcatcttaaaacccctaacagttgatgcagagaggaatattacctctctctgttgtacatcgacctctcttgaggttaattaagagatctgatncatttgatattacaataaagctaattcctgccaaaaaaaaaaaa

SEQ ID NO: 36440 - DNA, 733 bp, Triticum aestivum
  Clone ID: PAT_TA_36440
gcacgaggccaacccaacccaacgagagctaatatccatccttggagctaaccgatcagatcatggccatggggactaggcgcgccgctctctgctttcttctgctagtcgccgtcttcttacaaggcaatcctacattggtttcagcggatgaggagtacaagtataggattccgtatgtacccttctgcaaggggtggagctgcaaggtggagtgctggctggaggccaagctcttccgcacccgtctgcaggagcgcaagtgcatcaggggcggcatcaagggcgcctgctactgcctcttctgcgggaagcacctccaatgaaacacatacatcatccatccattatttgctcgctcgctcgtctagtaggcattaccactactccctccgttccataatataagagcgtttttggcactacactactgtaaaaaacgttcttatattatgggacagagcgagtagttatttatctcgaagttcctcatccacgttcgcttatccagctgaagccaataattccttttctcataaacgaattgcgactagtttatattatggtagcagcagcagctctagtacgtgggagcttcagatgtagttagtctcagtttggagattgaattctttctcccttttttttggcttcctagatagcttctacgacccgtgtaatgtcttgcttcaattaacgttattatggattaaaaaaaaaaaaaaaaaaaaaa

SEQ ID NO: 36441 - DNA, 875 bp, Triticum aestivum
  Clone ID: PAT_TA_36441
ctcggccgatccgggaaagcttccccctcgcatccctccccctctctccgccgccgcgccatcgcggcctccggtccgcctgcccgcttgctgccgccgtgcccccaccgccaggcgtccccgccgactcgccgtcatcacccccccccatatccgcccccaccccaaggcgtttcacctgtctccaccttggtccgcactttccggacattggaacctttgaatcacgttccgtttcagctagacaataatcatgagccttgcttgtctttgtatgccatggcatgaacagcccctcacactcttgttacttacctacccggtatcccatttcatgaagggccactcacactctcttagtagctactcggtggctagttcagagaaggacaaccgatgcggagttggcgtttcctggttcattcggaggttaaccccgattgaaccagcaagggttgggcaatgaaacgtaagcccctccccatccataaagggaagccaagctgtctacgacagacctcgccctcaacgctggcatcttgtgatgagggactttgtcgcaaactaggattttgatgaagcctgctccgaaaattggattccggcacccttacttcatgcaaggtggagaccccgtccatgtgcgggtgactccttcgctttggtgtcccttgtcttccttgctttccctttggctatccgtccgtctcaggcgcgactcctatcgctctatgcgcttgggtgatggcgctgcccaccgggctgtttgtggcttggtaacatatgtccgccttcctgtgttggtaggctaccgttttccgtttttttcaatactattccagtggatatgctacccggtaataggcggtgaaaaa

SEQ ID NO: 36442 - DNA, 501 bp, Triticum aestivum
  Clone ID: PAT_TA_36442
gccggcccattcatacccacgatggacaaggcacatggcccccgtccgcgcggcgccgcttctcctcatcatcatgagccacgatggagaccaagagcgctgccggccgagcggtcactctgctgcgccgatcagttttccttgctactcgtgcgcgatcgctgagcggtcgtgttcctacagagaagatcgctgctccttccgggctgtgcgtctgtgagatgagtttttgtcgatgaacgggcgaatgttgcaactgctgaagaaaagccgtgggccttcggcatttgtgggcggcggtgtgcatgaagagttgccttgttaaaatggacaagccgccggtccaccgagggagcggtggcaacgcctctccgatagagtatcgaccacgttcttcgagacaaaagaatgattctcctacgatggatgtttttgaaataagatacgagtatcgatcactggtttcctactaaagaaaaaaaaaaaaaaaaaaggccccta

SEQ ID NO: 36443 - DNA, 850 bp, Triticum aestivum
  Clone ID: PAT_TA_36443
gccggccgggtcgcgctccttttcttccttcttcctactcaactccagcctacttacctaacatttgcttggttaggtagcttctagatagcatcaccctcagcttctaccttcaccccgcctcttcttcacccaacagcttcgccccgctcgcccaccatggcttcccacgacgatgataccatgcccgaggagactcagggctacaagttctctcagcccaagcagagtctggctgagtaccagcagatggacgctggcgatgagtctctccagcgatacaaggagtcccttggtctcggaggtggtaccgacatctctgaccccaacgacccccgagtctgcatcattctctccttgaccatggactcccccggccgtcctcccgtcaccatcgatctctctacccctggaagcgagaccaccctcaaggacaagcccttcaacatcaaggagggtgccaagttcaccatgagcgccaagttcaaggttcagcacgagattctcagcggccttcactacgttcaggttgttaagcgaaagggtatccgcgtctccaaggactccgagatgattggcagctacgctcccagcaccgacaagcagcccacttatatcaagaagttccaagaggaggaggcccccagcggcatgctcgctcgtggccactacaacgccatctctagcttcgttgacgacgataagaagaagcatctcgagtttgaatggagtttcgatattgccaaggactggtagatatcggcgccttgatagtacggaccgacgacataactcaaaaatacatatcacaagtcatgagataatgaaaaaaaaaaaaaaggcccctagg

SEQ ID NO: 36444 - DNA, 2198 bp, Triticum aestivum
  Clone ID: PAT_TA_36444
tcggcccgccgctggcgtcgctcaccgccgaaccccggcagcatcagcctttgaagttcccgaagctacgcgtgccgccgccgccgccgccccatctctcctccggcaccgggcaccgaaggaaggccggcttctcccacatatcttctcctcttgattgctacctcatagcaaggcgtggcccagctcttcaccatggcgccgacagcaaggcaggcagcgccgcgagctctcgtcacgaggaagccgcaggaggacgaggtcaagccggactaggtcgatgcgcccccctgccatacctccttcttctcttgcgggttggttgctggcttgctgctgtttctggtgccgttcgtgtccgaccggaagggcgtagcttctgtctgtgtcgctgctcctgagctcacgcatccacatcggaggctgccgcttgcaaaactgctctaagcctctaacccgaggagctcgttgtcaccatcgtgtagaggagcaccaggctgcatcataagacgcctcaacagcgaccgacgaagtcgtcgagccgagacatgcaagccttttgagtgagttcctccatatttcatcaattcagccggtgttgatttgcaggtagctgtttgagtaataaaaggaacatactgattaacttgttcgctgcttcctctgctgcgaacaacgagcctgaaatagtttttaacttcctcttgagaactctccacttgcaaagctcattaaaaatggtagacctattcaagcttggagcaggagcaatgcctgcaagtttcaaggtggaccggcatgtaaacaggaacactgaaacattagttgcagattttggtgagagcgcaattggcagggtggcaccacgtggactctggattttggtggattattctcctccgggcgtatacaaaatatactggagatgctagtttgtcagaatcacctgattgtcagaaggtgcatgcggcttatactgaatctttgcttatctgagggattcgatactttcccaagctctgctctgcactgactggttgctcaatgattgatcgtcgaatgggtatatacggttatcctattgagatccaagctctcttctacatggcattaagatgtgccctccaaatgcttaagccggatggtgaagggaaggacttcatagagaagatagggcaacgactgcatgcattaacctaccacatgagaaattacttctggcttgattttccacatctaaataacatatatagatacaaaacagaagaatactcccacaccgctgtgaacaaattcaatgtcattccggattcaatccctgattgggtgtttgatttcatgccttgtcggggaggctacttccgcgccagcgtcagccctgctatgatggacttcacgtggtttgctcttggaaactgtattgccattatatcatctctagctaccccggagcagtcatcggcaataatggatctcatcgaggagagatgggatgagctagtgggcgaggtgcctctgaagatagtatatcctgcacttgagaaccatgaatggagaataattactggctgcgaccccaagaatactaggtggagttatcataatggaggatcttggccagttcttctatggctgctgacagcagcctgcatcaagactgggcggccacaaatggcgaagcgtgccatcgagctctccgaggcaaggctcctcaaggacggctggcccgagtactacgacggcaagctggggaagttcgtcggcaagcaggccaggaagttccagacatggtccatcgctggctacctagtcgcgaggatgatgctggaggacccatccacgctcatgatgatctccatggaggaggaccggcctgtgaagccgacaatgaggcggtcggcgtcatggaatgcgaaggaaggttgagtttcttgaaaaaagaatttacttgccaagggttcaacagaaaaaggagtccagagttggttgtaattgtactctgtcagtttggacagaagtgtataccgtagatgcatctagaggtcgcactacgttttcttcctttttgtcaaaaacagcaagtgaagcttgtgctttggtgatacctcagtctcggaataatatgtttattttgtaccaaaaaaaaaaaaaaaaaaaggcccctatttagcacacaattatgaagaaaaacttgtttt

SEQ ID NO: 36445 - DNA, 1609 bp, Triticum aestivum
  Clone ID: PAT_TA_36445
gccggccgggtcgggctgttcacctgccacatcagaaccagtcctccccctcccggcgcgcgtgacaggcgaggcagaccgaagatggcaacggcagcctccgcctccgcctcccccgccgctctccgcgccaaaaccccagccccgggcgcgcaccccagcccgaaatccagcctcgcattcccgtggccttccccgggagcctccgcctccgcctccgccgctgcctccggcaggctccacgccagcctccacctcggcggggtccgcggcgtcggcaccgccaacggcaccggcctccacgtgctgcaccccgacgtcaagccgctggccgtgcccaagatggccggcggcgccggggcacagaagagcatcctgctctaccactgcgaggagatgagggatctcgcccagcaggtggccgcccggaacgacgacatcgagctctgcaccatctcctggaggaagtttccggatggattcccagatttgttcataccaaatgcgcagaacattcgtgggcgacatgttgctttcttagcatcattcagctcgcctggtgtcatatttgagcaaatatcgattatatataatctgccaaagctgttcattgcttcatttactttgatactgccatttttcccaactgggacttccgagcgtatggaagacgaaggagatgtcgcaaccgcctttacacttgctagaagcttgtcacacataccaatatccagaggtggacccaccagtttagtgatttttgatattcatgctttgcaggagagattctactttggagacgcaatcttaccatgtttcgagagtggcatccccttgttgaaaagtaggcttcaggagctacctgattctgataatatagccatagcttttccagatgacggcgcatggaagcgcttctataagcaacttcaacattttcctatgattatatgcaacaaagttagagaaggtgatcaaagaattgtgcgtataaaagaaggagatgctagaggccgtcatgttgttatagtggatgacttagtgcagtctggtggtactttgattgaatgccagaaagtgttggctgctcatggagcagcaaaggttagtgcgtacgtgacacatggcattttccccaacaaatcatgggagaaatttaagcctgataatggagagggtccggagcatgccctgagccacttttggattaccgactcgtgccctctcactgttgaagcggtcaaggacaggcggccgtttgaaattctcagcctggcagattctattgcttccgctcttcagatttagcaagctgatttggtctgctcgctcggctgcgatattgtttagttcatttttctagcacatctcctccccacctttttttgcagtagtttcttttgccttggatattgtttagttcatcttttaatctttattattcccgagaaacctcagatcctacatcttcagttcttcaccttagggaagcgttcaatggattgttgggaccgcaaaaacatttctaggatagtatgcctaataacttggcaggacaagccaagtgagtcacatgtttgctatatataaataaaaaatcaaataagtt

SEQ ID NO: 36446 - DNA, 738 bp, Triticum aestivum
  Clone ID: PAT_TA_36446
taagaaagacatccttagaggctggagcacttcatttgtgtgtagaaagtgtttcaggccagtgtaagcctgttgtagtccctgtaatacaaaggtagtaagtgacgcatcgccctctccgaactgaataactgtggcgtcaatgagacgcttcgacgccggctggccgtcgttccccaccactgagatgaagaaggaacgactggcttatcattcactcaagcatccagagcttcggcgcccaactattgaagaaggctcatactgatggagttgtcccaaacaagaatgtcatagcgcatgtgttgccgttgtctccctcaataagtccctcgctggtggttacacacacgcgcccacgaactgctcggccaggggagaaaacagagcagtggtgttcggttagaatagaggaggacacacggttaggtttcaggaaccaatgccttcatatttttttctctttcaactgagtgctggctaagtaagcacaaccctcttaaaaaaaaaaaaaaaaaaggcccctaaagcaataacagcttgaaatgagctaggttggccaagtctagacattagggatttggtaatgtatatatattggaaaatgatagcatggtctttatatggttgttttttgttagcaacactataaggtcttcctcggcagtgcacatactaatatttctgctcaagcatgtagatatacattgtggcaacggatcaataaccatgtcatta

SEQ ID NO: 36447 - DNA, 907 bp, Triticum aestivum
  unsure (1)..(907): unsure at all n locations
  Clone ID: PAT_TA_36447
gggggcgggacaaggaaatccgcaatgccccccctactccctcctaataaccgacgccgaaccccgcgacgcttccccggctcctcatgctcgccgtgggcccccccgccgccgccaagccgacgtcctacgaggcgctcgcggcctacgacctccgcccgggcatcatccccctgcgcgtcgtctcctacatcctccacaacgccaccggcgacttcacggcgcacatcaacctcctcctccacctgcgagatctccctgcagcgctcctactcgctcccgtcaacgaccgccatcacgcggccgcatatccgtcgcccgcctcaccaaccaccagggcgtcgccgtcaaggtcctcttctcctcgctcatcatcgtcgaggtcacccgcacgcggcgtccaggctcgacttctccgtcggcatcccctccgcgcgcttcggcctcgacatcttcctccatagccccacctgcgtccgccgcctcgactgccctgacctcgcgctgcctgtggctcgcactccaacggcgagccgagcctgctcctgcgaggtgcgttctagtatacccaccgagcgctcggacaagtcacaacggccccttcagaattcagctagtgcctggatggattatccatgcttcttgttgctggaagttaccaaatggctattagtattttcttgtgctgttcctgtgttagagggaccaacaatttcaagactcgattttgatgggtaccgtgtatgagtggtgtactgtttcatcaggaagtttagagtaaaacacttgagatcaataaaagttttcagattcaaacacttaagatcaataaaagtttcatattcctaaaaaaaaaaaaaactcgagacacctgcccgggcgnccgctngaaatcattagtgaattc

SEQ ID NO: 36448 - DNA, 1158 bp, Triticum aestivum
  Clone ID: PAT_TA_36448
accggtccggaattcccgggtcgacccacgcgtccgcgcgccagaggcagttaatcatgcgctgagagctgtattgcgaagtcgttttttaccaaaagattggagacaaccaattgttgcagaaacaggtcatccagtcctcaaaaaggttttacggtatatccctgatacgttagatggaagcaatgagaatgccagggcgaatgaaggttggcgtaggaagtttgggtggtataaacccaggttgcttgatagcttgtgtatttttccaagacaagtaaacgaacatgcaaagtctaaggaggagctagaactggaaaagcaacaaggagtggagaatgaacctatgaacagtctttccgaattggatcttctgacgtctcattatctccaagacgatcttccaattatattggaagtattgctacgctctgatcatcttatgacagatgaattgtggaaatggttggaagaggtcctggaggtttactcccgaccagaagtccttggtcgtggaacctggggcctccgccgctgtgtttttggtggaggctggaacctgggccgccgtgcctattgccgccgtggtcgtgcccgtggtttcggacaccgtggtcacggtcgtgcccgtggtttcggacaccggtgactatcagagcgaaggcgccgtccgcggagatgaggggatctgcggcgatggtgcccagatccacggcagcggcgtcaactgtgatgagaagcgcatctgcggcgatggcgaccatggcaagggcaccagttcctcgattctcagcagttaccttcctctcctaatccccgtcttcaggaaacaggagccaatcaattttgttgcattgtagaccaatactgttgtttgtaaataatttgaacttgctaatattgtgaacactgcagttaagttccttgggccgctagattacttatttgtcactgcaagtagaaagttgaagtgctaaagctgatgatgggtttcggctgagtaagtagtatactctgatttagttgcgataggctttgttcttgccatcatttgatatggaatagttgtgttatgaccagagattgcatctgttaccctcttctttggacgtctttccaagccaataaaaaactggtgcataggcagacgaaaaaaaa

SEQ ID NO: 36449 - DNA, 688 bp, Triticum aestivum
  Clone ID: PAT_TA_36449
ctggcggcgtcgccgggcgggtcgcacggacccaaggggatcttctttcccgacactcgatacaaccttagaacggatgatggtgtcgatatctatatccagacgcagggacccacacagcctgacggacgaactctgctcaggggaacgttccagacgggacacccggattatgactggttgaactacattcttgctgttggtgttttgcagaggccgcctgctgagtcaaagggcaagtatgttgtcatcgacatgtggcagatggtcctgcctgactgcaacggcgcatgctgagacgggatggacggtagtctgggtgggatgccgagcattgactcaatgttgccgatgggcgctgtttgaacgattaggaatcctcttagatcaggccgtccacgtcagaatcaagccgatataataagaccgaatggcctggaaattacgcgttaacacgcaaccctgcggtatatatgggatgatgacgggaacggtaataagcaaaacggcaaaaacctattattcagctcccaccccgtgaaattaaactttgcaaggacggttatcgggcaaaaaagagtttggatacccctacttcagacggttattccccgggttgggggcagaatacgaataataaacgaattgtcgatcttgcagcaaaaaaaaaaaaaaaaaaggcccctta

SEQ ID NO: 36450 - DNA, 651 bp, Triticum aestivum
  unsure (1)..(651): unsure at all n locations
  Clone ID: PAT_TA_36450
gcacgaggctagctccgccctcctcctcctcgccctcgtggccctggcgggcctcgtcgatctgcaggcctccgcggccgccccgacgcccgctcacggccgccccgtctccttggcggcggcggcgggtacgctgggcatggcggatcacgagctggacgggacggtgcaggccctgatcgacgacttggcgactgatcgggtgcttcacgacaattctgggctgcgccttcaagtgcctgcgcacgcgcaagggcattgacctgccgctctgcgtcatcggctgcaacgacaggggcattgtctgcatgttcagctgcggcaagccaacttcgccgccgggtcccaagcccaagccaccacctgctcccacacccacgccgccacctggtcccacacccacgccgccagagccgccggctcccacaccaacgccaccagcgccgcctgctccaaaacccaagccgccgcctgctccaaaacccaagccgccgccccccaagccgacgccaccctatccaccacctgcccccccccccccacccagcccgccgccttacgccgatggnnnnntccaactacggcgacagttaccttgcatgatccccgtcatactagtgcaatatggtannnnnnnntaacttcaaaann

SEQ ID NO: 36451 - DNA, 717 bp, Triticum aestivum
  Clone ID: PAT_TA_36451
gcaaaacctagccgggaccaaaatctccaataaaagcccagctaagaccaaaaatcttcactggcaaccaactagatacaaaataatagaacaaacagccatggctaagtcaaatgcattggctgcaacactgttgcttgtcatggtggtgtccctcgccacactagagggtgttcatggcgtctgcggcatgtcgaatgatgaattcaagctttgccagcccgcggcggcagtgaataacccgacagagagtccgtcggctgagtgttgtgctgcgcttgggaaggccaatctatcatgcatttgccgctacaaaggcatcgccggcatatggctgaaaatgtaccacatcgacgcaaagcgcgccatggctctgcccggcaagtgcggtctcaccatgcccaacaactgctcgtgatgattggttcagatgtactacccatgagcatctaggagtcggttgctctacatctgcatcgacacttatatatggctaaataagtggaggagcacttgaaaaagcattgtgctactcggtcttattgttgttgtgtaatttgaaagtgtgattatcccattaagctcttgataaaatagtatatgcatgttatactagaagtgtaaggatggcaaacgtgccttgcatgttgtcccatgaaattaatatcttatagttatagtgttcgtgtcaaaaaaaaaaaaaaaaaaagcccccta

SEQ ID NO: 36452 - DNA, 827 bp, Triticum aestivum
  unsure (1)..(827): unsure at all n locations
  Clone ID: PAT_TA_36452
gccggccgggtcgggatcccattctttctactccattcagagatctgatcctttactcgcagctgttgcttgcgcctttctttctttttctctacgagacattacattctttgcaagccctggtggtttcgcttcattcactactaaaaataaacacatatacaatctttttgtactcaaacaagcaaagcaacattcaagatgcgcacttcattctctaccgttttggcccttgccgccgctctccccaccgccttcgcccactacaacttcgaggccctcatcgtcaacggcgaggtcactgagccttaccagtacgtccgaaagaccaccaacaacaacagccccatcaccgatgtcacctccaaggacatcgtctgcaacgccggcggtctcgacaaggacatccgcgccgccaccaagaccatgaaggtttcccccggtgacgaggttggcttcaccgttgccagcgagatgggtcaccccggtcctccctctgtctacctcagcaaggcccccgatggcactgaggcttccgactacctcggtgatgatgagtggttcaaggtctacgagatgacctggaagaagattggagctgatggtgttgagtgggccaactacatgaacggccagtctggtggtatcaagaacttcaccttcactcttcccaaggacacccccaagggtacctacctcatgcgcgctgagcacgtcggtctccacggtgctggcgagaagaacggtgctcagttctacatcggctgtgcccagatcactgtcgacggncaacggtgctggcaagccttctcccatggtcaagctcc

SEQ ID NO: 36453 - DNA, 1491 bp, Triticum aestivum
  Clone ID: PAT_TA_36453
gctcatccccctccacccgcgtcaacgccgcagtcaaacgcctcgcattcccactctacccctagctcgctctcaccatgcccctgccgtcgccgcccgcccggctggccgtgccggccgccgtcctcctcgtcctcctccacctcgccgccacggccacggcgaccaacttcacctgcagggcaccgcggggcaccacctgccagtccgccatcggctaccgcgtgcccaacgccaccacctacggggacctcctcgcccgcttcaacaccaccaccctcgccggcctcctcggcgccaacggcctcccggtcgccacctcgcccaagaagcgcgtcgccgccaagcagaccgtccgcattccccttccgctgcctctgcgccggcaaccggcgtcggccaggtcggaccacgcgcccgtctacaccgtgcagccgcgaggacgggctggaacgccatcgcccgcaactccttccgagcgctgtcgtcacctaccacggagatcgccaccgccaacaagatcgccgacgtcaacctcatcaccatcgggcagaagctctggatcccgctgccctgcagctgcgaccccgtggacggcgccggaagtcgtcttccacctcgcccacatcgtcgacggcggggagagcacctacggcatcgccgccaccttcggcgtcaccgaggacacgctgctcaagctcaacaagatcgccgaccccaagacactgcagaaggaccaggttcttgatgtcccgctccctgtttgcagctcatcaatcagcaacacctcggatgatcatgatctgcgcctcccgaacggcacctacacgctcaccgcgcaggactgcatccagtgccgctgcagttcaaacaccttccagctaaattgcaccgcagtgcaaggaaaaaagggatgcccagcagtgccgccgtgcagcgaagggctcaatcttgggcagacaagtggtgccggttgcgacttcaagatgtgcgcttacagtggttattccaacagctcttcactcagcatacagaccactcttttcaaaaaccagacagcaccagcttgcgagaaagcaggatctttgaggtcggcgttcgcagggtccatgtggaggatatctgctatctccttccacatggtgttgatcttggtatgcttcctttgatactgaagacgcccactctagctggtatatatatcttgaaaaaaaaaaactcatgatagcatatcaatttgtcgatcgatgtgattgttgttgctgttgtaacttgaattccgatggccggtttgtcgagcttttcgttttgactattcttctagagaatgagtggcactagctgcctgaataaagcaatgatatgcgtaaggtttgcatctggaaatgaattgtactcattagattgggcaattgcaataaaatgttacaagagtaaacaacttcagaatggtactataccaatcaaaaaaaaaaaaaaaaaaggccccta

SEQ ID NO: 36454 - DNA, 322 bp, Triticum aestivum
  Clone ID: PAT_TA_36454
cggggaagagttccgtcagcacgacggtgtggtgacgatcttgatgttctaccgtcgcagggcttcgcctaagcaccgctacaatattatcgaggattatggtggaggggggcaccgcacacggctaagagaacaatgatcaactgttgtgtctcgaggtgcccccctgcccccgtatataaaggagcaagggggacgcggccggccctggggggggcgcaccaaggaggagaagtcctcctcccactgggagtaggactcccctccttcccttctcctagtaggagggggaaagggaaggggaagagggagacggaaaggg

SEQ ID NO: 36455 - DNA, 611 bp, Triticum aestivum
  Clone ID: PAT_TA_36455
acggggaaaagtaccgtcagcatgacggcgtcgtgacgatcttgatgttctaccgtcgcagcgcttcgcctaagcaccgctacattattatccaggattattctggagggggaaccgcacacggttcagagaacattgatcaattgttgcgtcactggggtgcccccctgccctcgtatataaatgaccatgggggacggatccggtaccgtagcagggcgcgccacgggggaactcctactatgactgaggtggaatatggtggaggggggcaccgcacacggctaaggaacgatcacgaagatcaacttgtgtgtctagaggtgcccccctgcccccgtatataaaggagcaagggggagggggaggccgtcctaggaggtggcgcgccaaggggagtcctactcccaccgggagtaggaccccttccttccttgttggagtaggagaaggggaaagagggggagaggaagaaggaaaagggggctgcgccccttgtccaattcagaccagaaggggggcgcaggcctccttccttttggcctctctcctctattcccgtatggcccaataaggctcatataccccccgtggacccggtattacggacc

SEQ ID NO: 36456 - DNA, 511 bp, Triticum aestivum
  Clone ID: PAT_TA_36456
accggtcgagccattctacgggtcgacggggaagagttccgtcagcacgacggcgtggtgacgatcttgatgtactacagcagcagggcttcgcctaaacaccgctacaatattatcgaggaatatggtggcagggggcaccgcacacggctaaggaatagatcacgtggatcaacttgtgtgtctttagggtgcccctgcctccgtatataaaggagcaaaggggggggggggggccggccaagagagagaggcgcaggaggagtcctactccttccgggagtaggactcccccccaatcctagtccaactaggattcccgaagggggaaagagagagaggggggccggccaccttctcctagtcctaataggactaggggaaggggaggggcgcagcccacgttgggctgccggtcggcggcgccggcgcggcgccccgcccgtccagggctgccccttctcctttccactaaagcccactaaggcccatacagctcccggggggttcc

SEQ ID NO: 36457 - DNA, 551 bp, Triticum aestivum
  Clone ID: PAT_TA_36457
cggccgctcgaggcggcgggcggccggcttctcttcctccatcttgtctacacatctcttctctaccaaaccacttcttcacttacaccaaaaccctcttcgaaatgcccgagactaccactccccaggttcctgcctctctcggcgagaacagaggtatcaagttctccttcaagactggcaatgcccgttaccagtgcgttcttcaggaccgctccgtctatgagcgcaagaaggcttcccgccagaactcttctgactctgtctcctctaccgagtctacccagactgagaagtcttcccactaaatccgagttggaagattacgggatcatggcaccttggccaataacatcaaccctcaatcaagcctgtctataacaaggcttcgaagggagcaatggtgaccaaagcaaacaaaaatggggggagtttattataccacaattatcgagcattagcgacggttttacagagacatttggcgtctccatgaatcaaaacattcttttttttatcgttaccaaaaaaaaaaaaaaaaaaggccccta

SEQ ID NO: 36458 - DNA, 1326 bp, Triticum aestivum
  Clone ID: PAT_TA_36458
cccacgcgtccgttcccatctcataattttcagtcatacccaactttgtcgaatttgtggacaccatagtgcagcacagtaacaggcaatggagaccgccagaaagcctcactttgtgctcgtcccatggataggaagcatcagccacatcgtccccatgacggacatcggctgccttctcgcctcccatggagcgtcggtcgccatcatcacgacgcccgccaacgcgtcgcttgtccagagccgcgtcgaccgtgtcaccctggacggcgcggtgctcgcggtcaccacgatccccttcccggccgccgaagccggcctgccggaggggtgcgagaggttggacctgatcacgtcccccgccatggtgcctggcttcttcgaggccaacaagaagttcggcgaggcggtggagcagtactgccttcgggacgcgccacgccggccgagctgcatcgtctccgggatgtgccacacgtggacgctgcccatgacacgaaacctcggcgtgccctgctacatcttccacccacgcgtccggttcgccttgctgtgcatcgagcacctctacaggcaaggtcggcacgaggcgattgcgtccgcggacgagctcgtcgacatctccgtcctgcagccgtttgagtgcaagatcctcggcgggcagctgccgccgcatttcttgccatccacgtccatggggagcgggctgatgcaggaggtccgagagttcgacatggccgtggacggcgtcgtggtgaacagcttcgacgagctggagcacggctccacggcgcttctcgcggcagccgcaggcaggaaagttctcgccgtggggccggtctctctgtgctgcgcacctagtctcgacccgcagagcgatgacgcgaggcggtgcatgtcgtggctggacggcaagaaggccaagtccgtggtgtacgtgagcttcggcagcgccgggtgcatgccgcccgcgcagctcatgcagctcggcatggccctggtctcgtgcggctggcctgtcatgtgggttatcagaggcgctgactcgttgcccgacgacgtgaaggtgtggttacgtgagaacaccgacggcgacggcgacgcggacagcaagtgcctggtggtgcgtgggtgggcgccgcaggtggccatcctggcgcacccggcggtgggcggattcatgacgcactgtgggtggggctcgactctggagagcgtcgccgccggcgtgcccatggtcacctggcctctgttcgccgagcaattcgtgaacgagaagctgatccgtggacgtgcttgaatcggtgtatccgtcggcgtgacaaa

SEQ ID NO: 36459 - DNA, 677 bp, Triticum aestivum
  Clone ID: PAT_TA_36459
acgggccgcgacgcctttcctctctgctcgctacactcctctcacgctctcaacccatgaagctctcactttccctcccgcttatgccaaccttccagctcaacatgccaggactcgaggccagtaccctcggacttgacgcactcacctctcgcgatcaccatctcagttccgttgtggaagaactcctaggcatcgtagtggagcgtctgcgcctctctccgctgccgcgccggggagcggcaaaggtgggcggaggggcggctctggtgagggacgaagcgcggcggaggagcgccgccgtccccggactatcgttggccggctgggcggtgcggtcccgtccccggcgttggtgggtcgcgcatgccgtgtcgggcccgggcggctactgggccggggctggtggactggcgctcttcgggcgatcggtgcagaccaggggcgttcaatgccctccacgcgcttctggtggggagtatcgtttctgtctgaggcagaccgtgatcgactccgtccatgtgcttagagtgtggaataaaatgtttattcgaaaaaaaaaaaaaaaaactgcgccttgtatacggttatatgtttttatcaagtttattttaaatggatgattcatgtaaaatagagttgcagagtccaatcgaatcgggcagcgttttactgaa

SEQ ID NO: 36460 - DNA, 840 bp, Triticum aestivum
  Clone ID: PAT_TA_36460
gccggccgggtcgggactccgatccgatccaatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactaaacattcagaaggagtcaacccttcacttggtgctcccgtctccgtggtggccagtaagctcctggccatgggagctgcttttgtctctgggttca

SEQ ID NO: 36461 - DNA, 887 bp, Triticum aestivum
  Clone ID: PAT_TA_36461
ccgcttcgaggcgggccggccgggggccgaggccaatcttctctacctaaacctcacagagtatcatttaccatgttgttcaagtccatcttcatctcgtccctcgcgactagtgctctggccatttacctacccgaagaccattacctggttagagacaacgcggctgcgccaggagcaaaatgcgactgctctggtgacaatgtgcgatacaactcgacacttgcaaaggactacatctgtggagacaagcgtcttggccctagtcgtctcccaaccaagcttccccttggcaccttcgtcactgggtacgaccgctttggaggactgtctccaaactccttcctcgggaagtggtacaactccaccgaggggcctgatggccgcgaagcaggatggatctaccccgaaaagtacggcttcgagcttgatgaagagaagctccccatcaaggccaacgtggatttgatgcccggtacacttgttgaccgtttcggctataatactggtcgttacatctcccctgccaccgcccccttctcccagagagctctccacccccagaacctcgacaacgatgtgaacaagcagttcccaaacaactaccacgtatacaacgtgagcaggatgttcactgtccaggctggacccatcaggccttggttcggccagccaggctttggagttcaattcttcctcggcaacggcatcagcgtgaaggattacctcgacaacggacacttggttgagctgaagccatctgatctgctcaaggacggaactggctgtggctttgcgcgtgagggtgatgattcggtctcagacgagctgtaggatgctgcaaaagctaaacattgtccctacagaacatcaataacgatggccgc

SEQ ID NO: 36462 - DNA, 833 bp, Triticum aestivum
  unsure (1)..(833): unsure at all n locations
  Clone ID: PAT_TA_36462
gtgcggcgctcgaggcggcctaaatcaaatccgagtcttccccccaagcttgtgccgccgccgccgccgatcagccgaaccagccgccgatccaaccaatctcccgagcgcccgccctccgagctcaagccccgttcgtgaatggaccacggcttccacggcgctctccagctgcccccggggttcaggttccaccccacggacgaggagctggtgatgtactacctttgccgcaagtgcggcggcctgcccatcgccgcgccggtgatcgccgaggtcgacctgtacaagttcgagccgtggaggctgccggagaaggcggcgggaggggggccggacgccaaggagtggtacttcttctcgccgcgcgaccgcaagtaccccaacgggtcgcggccgaaccgcgccgccgggaccgggtactggaaggccaccggcgccgacaagcccgtggggtcgccccgccccgtggccatcaagaaggccctcgtcttctacgccggcaagccccccaagggcgtcaagaccaactggatcatgcacgagtaccgcctcgccgacgtcgaccgctccgccgccgcccgcaagaagtccaacaacgcgctcaggctggatgacccctcgctctgccgaatctacaacaagaagggcgtgatcgagcggtacgacacggcggactccgacgtggcctgccattataaaggatccaccggaancttctnaaataanaatgggtttaacttaaaaaatcantggaagtnagtgctctggcaancnaaaaagggaaanggccaattganaaacccaattgcctttgaaaccttatttggcag

SEQ ID NO: 36463 - DNA, 1849 bp, Triticum aestivum
  Clone ID: PAT_TA_36463
gcggccgcccgggccggtgcggcggttggaggcatctgccggccgttcgttagatgagacatcacacggggaccacccgtccgaccacccgcattgagctcacacatcacgcatgaagaaatcttccgatgatgcgaccttcaatgacagatcacacctgaagaaaccttctgatggtgcgaccttagatgacagatcacacttgaagaaaccttctgatggtgcgatcgtagatgacacatcatactcaaagaagtcttctgaccatgacaactcatctagctctggtgtcctgccaccaagcatatttagaatgcttctacctccccaaaaagtactgcctggtacggaaggaaaggcgaaaaagaagtcaggctggtcatcagacgattccgatggttgctgttcagcagatagttcagatggacctttgtgcaagcagggggggcacgtggattaccctgagaggcctggcagaccagaatatcaccacccaaaacagtcaaaagacaaagaagaggtaaactatcccgagaggcctggcaaaccagattgccccttctacatgagatttggtgattgtaaatttgcatcagcatgcaactatcaccacccaaaagacaaatacccagctgcgagacctgatgaaccagaatgcccattccttatgaagcgtgggtactgtaaacttggggcacaatgtaagttttatcacccagaggcttcgagcccaacagatgcaaaaagatctgttaccactgatgaacatcatccatctacaagaatcacattacaagactatatgcttccccagcaaccgcagtatcctgagaggcctggtcagccagagtgccggtactacttgcagtttgggaaatgcaaatatctgtctgcatgtatatttcaccatccaaaagatagacttgcagctcactctgatcagattggacctggcatgcatggcatgccagattgtcctttctatatgaaagctgggaaatgtcaatttggatcagcatgtgaatttcgtcatcccaaagatatacattcaagttcaactacagaggaagcatttggtcagagaactggctcgggggcatacgacaatttggcaaggtcagataatggcgtggagcaacaagaagagagcatcatgtatcctgaaaggcccggtgaacccgagtgtgcccactacatgaggcaggggtactgtaagttccagatgaactgcaagtaccatcatcctggagaccggctgtctaagaaacatgaagtcatccgcaccgacccacttgagcaaagcagggacacgctggttaccgcacgaatgctaccaacggaaagcattgtcttgatgtgtcgccaggtgttgttagagcaggctgtctggctcaagtgtgagtgtgtctgacgactgaagagagaggagtaggaggattctgatgaactaaccaaagcttggagtcatcgtttttctgggggtctatgagcgagtagttgctagttatgtccgttttgagcgcgtttgagctgtgttggtgaaaggcactccctccctccctccatttgctatcgattatgcgcttgcgacatactctatttgtgtggacaaggccaggccaggcaatcatgaatttgcaaactgtaatcttggcacgaactacaatctcaagtgaatgctgtctcaagtgaatgctgtctagctagcatgatagcaaggtgtatcatgaatgaacaccgatgatatgagatgagattactacttaattagcatgatgatgcactcattttagtttgacacttttaaggaagcttagctttctggatcatttcagacattattgttatt

SEQ ID NO: 36464 - DNA, 777 bp, Triticum aestivum
  Clone ID: PAT_TA_36464
actagatctagcaaggaggaggacactcaccaaaccccagtttcgcgcacggagctgaccatcgagatcgatcaggccggagggaaccaagacgcgcgccgcgttgttgtcgtccggctagccgggccatggcgaacagcctcctccccgtcgtggcgctcctcgcgctgctcttcggcgcgtcgcgcgccgccgacttcgaggtcggcggggacgccgggtgggtcgtgccggcggccggcgactccggcacgtacaacgactgggcgtccaagaaccgcttcctcgtcggcgacagcgtccatttcaagtacaaggcggactcggtgatggaggtgacgcaggaggagtacgacaagtgcgggtcgacgcaccccatcttcttctccaacaacggcgacaccgaggtgcgcctggaccgcccgggccccttctacttcatcagcggcgtcacgggccactgcgagcgcggccagaagatggtcgtcaaggtcatcggccagaacgagcccccgccggcgccgcccgcgccccccagcggcgccgcgccggccggcatcggatccgccggcgccgtggtcactgccgcccttttgcctgctctcattgtgctcggtgtctgatcccggacatctatacaatgttttttgcactaatctgagcacccctcaaagagaaaaaagataatctgagcgtgcttatgtagcccatctttttcgttgtggtatttaagatgttataattaacttgtgaaaaaaaaaaaaaaaaaaaaaaaaa

SEQ ID NO: 36465 - DNA, 998 bp, Triticum aestivum
  Clone ID: PAT_TA_36465
gcaagaagctcactcagctacccccagtcccgatcacaggtagctagccactcgacgcaatcggcatggccagcaagtcggtgtccctgctggtcctcgcggcgctggtggccgcggcgtgcctcgccgggctgggctcggcggcgcgcgacatgccggcggagaagcccgcggaggacgcggtgaagcggccggagacgttccaggaggggacggtgctgatcccggggatcgggcggtacgggctgggcacccactacatccctcactcagctcagctaccaccagtcccggtcacagcaatcggcatggccagcaagtcggcgtccctgcacaccctcgcggcgctggtggccgcggcgtgcctcacggagctgggctcggcggcgcgcggcgtgccggcggagaagcccgcggaggacgatgtgaagcggccggacacgttccaggaggggacggtgctgatcccggggatcgggcggtacgagctgggcacccactacatccccgacatcggcgggctggaccacagcatcccggccgccgccagtggacagttcatccccggcgccgacgacacctgggtgcccaaccccggctttgagattcccaaccccttccgcccccgctccgactctccctgatgggccgagccggccggccgccagcacgtccacgccaacgcccaccgtccgcccacacgttgcacccgtccatctacttggtagagctagcctgctacaaatcattttccgctagctttttggttgctacaataaaatagctgctgctacatggccatgcatgcatgtgtctgcgactgcgttcgcgccgtcgacgtctcgtgtttgattgaagtgtacgtgtagtcgtctatgggatatggatggttgcgtaggaagcacccatcgcatgtctcgtttggtttgttgttgccagtgtaatgtgtttcagttcagtaagttttttgaataatgaagaattatgcatgatcgatt

SEQ ID NO: 36466 - DNA, 839 bp, Triticum aestivum
  Clone ID: PAT_TA_36466
cggacgcgtgggctagccagcgatcgagacagcaagaaagctcactcaactacccccagtcccgatcacaggtagctagtcactcggcgcaatcggcatggccagcaagtcggcgtccctgctgatcctcgcggcgctggtggccgcggcgtgcctcgccgggctgggctcggcggcgcgcagcgtgccggcggagaagcccgcggaggacgcggtgaagcggccggacacgttccaggaggggacggtgctgatcccggggatcgggcggtacgagctgggcacccactacatcccggacatcggcgggctggaccacagcatcccggccgccgccagcgggcagttcatccccggcgccgacgacacctgggtgcccaacccgggcttcgaggtgcccaaccccttccgcccccgctccgagtccccctgatgggccgagccggccggccggccagcacgcccacgttacgcccatcgtccgtccagttgcaccgatccatctactacttggtagagctagcctgctacaaatcattttccgctagcttttttggttgctataataaaatagctgctgctacatagccatgcatgcatgtccgatgcatgcatgtgtctgcgactgcgttcgcgccgtcgacgtctcgtgtttgattgaagtgtacgtgtagtcgtgtatgggatatggatggatgcataggaagcacccatcgcatgtctcgcttggtttgttgttgccagtgtaatgtgcttggtttgttgttgccagtgtaatgtgtttcagttcagtaagttttttgaatgatgaagaattatgcagtgatcgattaagcttg

SEQ ID NO: 36467 - DNA, 1119 bp, Triticum aestivum
  unsure (1)..(1119): unsure at all n locations
  Clone ID: PAT_TA_36467
cgtgacagcacgaagcatccagccagcgatcgagacagcaagaagctcactcaactacccccagtcccgatcacaggtagctagtcactcggcgcaatcggcatggccagcaagtcggcgtccctgctgatcctcgcggcgctggtggccgcggcgtgcctcgccgggctgggctcggcggcgcgcagcgtgccggcggagaagcccggcggggacgcggtgagaggggccgggaccggttccagggacgggacgggtggtgatcccgggggcgagggcgggaacgagctgggacgcccgacgacatccccgggcatcggccgcggctatcaccaggagcagcccgtcggccgcccggcaaaccggcactgcgctggcccggcggcggggcgaccccccgcgcttgcccgggccccgcgccttggcgggtgcgtaacacccggccggccgcccgatcccgacgcacccggtgccggaacccccgggtcggccccctgccctacgccgtttccgccctcgcccgccaccacaggcctgtcccccgagtgcttgggacgcctaggcagcccagcagcccgtccaggtcacttcattcgttgccatgggaagactactggcctgccacaattcagcttccgctagcctttcgtttgctagaatagctccggctcgccctccatgggacaggcatgagtatgcgttgtatcaagcgtctgcgtcccgagccgcgctgtcgagcctattaaggtgtgtgctcgtcagagtgtaccttgtatggggtatgcatggatgcggttttgaagggaagcttcctgttgcatatcatcaactttgcttttgttgttgccaaataatgtgtttcagttcaatgtatttttctttttagttcgataaattaatgatgaagtactatgcatgataaagcttgctgtgttagccacacncctgccccanntttaaaaaanaactcatgggggggccccgggagccacctcaccctnatancggtgcnnnaantnccctttnnncannntgnnnnaaaannnannagnccttnnnnntnnncnttncaaantntnncannnntnaangnnnnatgnnanntntaacnntnanntn

SEQ ID NO: 36468 - DNA, 988 bp, Triticum aestivum
  Clone ID: PAT_TA_36468
gaatgcatccgtcgcgcagaggacccaggggcgccctcggaaggtgccggcgcggggcggaggcgccggcaggtcgccgcagaccccagaacggagtcccagcgtggccgtgacgcccgagtgggatgccagggtcaagaggcagacgccggagaggggggcagaggcggcgaagacggcggaaaatggatgcgctctactccgcacgccggagtacgcatcagcagacctcaaggccaggcggatggagaggcgaacggggtccgtggtcgggccggatcagcctctagcatgttccctctccccccccctggagcgagagaggtaactatcggagatgagagggcttcgtgctggttttacaagtcatcttcttgcaagtgagagatcgatggaccgcagattgccggatttggagatgagagggcgccgacggtttcatgcctcgcgcctcgaccgcttcttcttcatacggcatggagcgtccttttcctctatgtttgtttatcttttctcgcagctaaattagcctcagcctgggataacattgctgcgaactgtggtgctctctgtagttagcttaggggagatgtatatggactggacctctacgtataaacataggagcacatatgatccttcctgtgcatgacgttggagattcggacccgccgttgttgacgtcgtcgggtcgtctcccaaccttgctgcattgggctttcgcatgtcgcgtgctatccggtcatgttttcctttttgtaaatatatacttggttcaagacgaataataatggatgtaatgtaagtgaattgttggtttcgatgtgaaaaaaaaaaaaaaaaaaggcccctagcgaagacgccggataggtggtcctctttaccccgcacgccggagtatgcatcatcggacgtcaaggccatccggaaggagaagcgaacgcggttcgtggccttgcctgatgagatcattgcttgatgacctttc

SEQ ID NO: 36469 - DNA, 873 bp, Triticum aestivum
  Clone ID: PAT_TA_36469
gccggccggtactcgcatctagaccattacctcttgtgctgtcctgtcatcaactgccctgcctcttacactcagaagattgtcacccagactgtcattgagcgcaccactgtctgccctgccactgctactgctgtccccaacacacccactgagggctctgacgagtctggcaagacccccgactcccccgacacccccaaggagggtggcaacgcttctcaccagggccctggcggtgacaagggtgccgagtaccctacccctggtgacaagactcctgttgagggcggtaatggctctggttctcacggcgatgctcctgctcctaccgctccccctgctgctgcgcagaccaccatcgacctcgtcaccatcacccaggacgtcaccaccattgttccctgcacgaagttcgtcaccagcaccttcgtcgcccctaccactgttcaccctcccgctgttcccgttgtcaccatcatcgacaaccacactggtcaggcccctcagaacactgctactgagcagcctggtgctttcaccaccctcacccgagtcatggcctctgccaccgactctggcgactaccctgctgccactgacagcggctctgatgctgctgctcccggctacgaggcgcccggtgctgttcccacctacaaggttcccaacaatggaaccgttccttctcaggttcccgtcattgccggagcctctcttgtcagtgttggcagcatgctgctcgctctccctatggccctcgcctttatcatgtaaatagcttaattactggaagcacttatgctttcaatgcccgaatcagatagaacgtaattcatgtacttcaaaaaaaaaaaaaaaaaaggcccccta

SEQ ID NO: 36470 - DNA, 895 bp, Triticum aestivum
  Clone ID: PAT_TA_36470
gccggccggtccgggaccaccccagaccagccaccaggaaacacctgcccgcagcccccctctcctccgccgcctcaacccgccgacccatcccggtctcctccgatggcgtcgagggcgctcctcctctgctccctcgtcgccctcgccctcgcggccggctccgacgccagggaccacgtcgtgggcggcggcaaggacggcgcgtggagggtgccgcccccggcgcagcccgacgcgctcaacgactgggcggggaaggcccgcttccacgtcggcgacaacctcgtgttcaagttcgacgcggcgacggactcggtgctggaggtgacgcgggcggactacgaccggtgcaacacggcgagccccatcgccacctacaaggccagcggtgccgtcgtgccgctgccgcccaagggcgagcgcttccgccacttcatcagcggcgcccccgggaactgccagaagggcgagcgcgtcatcgtcctcgtcatgtcggagaagcacggcagccgggtcccgcctgccgcgccggcccccgcccactccccctcgtcgtccgcggggctggtggaggcgcccgcccacgcgcccgcgcccgcgccggccactggcgccgcgtggaggacggcgtccggcagcggctccgtggtcctcggcgctctgctcggtgcgctgctcgtcgttgggttctgagttgctgttggttaggatcttagggaggattatttgattaggctctattattatgggcattgttaagcttagaggacagatgtgcttcttctgtctgtagaagaagagaagatggtttctttctggcgtaaaatcatcgatcataaatggcaatatattcgatcaatctttgagattccagatttaaaaactcgtgccg

SEQ ID NO: 36471 - DNA, 874 bp, Triticum aestivum
  Clone ID: PAT_TA_36471
gaggcgagcttcccggcgacggtggcactggcttgaggcgggggagcggctgatgcagggttggatcgaggcatgggagcgacggatgcgggcgtcgacctgcgaagaggcgagaggagcggtggttgcggcgttgagctgcgaagaggtgccgctcgggcgcgagaccacagaggcgggagcggctgcttcgggccccggccgtctcattcaccgatgacggcctccttggcctcaacatcaagggccgccttctcgcagagaagaacttcaagctgaagaggaagagcggcgccgtcgagttcgcctagaccatactcgacttcagaaagggccaagacgtcaggatcaaggccggatacgagctctatcgcaaggtacaaagctgaaatgcttgatgatgcgcctcgtatattcgaggctgttttccagtgtacccttgagttctgcactatgctctgctggatgtcgcctaagcagaggatgcggcagtctcggccacatttggttttcctaagctaatgttctttgttggttcgttcgaccctgccgttacccaacaaggcctctgatcatgtgtgcaatgtgcggcagggttgttcgtccgtctgaatcataggttctttccttcctgttttcggctgcttaaagactctttcgaagaacgggcaagcactatatacaccattcatctatgctaatatagcccgtcttttaaagccaatgtatgctatcaccaattgatcggaatattttctttcaagcatagctttcatgtaatggaatataagtatctttataagttgattctaaatcaatatcatacacatactttgaatgctaaatataagaaagaaccaaagggggaaggggc

SEQ ID NO: 36472 - DNA, 1587 bp, Triticum aestivum
  Clone ID: PAT_TA_36472
cggtccgccccccccctatcctaaccctagccacgccgcgccgccccgccccgccatcctcgatccccaaatcccttctcctccaccaaaccctaatccctagctacctagctagccgccatggcccctccgatggttctgctcgaccgcgaggttgagttgtgcgacgaggaggcggggatctgcgaaggaccaatcggctcctcgtggggccggctcgcccgctagaacatcagccaagggccaggaaaagttgatactcgcagccgccaagtacctgcagaccctaggcctccagtcgggccacaccgatcccgcggacatgaacctggtcaacatacacgccggaggataccaccctggcgccgatacgtttgcggagatgggagcctatctctcctacgacgccaagcacgtggtcctcttctacacccccccttaccgccctggctacagcttgccggggaggtatctcatctacgacgccagcaaggactccatctccgccatccgtggcatccaccttcttgccgagctcgtctgggtcatgccaggattctcccgagcccgcgtctggctgcgggagtcgtcaaggaaactaccgtcttgctggcctcgtctccggccccccccacccctcccacgccgcgctctggctctccgtccactcgtgcttctcttttgggggctctttcctctgctgggtggatctacaccgtggcatggtgctctgtgatctgcgccaaggactgcaacttcagcttcattgagttgccccaaggacctccaaactatgatgcctccgattatccacacggcctctgcgctgaggagttccgttccgtggcctgtgttcatggctccgtcaagttcctcgccttcaataaatttgttgaacgcgagcccggcgaaacatttggactggccgtctggactctgtcgcctgaccactcagcgtggagcagaagctacaagtgcagcgttggagacatctgggctaacgccaactaccagtctgctggtttgggacagcttgctccgtcgttccctgtcctgagcatccatcaagacggcgtcgtctacctagtcgtaaatgataccagtgtggtgggccgtcgactagtgttcaaagaccagtacttgcttcgtgtcgacatggggaataacaacgatgtccaggtctatcaacagaagacgacgcgtatttattcccagctctttgcaagtgagttcagtgcgcaccgacgacaggagcacccgccagagagagatggaatctagcgagtttggtgcaagtggaaagaggatgaaggcctgagatccttgcaacatatcatgtggaaatttgggccgcaccattatcagttgtttctgcttaggaggtccactggagacatttaatgtcgtcattatcaagtagtagtacttaaactggatgttgggtagtatgcattatgtatgagtcatggctctatgtctagtgagtggcttcttttggattgtaacttgcaccagtgtcattttcttgcatgaatcctactggtttaatttagaaacaatattagatgtttcgaactaaaaaaaaaa

SEQ ID NO: 36473 - DNA, 767 bp, Triticum aestivum
  Clone ID: PAT_TA_36473
ctgtgcggcgattaggcgccctcccgccctgggccaactgcttaatagtcttctggcctctggccggacggagcccgacccctcccccgccgcccccgaccccgccgcagcctcctcgtcgagcggcggccgccgtctccgccgcacgcgcctcgcgctagaaacttgcatacctgaacagcctcgaagggaacgatggcgctatcacgcagtatgagaacatgcttgcatagcggaagacttgccgccctggcaatacttgtctctggtgggatcgtattgcagattttggcatgtgctctttataacaactggtggcccatgttgacagttctgatgtacctcatactacccatgccgctcatatttttcctgggctccgattctccatcgatcatgtcaaatgagaatgatgggtgggtgaacttcaccaagttcctgacgggcgcgtccatcgtgggcagcatcgccatcccgtcgatcctgaagcacgccggcgtcatcgggtggggcgcgctgacgatggagctgtcctccttcgccgtcttcgggctggccatcgtgtggttcctccagatgaactccgaggacgagtacagcgccttctgatctccagcgcttcatcctctcccgcgccttctgatctccagcgcttcatccagtcctgaacctgtggtctgtgtgtttctagtggtgcctcgctagaaatagggatcatcaacttgtgaatatctacagtacgatttggagcattggtgtgcttgacc

SEQ ID NO: 36474 - DNA, 1461 bp, Triticum aestivum
  Clone ID: PAT_TA_36474
cgtcctaaaaaatcattgatattcaagaggccatgccagatatagaaccaccatcgcccctctttggctccgtttgctgagtgtaacctgctagctctagaaatgggcttcctcactgcaagcggtgctacttcatgcaaagatgagattgaaatttatgttgtggggtcagggaaatggcgtcatttagttatcagtccggtgaactcaggaagtcatttatcagattttgggagttcaggtgaacatgaaaatttgatatcactcagatttgctagacagtgtctactcaacgcccaactattaatggatgcttctgagcagaaaaaaatggcgatttcagatacagaggagtgcaaccaagggtcacaatgccagaaaagttcaggccggagcacaatgagtgtggaatccaaagtccactctggtccaacaactaatgcaaatggagaacaaaagggagccgcgagcttgaatgccactttgcagagctctcttgctatgtatgatgacatcattagaaaagagaacctgaaaattcgacaagccatcctgggggacctggcgttcgtcgaattgtgtcttgagaatcccttgaaagctttgtctattgccaactcactgttgcaggttccagactgctccaggatgtacttattccttggccatgtatatgcagctgaagctttatgtttgctgaacaggctaaaggaggctgttgatcagttaactgtttatttgagagatgacaatgctattgagttgccctacagtgttgagaatcgtgaaaaggcccctgttgagaaagacagcgatggcgaggattcagtcactcctgccatgacaaaacttacctcagaagaatctcagcactcaatgtctctcaagcccgaggaagcctgtggggttctgtatgttgaccttggcatgactgctgcagtgcagggagagcttgagcaggccaattacctggtgagccgtggttttgcaatgttgcccaacagccctagggcactgctagcatccatctatgtggatcttctgcaagggaaggtgcaagaagctatcggcaagttgagaaggtgcagaaacgtgagatttaagaccagtagtgtagcagccagcagataagacttgcctcgttttgatgatttatctatagttgataattgccatttcttgagttggaccccgaccccatgtggatgatcatcctgaaagattgtaacgttttcctgtgtaccatacataagaaaaagaactttagatctcctccctgtcccctctttagctttcccagattcaggggtgtaatttgtgttactcgagttttagagcccctctttggactgaaatgatgataccttctgatattcctttattcaggaaagaaatgtgcaaaaggcatcagaatctaaagaacttaagtatatatttcggtgcatttctaaaaaaaaaaaa

SEQ ID NO: 36475 - DNA, 871 bp, Triticum aestivum
  Clone ID: PAT_TA_36475
gccggccgttcccaggtctctctcctgtatccgctcgccgtttacccaaacccttgcccccgcgccgccacccccaagaaccccatcggctccggtcctcctctcctctggccggcatcctccaatggccaccaagtcccaaaagaagaagctctccgcccctaacccctccgtcgacgccaagaagcccaaacctcagaaacccgtcgaggagcgagagacggcggtggcggccaagaagccaaaaccgaagaagcagaaggagggcaaggaggcctctgccaagaagccgaaggagcagaaggaggtctctgccaagaagacgaagaagcagaaggagagcaacgagatcgacgagatcttcgaggccaccaagaagcgcaagctgcaggagcaggaggaggatgaggaggggtccgaggggggcaagaagcccaggaagggcaaggccgagggggctagtaagaagaagagcaagaaggagactgggggcagaggctgggagcccggccacgatgatgaggtcgaggagaagcggccgcggcggcgcaccaatgacgggctcaccatatactccgccgacgagctcgggttcggcaaggccgacgccggcggcaccgccctctgccccttcgactgcgactgctgcttctgagcccttcaggggtcctccgtgcctgaggtgatgtaatcgggttacgtcgcagtggtgtttgttgtaatgcctggttgatttgatgactatgtgcttagacgtgtgatccgatgaaatggaatttcagttttatacaagagctcaagattacctgtctttctagctcaccagttacttgtttcacatttcctttagaaaagcctacctgtttcgagc

SEQ ID NO: 36476 - DNA, 1039 bp, Triticum aestivum
  Clone ID: PAT_TA_36476
atttctgtccatgcagtacctcgaagactccatgctacgagcctcaaacgccgtcacgtcacgtcacttacgcttttttcttgttcgcggcgcattaaagctctttacaaaatgtccgatatcgaaaccgtctcctcctttgtagagggagctcccccgggagagctcgccgacgttatcgcagatatcaagtcgctgacgctcgaaaccaaccccgatatcgtcaacagcctcacccccgccttcgagaagtacaatgaggagcaatttgttacggtgaagctgcctggtagcagccaaccagttatcatcagctcctacaactcccttggggatggccgatacttcgatgtcgagagctcttccagttttaccttcgaccacactacgcagaaagccagtgctgtccagagccacgtattgaaaggagctcaagcggacctcgtcaagtccaccctcaagagcatcggtccctacgttgacgagcactttgccaatgctgcgcatggcgtctacccaatcgagtcggactccaagattgccatcgttattgtcggcaataaatatagccctaacaacttctggaacggacgctggcgatcgctttatatcttggacccttcatccggggccctcgagggctctctcaaggttgacgtgcactactacgaggacggaaacgttcgtctcctgaccaacaagcctgtctccagtactatctcctctgccaacggcgccggtatcgttagagaaatctcggcaatgggaagaggtaccaagaggagctgaacaagggtttcgtgagccttagcgagggtgcattcaagggtctgcgacgacagctgcctgtgacaagacagaagatcgaatgggaccgcgtgacaagctaccgtctgggccaggatattggcaacggaggctcgaggcgatagagcatgattttttgaagcgtatgaatttgaaagatagaccagttcaaggagaaacgtagagtaaatgcgatgggttgatgcaaaaaaaaaaaaaaaaaaggccccta

SEQ ID NO: 36477 - DNA, 599 bp, Triticum aestivum
  Clone ID: PAT_TA_36477
gccggccggtccgggggcaagctgcactcattcttttattagttgttagttattcaacaggccgtttcgcaagatgctcttcttcaagtctatcgtctctctcgcagccctcgttggcgctgctgttgccagccccatcgagacccgccagtctgccactcgatgtggcagcaccagctactctgctgctcaggtcaaggccgctgccaatgccgcgtgccagtactaccagaatgatgataccgctggtagctcgacttaccctcatcaatacaacaaccgagagggctttgactttcctgtgaacggtccctaccaggagttccccatccgaaccagtggtgtttacaccggaggctctcccggtgccgaccgtgttgttatcaacaccaactgtcaatttgctggtgccatcactcataccggcgcttctggaaacaactttgttggctgcacgggtaccagctaaatcaccttttccatcacagattgagcgatgcgtttcttgtaaatagtcttagcatgattctatcagcactgaatatacataaagccttttctttcaaaaaaaagaaaaaaaaaaaaaaaaaaggccccta

SEQ ID NO: 36478 - DNA, 891 bp, Triticum aestivum
  unsure (1)..(891): unsure at all n locations
  Clone ID: PAT_TA_36478
gccggccggttcgggaagatccagcgagagacgaagagaaatccccaatccaccaatccctaacccaccaggagagatcggcgagagagacccggcgatggcggttgaggagatgcagtttgccatgccgatggccgccggctacgagggatttcacttcaccccgttccaggcggagaaggagcaggcggagttgttcgtcggggccaccagggcggagccggcggaggacgaggcgttcgtcagggtcagggcgaagacggaggcggaggcggaggcggcgatcctcaaggccaaggcggaggcggagaaggtggcggcgatcttcaaggccagggcggagaaggagcccaaggcggatgtggaggaggaggctttcgtcgtcaaggccaaggaggagaaggaggaggcgttcgtcgtcaaggccaagtccaaggcgaatgacccggcgttcatggcgctggcgggacagaggggccctggtatggcggaggcggacgagatggactacatgtcggacgagacggactacggctcggacgaagacattgacgtgacctacgccaagatgtgtgagcggttcgagctgcgcaggcgggtgaggcatgctcacatgccctggctcaagttccagtccgctgcctccctcctcaagatgcaggaggataacaagggacggcaggaggaggtttccgtggtcgtctgagaagcacagagacaaaggaggtcaccgatgccagtatctataatccatccatgtagctatctatctatatttgtagctgaaccgtatgtagtgatccatccncaccgttatgtatgctctcatgatcaagttaggcaccgatgaaccaatgttatgtgcccactgataaattatctaatggtatc

SEQ ID NO: 36479 - DNA, 644 bp, Triticum aestivum
  unsure (1)..(644): unsure at all n locations
  Clone ID: PAT_TA_36479
aagctcgccaaaagccctagccccgacgctctgctcagctccagctccccaatcaagcgaggcaaaagccctagcccgcgagctccggcggccgccgctccctccctcccctcccccgcacgagcggcgcggcctccgtccgtcccctcaatcggggtccagcaatgccccggcggcggccgagggccggggagaagcggatggacgccgcgatcgaccacttcgccgagatgggataccgcaaagccgacgtccgccgcgtcgtcaacaagctcctcaaggatgtgtatgggaaggatgggtggccgttgctggaggacagttgttactccgtagtgcaagaagcgctctttgagatggaggagcaggagaagttgcagcagcagcagcagcagcagcagaatgaggatgatgatggtgatgatgagggggaggaagctcatccggagccgcagcaggaggacgtggaggaggaggctccgcagcaagaagtagcaataaaggaggaaccgtcagaagagttcattcccattgcgatggttgtaccaccatctgaggcagtgctagcagttgggcagacagaggaagcggaacccccgctcgtcgacccaccttctcccagagctgcgtcgccagatncntta

SEQ ID NO: 36480 - DNA, 643 bp, Triticum aestivum
  Clone ID: PAT_TA_36480
tcccacgcgtccgcccacgcgtccgcgcatatcccaaagcagaaacgcaaaagaaaccagcaatccaagcacgcggttggtgcgaagcagccaaggaccaacgaagggggagggagttgacgatggggcagtgcggatgcttcggggcggcgcagaaggagcagcgggcggaggccgaccgcctcgaggcgcaggaggcccgcgcaagggccgccgaggccgcccagaagaggcagcaggaatatgaaaagtcagctgctggacgagcagcacgagcacagattaaagctatgaaggaggccaagacatcatcaaaccaaggagagccggttctgaagtggcagatggggtaaatcatcgtatgtgcccttgcaaccttcagcgtgttgttgatggtgcgcggaagcttgttttcttttgatcacgcgatgcagtttggtcacctaactcatttgtgatttttatcagtgaaatgtacatccttttagtcactgctatacacgcttattcagagagagtgtatgtattgcccaatttgtcttctagaagtgtgtggcgtgttactgtacattctatagacagtggtggttgtctggcaaagtaggtattttgcttacaaaaaaaaaaaaaaaaaaggccccta

SEQ ID NO: 36481 - DNA, 348 bp, Triticum aestivum
  Clone ID: PAT_TA_36481
aaaaatgaagggagagtgaataattattggcagcaatcatcatatatatacaggaggaaattgatcgtgatcatcaacaggcccgtgtgccaacccagggcagcttcacggggccgatgggccaggcggcgccgcgcactgaatgccacgcggggccaccggcgacggggccctccacggcccacgccatgcagcatcgtcacaccggcgacgcggagggcccggcgccgctgatcgccgaccgccaaacggggtcgacctcgccgtcggcggcggcggcgagccaggcgtcgacgtcgtttaagagcgcgcgctgcttactgggcatcaaaggttattcttatctta

SEQ ID NO: 36482 - DNA, 1197 bp, Triticum aestivum
  unsure (1)..(1197): unsure at all n locations
  Clone ID: PAT_TA_36482
tcgagcggccgcccgggcaggtactcctatgaaagccattgtttctttatcctccctccttctggaaacagctcttacggctgaacaacgcctgatgattgagaccatactaaagagtagcgattttctagtaactttgaccaacgacgttttggatatttccaagcttgggaatgggagtcttgagctggatattgcacctttcaacctgcatgctgcctttacagatgtggttaatttgattaagccagtggctgcatgcaaaaggctctcggtaatggtttccttggctccagagttgccttcctgtgcaattggtgatcgcaagcgattgatgcaaataatgctgaatgttgctggcaactccattaagttcacaaaggagggccacatttcaattgcagcttccatagccaggccagtgccgcgcagggacccgtatgcttcttacttgcatccagttccctctgatgggtctttctacttggttgtcaggtaaaagacactggctgtggaatcggaccagaggatatggctcacaccttcagaaaattcgcacatggtgagaatgcaacaacgaaattgcacaacggcaacgggttgggtctggccctctccagaagatttgttggcctgatgcaaggggacatctggctcgaaagtgaaggtgtagggaagggatgtaccgccacgttctttgtgaaactcggcacgcccaagaaaccaaatgtaaatgcaaatcctcgaagaatgatggcgcctctacaaccaagcaaaggtgctggaggccacggcgccgatgctctcagtatatcgataatggacagtgatgcgcggggccctagggcccgctaccagtcgagcgggtgagaggcagaagcgtcgtcagacgcacgcaggcaagcttgactgaggggaggcgggtcgcaggcccgattttgtgaccgtgtacgctcccatttgaagagtgggtgtttggctggtgcagggatagatttcctactgagttgaattgtgatggtgactaggtccagtctgagatggtgactttgcccttattggcggcatggtggaggagagcagtgatgtgttgtacatgagggtcttgttagggaggcaaaagctgatactacatacattagttaggcactgcggcgagatccctgtgaagaagtcagtgagctgcagngtgtaatt

SEQ ID NO: 36483 - DNA, 718 bp, Triticum aestivum
  Clone ID: PAT_TA_36483
aggagaaacccaaccccccccgcgaggatggaccgaaaccctcgcgtcctcctccgcgccgccgcctatctcctccgcccctccccccccgccccgcaccccatcccgtgacgaacgccacccctcccccttcctcttcggcgccggatcctccccgcccaacgccacgccttctcgtcgggacagggcaaggacatggacgcggtgaagcgaaacttcacttcggcgaagggggggatggaagcggggatggccaggaaaggcaaggagacggtgtacttcaacgaggaggccgcctgcgcgcgcgacgcggcaggccctggccctctgcgccgtccgacgtgctcgggtccggggcgtcccccccgccggacgccgcagctctacgcgggttcaatgggggctgcagatgggcgatcaccaaaggccgggctcatagtagttctttgggggccattttttggcagcgtatgttgttgatagagtatgtttttaagagagattttttctattctgattcgtaagttagagttcgtctgtttttttagtatttcctgggtcttcacattgggaagcaaaattccgattgggatgcaaatttgtagcagaaaatttgtactggagctaatggtacatgctgatgcaaattggtagcatacaattcagtactaaaaaaataatatttatgttcataatggattgatggaccctctctatt

SEQ ID NO: 36484 - DNA, 375 bp, Triticum aestivum
  Clone ID: PAT_TA_36484
gccggccgggtccggttcacttctactacccattttattacacagtacaccttttcgacatgcaacgcgataccttttgatgagtaaagacccgatgatgcaagctttagtaaagcttggatgaggtaatgacacgcttcggcgtaaaggtaggcggattggggaatcatggattggcctgcaagtgagtgacagccttgcacagcctttcaggggatgagagaatggcaacggccatggtggtggttatttgtttgtgcgttaccatccaattcaatcatagcaagaggcgaaatggagtaggaaaacttttgatattgaacaagcaatgaagaaacatcttttctgcaaaaaaaaaaaaaaaaaaggccccta

SEQ ID NO: 36485 - DNA, 696 bp, Triticum aestivum
  unsure (1)..(696): unsure at all n locations
  Clone ID: PAT_TA_36485
gccggccgggcttgcgcaaagaacacaaccgcatccagcgatatcgtcgtcttctcttgacgtgggcaagttttcgatctcagctttcgggacctgatggagagcaaggaggctccggtggcggcggcggcggcagcggtgccggagaaggagtcgacgtcgtgcttcaagagcacggtgggggaggacgcgtcgctcctggagaaggccaaggaccagtacaagcagttcacgggggcgcaggcgggcgagcactgggagtgcctcaagaacaaggtcagctccatgttcgccgaccccatccccttctttggcggaggcgccaaggaccacggctccaccagcaacacgccgccgtccgtcgagtcacactaaatcgtcgtcgtcgtcgtcgtctagatggcctatcgttactactactatactactactactctatgaggatcactagttggttgggtcttatttttagttctggttaaaacctgtatcgtcgtcattatgttcaagtctggattaaacttgaggaactgtatattgtggatttttgacttaattgaatcagtcaagtgattatgtcgaacaagagctctttttttcgtaaatttttttcactttgtattcccttctcgattcaaatanagttacagattgtttttaaaaaaaaaagaaaaaaaaaaaaaaaaaaggccccta

SEQ ID NO: 36486 - DNA, 752 bp, Triticum aestivum
  unsure (1)..(752): unsure at all n locations
  Clone ID: PAT_TA_36486
gccggccggttctacacaccccaacacaaacctccagtcctccccgcgcgccgcaaccttccccaacccgatccctcgtcgcctccacctccggcgaaaccgccatggcgcccaaggccgagaagaagcccaccgcggagaagaagccggtggagacggagaagaagcccaaggccgagaagcgcgtgcccggcaaggacggcggcgccggcgccgacaagaagaagaagaaggccaagaagagcgtcgagacctacaagatctacatcttcaaggtcctgaagcaggtgcaccccgacatcggcatctcctccaaggccatgtccatcatgaactccttcatcaacgacatcttcgagaagctcgctggcgagtcggccaagctggctcgctacaacaagaagcccaccatcacctcccgggagatccagaccgccgtgcgcctcgtcctccccggcgagctcgccaagcacgccgtctccgagggcaccaaggccgtcaccaagttcacctcctcttagattgcctgccgcccgccgaggctcttgtcagtctggttccgtttcttcgtgtgtcaacaatcgcaggggcttaggatcccctatacaaacagtgtaaaatgagtcggattatctgaatcaatgaatcatccagtggttgtttcaattgtgctgtgcttcagttttatgatgatggcagttgttttattgttttaaactcttttgatgcgaaaaanaaaaaaaaaaggccct

SEQ ID NO: 36487 - DNA, 1173 bp, Triticum aestivum
  Clone ID: PAT_TA_36487
gccggccggtccgggattgctcactcacttgagaacaactgcgactgatatatatcttctgtggccgcttacactttcctgttgctctcatcatgaccaaggttctcctcaccggtggctcgggcttcatcgctgcccataccctggaacagcttctcgaaaaggattacagcatcgtcacaactgtccgctcagaggacaaggcccagaagatccgcaacgcattccccgacaaagtcaaggatggcaagttggagattgtcattgtaaccgacatcgcaaagcccgatgcttttgaccaagtggccaagactcccggcctcgatgccgttattcacgttgcaagcccctttcacttcaacatcaccgatcccaagaaggatctcatagatccagctgtcattggcacaacgggtatcctcaaagcccttcatgcttcagcacccaacgtcaagcgcgtggtcatcacttcatcattcgccgccatcatcgacgaggccaagttcacagacggatctcacgtcttttccgaaaagacatggaaccctgtcaccattgacgacatcacccgttccgatacaactgcttaccgcgcttcaaagaccctcgctgaacgtgcagcctgggactttgtcgccgagaagaagccctctttcgatctcgtaacggtttgcccgcctctggttctgggtcccgtatcaaagcacctcgctactctggagagcatcaacacgtccaacgcccgtatcgtgaatcttttgcgaggcgagtggaaggacgagattcctccctgcacgcccgttcctctctggattgatgtgcgagatgctgcgcgcgcacacgttcgaggtcttgaagagcccagcgctggagggaagcgactctttaccacggcaggattattctcacaccgtgagattgtcgacattattgctgagaaattcccagagttcaaggataggctccctgggcctgaagtcaagggcggagaactccctcccaaagaccagatttttggaattgataataaggagacgaacgagctgctcaagattgactggctcacagtggaaaagagtatgacggatctggttgagtcactcaaggagattggcatctagaaagttgaatgcataataaatagtataaaaaaaaaaaaaaaaaaggccccta

SEQ ID NO: 36488 - DNA, 1254 bp, Triticum aestivum
  Clone ID: PAT_TA_36488
tgactccgccaaactgttctcctcaacctttaaacgtgttacacttcgttcaagcgctggcctatcgattgcggcagcggcagctacattccaaaaaacaactagaaaaccagccgtcgagtttggtgtaaggaaaatgcacagcaaggttgtcattatcggttctgggcctgctgcccacacggctgctgtctacttggcacgagccgagctgaagcccgttctctacgagggtttcatggccaacggtatcgccgctggcggtcaattgaccaccaccaccgaagttgagaacttccccggtttccccaagggtatcatgggaggcgagttgatggacaacatgcgagcccagtccgagcgcttcggcacagaaatcatcaccgacaccgtcgctaccctcgacctctcttcccgcccctacaagtacacaaccgagttctcccccgaggagacacacaccgccgagaccgtcatcctcgctaccggcgcctcagcccgccgtcttaacctccccggcgaggacaagtactggcagaacggcgtctcggcctgcgctgtctgcgacggagccgtccccatcttccgcaacaagcctctcttcgtcattggtggtggtcactccgccgccgaggaggccactttcctcacaaagtacgccagccacgttaccgtcctcgtccgtcgcgatgtccttcgtgccagccgaaccatggccaaccgacttcttaaccaccccaagtgcaccgtcttgttcaacagcggtgccactgaaatccgaggtggcgaggatggcctcatgagccacctcgttgtcaagaacaataagactggcgaggagaaggttcacgaggccaacggtctgttctacgccatcggccacgaccccgccacgaccctcgtcaagggtcaggttgacatggatgaggatggttacatcaagaccatccctggtacaacatacaccaacgtcgagggtgtctttgccgctggtgatgtccaggacaagcgataccgacaggctatcaccagtgccggtactggatgcatggctgccctcgaggctgagaagttcctcgccgaccacgagatgacgagcgagccgacgagcgacccaaccccaactaagaaatcaaaataagacacatagaaactttcatatagacttgccccattttagacatgatatagaaatctgcataaaaagcatgagcagtcaatagacttttcatctaatttcatttaagcgttatc

SEQ ID NO: 36489 - DNA, 628 bp, Triticum aestivum
  unsure (1)..(628): unsure at all n locations
  Clone ID: PAT_TA_36489
gccggccaggtctcggaaaaaaggcaagaaaaaaattgatcatggccccttcatcttcttccctcgcccgcagcatcgccctcctggctctgatctgctgtgccttcgcatgctccacggcggcacaagttgctcgaggggggagccgtgcgccggttcgtcctccgtcgccgcagttcccgtcgccaaggcggccggggcaggcgccgctcgctccaccgccgccgtcatcaacagaaaggccgacggcgctcacggcacaccggaagaccatggagattgctgcccgctagctctgaattgaagatgaggtcgacttgtttttacttggtgtatacatttggccctgctgggctgctggcgctaagggtactgtatttggtttcgtttcagcctctggtttagaattatgtcacagtgcgctgataataggtctcgaaaatgctatcgttcagatgatcctatcatctcgattaataaacatctgattaatatggaaaaaaaaaaaaaaaaaaggcccctaaccaggtcctcgatctatacagaagtatgtcgggtgtgtacaatttcnnngnannnnnnnnnnnnnnnnnaannanangaaaaaaaaaaaaaaaaaaggccccta

SEQ ID NO: 36490 - DNA, 661 bp, Triticum aestivum
  Clone ID: PAT_TA_36490
cggacgcgtgggtttcaaattagtgattgcaaagccttattgaattgccgcttttgaatggcagggactggtgaagcacaaagagtgacacatggaaatggcgtgcaacctacttacacatagaatatttcaagagattgttccttcaaatgctggaaatgttcttggtactgaagataacgttctgacaaagaagcgggtatcacttattgatcaccaggtgatgaatatattggtggggatgcaagaaatgtaccatatttttcaccattcccatatggctatcgtacttcaacacctatggaagaagatgatgagcagccaaatacttctagttcctattgtaaataaagcaaaagaagttttgtggcaaagatgcagaccgcaagaccaaactaagccttccatgagtctctcattttttgaagctctcacagataagttaaggctttcgtagcatgttatgtaggaaagttataatcattgattagaaaagcctcaaatgctcctctcaccctggtgaaaagttgtgaatgatgttctatagagatttttaatttaagtgcatggttgtcaatgagcttaatcctttgtaaatccaacaagattctattgatgcagttctattgagtatattctttcttttttgaaaaaaaaaaaa

SEQ ID NO: 36491 - DNA, 762 bp, Triticum aestivum
  Clone ID: PAT_TA_36491
gccggccggttcgggaatcttcctaaatcccctctcttcccagactcttttacttaatagtctaacacaatggcaccatctcaaacccaagaagacaacgccaccggctccaagagctctgacctcttgaagcactccaaagaagaatcagttcttacagacaaggaccgcaaggcacttgtattcacagacaagcatagctccccagatgtatacatcagctacaacaaggatactctatggtatccttgggtgactacgttggaggtcaagcctcttcgatttgagactcggtcaggcagtttcgtgattgcattgcgtaccccagtcgatgcatggcttggaaagcatagacatcgaggcaccgtgaccgctgttacacttgcgggtaactggggatacaaagaatacgactggacagcagggcccggcgactatgtcgttgagaacccgggcacgatccacacactgttcatgggagctggctcagaggtagtatttaccatcaccggtagtcttgagttcttccacgatgacgatagtttgaaggagacgatggacatttttagtttctcgcagttgtattacgatcactgcgaggaaaagggcgtggagcccaatgcgggtctgtggtattaagagataaacaaggctaatacatcaccttgatgagtacacggtctttcataagttgtaaggatgacagcatagtaataatttattggaagctcgtctcgaaactatttctaaacaacggatcta

SEQ ID NO: 36492 - DNA, 689 bp, Triticum aestivum
  unsure (1)..(689): unsure at all n locations
  Clone ID: PAT_TA_36492
gccggccgggatcaaaaaggagattccgtgctgtctacgttttgcagatttcagcagacggccaaagcttgaccatccccttcttccttcaacatttgacggccggcaagctcttgtcctcagtgcagccaaggcaggcggccatggacggcgacagcccggtgatgacggacagcgagcggagggcgtaccggtacgtgcaggcgcccaaggtgcagggcctgggcggcatcaagaactcatggtccaacgactccctcttcagcctcagctacgccggcgcggggggcagggccgtcgtccactcgtgcgtctgcgcgcccaccacgcacccgggctccttccgctgcaagcaccaccgccagagcgccgcccacctcggcgtcgccggtcacgcgcaagcgcagcccacggctgaggctaagcgcaacgaggtccacggagaaatgtcgaccgcggatgacgagaaggcgtcctgaaggggaccgcgtgcgtgtgtttcttcatgggacaaaacgtaccgtgctgcttggtcacacgtgaccggtgtagtacgtggcaaagcttattcctctgtcatttcaaagacttttttcgtgtgtaaggatgtttatttgttttctatatttgtgagagaagagcgtttcattttcccagtagttatgtangagtaatatattgttgtatat

SEQ ID NO: 36493 - DNA, 804 bp, Triticum aestivum
  unsure (1)..(804): unsure at all n locations
  Clone ID: PAT_TA_36493
gccggccggtctcgcacaaaacaagacagcgcggagtggagagtggagaaccaagccgtagctccggtaaagcttcagctacgatgaggacgccgccggagatgccgctgggtctccccttcaccgtcgacacatggggcccatcccgccgccaccggtgccaccgcttcatcacccacgcgcacacggaccacattgccggtgcctgggccggccccggcgacaccgtctacgccacgcagctcaccatgcgcctcgccctcgaacgctatccccagctggagcgggttaagtttgtggaaatggaggtgggaaagaggtgggtggtggacgaccctgacggcgccttttccgtcaccgcctacgatgccaatcactgtgctggagcggttatgttgttgttcgagggtccatttggtaccatactgcacacgggggactgtcggctcacatcacattgtgtgcagaaattgctactgaaattggaagcaaatctttgccggttggacactgtgtacctggacttgacatttcccaaattcctcgagtttccgagcaaggagtctgcgattcagcaggttatagcttgcatatcaaagcattcgcgtgcacctttcatttatcttggatgtcaaagactcggccaagaaaatatcttaaagaggtgtcagggtcatttagatcgaanatctatggtgataagggactgtactttggattggtttaacacattgtcccacactgtcccntgaataatcactgatgatccaactggtcgcttccaggtactgccagttcgatccg

SEQ ID NO: 36494 - DNA, 1260 bp, Triticum aestivum
  Clone ID: PAT_TA_36494
gccggccggttcgggagcgaaagtccatctcacaagaagtggaagcgtcaggcggatgacgagtcttggtatgatgagtttcacaattatgaagatcacatcgattacttccgagacttgcatgcgcagtttcccaacaattctaagcttgtttcttcaggaaagtcgtaccagaacaggaacatttatggacttcatctctggggtgaggctggacctggaaagcctgctgtgctttaccatggtactgttcatgcccgagaatggatctctgcgccaactgtcgaatacatcaccctccagcttatcaagggcttcaagggtggagataaagacgtccagaccatcttgaacaaatatgacttttacatctttccatttgtcaaccccgacggttttgtctactccaccacggctgatcgtctctggcgaaagaaccgccaacctcctcctacttcagcaccaaaccagacatgtctcggtcgcgacatcaatcgcaactgggagtttggttgggattccaacaagagaggtgcttcgacaaacccttgttctcagacttatcgcggcgagaagccagctgatagccctgagaatgctggattggacaagtttgttcgtcagctgagagacaccgttggcattgctctctacattgactggcacagctacggtcaatacatcctttcgcctttcggctacaaggaagacctctacgcgcctgagcttgggccgtggagggaagcagctgccctcgtcagcgaggccatccgcgatagctctgacgacaagacaacctatacattcggtcccagcggtgcagtgttgtacgtcaccaccggcgcggcgcctgaccacgtttacagcgtaggacaggccaagttctcgtacacaattgagttgagggacactggcgagaccggatttgtgctcccgccggctcagatcagacccaatgttgaggagcagtgggctggtcagaaggtgttgctttctcttttggatgagactttcttcgatggctcgggtcctgctctctaccagggacagacttagggcaccttgaatatcgcctagaggggggttctggggatgtggtaggacgttggaaggtttgcgcaagttcagagttgcgaaacgcttcagctacctgcgtaggtacattttcatgtatatacattctgatttatatattatgtataaattatcacagcttagactcattgcctggcgcaaaaaaaaaaaaaaaaaaggccccta

SEQ ID NO: 36495 - DNA, 439 bp, Triticum aestivum
  Clone ID: PAT_TA_36495
cgagaagacgaagaatccccaggacatgatcacgacggtgatgctgtacacagtcatcatgtagaagatgccggacatgatgatgaggaagatgcgggagcagacgaagggcatgatcatgaagatgaagatgccggcggagcagacgacgatggaccatcgatgggctgggtgcaggaccctcatattcaagagctgcttctcaagcagacggataacgcaagagctgccgcccgagagaaagccaagctggatcaactggagatagacgcggttactccattgtatgaaggatgcaggcccgaggatacccgcctgaaagtaacgctcatggctctggagatgaaggtaaaacacaaaatgaccgacgcatgcttcgacgagaacatgtcattctggcacgaacgtcttcccaaggggaacaagtgcccgaccagtt

SEQ ID NO: 36496 - DNA, 965 bp, Triticum aestivum
  Clone ID: PAT_TA_36496
ccggcccgacgcaggccggagcagaaatgaggaagggcaccaagacaaccaccgcggctcgggggggcgagaagacgaagaatccccaggagatgatcacgacggtgatgctgtacacagtcatcatgtagaagatgcaggacatgatgatgatgctggcggagcagacgacgctggaccatcgatgggctgggtgcaggaccctcatattcaagagctgcttctcaagcagacggataacgcaagagctgccgcccgagagaaagccaagatggatcaacttgagttagacgcggttactccattgtatgaaggatgcaggcccgaggatacccgcctgaaagtaacgctcatggctctggagatgaaggtaaaacacaaaatgaccgacgcatgcttcgacgagaacatgtcattctggcacgaacgtcttcccaaggggaacaagtgcccgactagtttggaggaggcgaagaaaatcgtgtgtcctctggatttaccgcacgtgaaataccatgtgtgcatgaacaattgcatcatttatcgggacgagcactcggagtctaccatatgtccggtgtgcggtgtcactcggaagcatacttcgacgaaagctcctcgaaaaggggtgtgatactttccgatcactcctcgtctgcagcggtatttcgcgggccctaaggtagcaaagctcatgcgttggcacacggataggaaggagaagaagcgggaagatgacggaaatgatccggagataaattaaaaagacaagatgctgagtcaccctaaggatgcgagccagtggcaagtgttgaacttcgaataccccgaatttgggaaggaaccaagggacctcatggttggcgcaagcaccggttgggtcaaaccgttttgccacccggggagcgacgtttgccgagtgatctggaacgatcgagctcttctcccttcgtcgacccgggagt

SEQ ID NO: 36497 - DNA, 516 bp, Triticum aestivum
  Clone ID: PAT_TA_36497
aggcggcggccgccaaggcttggctagagctggccgccgccgggtccggcagcacagacgacaggcgcaggaggaacccaggaagggcggatacggacgagagaagacgctgaagggcggcggccgacgactagccgatcgcaagggacttcgatagggtcggacataagcggaacgaaagctcaggacacgttcggaactacagctcggaggcagagcgtggcccagagcagaagcagcccagagggcggccggcttcagtcaggacgaacgcttcagtcaggacgaacagaagactagctcagcatatatgcagccataagagatggtttcttgatttagatggattgtttgatagcagttgtacttagcagttgaactttttgcagctatatattgcagatcattcattactaaattttgtgtatgcgatgtaaatatcgatttgggaaagtaaatattcgtatgattctgatttttcaccgaaaaaaaaaaaaaaaaaaggcccctagagac

SEQ ID NO: 36498 - DNA, 3010 bp, Triticum aestivum
  Clone ID: PAT_TA_36498
ttgtggctgtttctttttttcgttggcggggccacgcgtccaatttcctccgcgaactcatcgcatcctgagcgagcaaccccccacaccctcccccccgggaccacgtgacggagaagttgaggataatgacgtcgtcgtcggcggcgaggaaccagcacctggatgagctccgcgctctcatggcgtcgcactcgccgccgatccacgcgctcctcatcccctccgaggatgctcaccagagcgagtacgtgtcggagcgggacaagcggcggcaattcatctccgggttcactgggagcgctgggttggcccttatcactacaaaggaggcgttattatggacggatggacgatacttcttgcaggccacaaatcaacttagcgatcggtggagactcatgcgcatgggagaagacccaccagtcgaagtctggatagctgataatctctcggatgaagcggttattggaattgattcatggtgcatctctgtggattctgctcagagatatgagcaagcatttttaaagaagaatcagacgttgtttcagctttcctctgacctcgtcgatgaagtttggaaagatcgtcctccgaatgatgctacacctgtaattgtgcaccctgtagaatttgctgggcgtagtgtagcacaaaagatgaaggagttaagagaaaagttacaacatgaaaaggctagtggcattataattactgcccttgatgaggttgcttggttgtacaatgttcggggaaatgatgtgcattacagcccagtggttcattcttatgctattgtaaccctgcatgttgccttcttttatcgcgcgagagatgcaaccgtcgcggcggccggcggggacagagtagactacgttgacggagagggcggagcatgcgagggagcagctggatgtgatctcggcgccgtcggcggcgcggaaacagcccccagttaagggcagcttgcccatggaaaaggatatcaacccggcggacgcgtccaaaatctggattgattcaaattcgtgttgccttgccctctactcaaagcttagaccacatcaagctttgatgctgcaatcgcccattgctctaccagaggctgtcaagaatcccatggagctgactggtttgaggagggcacacattcgagatggcgcagctgttgtgcaatacctggcttggctcaagaatctgaggcaagagaactatggggcctctggttacttcagtgaggccactggatcaccgaaaaaagagcatttggaaataaaacttactgaggtttctgctcagtgataaactcgaagccttccgcgcagagaaagagcattttaaaggtttaagttttcctacgatatcatctgtggggccaaatgcagcaataattcactattctcctgaggcaaatacatgtgcggaacttgatgctgataaaatatatctctgtgactctggggcacagtacctggatggcactacagacattacaagaactgtacattttggtaaaccctcagagcatcagaaattgtgctacacagctgtcttgaaaggccacattgccctagatgctgctgtgtttcctaatgggaccacaggtcatgctcttgacatactggcaagaaccccactgtggaaaagtggtcttgactatcggcatggcacaggccatggaatcggatcttatttgaatgtccatgaaggccctcatctaattagcttcagaccttctgctcgcaatgtaccactgcaagcatcaatgactgtaacagatgagcctggttactacgaagatggaaactttggtataaggttggagaatgttcttatagtcaaagaggctgatactaaatttaattttggggagaagggttatttgtcatttgaacatataacatgggctccataccagactaaacttataaatactgccttgttgacccctgcggagatcgaatgggtaaacttgtaccactccgactgccagaaaatcttggagtcttacctaaatgttcaggagaaggaatggctgaggaaggccaccgaacctataactgcgagcagttaagccagccacttcatggttactgctgttgtgagccaaacgtagatagatggctgcccgaatatttaatcaactttaataagtgtgaatagcgccaagtgagcacccgtattctttatgtatttcgtgccgcctagcgtgaggccggaaataagaatacagatactgaatgaatactgaattgttacttcgcttgaaaacgaattgtctggttcttcctcaaagcatcagaaatcatgctacacagctgtcttgaaaggccacattgccctagatgctgctgtgtttcctaatgggaccacaggtcatgctcttgacatactggcaagaaccccactgtggaaaagtggtcttgactatcggcatggcacaggccatggaatcggatcttatttgaatgtccatgaaggccctcatctaattagcttcagaccttctgctcgcaatgtaccactgcaagcatcaatgactgtaacagatgagcctggttactacgaagatggaaactttggtataaggttggagaatgttcttatagtcaaagaggctgatactaaatttaattccgggctaaacggttattcgccgcctggtcgtcccccgcgggctccgtaccggtctactcgtaccaccccggccgcctggacccctgcggggctcgcctgggtgttctggtgccgctccggctgccggaggcccccggacccttacctgcgtgctctggagccggcctcgccgtggttgccccccgtgcccgccactccgagctggttggccgcccgcttcttggttcctcctgttgggcgccgaacgtcgccaggtgcccgcccgtattcttcatctacttcgtgccgcctggcgtgcgccgggtgcgcgccctcagtctccgtgtatttcgtgccgcctagcgtgaggcggaaataagaatacagatac

SEQ ID NO: 36499 - DNA, 986 bp, Triticum aestivum
  Clone ID: PAT_TA_36499
ttttttttgtaaaccaactaatgggattccattttatttccaacatttaacgactacagtcaaaatgaagaggatccgtaccaaaagaaggaaacaaaacatgaaactaataaactatgaaaaactaaacaaaacacgaaagaaactatgaaaaactaaactgaggatcaacaggaatcccacgttattgagcctttatccattgttactgagccgaattgctcgtggcatgcgggcgatctaggggcggcgcaacgggggagcgaggggagggagagggccgggcggagtcttggccgcgatcttggtgaggaagttgacggcgatcctgatcatcttctggaactccacgaggctggcctcgaggatgagcctgacgtcgccggtgaggttcctgcagctgatcgtgcaggccgacacgtcggcgatggcccggtcggcgagcaccttggcgaccaggtgggcgtggaccttcaaggcggccgtggcgccgtggatcttcttcatggcggatttcatggtgacgctgcagttgctgaggcagaccttgaagtccggcacggaggtgttgaacccggggagcttgccctcgaagatggtggtcgccaccgcgccagcctccgtggccgcctccatggccacggcgacgagcgcagagaagtccaccgtccccggcgcgccggcgatgagcgcgccccgcggcgagaccgacgccagcgcggtctggatgtcgaggaggcgcgggcccagctccttgacgcagtgcgccgggaaggggccctcgttgcacgtggtcacgagcgggctggcgcccggcggggcgcgccccgcgcgccccggcgccgccgccgccgccgccggggggaggaggacggccagggcgagcgccagcacggtcggcgcggccatttccttcagcttggaatgctggatcgagaacctcggtggtttctgtcggccctcccgccggcctgagctcctcgtgc

SEQ ID NO: 36500 - DNA, 851 bp, Triticum aestivum
  Clone ID: PAT_TA_36500
ctgtgcggcgctcgaggcggcggccgggaaatccagttcatcgacaaagacagaatgcgtgcctctctcgactcaagccttcttctcatcctcgccaatgctctgacggcaaaggcacaggcccagtcatgccccgatattcacatctttggcgcccgtgagacatccgtggcacctggttttggctcaactggcgcactgatcgacatgatcaaggctgatcacccgggggctacttcagaggccattgactatcctgcttgcggcggccaggcgtcttgtggcggcgttgagtatggtgtttcggccaagcaaggtactgaggctgttaccactgctgtcaacgagctcaataagaggtgtcccaataccaagattgtcatgattggttactcccaaggtggtcagatcatggacaataacatctgtggaggaccagacaacggggcttcaatctctgcttctaatgttcctctctcagcaagtgcagttgaacaagtgaaggccgtcatcatgatgggcgatccccgattcatccacggtctggcttatggagtcgggacctgcgacgctggcggctttgatgctcgacccgaaggtttcgtctgccccaacgcgggcaaaatccagagctactgcgactctcaagatccctactgctgcaatggtaacgacgctgctcatcatcagcaatacgtgaatatctacggaaaggaggccttgaaatttgtcaactctaagctctagggtgcagctggaggaaatgccgcaaatacaggaaacaacggaaacacgggtggaaactttgggggtaacttcggccagggtggtaactttgcgaatgctggcaa

SEQ ID NO: 36501 - DNA, 511 bp, Triticum aestivum
  Clone ID: PAT_TA_36501
acccggccgcggccgtcatatcgacaaaatggccaagagttcacgagcaagcaccaaaaaggccaacaacaggcgccttgtcaagaatgtctttggacctgctgaggctgcccgaaatgagcgcctctctgccaaacttctcgaggtggccaagcagcccaagcctgagtcttcagatgtgaacatgaacactgaagaggagaccaacgaatccaacgaggatgctcaagaagagacgacaatggatgtggactctgtgaagaagccttccagtggacgtatcgagaagaagcgacccgataagcgcaagcaacaatccagcaagattaccttcaagtcttatggcagtcgatcaaagggaaagggcaagaagaagagtgcttaaaatggatcatttcgtttaccaggttcaggttctgtttctcttttcactgtatcggcgtttagcagcaaaatcttaggtcaatctcaatgaatctgtatctaaaaaaaaaaaaaaaaaaggccccta

SEQ ID NO: 36502 - DNA, 763 bp, Triticum aestivum
  unsure (1)..(763): unsure at all n locations
  Clone ID: PAT_TA_36502
gncggccggtttctatttctgacaaagaatgcaagcaacacgcaacagttccaggatcatcgtaacatttttgatgcaatggatatacaactttcaacaccaaccaggggaaagagatcagctggatcaaagatagccgccagtcttgataaaccagtggactggccggtgagaatgagcaaaggaggaccccgtgcaggactgtatgagttctgcaaaaagttgcaatggccagctcctaatttcgattgtgcgaaggtagaacaaagtgtgcctacgcctcaaggtcaagggttcaccttcgcgtcaaccataaaactgcacataccgaatagtgatgtgatcagcctcacaggggattgttttgcggataagaagagcgcgatggattccgccgcactgctcatgctctatgagcttcagcagcgagggagattgcaagtccaggagattcatgtttcgtgagagccgtctgtgatgctagtaaatattagtattccccattgaccgggaagtttggaagaggcacgtgtggcatcatccgaataacggatgctgaggatggatacttgtgagaggcaggacacagctgagctgacctggctctgctgccagtcgctatgtatgttgtactttgttaaaaaaaatgtatgttgtgcttggcttcataaaaaaaaaaaaacaggaaacgatgagcccaagtgctgcaagtccactgtctatcagtacttaacaggcgcagtcattatatcttggatgatcc

SEQ ID NO: 36503 - DNA, 628 bp, Triticum aestivum
  unsure (1)..(628): unsure at all n locations
  Clone ID: PAT_TA_36503
atccttcatcaaatgttcccagccctaaggaagtgtagttcacatccccctttaacccttttaacacctaccaaaaatggcgtcatcacacaagttcttcccggccgtcctcctcctcctgctgctggttgtcgccatggaggtggcgccggcgcaggcggaggagccgagggtgtgcgagacggatagcactcggttcaaggggatatgcatggttggcacaaactgcgccaacatttgcctcaccgagggcttcaccagcggcaagtgctctggcttgaagaggaagtgcatttgcaccaaaccatgctagctagactgataaaacgtggtaatgaccgtaaatacctatagatctgttctcaagatggtctgagtcacatcgatctgccgtgcatgcctctgcatacttcaggttcacggcatcgcgatgttctttcttcagttactatgaaggatataattttatttctttcaacaagctagaagatgtatggtctaagcatgcaagtgttcattgtattctatcatatgtgtatttttttgacccttttctttatgttattacagtttttattgctgatcnnnttgatttcttgtggtaataannnatatangnnnnntccct

SEQ ID NO: 36504 - DNA, 1097 bp, Triticum aestivum
  Clone ID: PAT_TA_36504
gccggccgggctgcgaacccccgtgaagcatcgtccatcttctctccttacgccgccttgcactgcattccagcctccatctccaacagcaacccatggccggcatgaaaaccatcgttctccttgccgtgatctcggccgccgccttgggcaccgcgtcagcggcgacccaccgcgtgggcgagccgggcggcgcgtgggacctcaccaccgattacggcagctgggcgtcctccagggagttccacccgggcgacgagctcatcttcaggcaccagccaggggcgcacaacgtgctcgaggtcagcgaggtcgactacgactcctgcaacgccaccagccccatcaccaccttgggctccggctttttcacctacgtcgcccttccggccgtcggcacccgctacttcatctgcggtttccctggccactgcaccaccaccggcaccggcggcatgaagctcaagatcgacgtcgtgccaggttccccctcgtcgtcgcccgccccggccatgccgccgccctcctccgccgcggcctctgccggggctacaataggatctggccttgtcgtcctgctggcggccggtctcatggcttgaaatgcatgtattcttcattagctgatgatgcccggtgcattcaaccgatgtaaagactgtagcctgtaggtttccccccttctaaaaaaacaaaaaaaaagttgagttgccgcagcagacacataccagcttatactatattgttaactggttattattgttgaatacatacaattaatttttttagagcgggacttctagctagtacttgcgttgcattttcaaattggctgctatctcaccgaaccaaatggacgcttgtggctttctaccttgctaagcattgcttgtgggtgagcagcacagcagatcattgtttaaatcaaagctatacgtctaacttggcaccagtagtagtgactgtatgtactatagtttgacaacgagcatgccctcttctttagagatgataattcgcaaaaaaaaaaaaaaaaaaaaaaaaaaaaaaaaaaaaaaaaaaaaaaaaaaaaaaggccctaggcccgcggccgctct

SEQ ID NO: 36505 - DNA, 1875 bp, Triticum aestivum
  unsure (1)..(1875): unsure at all n locations
  Clone ID: PAT_TA_36505
gccggccggtccgggatgaggttgagtggtatctcttccaaggcttgacagaccatttcgctgtcatggctctcatcaccagtttgcaggatgtccggctcgacatgctggcacattttgttgcctttctcgtcgtagtatccgtcgtacgaaagaagctggccccgcaacccagcgcatacttgctcaaccccagacgctggtacgagtttaccgatgctcgtgcagtctcagaagtccttcacaccacccgccaaaccctcgaagaatggttccacaagcacccaacaacccctgtccgcctgacaaccgatttcggtgaaatgacctttttgcctcccactctggccgatgaaatcaagagcgataagcgcctcagcttcatcaaggcagctaacgattcggccttccacactgaaatccccggttttgagcctttccgcgagggcggaagaaatgaggcagcactgatcaaggaggttattcacggtcaattaaagaaaactctgaacaaaatgacctttccattggctcaagaaacccagctggctgttgaacactacctcggtgctaacaaggaatggcacaagattcgactcagagacgcactgctacccctggtcactagaatctcaacacgtatctttnttgggtgaagatctatgccaaaatgacaaatggattagcatcacttcggaatacgctgccaacagtctcgaggtcgcaaaccgcctgggcctctggccaagtacatgcgttacgtcgtttcatacttctctccaggatgcggaattctacgaaaccaggtcaagaatgctcgcgaactaatcactcccattgttgaacgccgtcgatccgaggaaaagggtaaggaatacaatgattctctgggctggtttgagaagactgccaaacaagcgtacaaccctgctgctacccaactattcctttctgctgtatctgtccacaccaccaccgatctcatctgccaatgtttggaagatattgccgctcaccctgaaatcatcaagcccctgcaggaagagatcaggagagttattgccgaagaagggtggaacacgaaggctatgtacaagatgttccttctcgacagcgtatttaaggaaacccaacgattgaaacccattcaagttgcttcaatggtgcgagaagcgcagtccgacatcacactctcagacggtacatttatccccaagggtcatcaaattgctgtctcctgtcacaacatgcgcgatggaaggatctacgagaaccctgaaaagtgggatggttaccgattcttccgtgagagacaacaatccgccagagaagacaaggtccagctatcttcgaccagtgttgaacacatgggcttcggttacggagaacacgcctgccctggtcgtttctttgccgccaagcaagtcaagattgtcatgatgtaccttttgctcaactacgagtggaagattcctgaaggtcccgagccgcaactgatggcctggtgcaccacttgggttacggatccagactacgaagtgctaatgcgcagaaaggataaagatgacccttgtctgcgattggaattggtacaggatgactaggtagggggaggtcacagtcttggtcagatcatcattatgctgtatttgactacaacgacgtttgcctcgagtggaggaccatccttgggttgaccggcgaagtaaatgggaagtcatatttcttttgtagtcgttgttatagatcgctgggtcacggtttacatagttgggtttgatctcgccacttgttgacggtaacatctcgcccaaaaagcccaatgaaaataaatttttatttattagtcgaaaaaaaaaaaaaaaaaggccccta

SEQ ID NO: 36506 - DNA, 689 bp, Triticum aestivum
  Clone ID: PAT_TA_36506
gattttgaggccacaactcactcttgtcttagccacagcatctccatccaaatttcgcgcatcatcttccttcacaccactaccagccatcctcccagcccagaaccatggcggccacgctctcctccgtgtcggcctcatccaagcactgctccgtcgtcagggctcagcactcgtcacttccttccatcctctcaacatcaccagccaagaaaactgccttccgtggggtttccttggtggacagcagatggttgcgcaggggcggcgcgcggcgaaggctggtgcaggtgaatgccaagaccgccggcgcggccaagaacattgaggtggaggtcgacaagccgctcggcctcacccttggccagaagtccggcggcggcgtcgtcatcaccggtgtggagtccggagggaatgcagcaagagcagggctcaagtcgggcgaccaagtgctctatacaagcagcttcttcggtgatgaattgtggccggcagacaagctgggattcaccaagacagccatccaagcaaagccagactctgtatactttgtggtaagcaggggtggtggtgatattgatgtgaagcgcctgcccaagaggccggcgccccctcggtttggccggaagttatctgattcacagaaggctagagcaacacacatctgccttgattgtggatacatatac

SEQ ID NO: 36507 - DNA, 1166 bp, Triticum aestivum
  Clone ID: PAT_TA_36507
cctcccagcccagcaccatggcggccacgctctcctccgtgtctgcctcttccaagcactgctccgtcgtcagggctcagcactcgccacttccttccaccctcacaacagcggccacgctctcctccgtgtcggcctcatccaagcactgctccgtcgtcagggctcagcactcgtcacttccttccatcctctcaacatcaccagccaagaaaactgccttccgtggggtttccttggtggacagcagatggttgcgcaggggcggcgcgcggcgaaggctggtgcaggtgaatgccaagaccgccggcgcggccagggagcatcgcagtgggggtcggcgcgcaagtcaggcgaccaagtgctctagacaacgcagcttcttcggtgatgaattgtggccggcggacaagctgggattcaccaagacagccatccaagcaaagccagactctgtatactttgtagtaagcaggggtggtggtgatattgatgtgaagcgcctgcccaagaggccggcgccccctcggtttggccggaagttatctgattcacagaaggctagagcaacacacatctgccttgattgtggatacatatactttctacccaaggcttttgaagaacagcctgatgagtatggctgtccccagtgcaatgcgccaaagaagcgattcgcgagatacgacgtagagtctgggaagcccattggcggtgcactgccacctcttacggtgatagtcagtttggttatcggcatcgctggcataggggctttacttgtatatggccttcaataggcttgttcgtctcttcagaaattttgttctggccgacaagctcaaccgattgctcatgtactctatctaacagaaaattccagtaatgaaggggtaaaatgcaacatgttatgtttgaggctaattgcagtccaatattctttggatcatgttgtcaccagaggccagtcacttttcagaaatgtttctggagtcatattgctctcaacgcagtggtgattttctgcaaaatggttgtgggcattcatgtggtgttggtattgaaaaacatgcctcatcttggcatgcactactatgtaagacagaagcccctttgatgagttgttgctgatgaagtgatgtcgtaaaatttgaagaaaaaaaaaa

SEQ ID NO: 36508 - DNA, 1016 bp, Triticum aestivum
  Clone ID: PAT_TA_36508
gccggcccaaccgacgccatccccagtacctacgaccccaccgccctccagcgccgtcaccaccgccccctcttctgcgaccaccacgccgtccgcgccgccctaaagcacactgctcctttcccttcccaagccgccctggatctggcgatggaggtggccgccgtcgtggccatggaggtctcgccagctgccttcgaagtcctacatccccgataacggcgggattgcagccgcctggccaaggtcgtcggccctcgacgagctcctccataacttctggttccccacagtgcctatgggccgcctctccctctccatcctacgctcctccttctccacttcagattttggctgaaaatcgcctctccctattccccttccaatctgtagcacaggcggagagcctggttgtgtgcggcggagatggcgccccgcctctgcgcctcataaggctggacgtagctccgccgaggccatgacttttccaggggaggatcacaggtggagtgaatgcagtctgagttgcaccagtctgttgggatcatcgtatgagttggggacttagcaaactagcgggatactttccctcagccatattagatccactcgccaagatctcttacacccccaacattgcacggtgttctgggagcgccattgcccctagggtcaagattttacccatatcaaaatctgggtacttcatgctcgttcggtcatgcaggacagcgctattcgactatcgttcaatttcactcgcttcaaaaccggatatgacatgcgcgctgctcactccttagactgtctgtgctctgatctgatcgactggtgcttgataaaatgcccatccgagcaaacaatttgttttgtgctacctgagagatgcaagttggatgtggaggacaatcatgtacagcccttaggttctatggttaatctgcttaacctgggaggtggtcatcaagtttgagatggaaagtgtaggtgctatgtactgttttcaataaccaata

SEQ ID NO: 36509 - DNA, 574 bp, Triticum aestivum
  Clone ID: PAT_TA_36509
ttctcccacgcgtccgcgaggacctcgagatgggcgtcgtctacgccaccttccccatgaagcacatcggcacgaagctggccgccgccgacatggcccgcctcgccgccgcggccacccgggaggcccgccgctccgccaaggtctcctccgtgggggccgcggcggcggcagcggctcagcccgagccggccatcaccttcgtgccggccgcggaggaggcgccgtctccgagggcgcggctggacgagatggtggacgacgcggtggccgcggagatcgacgtgctcaagcaccgcctcagcagcgcgcgctccaggcggcccaacctcgagaccatccacgaggagaatcacctcctgtgcagacgctgaaatatactactagcagctcatttttcttcttcttctttgttctcgaattttttgacatcaagttcaacagaagttggaaaggatatatgtggtgaaaaccaaggaattgattgtacagtctgactttgtggaagaattcaaaacgtatacatatgtggatcaggtcagctttgcaaaaaaaaaaaaaaaaaaggccccta

SEQ ID NO: 36510 - DNA, 1081 bp, Triticum aestivum
  unsure (1)..(1081): unsure at all n locations
  Clone ID: PAT_TA_36510
gccggccgggcctggaaaaaagccggccgttgccaaccccgcgccaccaccaaaccctggccgtgcgccgcccgttccccatcccacgtcccagcaagcgcacccgagcgccgcccacctcgtctcccggcgccccctcccactggccgcgccgatcccctcgccgtcctccagctccagctcgaccccgacaccgccgacgtaagcagcctctcgacccgagctccgtcctcctgctcctgcccgacaccgagttctatcgaccggatcctcaagctccaccaccgacctcttctcccagctcctgcccaaccctagcgccgtcgacctcgtcttctagcttggccgcctacctcgtattccagctgcctgccggccgccggttcgggtcgctactggttgccgcccgatctcctccgcagtcgtcgccccgagcatgtccacctcgcctcggtggtgagaagctatgtgtgaggctctgcatacactgcaatgaacagcaagtaaaggatacataaccaagacccagtgaatctctcacaccatggcgaagcacatcaagcacaatggccaagctctcctactactttcattggttcttgtgatttgcttggccactcctcggccgatatacggacggagcatcgacaagatggggatcaacataacggatgtgagctatcgttgtcgctacgccatatttccgccaaatgcattcaagtggtgctgcgatggtccttgctggggtggcccgtgctacaagcacagagacgactgcgtcaagacttgccagtgtccccgacccatgaatgatgatgatcatgtttcatatcaatctgcactttgctgattgccgttggagcgaataaagatgttgatccatgcttaatttattgttcctgaaactgtactagtttttccctttgtccnacnatttgtaatctgcctgtggaatcaccctgatgtgtggtggtgtaagggaaaggatggcgatctgtccgactggtnccattttccccaattggcncggnaagaaacgactacttaaggtnantagggcnagcntagtaaaaaaaaaaaa

SEQ ID NO: 36511 - DNA, 632 bp, Triticum aestivum
  Clone ID: PAT_TA_36511
gccggccgggctcgggggccttccccaggagagacttccacgcatcaacaggtcggggaggaaaccctcgagctcgagaggcgaccgactggatccacgcctccacccctcccaagattctccctcggactaccgggggcaacgccgcggagggccgcgcctccgcgctcgtgccctccagcgacatcgacgaccccggtcgtcattgtcctccatcctctgagctcaactcagtcacaaagctcttcttccctagggcgacgccggcggcgacagcgacagcgtgacattcctcttcctactgcgaccaaggtttcctaaagctagcaaatgaaaatgtttaaagaagttaatggtggaagcttcagactcttccgacagcaaaacattttgacatggggcagtcacatataggcatctttttaatgaactgaatgttaattattgcttgatatctaactgtagttagtatttgtgatggtaagaccatgattaacacattaatatccttggtgcagtgttactcgtgcgaatttgacatgtataacttatggtcaatgtgtatgattgggttgaattattttattgttgcgctgaatatgggaaaaaaaaaaaaaaaaaaagggccctac

SEQ ID NO: 36512 - DNA, 404 bp, Triticum aestivum
  Clone ID: PAT_TA_36512
cggacgcgtgggggaagccaggatttcggacagtggcagccacacaggcgcatagcagcagcagagaagggaagggaagagcagagcgcgccatgtccctggtcgccggagtgcgcgcctccctgctttcctcccccgcatcgtcctcgtcccgcccatgccaggccctcgcccaccaggtccgtgcgtatcggtcccttatctcgccggcggcgagcaggggaggccgccgcagtacgcgtctccgggtgcgcgcagccaggctggagtccaccggcgtctccgtgggcttccgtgcaccccaatttgagctcccggagcccctgacagggaaaatctggacactggatgacttcgagggtagccctgctttgctggttatgttcatatgcaatcactgtcca

SEQ ID NO: 36513 - DNA, 1227 bp, Triticum aestivum
  Clone ID: PAT_TA_36513
atttcggacagtggcagccacacaggttagcagcagcagagaaggaacggaagagcagagcgcgccatgtccctggtcgccgcgtgcgccgccggagcgcgcgcctccctgctttcctcctctgcaatttcctcttcccgcccatgcccggctctcgcccgccacagccgcgcgtataggccccttgtctcgccggcggcgagcaggggaggccgccccagtacgcgtctccgggtgcgcgcagccaggctggagtccaccggcgtctccgtgggcttccgcgctccccaattcgagctcccggagcccctaacggggaaaatctggacactggatgacttcgagggtagccctgctttgctggttatgttcatatgcaatcactgtccatttgtaaaacatctgaaaaaagatattgcaaagctcacttcattctatatggagaaaggacttgcttctgtcgccatatcctcaaattcaattgtgacacatccccaggatggccccgagtacatggcggaggaggcaaaattgtttaaatacccttttccttatttgtatgatgagtctcaagaagttgctaagggttttcgagcagtctgcacaccagagttctacttgttcaaaaaggatgggcgaaggccatttgaacttttttaccatgggcaatttgatgattcaagacccagtaacaatgtgccagtcaccggaagagatttaagccgtgcaatcgactgtgcacttagtggccaagaattgcctttcgaccaaaaaccaagtgtcgggtgcagcatcaagtggcacaagtgaagagcttgttccgttgacgacaagcagatgatttttgtttttctccctcgaattgaaacacgtgatcaagtgctgacgtttctgttggcgcttggtggagcggacttatgcgccggtggtgattgttggggatcagaattgcggataaacagattgtcggcgtcggaggttgttttgttgtgtattacagacaaagtagcagtgcagagcctggcagcccaaattctacccgtagctctctgaggggcctaattagaactgctgtgataaacatacacaaggaaatagtaccaactgttgatgtatcagtacttcaaacctatgtggaccactgccctactgctatatggtttgtagatgacaaactaaccagcatataaacagagagcatcagctaaagaagatctgtattggttc

SEQ ID NO: 36514 - DNA, 550 bp, Triticum aestivum
  Clone ID: PAT_TA_36514
cttgcccggtttctgggcaatctacgaggtgatgggaactgcattgttctgggcgttgcttcttgcggtgattgtggttggaatgatccctcattttgccgcaaggcccatcagggaacatttcatgcccaatgacatccagattgccagagagatggagaagtcacaagattctcgtgatgttaatcatccagaagtccagatgagtacatccactcgagcttaggagtaggggatctttgttcattcgcgtagttagagttacacctttctctttctgaagaaattacaccttttccttggttctttttgttgtgtgtatataaagcaattctttcggcagtgagcatgcttcttgttgcttgctaccctgtcaactatccaaaggatagatttcttgtagccatgctgtgcatccgcctgcattttttgttgttaatttatatgaaaagaatcgtacaggagttaactgtacatattcgaaaaaaaaaaaaaaaaaaggcccctatgaaactgatgatactgatttccaagagctaaaaaaaaaaaa

SEQ ID NO: 36515 - DNA, 668 bp, Triticum aestivum
  unsure (1)..(668): unsure at all n locations
  Clone ID: PAT_TA_36515
gccggccggtactcggtctctcagctcacctctgcccctcctctccggggccttcccgagctcgcgcgacgagatgctacgctcatggaggaatctggaccgtgtttgccgatctgcttatggacccttcgcgatggcaaggaacattgcagtacatggccaaacgaatcggggtaagccgaatcagaccagccacctcccttgtggcagtgcttttttctgcacccccagtgaacaatttgcgaccaccaaagggaagaatagagcaaaaatgaggaaggaaaccaagaaggtcaatgtaagatcgtccttcatcattgataatagcacccatcgcgatgggtctatatacaaaaactcttttctccaaaaaatatgcagtgttacaaaccgtgatgagagtaagtgatgtgaatctctcctgtattccttcctttaatttgggatattttacaagttgtacgattcatcgattaaaagtttaggctgaatgcatatgctcttgttttggaaaaaaaaaaaaaaaaaaggcccctaactattggtatatacttgccaaatgtctggatcctgctaaataatgnaatcctncaaggacattcattaggtgaanaggtcntcatnagatnacggcctanaggggttaangnccccccgtcnattatttn

SEQ ID NO: 36516 - DNA, 403 bp, Triticum aestivum
  Clone ID: PAT_TA_36516
ctcctacagcccccgctgcttcctcctcgcatccgcggtgctccacccgccgcgaaccctcgtcgccgaccgtgggcatccgtcggcggtgaactaccctatctcctcccctcgagtcgtcacagatctgggacaccaccgcccgcgccgtcctcgagagggcctcacggatcccgccttgaaccaccatcaacacgcaccgaccgcgccgtcctcgacaactgcgacgccgcgcccaggtctcgaccggaaccctagtcttcaccgcgcgcaaccagcaagctctaatgtcaagtgacagcgaaccaagtggctcccaatcaagtgacaccaaatcaagtgatgcgggaccaaaagatacttccattccctttaatctgcatagaggtagtgtaaatccagt

SEQ ID NO: 36517 - DNA, 1123 bp, Triticum aestivum
  Clone ID: PAT_TA_36517
cgaaattccggggggggccctctcttccgcgacgtcgtcgtcgacccctctccgccgtacacgcccactctccacctaagcgcgccagggaaggaattctctcgccccctcgccccttcgtccccgccgccgccgccgccgtctccctcctccgcgcggaggggatccgcccgggcccgaactcgacccctcccgctggacaaagcctttgcagtttggtctcggagaagatatcggtgtgcttatctactgcggcatggaatgagggtcttgagtgccgtgtcttttctccgagcttgacactagttgcgcttcgcctcggaaagtaacaaaccatgacttctgtcgccgacggtgtttcaggtgatcatagagctgatgagcaacagcagaagcaagctgctcaagggaaccaggaagaggccccagctactagtataggtagtcaggcaatggtggcaacaccttccacagattatgtcacaccctatggccaccaggaagcttgccatgcaatgggtcaaattgcttacccaactgtcgatccattctatggaagcctttatgcagcctacggtggacaacctatgatgcatccaccaatggtcggaatgcatgcagccgcaataccgttccctactgatgcaattgaagagcctgtgtatgtgaatgcaaagcaatataatgccatattaaggcggcgccaatctcgggctaaagcagagtcagaaaggaagcttatcaagggccgcaagccatatctccatgagtcgcggcatcaacatgccttgaaaagggccaggggagccggaggccggtttcttaacgcaaagtcagacgacaatgaagagcattctgattccagctccaaagataagcagaatggcgttgcatcccgcagcagtggccaatcctcccaatctcccaaaggcgcgacttcggctgataagtcagcaaaccatgaatgagatgctagaaggtccgccggacgcgacgatccatgccaacagttttgtacagtatatatatgctagtgagcgagagagagtcgcgccggcgggtgccataggatatatccgctctgctctatagtagtgatagacttatcgacagatttttttgc

SEQ ID NO: 36518 - DNA, 1715 bp, Triticum aestivum
  Clone ID: PAT_TA_36518
gtggcccgctcgagcaagacccccgcgccgtgctgctacctgctcccccggccccccccgtggcgctactccaacccctttccccgtgccccgcggcgtggccgcggcccgccgatccgcccacggccgcgacgccctccagctggtcccaagcattgcggccgcgccggggggtcgccatacggacaggggcgtcgcgccgtacgttgcggcgctgcatcgtagcttggtttgagcgatggttcgtgggcctggtgcgcgggcgcttgtcacgggccgcgtcaggccgcatgctccggccgtgtcggggggcgggacggtcacggtgtgctccgcggcctgaggcgtttcgaacccatcgttcgcggctttgctgctgtagttccaagttatggatttgggacgtgcagagttacacggcctctgggtccgctcggcgctcgcggcccccttgctggcttacgtttgtcccatcgacctcttcggattttacagtcggtgccggtccgcaacaccccttgcaggtttttggccacggcttatctaaaagaaccatggaagatgggtgtgcacaaaagaaacggtgttgtataccttgatgtccataacctccctgaaagaccacagagtgagattgaccgcaggtgatgtttttggggctattcttttgaaaatcttgccactgagaactccattgacgaagaggaagcggtattgatgctaatgtagagtattgttctgtaataaagacgaaattgggcgcgcatcgcattgtcatgggtgctgagatggactgctgtgattcaaccgacgatggtgggcggttctatgtgggagttgaaaacaagcagagagctggagtatcatacggtggaaaaattcgagagagagaagttacttaggttttggattcaatcattccttgctggcgtgtcgtatgttgttgcgggattcaggaatgatgctggtgtacttatacgaactgagagactaagaactaaagatatcacacaaaaagtgaaagcaaagagctactggcagggtggtgtctgcttggcctttgctgacgaggttttatgctggctgtatggcactgtcaaagaaaatgaagactacgttctgcaatttgcacacccgttccatctattggaactattaaaagcccaatctccgtgccccgatgcaataactctgcatgtggaacagctcaccggtgcaacaaactaatctgttcccaagcaaagcttcggcgctgatgtttcgctaaacggacagttttgacggaccttacgtagaagcgtcgcgtcttagaatggcttgagctatagttcgaggggctgatgcggatgcataaaagactgacagggtcatgctaaatggtcggtcggtaactgggggcagctatggtcacggtttgctctttgagtgcccaaaaagattttgaagccatcgaacactgtattttttttgtaataccaagttataaattagggaagtgcagagttacacagccattgtaacggttcatcgctcaaggcaccaacaatgtgtaacttttgcaccaatgatgatattgaattttaaagacggacgctgccatgccatagtaacatgtgaagaacaccccttggagttatgtaatctagcggtatatgctaaaagtttattttcagcttattatggagaacatctgatacggcatggttagtccaagc

SEQ ID NO: 36519 - DNA, 570 bp, Triticum aestivum
  unsure (1)..(570): unsure at all n locations
  Clone ID: PAT_TA_36519
gccggccgggctgggacagntgaagttaccgcacaactcgacgctggcaaggacaagcggcccgtcaaagtcttcgcaaagaacaagggccgcgtcacaaacttctcaaaagagtctgatcctgcttctcgacgagcaccagacgaattcatcgagatgggaggtaagggcgaccaagaactattcccggatgatgactcgagcatttaccccacaggtgacaatggcgagaagatcaaggcaacaaaggcccagcgataagccaacagtattgcaattttcgagccgaatgtttgggtttggttggttggtccggtacaggtgttgggtttttgtttttatcttgtcttggtatattttatttacagcggaattctcatagaggcagtacaggaaggattactagggtttgttatgggtaactttatttgtctggtttccttgagtacatgatggttcatagagaatggaggaggtgggtcatggggaatgagcgttgctgctatggaagcatttagtaactattgaaagcctaccaaaaaagaaaaaaaaaaaaaaaaaaggccccta

SEQ ID NO: 36520 - DNA, 1028 bp, Triticum aestivum
  unsure (1)..(1028): unsure at all n locations
  Clone ID: PAT_TA_36520
gccggccgggcggggatcccgtccttttttcccctttttaccaattgatccttttatcaatcgcaaaaatgttcgccgcttctcgcatccagcgccgtgctttctccgccaccgcccgggacctttccaaggtcaccgttctcggtgctgctggtggtatcggccagcctctctctctcctcctcaagatgaacccccgcgtcactgacctcgccctctacgatatccgtggcggacccggtgttgctgctgacatctcccacgtcaacaccaagtccagcgtcaagggatacgagcccaacgcggctggtctcaaggaggctctctccggcgctgaggtcgtcctcatccccgctggtgtcccccgcaagcccggtatgacccgtgacgatcttttcaacaccaacgcctctatcgtccgcgacctcgccaaggccgccgctgaggctgcccccaaggccaagctcctgatcatctccaaccccgtcaactccaccgtccccatcgtcaaggaggtttacaaggctgccggtgtctacaaccccaagaccctcttcggtgtcaccaccctcgacgttgtccgtgcctcccgattcgtttccgagatcaagggcaccgaccccaaggacgagaacatcaccgtcgttggtggccactccggtgtcaccaccgtccctctcttctctcagtccaaccaccccgacctctcctccaacgctgagctcgtcaagcgtgtccagttcggtggtgacgaggttgtcaaggccaaggacggtgctggctctgccactctctccatggccatggctggtgcccgcatggctgactccgtcctccgcgccgtccagggcgagaagggtgtcaaggagcccgctttcgtcgagtctcctctctacaaggaccaggggtattgagttcttcagctctcaggtcgagcttcgncccccgaggtgttgagaaagatcacccctctcgcaagctcgacgccaacgaggagaagctcgttgacgccgctctcgtcgacctca

SEQ ID NO: 36521 - DNA, 1240 bp, Triticum aestivum
  Clone ID: PAT_TA_36521
cccccccgccccccaagtccccggggagagaaacgagaaaggctcaccgtggaaccgatcgaatcgcagcgaagcagcggcggcggcggcgatggggatcggcgagcactttgagggcgtgaagcagcactgggcgcgcaacttcgccttcctcgactacttcaagaaggtctacggccgcgaccagcccctccccaagtggtccgacgccgacgtcgaagagttcatcgcctccgaccccgtctacggcccgcagctcaaggccctgagggagtccaggaagttcgcgctcggcggggccctggccggcgccgcgcacctcggcggcgttgccttcaagtactccaagagcccgcacggtgtcgtgctggcgaccgggttcggagcgctcactggcgccgtgctcgggtcggaggtggccgagcactggtacgagctctacaagatggacaagcagggggccaacctcaggttcatctactggtgggaggacaaggtctcaggccagaagaactgaagaagacttctgcataagcttatgcctgtttcagcatactggtttgacaagacaatgatgtctccagtttgggatttctagtttttacttcctagtctttttccaataaggtgcatattggccatcaactggacaatgtattttattttctctactatgggttgctctcagtttctctatgatgttcatgtttgcacctatggaaaactaaatgccagtacttttcagtctatcagttcgcacatgacctgtaagtattcaatgaccgtaaaaataatatcggggatgcctactttcttccttgcttttggctgaataaactctttgcagataacttttgtgggggaccggacggtggtgcagatgtacaagttcctcaagaagcacgctgccgtccctttcaactctgatgcagccgcggctggctgtgcttctgcctcggccggctgtgcttctgcctcggctacaaactgcctaggggccagagagttagcccagtcctgactatgggtccagtgagtctggcatttgatcactatggaaggagctccatgatgaagaagaaaacacttgtagagcttgtaactatgattcccatacttgtatatgttacagcttctattacttgtcatttgtagagcttcgtcggtacctggcttttgttatgccccgtcgtatgtgttcttgcttgcccaaaaaaaaaaaaaaaaaaaaaaaaaaaaa

SEQ ID NO: 36522 - DNA, 729 bp, Triticum aestivum
  Clone ID: PAT_TA_36522
gccggccgggcttcccatctttacaccatcagctaaacacacataccatcatacttccagccattcttactactcgtcacgacagcatttcaattgctgtgaatacacactcttcatcatgacgtcgacagaccccaagaccaccgatgacaagcctgtcgagcaaaagccagagcaaaagcccgccgccctcggcgaggacgacgggtttgaggacttccctgtcgatgactggcccgaggatcagaccgaggctgctaagggtagcggcgagaccaaacatctctgggaagagagctgggacgacgacgatacaagcgatgacttctcacaacagctcagggaggaactgaagaaggtcgaggcaaaacgccgatagaatcacgacgacgtacataccgcgacaagccgggcaactcccgtgctttcattcccatcaacatctgataacccaacgacgggacacctcgagaagtgtcaaaggggcgaggacaatatggcggcttaggaatatccatcattgacggaagaaggtaaagatgctgcgactgtatctgtacgccagtgccgtagatgcatgatggcaagatgtggactggtcagacaagcccgaccccgggtgggggaaagcagcaagacagggcaacaactcatatatcagtcaaaaacgaataattatgacgacctcgataacaaaaaaaaaaaaaaaaaaggcccctaggccgctct

SEQ ID NO: 36523 - DNA, 509 bp, Triticum aestivum
  unsure (1)..(509): unsure at all n locations
  Clone ID: PAT_TA_36523
gccggcagggttgggattgtgtgcctcagatatacctcttttgagccctgattttgaagatgtcgacaagcaggaagcaatgttctatcgcagtgttgctgctgctggtgctcgtccaactcatcggtgctctcgctcgacctccatgcgattatcttcgtccaggaacctgtcactataacaaaccatgaggtgaagctggaaaattgcgtggatgctgcttcgttgggttatattgccttattagattattcggtttctttatagaaatatccgtactgttcagtttgttggcaatctgaaatatgtaaaatataaaatctcactagggtccattttgacggaattctgaatccattgttaattttggtgaccaagtatttcctaagtagaaacgtttacttctatgggacactaatgcatgtgtgacacattgatctaccttggggaaaattatatacttcacatgattaaacctaannaaanaaaaaaaaaacccaagggggggg

SEQ ID NO: 36524 - DNA, 1042 bp, Triticum aestivum
  unsure (1)..(1042): unsure at all n locations
  Clone ID: PAT_TA_36524
aattagaccgggcgtcgaaaaaactcaatatgaattgcgcataaagaacccgcctaccggtccaaggtgaggccagcatgttggtagtgcctttgataagagagtgactgctgtgctgtgatgcttgtttgtttactgaccgaccattttctacccatacctggaccacctgaactatctagtctaaccatctaatcctccaccaacccgtgcttcgctcgattggggcctctaggtgacactatagaaggccggccgtgccgggactcctccgattcccgccaaccgtctcaagcagatcgccaccgatgcctgcaacagcgccatcggcaatgctgagttctacgaccacgctaagaccgagcaatggaactcgacaatcattagctccgtgctgaaggctgtcatctccgagtcgacccccgaaggtgcttccgctccttcattcaagtttgcctgcaacagcaccatcgtgcagcacctcgtcccaacatccgctctgaacaagccccgtggcggcaccgagacacaggctcaggagcctcacatctccaccagctccgaagctaccgctaccgacggcaagcctcacgtcggccgacgaggaatgcacagcgctaccggtgcctactgggacgagaagaaggacggcatgtggaccttcaagtacgacggcggcgagggcaagggcctggacgttgttgtcatgctcatctgggttgccatttgagctgcaaacaaaaagatgagcactcggggactttcaccctgttctgaaccgagttagtttgcttctgacgtgcgcgacccctgattcagctatggcgttgagggacttgggaagcgtgacattaggactacgaagtgtacgatcgagcttccgtttgagctatctgccgacgacttgggtggtattgcagaccttggatgtcaaaatgcgctggacttgataatattctacnatgccagacggttggagccagcctcgattcttctggtcatgatgccgctcgcttgggtacgnntgagctgaagtacatgc

SEQ ID NO: 36525 - DNA, 811 bp, Triticum aestivum
  Clone ID: PAT_TA_36525
gccggccgggcatttcgacaccaatacccagttcactcgcttagctactcaattgccagccatgctttccctcgttgcatacgctcttttggcttcggccaccctatccgttgctgttgaccctcgcttcgagtatccagacaccgtccctcttgtcaagcgtcaacagcccggcactcctcaatatgcctgccacgaggattgcggccttctcatcactctggcccgtgaaaacgaaaacttttgcgacagccaagagtggaataatcactatgataaatgtatggaatgcgcagagacctacggtatctggaagtactacggtagtggtgtgagcaaggtcgctgggcagtgtgacctctctcctactcccagtccctctggtgctgccaccaaggagactgccacctctagcagcgatgggtcgggaacaacggctcctggaaagatcacaacggaagcaccgactgaagttccctcgactactatcgcaattgagtctaccgttatcgcgacaccttcagccatgacgacaacagatgtttcctctgtcaatacggcaacctcgactccagagccttctagtgtcgctgtcaatggcgctgctaagcatttcgagttcaccaccgctattgtctttgcagcgttcgctatctttaatctctactaaaaaggatacggaggaatttgattgattgattgatttacagtaatgtagataatatatttgtttcttaactacaacgctatagatagaatctatataacaggttatacgcataccacatcattaaaatacgatttaactccc

SEQ ID NO: 36526 - DNA, 861 bp, Triticum aestivum
  unsure (1)..(861): unsure at all n locations
  Clone ID: PAT_TA_36526
ctgtgcggcgctcgaggcggcgggcttggacagccctctttggagtaacgacgctgacaatatcgttgaacgaaccttggccgaacctctctcactcgaaaacccgaacacataaacctcgccacgatgctcgctcaacgtgttggcgtcaacgccctccgctcaggcgcggccaagcctttcttcgctcagaacatctccaagagtgctctggctgctggaatctctacctcttctcccactcgcgctactggttccgtcaaggtctcccaagaggacggccaccagatcctcgttaaccagcgcctcaaccgacccgtctctccccatctggccatctacaagctcgagcagacatggttcggtagctccgcctggaaccgtatcaccggctgtacactctccgccaccctctacggcttctccatcgcctacctcgccgctcccgtcgtcggtctccacctcgagagcttgagcatcgctagcttcgtcgccggtcttcctctcgctgtcaagggtggtctcaagttcactctcggtttcccattcgtctaccacgccatcagcggtgtcaagcaccttctctacgacgccggcaagggtttcgccaagtcaaccattatccaggctgacaagtacgtctgggctgccagcgttctcggcgctattggtctggttgctttcctgtaagataccaaatatcgaanaatagaagagcggaatagaaggaaaacgagcgacatgcgcagtggatgatacaagttgcaaggggatatagggaaaggagtctggacgagacgaaactcgtgtacgagtatttagccgagaggcatctgactntgagcaaacaattttattatc

SEQ ID NO: 36527 - DNA, 974 bp, Triticum aestivum
  Clone ID: PAT_TA_36527
tcgagaccgttacccacaaggcccccaagcccgtcgagactggttctggtgagaagcccgttactcctgaggctcccaaggatggctatgaggttcccgatgttgtccccagctgcctgaacaccttccttgacttcgagaaggactgcaaggacaacaccgatgctgcttgctactgcccctccaaggactttgtcgacaacgtcttccagtgcctgtacgcccacgctgagaacgacgacaccgttgcccaggctgtttccttcttccagggtatctgcgctccttatgtcgagaagaaccctggtatcgccactggtgccgactctgtcactgagcacatcaccgtcactggcaccaccatcatcacctctgcccactacaccaccatcgtcgttgctactaccatcactgagccttgcgtcactggcggttccaccattgagggatcctccaccgtcaagaccattgagactgagatcgtcgttcccgaggttggcttcactgacggccctggcggcaacggccccatccctgcccagactatccccgctgatgtccccgctgccggtactgaggctcctgccgcgcccggctacgaggctcccggtgctggtgagaccctcatcaccaacaagcccgttgttggtaccggcggtcttcccgcccctaccgccacccctggcgttcccgtcactgctggtgccgctcgcaacggcatgggcattgccgccgccatcctggctgttgccatcgccctgtaagggtcatgtgttctgcacaactctgtttttccttgtttatagattaggtcttggtacctgaggcgggacctgtatgtcagttgtatgttaccgcaatcgagatctttcgagcttccagggaagttcgaaagtgtactcacaaacatgtatcattctcacgatccttacgaaatctttggtgtggaaaaaaaaaaaaaaaaaaggccccta

SEQ ID NO: 36528 - DNA, 587 bp, Triticum aestivum
  Clone ID: PAT_TA_36528
gccggccgggttgggacacacactttgaatcctcaacaccgccagtttctatctagtctactacagcacaccctcttctatcttctttcaaccaaactaaatcacaaacatgggtaacggtgccaaggctcaacagaagcgcgagcgcgctgctaaggacaagaacactgccaagtctcagctcaaggtgaacgaaaaggcttgcgacattcagtgccagatctgcaaatctaccttcctcaagaccacaaaggcccctgctctgaaagagcacgccgagaacaagcacagcaagaccattgccgactgcttccctacctaccaggagtaaatcgaccacgctggagagccgctttgacctgagacaatgataacgagaaaaggaaccgggataaagaggaagagagaagaaaaagaaaagtgaaaatggaaagcatttagcgaagcgaggcgtactgtggcgtgatggccctgcacgagaacatggggagatgagacaagtttagatgactggcagggactcatgataactttatacagttctttttttacacataaaagaaaaaaaaaaaaaaaaaaggccccta

SEQ ID NO: 36529 - DNA, 833 bp, Triticum aestivum
  Clone ID: PAT_TA_36529
gccggccggccggccgggttagcattctattcactttcgattcttattcttttttttttcatccttccaattccacattcatattcatcatgcttcgccaaattgctcttactgcactttctgtgcttcctctcacgctcggccaggtcgctgaggatttcgagagcggttgggatcaggtcgcttggcctacatatgcacctgactgtgaccagggtggaaaggttgtccttgacaagaccaccggtcacagtggtaccaactctatcaaggtcactggtggccccaatggtttctgtggtcacaagttcttcggcaccgatgccattcccagtggtgatgtctatgtcagagcttggatgaagtctgaaaagacccttgacgattctcacgtcaccttcatcaccatgcccgacgcagcccagggcaagggcaagcacctccgcatcggcggccagagcaagatcctcatgtacaaccacgagtccgacgacgccactcttcccgatctctcccccgaaggcatcgccgcctccaagaacatccccgccaaccagtggcagtgcctcgagtaccacctctcccccgacggcaccatcgccacctggctcaacgacagccctgtcaagggtctcgtctacaagcccaacgaccctgcgtcttacagcaacggctggaagaacagcaagcccaagcccaagatccagggcgtctacttcggctgggagtcttacagcggtgcttccaacactttctggtacgatgacattgctgtcagctccaagcgtattggatgctctaccaagtaagggtatctttgggacgattttgaa

SEQ ID NO: 36530 - DNA, 509 bp, Triticum aestivum
  Clone ID: PAT_TA_36530
gccggccggatttactcacacctctacaatactgcaatacaattacacttgcaacaatggctggaaagtttgagcccaagactgccgtcacccttgaccctccaaaggacgacatcatctctaaggaggagcttgccaaggccaacggcgctactgaaggaggcaagtgctacgtggcgatcaagggcaaggtttatgatgttaccggaaacaaagcctacctccctggagcttcttacaatgtctttgccggcaaggacgcttcaagagctctagccaagtcctcgacaaaacaggaggatgcgcttccagagtggcaggacttggatgacaaggagaagggcgttctcaacgactggatcactttcttctccaaacggtacaacatcgtcggtgttgtggagggcgccacaaaccaggagtgactaaccgagccgcccccaagtactcacgccaagttatgaattcatcgtttttagtcctaaaaaaaaaaaaaaaaaaggccccta

SEQ ID NO: 36531 - DNA, 473 bp, Triticum aestivum
  Clone ID: PAT_TA_36531
atctaccgagatcacccattctcctcttcgccgattctccgatcagctagcaagccggcaagctactacagcgcaaggtcgtgatggctccacgcgtcgccgtgctgctcctggccgtggccgtcttcttcgcctctacgtcggcgcaggacttcacggcgccttcctcggcccccgctccggcgcctgacgccggcgcggccgccagcgtgtccgccttggccttggtgtcctcggcactggtgtcccttctcgcggcggcgatgatgcagtagatggatcatggatggtcgcagctttgggttggatggccggagcagagtttttctttgagagatcggtggtggtctgatgagtgttgctggctctggcctcttttgtttgcttgacattctttttattatgtgtctatatatagtgttatgattaaagtttgttggttctgtgagaatcttgtgtgaatatctcccggc

SEQ ID NO: 36532 - DNA, 786 bp, Triticum aestivum
  Clone ID: PAT_TA_36532
gcgcggccccccttcgccgccaaactcccatcccacctcgccaggcccccagacttcaactcactcccctcctcgccgattctccgatctactcgcgcccttcctcgcatggtctcgcaagcccacagcgcaaggtcgtgatggctccccgcgtcgccgtgctgctcctggccgtggccgtcttccttgcctctgcgtcggcgcaggacttcatggggccttcctcggcccccgctccgcagcgtgtccgctttggccctggtctcctcggcactggtgtcccttctcgcggcggcgatgatgcagtagatggatggctgcgggttctgattggatggctgggcgcagagagtttttcctttgagaaataggcggtggtttgatgggcgttgctggctctggcctcttttgtttgttcggcattctttttctatgatgtattgtctgtccatattatgtgccttgtgtataaagcttgttggttgctgtgtgacgttggcgcggccgccggcgtgtccgcaatggccttggtgtcctcggcactggtgtcctttgtcgcggcggcgatgtgcagtagatgagtgttgctggctcttgcctctcgtttgtccgacattctttttattatgtgtctatatatagtgttatgattaaagtttgttgaaaaaaaaaaaaacaaaaaaaaaaaaaacaaaaaaaaaaaaaaaaaaaaaaaaaacaacaataataaccaaataataattacacacccaaacccccccgaaaaaaaaaaaaaaggcccctaag

SEQ ID NO: 36533 - DNA, 812 bp, Triticum aestivum
  Clone ID: PAT_TA_36533
tcccactcggcaccaccgcgccgcccgcccgcgcccggaccccgcgccgctgcacgcccgccgggggcggaccaagaacgcggcctgcgagctcggggagcacggcatccgcgtgaactgcgtgtcccccttcggcgtggccacgtcaacgctggtgaacgcgtggcgccatggccaccatcgcgagccccagggagggcgcgcgccggcggccccggggagccccgaggaggcggagaagccggagcagggtgatcgccgacatcgacgacgcggccggggaggcgctggcggccgcgctgggcggcgcctgctgcagctacgtgcactgcgacgtgtcggtggaggccgacgtggagcgcgccgtcgggtgctgcgtggcgcggcatggacggccggccgcccgctgcgacggcgcgggcgggctggcccggcgggcgcccccggcggccttcggcgccaggacccgcggctgcccctccctggtccccccccagtgcgtccgcctgccccccggcatcacccgcgccgcggccctcggcaggttgcccccggcgcgggccaggcgccagcggcgccgcggcggcggccccgctgggtcccccgtggcggtggcgagcgtggccggcgtgctcggtgggatgggcccgcacgcgtacacggcgtcgaagcacgcgctggtggggctgaccaagaacgcggcctgcgagctcggggagcacggtatccgcgtgaactgcgtgtcccccttcggcgtggcgacgccaatgctggtcaacgcgtggcgccatggcgaggacgaccaaaggggg

SEQ ID NO: 36534 - DNA, 472 bp, Triticum aestivum
  Clone ID: PAT_TA_36534
gccggccggtctattgcttgccaaggaaaatgcctaagcttctgccatcacaagataataaacatctcctaaacttggagtcactatgcaaacgctatgagatctctgtggaaggcccttctcatatagcaatgcaagatgtgatggcattatgtcatgtttttcagaaaatgagttttgatctacaactgacacatgaaggattaatgaatgaggccatcaacgctagttatttcagcaagtatcttaactaaacatttgttgtttccagcttccttgttaagtggttacatttatttgactttccccaataggattagcctctccttcacattgctggatattattgccttttgttgaaacatctcaagaattatggcttctttttattgaaaagtaactgcatttgtcagtgaaagccctactgtgggagctggattattgctaaaaaaaaaaaaaaaaaaggccccta

SEQ ID NO: 36535 - DNA, 796 bp, Triticum aestivum
  unsure (1)..(796): unsure at all n locations
  Clone ID: PAT_TA_36535
gccggccgggccgggattttgctttcnaatcaccttctccttcctaggaatgcaacgacgccgagccaaatctccccatcgtgtagcagccgcctcctggaccaaccctctcgactttctccagcttgccgacggtggaggcgggccagatccggtgcctagctgggccattgcgcccagtggagatccagatccagctcctgaccatcttgtcaccggcggcctgattgccccggcggacctcccctgttctgagctgcgaccttgtgcggacaagttctccaaggtactctcctccgacgtccacagaacaaccttgccccatcctttgtcctaccccaaccagcccattccacatgtcgcccgcacccctgcgcatctagctccgccacctgggaacggcggagaataaaactccaatcttcaggtctgatctctcccagcacaagaagctcgatgaacaataagcactagtaacagaggcaaaggctatagcttttctatttggccaaaaaaaaggctataacttttctgttgtgtaccatcaagtaccaaaagttgatgcagtttctagtggcgatgcttgttgaacggtcattattccactccatcatatttagtcttgcctgtgatgtacaaaaatgatcctttcatgctatgtaacacttgatattttgacaattgatcatagtaagtgaaatgagtgtctagtagtgagatcaatattgcataatattaatcatgcagtctaatatttgtgatgatgtccaaaaaaaaaaaaaaaaaagcccctagg

SEQ ID NO: 36536 - DNA, 1317 bp, Triticum aestivum
  Clone ID: PAT_TA_36536
gccggccggtccgggcggacgacatatactcgaattttcccaattcctccatcacacagaaaatatgggtgtcaccaacaagcgaacgattaccaagacccgacgcaagactcgcgatgttgaccaagtcaaggccgatatgctgtcacctaagcacttgaagcaattcatggagaccaaggctgccgaggatcttcctggtcttggacgccactattgcgtcgagtgttccaagtggtttgatacgggttctactctagtctcgcatcagaagggaaagcctcacaagcgaagggtcaagcagatcgccgaaggaccttacactcaggaagaggccgaggccgctgtcggcttgcggacagacaatggcgaccagaaacgcacatttgccgacggagacaacgacattgccatggatgcttgaacgtgcacgatctcgatgtctttcatagagaattgaaaaggcgattggtgcttttgggggcgtatcggagctagggttgatcttcttggcatcgtaaacggcgtttcggtttatttctgttgactaccatatcatattcatcgcacacctcgaccgcgcgccctggcaagcccactgggccggcctcgtccgactccccgtgttgatctaccccgcgccgttgttcctcgacctggagctgcaggtagacgtgattgtcgttttggaggctctggcgtggtgaacttggatgtcttggcagtcgttggtggattctcgacaaacgatccatccgtggtcatgaatgtcatctctgcatcagcctcggatttcgatggggtcacggctggttgctcttgtcgggttctatctcgacggaaggattcaggaaccggcccctcgggaaaatcgacacagaaagcattcatattcaatccataaaggaagcttgcgaacgactcgctaaatctcgccagactctcgtgcatgagctgaaagtgcatcatattcgtttcaaggtcagccatggcatctgaaagctcggcaaaggctggctcgaatgcgttcaggggaaatggtgcatcatggtgtctagcactacgcgcagaatcgcgaaaagaagatcgcgacgagggtcggagaggagtcgtaggtctggatgttcgtgaacgagagtttggtcgcttggcggcgtccttaggtgtcattgacatcttgaggcgttgtcttgcgccggttcaaataatcgattgaatctgctcaaatttttctgtttgtttcaaaatatgcgagcgcaggcgcagtttcgcagtatttaagttgcgaccttgaagttaattcccaacccggccggc

SEQ ID NO: 36537 - DNA, 2097 bp, Triticum aestivum
  Clone ID: PAT_TA_36537
ccaccgctcctccccgccgcccgcccgcccgcccgatccccgccgcgcgcagccgaccgccccagcggcactccgcgcgccgcccggtcgccccatcccgcccccctccctcccctcgcgcgccgcgcgagctgccttgcacagtgagtactagacaggcgaggggtgtcactccccccttctccccccccgcgcctactcctcctcgtcgccctcacagtcgccttttcgtgcgccctcttgccgccctcccccctcagttcgctccgctggggcccccggcgtagcttctccctctccctgcagctgctccccgcgccgccagcggggaggtcgccggggttgcgcctggagagtaccggctgtctgtccgtcgatctacccgccgtcgcgcctctcgcgggctccggacacctttctttgattatattaaccgagaggctagttccaggcggtagattccctcctcgagctgccacacctgtcctttgttagaccatagatagcaggagggcgttgaaatgtggcagcttgcctccatcctttgttacttctgaatactgaagagcttagcttatcatattcttcaaaattcaaggtcatactgctatgcaatctgggatggaacaaacaacaggggtaagtggtcatgaacatgtaattgatattccaagggatagcggtccttcggcctcggcatcgcacagtgttggtagagagaaccatgaagagttgaatcctgtggataggccttcaacaagagctgcaacgtctgccttgcagccaccagcagcaataggtcctcctcatgcagaaaatacttcaggcactaggagacgtgataactatggtcggcgacataggagccctttgaactctggactatggatttctgttgaagttatcgttaatgttagccaaattgttgctgccattgttgtgctatccctgtcaaggaaggaacatccacaagctccattgtttgagtgggtcataggttacacagtcggttgttttgccactttgccacatctttactggcgctatatacaccgtaatattgtgaacggtgagaatgagccagcacactcacttcagggctcctcgcagaacaactcgactgagcccactcctgcaagtgtatcagaacggcgaaggaatgctgcacgaaatgcagttctggctaacccaaggattaatgcactttttgaccacttcaagatggccttggattgtttctttgccgtgtggtttgttgtaggaaatgtgtggatattcggtgggcgttcttcggctgttgatgctccaaacttgtacaggttatgcatcgtgttcctcaccttcagctgtattgggtatgccatgcctttcatcctctgcgcaatgatatgctgttgtctcccctgcattatatctgtcatgggcttcagagaagacacaaacaatacaagaggggccacttcggaatccatcaatactttgccgacttataaattcaaaaccaagaaacgccgccatggttcaggtaacgaagccgaaggccaagagggaggtatagtggctgcagggactgacaaggagcgatcgctttctgctgaagatgctgtttgctgcatctgccttgccaagtatgcacacaacgaagagcttcgtgaacttccctgcacacactgcttccacaaggaatgtgtcgacaaatggctcaagataaatgcactatgccctctgtgcaaagccgagatagcaagctcatctggcacatctgatactcgccacatcgaccatacagtaccgacgcaggagatcgaaatgcattagattggtctgccttccatcttccgaggtgatacataagcatatagtttgctcgcggtgccggtctgcatgtataaagttgatgcttttgatctatggattgtagcgatggtgtcccaaggttttttttgtccttttttttaatcttggagaagttacagctcttctcgctgtcaacactcttgacaatgcaaatgcagtattgtttctatttggcgttccgctgaacatggagaaatgctggcccaggcccaggtatatatatgttgcaaaaaaaaaaaa

SEQ ID NO: 36538 - DNA, 736 bp, Triticum aestivum
  Clone ID: PAT_TA_36538
ccccggtcctgtcggcgcgcccctcaggtccaccaagaccggtacctgggctgttccctgcctcgaaggtgctcccggagaagtgcggcgacgcgcgttcgcggcggagtagggcccgagcctggcccccgtgtgccccgcggccgtcgtcgccggggccccgccgtccatggtgtgcaccagcgtcccagcagccctcgcccgcctccccgccgccgacgccgccgtggaccccctggtgcggatccagcggccgccccggtcgtccccgcccggccacgccgacgacgtgcgccgcggtcggacaagctcctcaaggaggggttcgagtacaagtacaagaacctggacgagatatacgacgacctcgtcgtctacagcaggaccctggggctcctgaaatactgatataacgggctctcggaatgggattatgcgcttgcaaaataaatctaccctcctagaggctagagcataaaatgtgttgaaatgttggtgcttatgtttcatttcatgattgctgaccgagagcataattcggtcaaatcgtgtagctttgttcttcccttcttctttgtgtttatcttgtataagaaaagaagattactatttccatgtcaaaaaaaaaaaacaaaaaggccgcaatgtttgtgcttaagttcagtttcatgattgctgaccgagagcagagcccgtgaaatcgtgtggcggccggttccccttcccgtttgtgctt

SEQ ID NO: 36539 - DNA, 695 bp, Triticum aestivum
  Clone ID: PAT_TA_36539
gccggccggtccgtcgacaaacagagagagagaagaaacagagcgcctcccttcgaacgcgagcagcggaaacagaggcggcgaagcaaatggcggaggccccaagccagatcgaatccatgcggaagtgggtggtcgatcacaagctccgagccgtaggttgcctgtggcttagcgggatctccagctccatcgcgtacaactggtcgcggcccaacatgaagaccagcgtcaagctcatccacgcaaggttgcatgcgcaagctctaacgatcgctgccttaggtagttgtgcattagtagagtactatgaacagaactacggttcttcaggaccaaaggtggacaaatatacaaggcattacatgtcacactcgcataaagattaattatctgcatggtcggtgctggatcctggattagttttaggttctttcctgggctccatcaaagggggctgctcccaggattgttccttgaagtcttctttattgcgaaatgaaatgatacttgccaggtcctttcctgagcaatgagggtgctatacacaattgcatatatgatctgcataacgtgaatgtaagattcattctgtaacattattttgtactctttatgatgttacactggatataacaacagtgttctgatgttgcactggattgcctcaaaaaaaaaaaaaaaaaaggccccta

SEQ ID NO: 36540 - DNA, 952 bp, Triticum aestivum
  unsure (1)..(952): unsure at all n locations
  Clone ID: PAT_TA_36540
tttgctgtgtttcggtgcctttnngatgccggctccccacccgctccacgccgggctcccctgcctccctgttctggttcatcttttatttaactctccattactcagtgaacagaggtggtttccccgccctctgtgcctagaccatacaacacaccagcatatttctcagttaatccgccgaagtacgactccttgagcttgttgaaggagagcgcggtgagcagagaatcggagcccgcctgatggcggcccccgacccgcccggccgggcgcagtcgatcccgctgcggcgcagcaggtcgatggagtccgcggcggcgccgtcggtgcgcggggcgaagccccggaagttgaactgccagacgcagggggacggccgtccgggccgagggcggggaggccgccgcgctcgtcggagaaggtgaggccgagctggatgagcttgagcatgtcgacgttggccttgagcgtggcgtagttgaagtcggcgttggacttgaaggtgccgagcgggcggcagacgacgccggggaactcggtgtccatggcgacgtaggggtagtcgtcgacgatctcccggatcacggcgaactcggcctcgaggttctccgcccacacctcgcggatctccaccccgtcgggcttctctacggtcggcgtcgccatcgggtgccgggcatcaaagattcgaacttctcctcccctctccttcctggaagcctcggagctgggtggcgcggcggagcgggaggcggcggggcccacgggcgagcggcgaggggcggcggggctcccgtgggcggggaggtgggggcggggcgggaggaggagatccaggggaggggactggagtggagtgctactttttactactaggtggggggtgctttgcgcggagtccgcgtgacgtgggcttaataaaagtgttgtcacgacgtaccccagcccc

SEQ ID NO: 36541 - DNA, 351 bp, Triticum aestivum
  Clone ID: PAT_TA_36541
caaaaatgacatcagtttgataatgggccaaatctaaagcccaagttatgttatgtattattcagtgttgaatttgtcattttttttgagttatgtttcaaattttgatttgaaattttgtgacaacctgcattgatgttgtgtgagtgtgataattttttttcagaattctttaaacattttaaaagcacaatatgacttgggtgcaccagatatttttctcatggtccaacccccattctttatgaccgcctcttaagttaccaccaatggttgctaacgctccaccgtcagactgagatacaagattctttttttggctcttgctgcatgttagattagagtaaatac

SEQ ID NO: 36542 - DNA, 1114 bp, Triticum aestivum
  unsure (1)..(1114): unsure at all n locations
  Clone ID: PAT_TA_36542
cggactcgtgggccaggggtttccatgccgccaccttcaccctccccatgtccgacatcgtcagctataatgtcggagggaaggctgagaagaacgtggagatgctctctgaacatcttggtgattgggtcagggaggaggacgggaagaagattgttttccacactttcagtaacaccggctggctttgctatggcgtaatactggagaacttgcagcggcaggatccttcagcagtggagaaaatcaagggttccataatcgattcagcgcctgttgctgttccggactctcaggtgtgggctctaggtttctcagctgccgggccgtgtatcatgaagaaacacagtgtggcaacaaaaggcactgcaccaaatacaaggtctgacgtcgtagttgtggagtctcacaaagatatcagaccagcagctaccgaggcggttctactatctgcattggaaaagttttttgatcttgttctgaactatccggccgtaaataggaggttgtctggtgttatggagcttttgtcctcaaaccaaccaagctgtcctcagctgtacatatacagctccgcagatcgggttatcccagcaaagtcggtggagtcattcgtggagaggcaacggaaagcagggtgcgaggtgaggtcgtgtgactttgtgtcgtcccctcatgtcgaccattaccgcagcaatccggggctgtacacctctcagctgaccaacttcttggaggactgcgtgctggcccgccgcgaggactcctcgtcgcggtcaccgtctgcatagggtgtttctgcagcaataccaacatattctttcctggtgatccattgaaatgtaccaggattatacatcgactaattatacatctgacccaatttactcgttccttgttgttggttcgcttgtgggtttatgttaggaggcacaactgtaaaaaacgtgagggagaaaagcaaaacaaaattatggttggcttgctgttggttccagtgcacaagcacaaaccattgatttgtgtgngaggaagatgtgtttgtttctttgtgcatactctgaatctccaatgactggttaacttttctaaaaaaacaaaaaaaaaaggccct

SEQ ID NO: 36543 - DNA, 646 bp, Triticum aestivum
  Clone ID: PAT_TA_36543
gagtacaacaaacactccagtcacttactcgggttctcttctgctgcgaaaagaacaacacccactgttcgcaatcaaatgggttctcgatggattcgacccgaggtgtacccgctgttcgcgacgactggcgtggccgtcggtatttgtgtgatgcaacttgtgcgcaatatcaccaccaaccctgaagtcagggtgacaaagcagaacagggcagccggggtgctagagaatcatgatgaagggaagaggtactcccaacacggggtgcgcaggttctggctctccaagcgccctgactacatgcatgaactagacaacccgcccaccgaccggaagtagatccaatgacggatcgtccatgagaagaggccgccgtgtttgctccatccatcacacatatatgcatactacaagaacaaacatgcttcgtcgcgcctgctattattgttgttttcctttgtttactatatccgtgtagtcatacatgtatgtttttgtggctgaaaagaactatattgttgttttctttgatatgacatggtaatacattttaacatctctatagtttattttcttgccaaaaaacaaccacatgtattatccttttgccgagaagaaaaaaaggcaacaagaggaattttag

SEQ ID NO: 36544 - DNA, 958 bp, Triticum aestivum
  Clone ID: PAT_TA_36544
atcgagcacagcacttcccgagcattgaaaaagcaattgaatggagtgtcaaaggtgggccgctacggaacatcgattctgcgcgtatctctattccatctaccttgaagtatgatgaatcaaaggaatgctatacataccgtactcctcttgagaaaacagagaagtactggaaaggatggtacgaaggtctttcagacaagttcttatcttgtcctgtacaaaagatactattattagctggcaccgatagattggacagagctttaacaattggtcaaatgcaagggaagtttcaaatgatagtagttcgacacactggacatgccatacaggaagatgtacctgaagaatttgcatcacacatactgaacttcatatctcgcaacaaaatagggcccaatggtgttgagatacctggcctcataaaaaaatggcagcattaaatagactgtggaaggaggagcagtacctactgccaacatcagcactatttagggaaaaagcgagggctcgtatcgatgcctgtttattgtgtttctcatggaagagaaagtttgtgccaaaaagaaagacgaaacaatagggatgagatttaccactcagtcgcctatcatccatgccgtgaatggtttttcgagcaactattgtgccatttgaaacccacgcgtccgcccacgcgtccgcgcacgaactagattcgtgctttctaggcgtattgatacattttcaagccaacgcttggtttgttgtcccaattgcatgccccttcaaggcaggcttcgattttgctgccccagttctcccttaacataagattgtacttgagccttggagcccatattatacccagtcgaatgcacggtgtacaaatttgttttttttttgacgggtgtacatgcaagattttgttgttgttgaagttaagaataatactccctccgttcctaaaaaaaac

SEQ ID NO: 36545 - DNA, 732 bp, Triticum aestivum
  unsure (1)..(732): unsure at all n locations
  Clone ID: PAT_TA_36545
gtcccccactctcggggtggagctgcactcccccactctctctcggtggagctgcatctccgtcaatcggcgcgtgtggtcgccggctcgccgccgccacggcagaggacgccttctccccccgccaccgcccctcccatcgtcaatacccggcaccacctacctctatctccaagtctctgacccccaccaccacacatcccgaccgattccgaaggcaaggggagagaacaggagctagagaggcgggggggcgatggcggtggtcggcgttctcgccctgcagggatcctacaacgagcacatgtccgcgctgaggaggatcggggtgaagggggtggaggtgcgcaagccggagcagctgcagggcctcgactcgctcatcatccccggcggcgagagcaccaccatggccaagctcgccaactaccacaacctgtttcctgcacttcgagagtttgtcggtgcaggaaagcctgtgtggggaacttgtgctgggctcattttccttgcaaacaaggcggtaggacaaaaattgggaggccaagagcttgttngggggggctagattgcactgtccaaccgggaacttttttgggagccagctgcaaagctttgaaaccgaactttcagtgccaatgcttgcggacaaggaaggaggcagtaatacatgcccgtggagtatttatacgagcacccgctatcttggaagtaagatcggatgttgaaata

SEQ ID NO: 36546 - DNA, 901 bp, Triticum aestivum
  unsure (1)..(901): unsure at all n locations
  Clone ID: PAT_TA_36546
cagcggcgtccctggaattaaaaaggactcaggagcgtccctcaaaagaaaaaaaagactcgaggagcggaaccctatccttcccaaccggccgtactttggtaatcgaagcacaccatcgtcttctggcaaataaacgctgaaactggaatcccacgcttgttcttcaccaatggagataatgcacaaggcaactgaatctgcttatgatgaagataatggtaaaggtaaggatgtatcaagcacggaagaaaacgatccatggaatccttcatatcgatgtgcccctcgtccttgtaaagacttgactgacaatgtcaaattaatgaaggaggtgttgagggaaaaacatgttttgtttgctgtctccagagcaacccagacaatcgtcccagaccgtactcctcagtcagtgaatgatgccttcgtcaacaaattaccccgcttggtgcccatcctggaaaaggatagtgtcaggctttttctcaacttattcaagcatgactcagtgggattggcttggggtttcgtcatgacgccacagaccttcaatcagatgatcgtgcaaaatgccctgcgatgtgcgaaagttgccttggagggcaaggcccctgagctcaatgggcaccgcgccaatcccaactacatgaactcacgtgggtactttcccctccaccaagctgctgaaatgttctctgctgacatgatcaagttgctcttccactatggcgcgtcggccaatttgcgcacatctggccctgaagtcatcgagggcctactcccactacatgttgcagttgagaatgcttgccaccataagtttcttgagagaaaacctggtacccgacaaaagnatactgactatgtctacaggctcattcaactgggtgcttacctgaan

SEQ ID NO: 36547 - DNA, 597 bp, Triticum aestivum
  unsure (1)..(597): unsure at all n locations
  Clone ID: PAT_TA_36547
cacgagcaggagctcaatcccgagcgaccccgacgcctctcccacacctccggtggcctgcaaacgccgacgagcgcagccaggcgtgaggggtggggaggggcgggttggtggtgagcaccggggggatcccccttctcccatggcagcttgggtggtggtgagggagagctgcgtggtcttcccggcggtgacggagaggtccagggggaccggatggctgaagcggaggaggcgggcgctcgtgcaactacttctgaggttcgagctccgctgcgcaccagtctatttgcatgctgccgccgcgctactcaccaactcctgccacgggaaaggcgggggcgggccggcgggtgtccctggtggggctcggcctccgcggtggaggcaggcgcgggccggagctactcgatccggtgggcaagctccaccccgcatttgtcgtcaacatcgacgggcttgtggtcgtgggggggcaatggcttgttcgtcaggctgtcgctgcggcccaataactactacaatcatggagacatccgcgcgctcgatgtgatcttcaggaaggcctttctgctccatgctcctncagcacgcgat

SEQ ID NO: 36548 - DNA, 643 bp, Triticum aestivum
  Clone ID: PAT_TA_36548
gatcgcgcattcatacaatactttccgatggaccctcagacagtgtacacagggcgcctcgtggccaggtttcttgtgtcattccaggatgacagagcataattcggagacgctgtttaagaactatttgtccgagacatctgtcgagaaaggagtaaaatgcatgtttgtttaacggctttcttggatgacatggcgtatgcgaggtatgtcttggtataacggtcggtgaatgggcgagcgtaccctttcacagagtgggtttctaggcctcttttttgcatgatatatgataggggagggggtacgcaggcagcacatgaggctgaatgaaacaatgtatgccacgtctgaggaatagggcggtctcatagttggatcttgacacttgacaagcttgcatattcaaggcttatcgtatcatgaatatggcatgattttagctagcaacacttttcagcagcgggcaagacattgtgcaacgacgatagtaaccatgcatggggttcggactggtcttcaccagacagaaacaggccaggcaagacacagtagttgagccatagccttccattcgtcgtgagcacgtctcagtgcagctacaatagatttattcactcaaaaaaaaaaaaaaaaaaaaaaa

SEQ ID NO: 36549 - DNA, 844 bp, Triticum aestivum
  unsure (1)..(844): unsure at all n locations
  Clone ID: PAT_TA_36549
ggtgcatacctaaaagaacttgcatcgagttttgagttgatgggtaacgacccccctctcttctcgttctccgcctcccttgagtgtcccccatggaactccgggttaatcccgagcctctctcgccggaatagccggtcgaagatggcaaaggagagacgccggcatctctgtacatactagttgtaggctttggtttaggtctcggcttgatgctggtagttggcgctgtgccgggagagaatctacagatctctctggccagatctgtagcatcccagtgctcttcctccttgcggtggggatctcttcgtttgcaataaggctggcttcttctgcgaatctggtgctggtgcccgtgtcctacaaactgtgttatctggtcttggtgatctggaggacgcttgtctgtagctcgtgcgtcggctggtgctggatctggaggcgggagtatggaagctgctcccgggagcgaaatcatggaggctctttgttggctgccatctaagatggtcgaagggtgaccgttccctccctcttctttggcatcggttctcttcggtcggcgtttgcaggtgaacatcaaccttctggcttctatgccattgtggaggcccctttgcttcagtgcagttggctcccggcacctcgccccaagtggtgttgtccccggcggcgttgtgcttgactgcactgaggtgtgcagaagcggtggcgatggagctggactcgatggcgttttcttcatatctttcagggcccttagtgcaaaaagccaggacatggttgtaatttctttctcctttgatggctttnctgtgtaatttttgtcggctgtttcatg

SEQ ID NO: 36550 - DNA, 534 bp, Triticum aestivum
  Clone ID: PAT_TA_36550
ttttgaaagacaagttttgagatcaaagttggcaagggaaaaagtatcaagttgcacccatcaataaccgaagaagtgcccttgcacccttttgcaagggttgaaatttagtccaagcaacccataatggccaagagtttcaaaatgatgaggtttaagatgaggacatatttgagattggggtgtttgtaaagttatgcagaagcacccatggcagcccatagcagttcgccggccgaaacgggcaccagcataatgcctttgcattcccaagtttcaagaggtgtgtttggtgaggctaaaaggatcttctgctgggatatgtttctacctaaaacctattttgcacttttttctatgatgtaatactttgacttatgaacctacaactgtatgcatttagacctgatggatggttgtgcttttggctgtcctggacttgtgaacctatatatgtatggattatgtatggatggagacttgtgaatctatggatgatggattgctcaaaaaaaaaaaaaaaaaaggccccta

SEQ ID NO: 36551 - DNA, 675 bp, Triticum aestivum
  Clone ID: PAT_TA_36551
gccggccgggcccgggaagcctacaatcacaaaccatcagaccaacactcaatctcgatttctgaatcatctcagatactaccaagcattcaaacaactcttctttaaaccccactcaatcaaacaagccacccaacatgcacgccctcagcactctcaccacccttaccatgtctctcttcgcggcccagaccgccaacgcatggctgctcgaattctggggcacccaaaacgtctgctccaagcccaagggtagcgccgctgacagctcagccggtggacagcccggagaaggcaacgattgtatgatggcctactacgacctggaagccatgctcgtcaaggactgggatgagggatgcactgtcaggttgtacaatggcaagggcttcaactgtgatggtgacctcatcctcgagtacaccaaggagaaggcagcggaggaggagaagctctccgatgacggaacatacatgtgtcttgctgatttggctggagagcctggaccttaccaggcttcttacacttgcgagtaaatgttggaggctattcggtttcagagggatttaaactatatatatacgccagcactcttgctgattttaggacagatttgtgatgatgaatcaaagcgacatgttgaaattagaaaaaaaaaaaaaaaaaaggccccta

SEQ ID NO: 36552 - DNA, 676 bp, Triticum aestivum
  Clone ID: PAT_TA_36552
gccggccgggtcggggcatcacacgggcaattaactatagaaaaattcaaggctattttttaaagtgacatttattcacgccgataatttccagtttcatgtggcaatgacgcatggaggacgacggtcacgagtgcattgtcgcaagctcacgggagggaggcacacatctcatccaatggaaaagcacgctccgaaaaaaccctaaccctccatggagccattgctagggggcgacgagatcaacgccacccatcacgaccactgagatgtagaaggctgggagccaaaaacacttcttaattttgatcatggacaaggcattgtggttggcggtgcgtggtgcagtgcggagatttcttgcctggcgtataacaatgcatgttcaatgggtcgcctcttctcacgcacaagtctcagggggagacaacgacagctattcagaataaccacaacaaaattgtgacactggtggttagtgggagaaggaacctgagaccgcagccgattctggagcaagggcgatgtgtagaagatagttgtatcaagcatatatatataagtcactctggaaaaagtgtgtagtcgttgttgtaatagagatccatacctatattttgcaaagttcaaaaaagcgctaggcgctaattaaaaaaaaaaaaaaaaaaggccccta

SEQ ID NO: 36553 - DNA, 631 bp, Triticum aestivum
  Clone ID: PAT_TA_36553
gccggccgggttgggatttcattgtcatcttcatcatcctctacacctctgctcatcttcttctccttgtaatcttttttgtttcatcagatttagaggatgtcttgcatctgtgaatccggttgcaactgccactcaaactgcctgtgcgacaacatgtaccctgtatctcgacgcagcaggccagtgccgtggcccaggtcgccgccgtgaacgtcctctcggtgtcatctgagaacaagacccgcgcagttctaggtgatcctcctcccaaaccgcatacgcctgcacctgccctaaccactgcaagtgcaacccctgaaactgataagctggatgcactcgctgacgatgctcgtgagactatacgcgaataatcaacgtacctctgatctaatgtatctgaccacggctgcatatgcctgagcttgagtgtatacttgatcggtctcacgtctatgctctgcccttgatgtccttgtgagtatgggaacgcacgtgtccctgtgattgcttcatctatctccactatgtatgtcgtgctgtctatgtaagaatgaatgatttgcctccttaactactcctaaatctataactaaagaatacacacaaggctcctagaattcgatat

SEQ ID NO: 36554 - DNA, 863 bp, Triticum aestivum
  Clone ID: PAT_TA_36554
gtgcggcggccggccgggccggaaaaagagaatcatttcatcgtcaaaagcatttgttctttgtatccattaattcaaaatctctaataatggcctccaaattcctcgccgtggccctcgtcgccgctgtcccagccctggccagaactgatctcgccggctgcaccacctacgataccgtcgtcagcaacgccgatggtatgtacgctacgagaatctggtacgtccccgactcgggcgagatctgcgacatcctcgactgcggcggcggccgagctcctcccaagactaccgtccctggatgtcccgcctacgagggcaccgagacgtactctcccctgtttatcgaccccaagactcttggtggtgctgcacctgaaaagactggcgatgctcagggtactgtgagcgtttctgctactattacttcggcccctgccacggagacaaatgccagtggtactgccactgagactgaggctgctactgaaaccgagactgccagcgagacagagtccaagtccgagactgcatctgagagcacggtcaggcccatcatctccaacacccgcaaggccaacgatacaggcatgtctactgcaatgacaacccccggccgtgctactcttacaaccactgcttcctccggagccggatccggtaccggtactgcatcttccggatccgattctggctccgcatccgactccgagtcgaagcccgcttctggaacggggtctgccgtttccgttttcaccgctggtgccgcgatgcccacagccggtgctttccttgctctcgccggcgccgccatctacgccgggatactatagatgattattttagtatagatagactggaca

SEQ ID NO: 36555 - DNA, 750 bp, Triticum aestivum
  unsure (1)..(750): unsure at all n locations
  Clone ID: PAT_TA_36555
cggacgcgtgggagcccacccaggcacaggtagagacagacaaccaggagcacccaagaagcggtgcaggaggaatcccggcctctgtagcaaacaagaatccatccacctgtcctcctcatcgagatctcgcacggggcggctcgtggtgaggtgagtgagtcgaccggccatggcgttcagggcctgcctctcgtcccacaaggcctcgccgtcgccttccgtcgcgcagaggagggccagcaatggggcaccgccggtggtggccatggcctccaccatgaacgaggtcaaaattgccaaaaagccctatgctcccccacgcgaggtgcatctccaagtcatgcattcgctaccagcacaaaagcaggagatctttgattcacttcaatcttgggctagggacaacctattgaaccttctgaagccagttgagaagtcatggcagccacaggacttcctaccagagccttcttccgagggattttatgatgaagtaaaagaactgagggagcgggcaaaggaaatccctgatgactactttgtttgcctggttggtgacatggttactgaggaagcccttcctacgtaccaaacaatgctcaacacccttgatggtgtccgagatgaaactggcgcaagcccaactgcctngggctgtttggacaagagcatggactgctgaagaaaacagccacggtgatctactgaacaagtacatgtacctttccggacgggttgacatgagac

SEQ ID NO: 36556 - DNA, 1732 bp, Triticum aestivum
  Clone ID: PAT_TA_36556
tcgccgcgcgcagccagcccccggtagagcaagccgagacagacaaccaggagcgcccaagaggcgctggaggagtgatgccggcctcagtacataacaatgtccccccccctcgtcctcctccacggggccggcccgggggcagcttgtgtcgagcggccttggccgtccgggcctgccgcccggccccctggcccccgcccccgcctgccgtcccgccgccgtccggcccgcaaaggagcgccggcggtggggggccgtggccgccagcatggacgtcctcaaagatggcaaaaagccctatcagcccccccgtcacccgcccccgcgaggtgtgcatccaatgcatgcactagcagcaggaaatcaggcattcgcttcttgattcgcctcgggcttgggcaaggaacaatctaatgccccttctgaagtcatggcagcaaccgggccacccaccaggccctcctaccgagcccttcttcgatgggattatataatgaaggaaaagagctaagggagcccgcaaaggctacctcggttggcttctttggtggcctggttggtgacaaggtcgctgacgcatcccatccaacgtacaaaacactgctcaactgcctgggtggtatctgagacgagcccaacgccagccgaactgcctgggctgataggacaagagcctggagtaatgaagaaagcaggcacggtgatcttctgaacaagtacatgtacctttccggacgggttgacatgagacaaattgagaagactatacagtaccttattggttctggaatggatccaggaactgagaacaatccctacatgggtttcctttacacatcattccaagagagagctactttcatatcccatggcaatactgctaggcatgccaagcaatttggggaccttaaactggcccagatatgtggtacaatagcagctgatgagaagcgccatgagacagcttacaccaagatagttgagaagctttttgaaatagatcctgactacacggtgcttgcatttgctgacatgatgaggaagaagatctcgatgcctgctcatctcatgtacgatggtgaggacaacaacctatttgagcacttcagctcggtggcgcagcggcttggggtctacacggcgaaagactacgccgacatccttgagttcttggtccagaggtggaaagttgcagatctcactggactgtccggtgaaggaagacggtcgcaggactatgtttgcactttggcaacgagattcaggcggctggacgaaagagcgcaggcaagggcgaaacaggggcctgtggttccattcagctgggtctacgaccgcaaagtgcagctctaataaagaggaaggaacacaaggttaatgagactgcatccatcctattatttcgtgtttcgggtcagtgtaggttttcctaatagcagggtagaatgttttatgtgtgctgtcctgtaagttgttggatgacagtgaggaagaggctagtgaaagtggtgtgagatgctggctggccatgaagggctccgttaccattttttgttgtgttgaatattttatgaccgttgaagtttacaggggcttgtataattttaaaagtaataaatggatatttgtataaaaaaaaaaaaaaaaaaggccccttaggtgcctcccaactttaaagccttttttctgatcgaaatgcaatgagttcaacaaaaaaaaaaaaaaaaaa

SEQ ID NO: 36557 - DNA, 856 bp, Triticum aestivum
  unsure (1)..(856): unsure at all n locations
  Clone ID: PAT_TA_36557
aattttcttcctagatgaaaatcataagcataatcgctgagggctacagactcaaccgctttgtttcctacctttttactgctagtcttggcatggatgaggatatgcactgggctccgagcagcgaacgtctgcgttctgatggagatgcgtttgcctagaaagcattgtccgacatctctttgaacgctttctcttttctgttcgcccggcggtccgggggggcattgtaccaggcttgggttctttgtactctcgtcttgctcgccagattcggctgtagtcaaaccaacatggaaggaaatctggtcggcctgcccatctcaatgggcaacccgcttaccaaccttcatatatctcttcacagtactaaatctgttctttccatctttttaagaatattatgcgagtgggcagtggaggggagtggtgcaatccattcctaagcaggctctctcggaaaacaagacccgactgtcttcctccgtttgtgatttgtaatgaacctgcgtctccttttggttgtttcaaatcctgcgaggaagatcgtccggtggttcatcatacaggcagcctgttgcgaaagtctcagtctgcgtcactgatgtatacatttctctttcttttgcatcaaatcgttcaatgagaaaccggatacaaacttatctgttgtaaacttatataaaataatgccaattgaagaattattgactggaaaaaaaaaaaaaaaaaaggcccctattaacaacgtttttaattaacaatattagaaagncacataaaatctaacatagcacaaggtcaataaantctnataaagtacaatacatccttgcagtaagttaggcccngaagn

SEQ ID NO: 36558 - DNA, 765 bp, Triticum aestivum
  unsure (1)..(765): unsure at all n locations
  Clone ID: PAT_TA_36558
taagtgatttaagaagtcntttggctngcaactgngctgtataatggngntcactttcatggntcgagggcttntgtttccttttggggattntaggacntggacttagcggtccctgttntagagaatcggntttaatgtatcaaactngggccttgtcacattggaaaagcgaattgaaggagagtgaacagacacttacgttgaaatnaggaaagagatggcctcggattgttgcttagaggaaatccggacaaagtggtgaatcatctaggataccaagttgtatttaaaaccnggaacacttccattgggagagtccattaatcaccaatgtattaattcaaaagggttagtctacaagactagaggactaaagggagcgcacatgtttcccacgcgtccggactcgcaaaacacagaattatgagagtccctattacatggtatggtaaattcactaagcatagaagctaagacggcggggttgggatggcccaagcgacgatgccagagatcgacggaggccagcatggatgttggaggggtggcggcaggaactccattaagagaataaagatcaccggagctattgaagcgagcaatctcggccttggtcaggtaatccttcacagataaaccaaaagggtcaaattcagccgaaactagattgtcgcaagtaaattggcgaacagagataagatttttaataagggcgggtgcaactagaacatcgcgaagtaaaagaggtttggtggaagaggg

SEQ ID NO: 36559 - DNA, 282 bp, Triticum aestivum
  Clone ID: PAT_TA_36559
gccggccgggttcgggaatatgtagctatcttgtaccatatagatcgcgtagtgtagtggtagtaaatttctgaggtttcttgctagctatatgagtttctttgtagactgccatactcactagggatttctactgttttagcggtatatgcatgcatgatttgagccgttgtatgcacgtaatttacatacgtatatgtatatgattcatttttctataattatcggaaaaggctttcacccttactttataaagaaaaaaaaaaaaaaaaaaggccccta

SEQ ID NO: 36560 - DNA, 665 bp, Triticum aestivum
  Clone ID: PAT_TA_36560
gccggccgggccgggctcacatcgcacacaagcacaagcccacacgccaaccttccttcacacgctcctctctcgacccttcttcttcctggctttcggagcaagaaggcgccagcagccagcaatggagcggcagggcgactcgaggcggcctctgccgaggcgcgggcaggtgaaggccagcatattcgcgtgcctcttcccgtgcctcttccgcaaggcggagcggaaggagggcaaggccagggctaaagaaggcggcagcggcggccgccgcgtcgcgcccggtggttgatccggcctggcccggcacgtgcccggggaaggagagggatggatatatgatgatctctgaagaaaagaatcaagaattgctgcggtcgttctcttggaacgcgaaatgggggtgggcgattgggggtcggggtcgctggtaaggtagggggtgttggaggggaataacattttcgttttttctggctgtatggaattccgttgtaattccgcagcttttggcgaacatgtggagtccgtagcctcgcagtgatttggatcgttttggtggatgtatgtatgtgtggtatatactactgtacgtaattgccattagttggtgaacttatcatgaaaaaaaaaaaaaaaaaaggaccctaaaaaaaaaaaaa

SEQ ID NO: 36561 - DNA, 592 bp, Triticum aestivum
  Clone ID: PAT_TA_36561
gccggccgggtcggggttgaaatactcttcatccagagacaacaacaactgtgtcaattgcgagcagcttgcatgtgcagctcattcatcttctgacaagcaattgtgtcagcgctgcgttttgcggcgtctagatgttgattgcctgcacagccaagtcgcgtctgacacgcgtcgattgctacattcaccatcaaactaaccctccagcaacacaacaccacagtcaaagtcaaatggttagtgataatctctttctttctcgattccctccgcaagattatataaactgttcaagagctttttaaccctgaattttctgttgacaccaacaatacgtatgacggatacgtctgatacctactgtttttgagaactctttcgtcagaacaaatggctaacagtcgaatgataggtctctaaagttgcttgcgtctaattgcgcaaactggtcccagtagcatacaaggttgcttcacagcaagggtatggtgcatatatggattgccattcaataccttacataaatattatgaatacaaatgaagatcgttatcatcaaaaagaaaaaaaaaaaaaaaaaaggccccta

SEQ ID NO: 36562 - DNA, 1105 bp, Triticum aestivum
  Clone ID: PAT_TA_36562
cgccgccgcccccgccgacccccccgccccccgacgcccccgccgcgtgcagcgggccggcggcggtgtgcgcgccgggagcgaggccgccgtgtgcccgtccccgccgccacgcgcggggaccgggccccgcgccgccaccccccagtcgccgccgcccccgcccggcttgctgaggggctagcagcgccccgcgcccagcggcagggaccgggggcccctcgggggactctgccccggggccgccgctacccccgcgggcgccctatcgggtggggagggcgcctcccccgcgcagtgcggggggctcgtcgacgcgttcctccccgtcgccgccgacctccttgcgttccccatgcccaccgtcgccgccgtcacgggccacgactacagcaccgacttcctccccgcgctctgccacgactaccgcctcatgcgcgccgaccgcgccgtgctctacatgagcgaggccgacactgtcctttgccccccgctctacttcgtgcacgtgctccgcactacgaactcccacacacacgcgctgccggtgctggggctgcgcgggatgaacctcacgccgcccgaggccagggagatgggcatcgtcgacgtcgtctgccccggcgcgcccgagaccgccgccgaggccctcaagctcgccgagggccgggccgggaggaagtgggacggcgccgtgtacgcgtcgattaggatgtccatgttccctgatgcgtgcagggccgtcgggatcgccgtggagagcgatgaggagaagagcaggcacttcgcttccaggctctgatcagcagagatcggagagtgtctatgtaacctgaaatcaatcctggtattctgcacctgtacattgatcagccatcgatgttctgtatgaagcacgcagcacatacttctgcagaccttgtatttctcttgctttgggagtgtgaaataaacagaatgcttgtgtgtggctgttggacatattattttgttgttgctgcagtgagattctcgtttacagaaaaaaaaaaaaaaaaaaaaaaaaaaaaaaaaaaaaaaaaaaaaaaaaaaaaaaaaaagaaaaaaaaaaaaaaaaaggccccta

SEQ ID NO: 36563 - DNA, 831 bp, Triticum aestivum
  Clone ID: PAT_TA_36563
ccctaactagcccgcgccttctccgagccagctccaccagtacttgtactttattatagaggtactaaactgaacaaataacaagttgctagaacttgtcaagtctgaacattacataaccctgaacattacaaaattctaaacattacacttctaaagtttacagcagtttgagataagagggagggggggctgcgggtgcgggagagaagcctgcacctgcagtagaggcgcagggaacaggagcagctggcgcaagtgaggagtagcaatggagcttggagaagcagcaggttgaggcactatgagaggattaggaggaggagcagtaggaactgagacgtagggtgggaagagaaacagcagcaggcactaggagagggagagagattcagcagcaggtggttagagaaagaagaagcagcagcgggggcatggagaagagagaagcagcagggggttcagagaaagcttcatcagaggcgcatcatgcagtttggagatggagaaggagttcgggttcaggggagaaacaacggaggtgaggaataagagggtagcagtaggaggagtggaggatggttgtggtggcgctggatatggtgatggatggtgtgcgacgacggtgctggagatggtgatggatggtgcgatggttcgaggtggtgatgcggcgctggcagcggcaggtggtgaagatggagtggatgatggagtggtggctggatggatggcgcgccgccatgtacggcctggccgcgccggcggccggagggtggagaagaaggggtctcgggggagagagccgggagagagagatcctcgtgccga

SEQ ID NO: 36564 - DNA, 863 bp, Triticum aestivum
  Clone ID: PAT_TA_36564
gccggccgggctcgggattaatcagccggccgctccggatccatgcccggctcgaattatttctttgacactcgttttaattgcagcacgtaaatacatcgtgtttttcgtttcacaaatctattattcatcatgttcaaccttgactggaacgacctcctccccttggcatatgttgccgtgctgggcggctcactcatggcattctcgactatctaccggaaacgccaggccgctgagagtgccaacctggctccgtggtttggccctcatctccaacgcaacgtctacctgtccctgctgcacctcgacgacggcagtgaaaagagccccaaggttcccgagagtgttctccgcgctgctttgttgcgccgtgccgtcgaggatatccgccgtcttatccaggtcaagtcagccaagcaagcctgtggttctttgttggcaaaaggcagtgtaggcgatgatctgtggcagcgattccagcgcgctgagaaggagatggaggaggagttaagagatgtcgtcacagaggccaacgcccttgctcccaactggggccagtctatcttccaatccgcccacgagatgaccgccaatgctgccatgcgcagttcgatcgaggagattcttgcccaagccgattcagagaagcagtggtgggagaagcgccgaggacagatccagacagagttcatgaaggagctcgattctgagcagagctcctccgccaaggccaccagcgaggaggatgctgttttggttgaggacccttcaaactagcgacaacaatcaaacaaaggtggagttgcagcgacggattacacggataaagatgtctttatgtacacacattttgaacctgt

SEQ ID NO: 36565 - DNA, 141 bp, Triticum aestivum
  Clone ID: PAT_TA_36565
gccggccgggccggggtccacgtgttactcttgcagctagctacatgacacattctgtgcagtgctgagagaattggttacactatatttcaatgaaattcaactgcatttggccaaaaaaaaaaaaaaaaaaggccccta

SEQ ID NO: 36566 - DNA, 667 bp, Triticum aestivum
  Clone ID: PAT_TA_36566
tgcgccgctcgagccggccgttccggcctctcgccctcagatcgacctctcttgccctcactttctccgtcgatggcttgcccgaacctgacgatcgacggggcggacgagctggcgcacttcggcatccccgtcacgtcggacgtgcggttgccatcgcggtggcgactgagcgcggcgggggtgcctgtgctgccgctgccggatgtctgctcgcacctcttcatgcgcgccgtcaggctctaccgggcgcggctgccggtggatatgtcaggccctgaacctcgcgcatactgaagaacaagcaccagatcaagttcagacaagcaacggctaggatgaagcgatgacgtttcggagaaatcaatggctcggatgaatcctcgccttttaccagtagttttaaactctgtactgctttgtaaccgtttaacgacagtaacagaaagttacagcgaggagctggactagtataagagaaccaggtcgcgtgagggagaggctaagatgtaattccccatttctagtcaagatagaaccctagctatgtacggcaagacggggtatctcccctcttgatctacctcttgtatccaaattcctccatgaaatccaacttaatatcctgaaaaaaaaaaaaaaaaaaaaccctaaaaaaaaaaaaaaa

SEQ ID NO: 36567 - DNA, 737 bp, Triticum aestivum
  Clone ID: PAT_TA_36567
gccggccgggccgggaattggcagcggaaagacaggctgaggaacgggtacgaggcaacgcccaggatgcgaatgcagcgtcgatgtcagcccaagatcgcagcgccgagactcaactgtctcccgcggttttgccagagctatctccgtatccttcacaggatgcacaggatcaacacccgagagccaggactcttcgaaaccctttgcaagtgcagactgattcgccttacgaaggtctgggaaacaacgaaactgcgccagatatgccttatcactcaaatcagagatggtaggctgtctatacgaggtcgtcaacaattttccagatcgtcaatcagccagccagacacaaacgggaaaaaggctggtagggtgaacacggtaggacttattaactctttaagtcataatctggcatcttgcagcatgctggacgggtgcgatctaggaattctcgcgttgcagatatacaatgatggtatgtaacaaggttttgcgtggagtttgctgcaagcttttgaaattgcacaaggtcaaccgatttttgggaggtgtttctggttgcttttggctgggccacaaacttacggatacggtcggatattggaagtagttttatggggcgcaagggcaagattggaggatcactgcagtatcaaacgggtgacctattaccgtagcggaattagcgacaatatctgatgaaagacaaaaaaaaaaaaaaaaaggcccta

SEQ ID NO: 36568 - DNA, 580 bp, Triticum aestivum
  Clone ID: PAT_TA_36568
gccggccgggccggggagaaatgggatctttgccgtcgccgcctcctcccgtccgtcgccgcctcctcttgcacccgtgcccgccgtgcagttttgacccgccggcgcacttgccttccagcccgcctccctccatcgagatccgcccctcatcgccgttgacgttcagagtcgcttcccaagtgcagaggtacgtccctcccccgtccggttcccttctccgcctccctcccctgcccaacacctccggtgccgagcctagcttggacggacatcaaccgaagctgcagaagggatcctgattggattggtttaaggggaaaaacaagacaggtacacatctacaaattttcagaggccaaatccccagcagaggttcacggtaccagtaatgtagatgtatgggtgttttggagggctactgtcgagaatcgtgatggcttggatcgtggagtttaactaattagattgtaatgttcgcgatctaaaaagaccaagtcattatagtgtttggcacccctcttgagaaaaattgcaatagttttgctcgttggaaaaaaaaaaaaaaaaaaggccccta

SEQ ID NO: 36569 - DNA, 409 bp, Triticum aestivum
  unsure (1)..(409): unsure at all n locations
  Clone ID: PAT_TA_36569
acgacccctccccgaagcccaaccacccgaaccctaactcggatcctctcccactccagccgccgctgccgcccagatccaatccctcccgccccagatccaatccctccagcggagctcgccgccctccttctctcgccctctccatcaaccgcactagagccactatgacacacaccagagcagctgagatccgcgtcccagcacctgcgcggaagatggtcatcctctcaccgcctacacgacacccacctgtctcctctcctctcgcccgccgcacgcacgcctcgaaccttccccaagccaggtggtggtggttccgcgaaccgcggaggggaagggggcgatgggcaatatactgcaccgctgcggcggcggnggtgggnnggggancaaccggtcaatggtt

SEQ ID NO: 36570 - DNA, 765 bp, Triticum aestivum
  unsure (1)..(765): unsure at all n locations
  Clone ID: PAT_TA_36570
gacttgcaacatttctgatttccaaatgcataaaaaaccctgccagcgccggcctcggagggagccatatcacagatcgacttcatttcgacgcaaccactagagactccgtctcggtctccattcctttgcctagctaatggggatggggatggcacttgctccacgctcgtctctgtctctgcgctccctgctgctgctcatgccgcacaggaagccacatcggagctctttcttctcctcctccgccgcggttccgcctgcggctccaggaactgccattccggcttctgatcctgccgttcagcctccagccgctccagatcctgatcttgcagttcctgaaggtccgcgcggatctagccgcgatggtccgccacgccaacctcctggaactatggatatagacgctgaagaccccggcaagaagactctctaacagctaataatacaaagtcagtgggagcctttcccactgtcctcaaggttaaaaaaaaggaccggcaagtcatcagagttcgcctacggcacttcaacgtgtactccttgatcagccacccaccgtacgaactgcaaatgcttgctgcggttactgccgtgttacctctatggacatgtaatctcagtgttgtcgtattattgatctttgtaccgttccaatcaaatacaaaaaaaaaaaggcgtctattgtccttcggttgggaagaaggatgctcctcttgcttaaagaaatataagagcgtttanatctttaaaaaaaaaaaa

SEQ ID NO: 36571 - DNA, 554 bp, Triticum aestivum
  Clone ID: PAT_TA_36571
gccggccgggtcgccctcgcgtccgcgcttgttgactcacactcttttgatcgcccagtcactcttttactgtccaaacctgtcgttactacttgaaataattcagttattatctaatcttctcaatctcatcattcatcatgttggccaaggtctttagcgttgttctcttcctctctgtcgctacggcaaaactccacaacaactgcgcctgccacaatggcgacagctacaactatcgcatgactatgaatgcatgcaccgtctacgatgatgcagactacaagtggggaggtgtcaagtacgacactccatctggtcgatgcacccaagaaaacgccgaagctcagatcgctggagaccagtgggaggatgcctgcaaagaggtcgccgccaagggcttcccttgtgctgatggaaagggaacttgcttcgccaaccccaaggaggttcgtggccgttgctagagaatgtagaatacgagatataagaggagataaatatgaatattggaggttaaaaaaaaagaaaaaaaaaaaaaaaaaaggccccta

SEQ ID NO: 36572 - DNA, 891 bp, Triticum aestivum
  Clone ID: PAT_TA_36572
tatgagggctcattaatgaagcggcgaggtacagggctccctcatgtttgctggcatacttgtctacgaagcctgctaagaagcctcgtcgcaatatcaatgttcacagtgcctatctgcacgtaattggggactccatccagagcattggcgtaatgattggaggggctctcatctggtacaagcccgaatggaagattattgatctcatatgcaccctcatcttctctgtgattgtactgttcaccacaatcaagatgatccggaacatacttgaggtccttatggagagcacgccccggagattgatgccaccaggcttgagagtggtctccgtaagatggaaggtgtgattgctgtccatgagctgcacatctgggctatcacagtggggaaggtgctcttggcatgccatgtgacgatcacgcaggatgcggatgctgataaaatgcttgacaaggtcattgggtacatcaaggcagagtacaacatcagtcatgtgaccattcagattgagcgagagtaaggcacatgtcaggtagttggggataaaggtgtgtgcctgttaacggtctatcatcttaatgacggttaatgttagacttgcacttgcaaaggcgttgcaggttcatctagctgttgcctttggtgctggagaaatattatatgtatgcgttttcgttagcccattagttgaatgaactattaatcgggtggtgcaaaaaaaaaaaaaaacatggatgcaatttccagacaatttttgagccccttgtgagtttatcaacctgcatgtgtagtttcagcgacaccctttcttagcactttatgtaaagatctgctatggttatggacagtgggtatggatgttatccagtttctgttcgctttact

SEQ ID NO: 36573 - DNA, 1880 bp, Triticum aestivum
  Clone ID: PAT_TA_36573
gtcgggcgccttcccggccaggacgcctcccccgcacctccctcttctcgccgcccctcccctggtgcctggggcctccttccggtccctcggcccctcgttcggtgcggctccctgcggccccgagccccgccgccggctggttacgcgcatcttctcccccctcctctcgcgtcgcccaccatccctcgcggcggcggcggcggcggtgctcctgccggcgctcaggccacctccatccagatggacagccataattctacgtcgccccatgttcctgaagtaaccatggacatctcatccgcttctggagcagctgggaacaaagcttgcagaggtgctgcttgcgacttctctgacgccagtaacacctcgaaagattcaaaggaaaggtctgcatccatgaagaagctcctaattgctgtgatcctttgtgttatattcatggcggttgaagtggttggaggcatcaaagcaaacagtcttgcaatcttgactgatgctgcccatctcctttcggatgttgcagcctttgccatatctttgttctccctatgggcagctggttgggaagcgacacctcagcagtcatatggatttttccgcatagagattcttggggcactggtttccattcagcttatatggctcctcgctggcatacttgtctacgaagctattatgaggctcattaatgaaagcggcgaggtacagggctccctcatgtttgctgtatcagcttttggtttgtttgttaacatcataatggcagtgttgcttggtcatgaccatgggcacggtggacatggacacagccatggtcatggccatggacattcacatgaccacgatcatggtaactcagaggatgaccattcccatcatggagatcatgagcaggggcatgtacatcaccatgagcacagccatggtacttctattaccgttacaactaatcaccactctcattcgagcactggacaacatcaggatgttgagcaaccattgcttaaacatgatggtgattgtgagagtgcccagcctggagccaagcctgctaagaagcctcgccgcaacatcaatgttcacagtgcctatctgcatgtaattggggactccatccagagcatcggcgtaatgattggaggggctctcatctggtacaagcccgaatggaagattattgatctcatatgcaccctcatcttctctctgattgtactgttcaccacaatcaagatgattcggaacatacttgaggtccttatggagagcacgccccgcgagatcgacgccaccaggcttgaaagtggtctccgtgagatggaaggtgtgattgctgtccatgagctgcacatctgggctatcacagtggggaaggtgctcttggcatgccatgtgacgatcacgcaggatgctgatgctgataaaatgcttgacaaggtcattgggtacatcaaggcagagtacaacatcagtcatgtgaccattcagattgagcgagagtaaggcacatgtcaggtagttggggataaaggtgtgtgcctgttaacggtctatcatcttaatgcagttaatgttagacttgcacttgcaaaggcgttgcaggttcatctagctgttgcctttggtgctggagaaatattatatgtacgcgttttcgttagcccattagttgaatgaactattcgggtggtcctagtcgtttgtattcacatggatgcaatttccagacaaattttgagccccttgtgagtttatcaacctgcatgtgtagtttcagtggccccctttattccctttattatcattttatgtaaagatctgctacggtatggccagtactgggtatggatgtttattcagtttctgttagcttt

SEQ ID NO: 36574 - DNA, 827 bp, Triticum aestivum
  unsure (1)..(827): unsure at all n locations
  Clone ID: PAT_TA_36574
gccggccgggccgggacattcttttcactataatctattcattcgcttcttcaatttatacttcactcgtttcactacaagctcttcaaaatgtttgccagcctgcctatgtacctggtcaccctcctggccgcaacctcgacggtgaccaacgccgcggccgtatcaccagtcttcaccggcctaggaacccgttacggcgacggctgtactgaggaaaactgctggcaagatggtgcttgcagcttcgttggatacgacttgcctcctggtatcgatggcagtacttgtgtttctgacgagatctggaacaagggcgccaactgtggtggttgcattcaggtcacttacaagagtaagactatcaaggttatggtcaccaacaggactggaggcgacaagaaccatcttgacatgacccctgcgacatggaacaagcttaccaacaacatgaagggaggcggtgttgacggcataaagtggaagtggattgaatgccctctccgctctgctcctctccaagtccacatgcacggtggagcgtccaagtactggttcgccgctaccatcgagaacatgacccaccgtgtcaaggctgtccaagttagcagcgacagtggaaagacctggaagtcttgctacctcaaggaccccaacatgtggatgctcgatggtactctgcccagcgactctgcttgngtccgtgttactagcgtcacaacaagcatgntattgtcaagaacgtcgctctcaagagtggtgtagtcaccaaggccactggcaacttctaggctggatacctattgagtaagggagaacttcggggc

SEQ ID NO: 36575 - DNA, 1063 bp, Triticum aestivum
  Clone ID: PAT_TA_36575
gccggccggttcgggagtggtctgatttaatatcgaccgtgcgtagtattgccagcgaccaccatgcccggctccaccgtggtgctcatcggcgccttcgtggccgcgcttctcggcgtctccctctccaccgtcgtcctctgctccaaccggcgccaggcgcaccacgcgtcaccgtcgccgttgccgtcacagcggagcgttgtcgacctcgagcatggcctgcggcggccgtgcgggatcgacaaggccgtcctgtccccctacccgaccatggtgtattcgtcggctgcgagccgaaggggccaaggccagagccagatggctgccgccgcggccaccgcgtcggtcgaacatggccaggcgcagggagacacgacgtgtgcggtgtgtctggcggagtatgcagacggcgacgagctccggtggctgcccgggtgccggcatgcgttccaccggtcgtgcgtcgacgaatggctgcgccggcggccgagctgcccgctctgccgcacgtagcctccaggcatgcatgcaataggaagcgcatgggtcgaatgaatcacacatttgtgttcattccttgactttatttattcagtgcacaattctccgcgtgaagctctaacagacaaacaaactgcctagatagattgcctgtcgtgtcctctcgtgtcggaaccatttcctaggcagcaacagatcatagggtagctaattcgcgttcgtacatgtctcctactacgtactccctctgtttctaaacatatcttctttctagagattttaatataaactatatacggatacaatatttatttgtatgtagtccatattacgtatgtatttcatattaaaatctcaagtaagatttatatttaaaaacgaaggaagtagcacgttttgggccacagccgccgcggagtgaaccattcatgtctctactagatcatcgatggcgcgcgttgccgcgcccattcctttcttcaatgtaatatgaatttatttacatagatatatgatgttatgagtgagagccgaaaaaaaaaaaaaaaaaaggccccta

SEQ ID NO: 36576 - DNA, 656 bp, Triticum aestivum
  Clone ID: PAT_TA_36576
gccggccggtctcgggatcatcatcaatacagtcagtcagttcttcattgtatcctcatctcaccaccaactctcatctcaatcactatttaaaagtgttatctcacttacaccacatcactcacaatggccgccatcgctagacccgcccttgtcaagcccgctgcctaccccaaggccctccctgttgtcgtagccgtcggcagcttcgccatcatcgccagctacgtgagctcccagctcgccaccacatcagccaagttcgaccgctcttttgcaaagtacaacaccacggagagtgaggcagcccgagcaagaacatttgacggcgccatcgagaaccccagaacaagtctcttcaacatcctcggccgccgacagtagacgggcaaccatctcacgagagagggcatggaccacaaaaagacctctagagatctgcctcgcacacacatacatacacatacaccttcttcacgttgagcgttctttattacgttggacatcctcgcctttttaagacggcgcagatagggacacagcattttagggtagacaggaagtattcgggggattcgataccatggaaatcacataacttgatcattaaataaacaattaaaaaaaattttcgcactaaaaaaaaaaggccccta

SEQ ID NO: 36577 - DNA, 585 bp, Triticum aestivum
  unsure (1)..(585): unsure at all n locations
  Clone ID: PAT_TA_36577
gcacgaggctcccgcctcccccctcgccttcccaccccggtctcgcgttcgcgtacaccacgagataacgtgtgaggtttcagggcagagccgagctagcagccatgatggaggcggccgcggcgacgatgctggaggccggagtggggcggttccgggggccgagcctcgcggcgctgcttgcggagatgtgggcgccgctggccgtggcgctggcggcgctcgcgacgctgcccagcctgctcggcaggctgcaggtgctcatcctccgcctccgctcccgcgggaaggaggtcatctcctcgcacatctccacctactactcctccggcgacgacgagtcggactccgacggcgagggcgaggacgaggacgagagctccgatgaggcggccaccagctcgtccggcgaggaggaggaggccgtgaggaggatcgggtacttcgagggcgccgccgacggcctcgacggctgcttcccgtggggcggcgccgtcgtgcggacgtggcaggacctgccgcggcggttctccgccgtcggctgccgggggnnagcccgggtccccgccngnnngcgtggccagg

SEQ ID NO: 36578 - DNA, 755 bp, Triticum aestivum
  Clone ID: PAT_TA_36578
acaagacacgaggggagaaccggcccccgcacgcgcagcggcggcctcagaagagcagtgtcatggctgggaagcaagccgtcgagcgagagcacgaagagggacgagtaccatctgggaaatggagttctctcagttgatataaatgcgccgcgtaagctgtgtgcttatgctcacttcagcaagcgacacacaggtgtcatgctcctcctgttcaacctaagcgacagcactgggtacaacgtgaccctctagaatgacctcaagtcctcgacctggacttcgaaaaaagaagcggccactagaggcgtagaggcggtcccagaagagcggtgtcatggctgggaagcaagccaatggagcgagagcacgaagaggaatgagtaccatctaaacaccaagggcggcgaccaccaaagtaggacgatgctgctgaagggtgtccagctggagctggcaggcgatggctgcatcccagtaatgaaccacgtatggcggagatgagatcaaagtagatagtttgcgccgaagtcgctagtattcaaacagctacccgcagattttaacttaccagttctgtacattacagaattaaattttgttcgttttgtggtgtagagatagaatcatagacatgaggaaaataggcagaaggacatcacaagggcatttttacttatcctgaatcttcttccccgttgagagcatcctgacttcaaactaaacaaaagggaaaatgttctcatggccgaaaa

SEQ ID NO: 36579 - DNA, 1117 bp, Triticum aestivum
  unsure (1)..(1117): unsure at all n locations
  Clone ID: PAT_TA_36579
gccggccgggctgcggaagncggcaaaaaaagacccagcaccatcggcgcaggcggccgggcgatttagatttgctttccctccttcgcctcctgcgacagatcggggatggccgcgcggtcgcgggcgcgccgcctcctgccgctgctcaccttcgtcgccctcggcatggtcctaggttccctgcttcagttagcatttttccgccggcttgatgatcactctcatacggggcattttgataatgatcaagaggcagcagatcttcgacttggatacgtgaagcctgaagttatcagctggaaaccccgaataattgttttccacaactttcttagttcagaggagtgtgattatctaagagaaattgctagaccaaggctcgagatttctactgtagttgatgtcgcaactggaaaaggtgtaaagagtgatgttcgcacaagttctggtatgtttgtgaactctgaagaacgaaaatttccagtcattaaggcaatagagaagcggatttctgtattctcacagatacctgtagaaaatggggaactcatccaagtattgcggtatgaaccaagccaatattacaggccgcatcatgattacttctctgatactttcaacctcaaacgtggggggcagcgtgttgctacaatgttgatgtatttgaccgatggagttgaaggtggtgaaacccattttcctcaggcaggagatggtggtgaatgcagttgtggaggaaggatggtcagaggactatgtgtgaagccaaacaaaggagatgctgtgctcttttggagcatgggattcgacggtaacacagactcgaacagccttcacagcggatgcgctgttgtgaaaggggaaaagtggtcagccacgaaatggatgaggcaaaagatgactttctgattgcagataggcattctggcatataggcagaatagagaggggattcttttccttgtaatctgtagtacagatatacaacattaaaggaataaataaaaagtggaatgatatctttactagcagcaggaggcactaatcttcctaagaggataaaaacatcgtgtccaacagaatctcttccctttcaaattccatcattttgcat

SEQ ID NO: 36580 - DNA, 525 bp, Triticum aestivum
  Clone ID: PAT_TA_36580
gagccggccgggccgggtcctctcagaccctacccatggatgcttatgacgggctcgcccaccttgttgtcaacgagactgaagcggcgatccttgcagagtgtaatgaacctgaacttgacactcctgctggcttggaacgtgttggtcgagttttcattgatcgtggagtccacaatgtcatcatcactctgggaggtcgcggcgtctacttcgtcaacaagcaaggccagagtgcattacttcctgctacaaagacaaccgtagtggacaccacagccgccggagacacctttgttggttcttactctttggccgctgtcgccgctaggggcggccagtttgacatcgaagccgctgtcaccgcggctaatcgggcagctgccttgactgttgcgcgcaagggcgctcaaatctctattccatggaaggatgaactatagtcaaggtagcaacagcttttctttcgtagaagaaccaacaaaaacgttcgaattccaaaaaaaaaaaaaaaaaaggccccta

SEQ ID NO: 36581 - DNA, 856 bp, Triticum aestivum
  Clone ID: PAT_TA_36581
gccggccgggtcccgacgatctagagcctcatgccaggccgggagtgacacaggctcccattttaaagcgccaattaacgacacttggccatgggaggcagacagatccggcccgcaagggtcttccagaccgtgacggaggagctcaaccacaacattctcggcaagaagtcggtccctacgccgccatggtacaacatcatgcaaaaagtccctcccgccgagaccctcgtccgaaacgtcacccctctaatcaaaccaagccgtgaaagtaccaccaagatcaagaacatcttccgacccctaccaataaggtacttggaggacgaactacgaggcatcttctaccgcgaccatccttgggagcttgcgaggccccgtgttattctcgagttggacggaaaggattaccagcactgcgattggtccaagggcttgaaacagcccaacactcccttgacgggcgaaagtgttgtccagtactggatgtggttacttgagaatgggaaggagactgtgggtaatggtaggagaaagagaaaggtaaaatggacaagggtacgagcatacgaccatgtccgccatcaattttatcgtctacgtcaagaggagcagatcgagaagcgagtggctcaagaagaagccaggtacgtaggcgcttactttggccaaacccgcatcgatgtctcccacggcctcgaagaccgcgagttcgagaactggaagctctgggctggaaaggaaacagagcgacaggagcagaaccgtaacggagaaattgacgactttggtctggaggatgaggcggagggagttatcggggatgcagaggcaacgccccgagtcaagggcgagg

SEQ ID NO: 36582 - DNA, 1281 bp, Triticum aestivum
  Clone ID: PAT_TA_36582
gattcggacgaggcccgtacttccgcacgcaggccccaacctccccgtcccgaaagttggcaggcacgatctctctctccacccccttggactctcctctcctgctcctcctcctccccctccccacggcgccatggagcggctcatctccaggacggcggtctccccggcccagccccggatccacctacccggcagatcccccttcctccccacccgccgcgccgcccccgcctccgcgggtgctgggagcgccgcgccatggacccggctgtgcgcgcagccgccgcgtctcggtgccgcggtctgcgccgcggtgcggcatgacggtgcttctgccccggcacccgtcgaggaggtggcggcggcggcggcggcggcggctgggcctccgttgaagctgctcgggagcctgctccccaaggcttctactgctgcccttgtcctgcttatgacacttactgcaagtgccttgcactctagcattccccatcctgcctatgcatcggtgcaaccagtaatcaaatctggtggactcctctcagcagagttattgagcagcggctgggctggtttcttcgcgggctgcttacataccttatccgggcctgaccatcttgtcgcattggcaccactatcaattgggagatcaagactggagagtggactagtcggtgccctttggggctgtggtcatgatgctggacaaataatttttggcctgctcttcttgttactcaaggatcgtttgcacattgaggttctccgtatatggggaacaagagttgtaggtctgacccttcttatgataggcgcgacgggcatccgggaagcttcagaggtccaagagtcagggctaattctggagggtgtagacatgagtggcagtgagcccttgcaacaggcccctgctgttgctcccagaaagaagaaagttggcttcacaacatttgccaccggagtcgtccatggcctccagccagatgcgctgctgatggtcttgcccgctcttgctctgccatcacgctttgccggtgcggcctacctcggcatgttcttggtcgggactgtattttcgatgggtagctacactgcttttgtaggttcttgtagtgaggctctaaaggataggatacctaagataacggagaagctgacctgggctgcttcccttgtagctgtatgcatggggttagctcttctagttgggcagttctttgggttcaccctatattgattcatgtcctagttctacgttcttgttactacttgtcaacattg

SEQ ID NO: 36583 - DNA, 291 bp, Triticum aestivum
  Clone ID: PAT_TA_36583
gggtgctgcaacaatcagaagaccaatgcattgccttccagaaggctagattgcaacaatgcaatgtctaaatgtctaattcagagtgcaacaatgcaatgtctaaatgttctcatcacatcacagataaatatagagtttggaaagataagaactcaaccatgactacactttcttaacacacgcacgctacaggcgacgaaactagaacagatgctttcttcatccaaaaaaaaatgattgtttcacaaaactgcacctgtttagatggttagatatttataacttggt

SEQ ID NO: 36584 - DNA, 332 bp, Triticum aestivum
  Clone ID: PAT_TA_36584
gagccatgatgtgatttattaagaaatgaagaaatggttacatgaacaagggtctctgttctacatccttttcaggccaatcagcatgggcgcgttacacactagacctagttacccagttaaggaaaggaggaatattagcaaaaaaaatgtacatggtctatgaacaatccccagagaaccaaaatttgtcgtgccattgatctccgaccgaaagaacaatccaacaatcatgttccttcagccagcttcggcggggaggtgccaagaagtgatcactgcacgtcttcagtgaaggccctgtagatgaagtccctgaaccttttgcagta

SEQ ID NO: 36585 - DNA, 492 bp, Triticum aestivum
  Clone ID: PAT_TA_36585
gtggcggcccgctcgaaaggccggccgggttcgggattcacaatcaagacaccaacgacatcaatcactgccatacaactactctcaccaactcaccaactcatcaacccaccaacgcaaccactctatcaaaatcaaccactgcaaaacaaccaaaatggttcctgctgctgcttactctcaggtcggccccaaggtcctccccatcatcttgaccgttggaggcgccaccgttgcaagccgatctgtcatcaagacaaaccaatatcgagagcccgtccgagcaaagacattccaaaacacttctcctcaacctcgatctcaatactttgaaaaagtcctagaatcaatctttgcatagaatcttgggaagataaaggataacgaattatgatgggcggcgtatatatgcttttggagtacctgtggttacttgagtctgcttttatgaataaattaattcaataaatcatcgtatctctgcggccccta

SEQ ID NO: 36586 - DNA, 1050 bp, Triticum aestivum
  Clone ID: PAT_TA_36586
ccacgcctccgcccacgcgtccgctcctcgacccgcaggcccccgggtcttgggacagctccacaacacaaaagttgccggcactccccgcgccgccccacgcgttgaacgcgcatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggaaaccaccttgtgagaaaagtcgcgtgccgtctcctctcgcccaaagcacgttggcagcaatggcacaagaagctggaaggagtctgaggagactgtccaaacacctgacgcaccaatattgtgtgtaaacaactgcggcttcttcggtagcagcatgacaaacaacatgtgctccaagtgctacagggacttcattaaggccacgacaatggctgcccctgtagtggagaaggtgttctcagtggcatcatcttccagtgtgaccttggagcaagcagaggcagacgaagtaccagccgcggctgtagctgatagccaagcagcacaggagcctccaaagccgcccagcaacagatgtctttcatgccgcaagaaggtgggcttgactggtttccagtgccggtgcgggggaacattctgcgccatgcaccgctacgctgactcccacgaatgcaccttcgactacaagaaggctggccgggagcagattgccaagcagaaccctgttgtgatagccgagaagatcaataagatctgattgatagtctcaccgggttcatttgcttgctatttgtggtggtgccggagtcgtctttacttgaatcagtaggtttcttctggtctggactaggttgctagggtctcaattgtgtctatccttctccttcatggttcgcttctctcgattatgaatgaaatgaaataatgtaaatatataatatctattgttttagctgttcgtttcggataaaaaaagtcgacgcggccgcgaattcg

SEQ ID NO: 36587 - DNA, 698 bp, Triticum aestivum
  Clone ID: PAT_TA_36587
aactactgctttcaggcatacaatcaagttaccagctcccaatcagctagctagtcagcagcaacatttaacaaaaggaaagcaagatcacactcggtcatggtggtgccgtcggtgttcgccgcctttgacgaggacggcgacggcaaggtgtccgcttccgagctgcagcgctgcatggaggccacgctgggtgacagcgtgtccgaggaggaggcggccgcggtcctcgcggcggtggacgcggacggcgacgagctgctagaccaggaaaagttctcgaggctggccgccggtgcccatgaaaaggatgatgccgacgtgaagcaaaggtgcctgagggaggcgttcgggatgtacgcgtcatcgtccgcggaggacacgatcacgccggcgagcctgaggcggacgctgagcaggctggggtcgcacgagctgggcgtggagcagtgcacggcaatgatctgcagattcgacctcgacggcgacggcaaactctcattcgacgagttccgggtgatgatgatagcttgatcatcgactctcttcccattcctctagatacatggaatggtcacttaattcattgatcaatcacatatgtgatatgtgatatgtatggacaggcatgtggtcattcggtcattggtttgctcgcacgatcgctaatatatgttacgggggaagttgtggctttc

SEQ ID NO: 36588 - DNA, 773 bp, Triticum aestivum
  unsure (1)..(773): unsure at all n locations
  Clone ID: PAT_TA_36588
gccggccgggtcgggaactgctttcagggcatacacatacaaatcaacttaccagctcccaatcagctagtcagcagcaaacatctatttagcgaaaaggaagcaagacatctatatagcgaaaaggaagcaagatcgatgaatagtcactcgatcatggcggtgccgtcggtgttcgccgccttcgacaaggacggagacggcaaggtgtccacgtccgagctgcggcgctgcatggaggcgacgctgggcgagtacgtgtcggaggaggaggcggtggcggccctcgcggtggtggacgccgacggtgacgggctgctaaaccaagaagagttctcgaggctggccgccggcgcccatgaagaggacctgagggacgtgaagcgaaggtacctgagggaggcgttcgggatctacgcatcgtcgtccgtggaggacacggcgacgacgacgatgattacaccggcgagcctgaggcggacgctgagcagactagggtcgcacgagctgggcgtggaggagtgcagggcaatgatctgcaggttcgatctcgacggcgacggcaagctctcgtttgacgagttccaggtcatgatgatggcctgatcgtcgatttctcttcttctgcgcattctactagtatattttgttcactcttttttttgcggaggctaataatattcacttaattcatttatcgatcacatatgtttgtacagtcatgtgttcattnnnnnnnnnnnnnnnganaaaaaaaaaaaaaaaggccccta

SEQ ID NO: 36589 - DNA, 1083 bp, Triticum aestivum
  Clone ID: PAT_TA_36589
gccggccgcggtccgaactagtccaattgttgtagtatataacaaacgcctcctttttacaacttcattccttgtctatccttgtttgactttatttatttatttcgataccatcatctacacaaatagacatcatggctgaggctcaattgaacgatttcccttcgctcttctccctcaagggcaaagttgctgttgtcactggtggttctcgcggtctaggtcttcacgcggcttcagcatttctacaagcaggcgcatcaaaagtctttatctcatcccgcaaggcctccgcctgtgaggaagcttgcaaggctctcaatgcgctccccaaccttcaacccggcgctgtcgccatctcagtccctgccgactctgccaagttcgagggcgtagagagtctgctcgcgcaggtcaagaagcacactgatcgcgtggatatcctctttgccaacgctggcgcgacatggggcgagtctttcgatacgcaccccgactctgcctttgccaaggtcatggatcttaacgtcaaggctgtgttcaacacgatccgcctcttcacaccacttctcgagaagagcgctacgatccaggaccccagccgcgtcctcatcacagctagtgttgctggtctcgctgtcggcaccattggaaagcagggcacttacggttactctgccagcaaggctgctgtgctgcatctcggacgcaacctagctatggagttgggaccccgacacatcaccgtcaactcaatctgccctggcttcttccccagcaagatgtccaacggacttttggagatgtcgggtggtgccgaccagttcgccgccgccaaccctatgcgcagacttggtcagcctgaggatattgctggtgtcgttgtttacctggctagtcgggctggagctcacgtcaacggtgagacagtcgctattgatggtggtgccctgtggcaacgtggggagctcatgattgcggagaaggccaagctataagtgtgtcacggtgagcagtttatgataaagccaaccattaatttacacgtttcaaatcgaaaaaaaaaaaaaaaaaaggccccta

SEQ ID NO: 36590 - DNA, 3300 bp, Triticum aestivum
  Clone ID: PAT_TA_36590
tgggggcctccccaactgcggtctcgcctacctccacctgcacctgcacctccggtgctgaatcaagggcatggccacctcactactagggtagacgggcaagctcacaccaacgaggttagcaagggcaaaccactagattggatttcaggacaaccagtcgcagatgagcatgaacgcctccagattataaagaatgatgacctcgaagagctccaagaactcggttctggaacttttggaactgtatatcatggtaaatggaggggctctgatgttgcaataaaaagaatcaatgacagatgttttgctgggaagccatctgagcaagaaaaaatgcggaatgacttctggaatgaagcatctaaccttgctgatctgcaccaccccaatgttgtggccttttacggcgttgttctagatgggcctgggggatccattgcaacggttacagaatatatggttaatggctcacttaggacggctttgctgaagaattccaagagcctggatggacgcaaacggctaattattgccatcgacgcagcttttcggatggagtatctgcataacaaaaacattgtgcactttgacctcaaaagcgacaatttacttgttaatttaagggatcctcagcgtccaatatgcacggttggtgaccttgggctttcaaaagtcaagtgtcagaccctcatctctggtggtgtgaggggaacgcttccatggatggccccagagcttctgaatggaagcagcagcctggtctctgaaaaggttgatgtcttctcctttgggattgtcctgtgggaactcctcacaggagaggaaccatatgcagacttgcactatggtgctatcattggtggcattgtgagcaacactctgcgcccgccggcgcctggctcgtccggccctccgtggtggtcgcccttcgggcgctcctgcgcctctgcccccccggatggcccatgcggcccccaggtcgccgtcacgccgcgtgcccccgccccggccccgaaggtgcaatcctagtagcgccagcagcggtcttgagaaaacttctggggccatccatccatccgtcttggacaagttctccttcgcatattgcgtattttaggaaatccggtgctgatatatataaatattatatatatggttggtttcgttctttcgttgcgtcggtcggtccctagggtgtctatctatctgttcataccccttcagcgttgcgggtcctgaccccagttatgttgccgccaccattgggcacctccccgtgcccccatcggccggtcgggcggcgcccccgttccctattccctcttttatccccttccccgtgcgcttgggcgttgtgccgcgcggtgttcgccaggctgctcctcaggtatccagtcccccttcgttcgcttatgctcttcccccccttcccacgccggtaataatcgagttgtttggaagtcgtcggttccgtcggtctgttggtccggtcagtctgaacaatgtggtgatgaactggttgtgtaatgtgggtgggggtaatacaagttttgggatctgcccgttggggccccatgccccttgctctcgcttgtgttgctcggggcctggtgtggtctgcccggctggggcgctgcctctgcacaaaggctcccgtgctgttcttgctctgtccggcgagggtgatgcttgctcttcccccggcttgctgggtatggaggatggtctagccgcatttgagcctccacctcctgtgctgaatgaagggcttgggaatgtcactaatcgggtagacgggcaagctcacaccaatgaggttagcaagggcaaaccactagattgggtttcaggacaaccagtcacagatgagcatggacgccttcagattataaagaatgatgacctcgaagagctccaagaactcggttctggaacttttggaactgtatatcatgggaaatggaggggctctgatgttgcaataaaaagaatcaatgacagatgttttgctgggaagccatctgagcaagaaaaaatgcggaatgacttctggaatgaagcatctaaccttgctgatctgcaccaccccaatgttgtggccttttatggcgttgttctagatgggcctgggggatccattgcaacggttacagaatacatggttaatggctcacttaggacggctttgctgaagaattccaagagcctggatcgacgcaaacggctaattattgccatggacacagcttttggaatggagtatctgcataacaaaaacattgtgcactttgacctcaaaagtgacaatttacttgttaatttaagggatcctcagcgtccaatatgcaaggttggtgatcttgggctttcaaaagtcaaatgtcagaccctcatctctggtggtgtgaggggaacgcttccatggatggccccagagcttctgaatggaagcagcagcctggtctctgaaaaggttgatgtcttctcctttgggattgttctgtgggaactcctcacaggagaggaaccatatgcagatttgcattatggtgttatcattggtggcattgtgagcaacactctgcggccgcaggtgcccgactcatgccacccagcgtggaggtcgctgatggagcaatgctgggcgacggaaccgtcggaacggccaagcttcacccagatcgccgtcaggctgcgcgccatggccgcgtcccagaaggtgcaatcctagtagcgccagcagtggtcttgagaaaacttctggggccatccatccgtcttggacaagttcgtcttcgcatattgcgtattttaggaaaatccggtgctgatatatataaatattatatatatggttggtttcgttctttcatagcgtcggtcggtcggtccctagggtctatctatctgttcataccccttcattgtttcataccttgtaatcataaaatcatcagccctccctcccaacctccccgtgtctagaagtgtcggtcggtcgtcgtcccagatccgtattcattcatttatacccttcccctttggctttggcttagaggcgcgctgaataagccagtcttattgtcagttatagagagtccgatattttatttattttcttccctttgtctcccctgccttctcttgtgggtaataatcgagtctgtttggaagtcgttggtcggtcaggtcaggtcaggtcagtctgaagaatgtggtgatgaactggttgtgtaatctgggtggtgtaatacaagtttttgggaactgtcaaaaaaaaaaaagaaaaaaaaaaaa

SEQ ID NO: 36591 - DNA, 861 bp, Triticum aestivum
  unsure (1)..(861): unsure at all n locations
  Clone ID: PAT_TA_36591
gccggccgggccgggatggactcccaaaagataccccagatttaaacatctacttcctccacaaaactctctactcccccaccatgtcaaacggtacaaacggcaccaacggcgctgaggcgcaatcaaagttcgaccccaacttcacagaccatgtcatcggtctcatgagccccgagaccgaaccaagacagcgcgagatcctcacctctctcatccgtcacatgcacgacttctgcagagaagtcgagctcaagcaagaagagtggatcattggtgtcaactacatcaactctcttggtcaggcctacaagaagaaccgcaacgagacatggcgcgtctgcgatattctcggcattgagtccctcgtcgacgagatcaaccacaaggtcgtcaccgaaggcggcaaggctcccacctcctccagcatcctcggccccttctggtctcccgagacccccttccgcgacctcggcggcagcgtcgtccaagatatgcccaaggatggtcaacttacattcttccacggtgtcatccgcgacgtcgacaccggcaagggtatccccaacgccgtcttcgacatgtggcaagccagcaccaacggcaagtacgacgcccacgaccccgagaaccagtctcgccacaacctccgaggcaagttccgcaccgaccaggacggcaagttctggttctactgcctcaagcccaccgagtacgccatcgacacctctggtccctctgctgagctcctccgcatcatgggccgtcacccttaccgncctgctcacatccacatcatggttacccacgatgactacctttggtgttaccgctcagctgtaccccagcgacgacccctac

SEQ ID NO: 36592 - DNA, 1577 bp, Triticum aestivum
  Clone ID: PAT_TA_36592
gccggacccgacgtccgctcgatccccccgagctttataccgggccgcccgccggcgaccgggccacgatcggtgcggcggccattacgttcgctccgatccgcagcgacccggaccagtcgcctcccccacctgccaaactccgccccctctccaacgcctccctcccttcccccagccccctaacccgtgcactcaccctagttcactcgtcaggtatgcggaacggccttttccatgtcatggatttggtactactcctgtctgtggcaacgacacttgcattggattgattctcaaaattatcctctggaggaaacgtgacgtcgattggaggcaattggaggaagggcggcgaaagactttcccgatgtctgcttctgccatcttggagaacttccccatcctgctcctgcgctgcggtattctgtcccggctaaagaaccatagcacccacaagagtattttctccaaggagacaatcctgagttgatcaaatcttataacccctgcagagtttttaaactatctaagtgaaattttaggttggttcttgcggtgcttaaaactagggaaattcgtgctgctgtgcgattgaatgcattgcagtggttacttcaagcatcggagcgaattttagctatgtttttagcagcatttggaccttaccatcttgctagtgattccagcttcctcactgataattgcagcagagggtattgctcatgtgaagaggcatcttcttgaaaatgcctcacagaacattgtcactgttgaacaaaaattatcacgaggatggggaggagaaaatgcctatcatgtcggtggataccgttatatactctctgatccaaacagaaaagtatcaagagcctccccacctgggaaagtcatcaccttgtcaaaggattctctacttgccctcaacaggctaagaggagaaatagatctagagaagtcaagagctaagaggagtgaccctacccatgacaaggattatgaagtatgcatcagagcgaaaaataatgcatggattattgctaaaatttctcgaggaaaagaactctatatggctatagagaagggcggcgaaacacttctctatgcatctacagctgttgagaaatttagcaacaggtactgcgagggggcattctctacagactaaaagcaccagcaccagcatgtttcccacgatccagtccagcactgcacatggttgtcgactggatcactccctaatgtgtgtaattgatgtcgatctcactcatgcaataactggattcataccagttgtacagctgccatttggaataaaattatgcagagcaggaaccagcatgttctgcctctaggttctgcggccttatgggatacagtacttaggaacattctcatttctatctgatgttaaaaaaagaagatcatttcgatctgtaaatgccgacggaggactgctaactcgtattttatgtattacgggccagttctcttggggcttgtactgatggcttaacttggaaattaagtctccttcaggaaaaagaaaactggaaattaaggccaaaaaaaaaaaa

SEQ ID NO: 36593 - DNA, 908 bp, Triticum aestivum
  Clone ID: PAT_TA_36593
gccggccgggctgccggccgggccgcgatcgtcgctcgtcgttttttctgcgccaccactccaaggaccgccccacgatccaaaccctttactctatccctagaaacacaggcctcgacgccgtaaaccgcaaacatgggtctcgccttttcgaagcttttcgaccgactgtgggggaagaaggagatgcgaattctgatggttggtcttgatgccgccggtaaaaccaccattctctacaagctcaagcttggtgagatcgtcaccaccattcccaccatcggcttcaacgtcgagaccgtcgagtacaagaacattcaattcaccgtgtgggatgtcggtggtcaggacaagatccgtcctctgtggaggcactacttccagaacactcagggtatcatcttcgtcgtcgactccaacgatcgcgaccgtattgttgaggcccgagaggagctccagcgcatgctcaacgaggatgagctccgcgatgccattctccttgtcttcgccaacaagcaggatcttcccaacgccatgaacgccgccgagatcacagacaagcttggcctccacagcctgcgacaacgcgcctggtacatccagtccacttgtgctacctcaggtgacggtctctatgagggtctcgagtggctcgccaacaccctccgaaaggcgggtcaccagtagaaagattgacgagaagcatctcttaaagaaacccgcctttttctcttgctctgccacatactctcaaatggctctttgtgtcgactcgaggtttcggttgtaatttgcaaagttatcggtcaaccaatcgaaaatgaatccttgaaccaaagtcgcatctattgctcgtttctgcaaaagcaacctagttctacgaaaaatgtaaaactcagccctagggc

SEQ ID NO: 36594 - DNA, 457 bp, Triticum aestivum
  unsure (1)..(457): unsure at all n locations
  Clone ID: PAT_TA_36594
tttttttttnnntttggaaaaagatcgnatttttanaaangggaatttcccgggnaaccgggagtattgttgttncccaggagttcaaagtgcaacatnacattcccataacattgattggacaaactgcgcacaaagccacctctgcgctggttattacttcatcataccttcagcgtggatgaaggaaaccgtcatccgtgaaaaaaaatctgttggttcgcctataacaggttaaacaatgaatagcagtcgtatttcagtgcctcgtatgcgagggctctaggttacaacatcctctatacctaggagcgggttcgttcgtgtgcctgccgggaacctgacagaagataacagaaccatttcgacgagcagcagcagcagcagagatacctcaaaagttccgacgaggccttctttgccgccaccgctagagcgagggagagcgggcacctgc

SEQ ID NO: 36595 - DNA, 926 bp, Triticum aestivum
  Clone ID: PAT_TA_36595
gccggccggtttcgggactctcagtcatccagtcgctcattcacactcattactcaactctttaagagacagtcactcatttactttctttttaatcaatcccaaccaaatcagtcaacatgaagctgtccgctgtcacccttctcactctcgccaccggcatcattgccgctcctgtcgctgatgtcagcaaggaggtccgatcttacgctagctacgagcctcccaaggacacctacgagcagcctaagactcccaagcaggagaagcccaagaagcctgagtacaaccagcccaaggcccccaagcctcatcacgagaagcccaaggctcctaagccccaccacgacaagcccaagcactacgctcctcctcaccacgagaagcctaaggctcctaagccccatcacgagaagcccaagactccctcttatgagaagcccaaggcccccaagcctcaccacgagaagcccaagaagcccgagactcccaagaagcctgagtacaaccagcctaaggctcctaagccccaccatgagaagcctaagaagcctgagactcccaagaagccttcttacgaggctcccaaggctcccaagcctcaccacgagaagcccaagaagcccgagactcccaagaagcctgcttacgagcagcccaaggcccccaagcctcaccatgagaagcccaagaagcccgagactcccaagggcccctcttacgagcagcccaaggctcctaagcctcaccacgagaagcccaagaagcccgagactcccaagaagcctgagtacaaccagcccaaggcccccaagcctcaccatgagaagcccaagaagcccgagactcccaagggcccctcttacgagcagcccaagactcctaagcctcaccacgagaagcccaagaagcctgagactcccaga

SEQ ID NO: 36596 - DNA, 874 bp, Triticum aestivum
  Clone ID: PAT_TA_36596
gtgcgtcgctcgatcgggcccgccctccgccaacccccggtccccggtcttgcgtagtcgaagagagagaaaaaccctcgccgtcgagaatgagggccgctctccgcctcgcctccgccctccgccgcctgccagctcgcaccggcgacctcgtgtcctcgcaggccgtcctcccgccgctcgccggccgcgcccccctcctctcacgcgccctctcgctccctcacctccccgccgccgtccgtcgtttctcgcaccaaaggggtcaaggactcctccaaggcgccacctcccgtcttaagcaaaggcctatcctcgttcatcagggcaaggtcatttccccattgggtaccaaggggtgcatggctgacaccatcagtgcgcttcgtacttatcctcctcactgatcggaaatcattaggctttgggggctcttacattgggtacatatggttgcttggcatgaaggcgaatgctactcaggccttatcctcgtcaccggtgggatcctcatccatcttgggggctcttacctcgagggcttatgctcgcctcacatgagatcgattgctacccagtctcttgatacggccggttgtgtttggatggaagaagaagaaggatgaagatcgcagcaagaaggaggaggcagagtcgatcaagaagtagaggcccaagcccaaggaggagggcacaagcaattttttgttcattcaaaggggggcgattcactgcgccaatcagtttttatttcatctttccttcggtggcctcaatctttactttggcgctctcaaacttatcaatgtgttgcctgtaatgatggttcaagatctctgttttgggtcggtcctgtggaattttaatatccaat

SEQ ID NO: 36597 - DNA, 947 bp, Triticum aestivum
  Clone ID: PAT_TA_36597
catattcagccgtcctccaactacatacaaatggctgatgcaggagcacctcgcggcggcggtggattcggatctcgcggtgaccgtggtggtgaccgtggccggggccgtggacgcggacgtggtcgccgtggcggcaagagcgaggagaaggagtggcagcctgtcaccaagctcggtcgtctcgtgaaggccggcaagatcaagagcatggaggagatctacctccactctctgcccgtcaaggagtaccagatcgtcgacttcttcctccccaagctcaaggacgaggtcatgaagatcaagcccgtccagaagcagacccgtgccggtcagcgtacccgcttcaaggccatcgttgtcatcggtgactctgaaggccacatcggtctcggtatcaagacctccaaagaagtcgcaactgccatccgcgccgccatcatcatcgccaagctctccgtcgtccccatccgaaggggttactggggtaccaaccttggtgagcctcactctctgcccaccaaggagagcggaaagtgcggttccgtcaccgtccgtcttatccccgccccccgtggtaccggattggtcgcatcgcccgctgtcaagcgcctcttgcagcttgttggtgtccaggacatttacactgcctcggctggttcccccaagaccctcgagaacacactgaaggctaccttggttgctgtcgcaaactcatacggcttcctcacaccaaacctttgggccgaaactaagctcattcggagcccccttgaggagttcagcgatgtcttgcgtgagggcaaaaggtactagacggtttctggcgattcgggttttttcagcattccagggttatggcgtgaggtaatgcattcgggccctcagttatgcatctgacgactgagctgggaaactggcacgaaaatgaacaacttcattccccc

SEQ ID NO: 36598 - DNA, 620 bp, Triticum aestivum
  unsure (1)..(620): unsure at all n locations
  Clone ID: PAT_TA_36598
acttcctctcggacgcgtggtccactctccaatctccatccatctttcctctgcgagatcagcggcatgtcgaccaccgacaccagctcacccaaggacgcacccacaccggcgagcagcgccccggcggcggcggcggcaggcagcgagccggcggtgacaaagacggtgcagacggtggaggtgaggcagtcggcggggcaggaggagggggaggggaccatcaagccgatcgaggtggtgcacgagatcccggccaaggagcctgctgctaagcaagagtgagcacaacgaatcgagaaaaagcagtgtgattggtaaaatggaggtgttcgcttaatgttccccggttgagtaaatcgccgggtggaacccctgttttttcactttggagaactgaagtgattggaatatctttgttttcggtaagtaagaatgagcatttttagtgccaataagaatgaacttacgagtatgcagtactaccggaattgtgctattgtctgtcgattttcccacgaaaaggaaaaacgttgtactgttgctttttttacacagcatttgattttcttacacagtataatcgaagtcngttacatacacgagcgtgtgtgtaactt

SEQ ID NO: 36599 - DNA, 512 bp, Triticum aestivum
  Clone ID: PAT_TA_36599
cgagccgcagccaaggaaaaaatccttctcgaaaagggcagcggcgagcagcgtatatatacggcgcggagccggctgggagagtgtcccgcatccctccctccctccctcgccgctatccgctccccgtccgtccgtaggctcctcctcctcctccccctcccccgtcccggccgtctccgacccctcactgctcgagtttggaaccagggaggagtatctagaggagagatggcggcggagagggtcaaggacgccggcgtcctcgccatggacatctacttcccgcccaactgcgtcctccaggaagaactggaaactcatgatggcgtgagcaaagggaagtacaccattgggcttgggcaggatagcatggccttttgcactgaagtggaggatgtcatttcaatgagcttgacagtggtgaagactctcctgaaaaattataacatccgatccaaagtgcattggacgtttggaaggtggcagggaaactgtaatagacaagagca

SEQ ID NO: 36600 - DNA, 965 bp, Triticum aestivum
  unsure (1)..(965): unsure at all n locations
  Clone ID: PAT_TA_36600
cgtccgcggacgcgtggggcaaantcctcatccatccctccctccctcccccgtcccggccgtctccgacccgacctctcgcttcttcttctggggctgggtcttcttcttcttcttcctccctcactggtgaagccagatggctgcggagagggtcaaggacgtcggcatcctcgcggccgacatctactaggtgacactatagaaggctgggcgagcccgctgtatgacaccaaggttcaaccaacaacattgatcccgaagcaactcgggaacatgtatacggcatcgctctatgctgcttttgcatcagttgtccacaacaaacacgatgctctggtgggccagaggatcgtcatgttctcctacggcagtggcatgacgtcgacaatgttctccttcaaaatcaatgaaggccagcatccgttcagcctatcgaacatcgcaagcatactggacatctccaacaaattggagtctaggcatgtggttccgccgaagaaattcgtcgaggcgctgaagctgatggagcatcgctatggcgccaaggacttcgtcaccagccaggacacgcgcttgctcgtcccaggcacctactacctcacccatgtcgactccatgtaccgccggttctacgccgtgaaaggcgacaccgcggccactccggtaaccaatggccattgattgattgactttgcccagcctgaaggctgcaataagcgccgcaagcgctcttagattatttatctggtagggaagggaaagggaagggtggagcttgcccagattaatctatctgtaaacttgttctaagtttgtaaagttagatagtgctgtcattgtccgtattgccttgtcagtgagaattcttggctctgtagtggaacgttggtgctccgcttggttgtaaacttgtaagatctgaataatagaataatcccccgaattaccgtcaggtttaagct

SEQ ID NO: 36601 - DNA, 1907 bp, Triticum aestivum
  Clone ID: PAT_TA_36601
cgtctccccgcgatccgctcccgtccgctggctgtccctcccccttcgtccccgttcatccccctggccctggcccttttcgactccgcgttccttcttcttacctccctcatcgcgaccagagacaccgaggagcagctggaggccatcttgctgcggagctacccacgcaccatgccaccttcatcctgcgagaccagcgacatgtcgacggcggacaccagctaacccagggagctcacgagggccggagaaaagcgccgcagacggtggcggatgggcagcgtgccgaggggtgacgcagacggtgcaggcggttgaggtgaggcagtcggcggggcagggggagggggaggggactgatcaagacgatcgaaggttgcgcacgcagattccggcccaaggagcctactactaagcaagagtagcagtgcacaacgaatcgagaaaagcagtgatatgggtaaaatggtggtgtccgcgtgctatttcccggttgagtaaatcgctggtagagaccccagtttttattttgtagaactggagtggtgggattatctgtgtttttggtaactaataatgagcatttttagctgcacctacatttagatatatgctgattggtttacacgtcatactcgcagtccagctgctattgcaatgctgattggaccaaatgctcctatttcattgggaaagcaaatttagagggtctcatataggcacatgttttagtgacttttacaagcctgatcttgcgagcgaatagcagggggtcgatgggaagctgtcacagacatgctatctcatggcactggattcctggtacaagaccttctgcaaaagggccggtttgctcttgcggagcacccaacttcttcctcccaccccccagctcaatcaacacaatcagacacaatggctgaccgaggaacttctcgcggtggaggctttgcttcccgaggtggtgaccgtggcagaggtcgcggacgaggccgtggccgcggtcgcggtaagaacgaggagaaggagtggcagcccgtcaccaagctcggtcgtctcgtaaaggccggcaagatcaacagcatggaggagatctacctgcactctctgcccatcaaggagtaccagatcgtcgacaacttcctgcccaagctcaaggatgaggtcatgaagatcaagcccgtccagaagcagacccgtgccggtcagcgaacccgattcaaggccattgtcatcattggtgactccgagggccacgtcggtctcggtatcaagacctccaaggaggttgccaccgctatccgtgccgccatcatcatcgctaagctcagcgtcatccccgtccgtcgtggttactggggtaccaaccttggtgccgtccactctctgcccaccaaggagagcggaaagtgtggttccgtcaccgtccgtctcatccccgccccccgtggtactggcctcgttgcctcccccgctgtcaagcgattcctccagctcgccggtgtcgaggacgcctacacatcctctgccggttccaccaagaccctcgagaacaccctcaaggctactttcgttgccgtctccaacacctacggtttcctcacccccaacctctggaaggagaccaagctcatccgaagtcccctggacgagttcgccgatactctgcgcgagggcaagcgatactagagcgggaatgttttatgaactgatgggagctggaaactggtgccgcggagtcacgaatcaattgtgtttcattgcataggttggccggttaggacacttcagatcgtataggctatggtgactgatggcttaacggtctgaaatgaaaaagaaatttcatcctccaaaaaaaaaaaaaaaaaaggcccctaaaaaaaaaaaaaaaaggcccctag

SEQ ID NO: 36602 - DNA, 466 bp, Triticum aestivum
  Clone ID: PAT_TA_36602
gccggccgggccggaaattgcctcatattgtgtatgtctatctcaaaatcagatacacagttcgtgcaaaatatgaaggggggcagcgtggtgtacatgattgcttttttgttcatcgggtgccttcttatggttggacaatgtcgtcctgagcccccaagcacctatggagatggccatgccaacgcgactatggcagtctcgtcaatagatgagagcaaagttactgtgaaattttgtgttattagaaattgcaagacaaaaggtgaattctggggctggaatggagggtgctactgttgcctcaatgcgccaggcataccatgttttgaacaccaatatcagtgtaatcagaattgcccaccaatccgaaataaggttgtgcaattcgagaatatataaattatgccgtctattggaataaaataagatcttggctgaaaaaaaaaaaaaaaaaaggccccta

SEQ ID NO: 36603 - DNA, 754 bp, Triticum aestivum
  Clone ID: PAT_TA_36603
gccggccggtccggggatgatgagacttgggtggacgacgggttccagtactacctcgcgctccgcaagtggtacgcaggcctccgccccgagtcggagttccgctgctttgtgcgggggcggaagctggtcggtgtgtcgcagagggacccgtctgcctactacccttctctgcctgggtggagcgctggggtacagcccaagatcgaggatttcttcgaagaattcatcgagccacagtttgcttcagagaattacacgtttgatgtgtatgtgagagccgatggtcgggtgaagctgatcgacttcaatccttggggcggctataccctgccgctgctgttcacatgggaggagcttgaggaggagcagagagcagaggacgagctggagtttcgagtggtgatgcagcagggtgcggtgaggccagggttaatgacagcaattccgtatgatatgctggattggggggatggcagtggctgggatgtgtttctgaagaaggctggcaatgagctcgacagacagatggcatcattaggtgtggattcgtagttacggcctacagcaaggtgctcgagtgctccagtaggtgaacaagtgaagtggtggctcttggtaatgtttcatctgtcgaacacttagaagtaacagttttcttcagattgtgatgcaacctcatggtacttgtttttctgtttcccgggactttgtaatgctaagttgctagtatgggattacctcttgttgctcc

SEQ ID NO: 36604 - DNA, 469 bp, Triticum aestivum
  Clone ID: PAT_TA_36604
aaacataaaataaggtatcattacatatctgttatcccagaccaatgtacatatatactatattgcttaaataagtatatagtataagcacacacgaggggtcatcatatgacattgtttctattgtaacaaacatctagatataaatatgcatcagtgatcgaactcagtaatatgttatcgatccagcacgatttatacatctggatatatatcttcatgacgcatgtatatttttgaagttaacccttataccatattgcactaatatgacggggatcatgcaaggtaattgtcgccgtagttggaggtgtccatccgcgtaaggcggcgggctgggtgggtggggggcgccggcggcgtgggggcggccgcaggtcctggatagggtggcgtcggcttgggtttgggagcaggcggcggcttgggttttggggcaggcggcggcttgggtttgggagcaggaggc

SEQ ID NO: 36605 - DNA, 444 bp, Triticum aestivum
  Clone ID: PAT_TA_36605
tggtcctacattcacgggtccacgggacaaccgtaccgcgacgtcatctatagtgtaccgtgtcccctgggtactgatttataaagtatcctaggggacaagcatgacatgcacttggtctgtaggctacccaaggtagcttacaaccaacgctagcaccacccatgcctacctcacactataaaagctagctccatccatccatcaagggatcggctcacacactctcacgcacatactcattcggccagaggtcacggtcaacacgccactagctagctagctcattgctactactctcagtccaatacagctccaggagcactttgtactgcccgatgtacaccccagatatatactcagacatgtaagagtaagggtattatctctccggagagccccgaacctgggtaaactagcgcgtgctacgcgcatatccgtctc

SEQ ID NO: 36606 - DNA, 553 bp, Triticum aestivum
  Clone ID: PAT_TA_36606
agggtttaagcagcagcagcagccccgccgcatccagatccccaacccaaaccctcgaacccggagaactcgccgccgacgacagccaagatgtttctaggcgcgatgccccggaagccgagcaaggaggcggcgtacaaggagctgcgcttgcatctcagcatcatggcgggctgcatcgccgtcatccgcgccgccccctacatcctccactacctcacccgcgagcccggcatgacggagctcaagctcgagctctaggtgcgactgggatggtgaagttactctcaggagcagactttgaagtaccttgtcaaacatgaaattagttttccttgttagtatttcgtctttctatagtgtgagaattcaatgacagtgttcgcataaactctgttggttgtggttaccactgccactgccccagcaactttgtgggtttttaacaatcagtgatgcgtgcctcatatatttcattattgctgggatgtgatttgtcgttgctatactgaatgtgtttcggttgttccctcttgtcaaatttataaatttt

SEQ ID NO: 36607 - DNA, 742 bp, Triticum aestivum
  Clone ID: PAT_TA_36607
cgccgctcgaggcgcatcgtgctcggggttaaaaaagaagcaaagaaaaaaaaagatccccaacccaaaaaaaaaaaaaccgagaaacagaaacgagctagggtttaagcagcagcagcagcagcctcgccgcctccagatccccaacccaaaccctcgaaccctcgaatccggagaggaactcgccgccgacgacagccaagatgtttctcggcgcgatgccccggaagccgagcaaggaggcggcgtacaaggagctgcgcttgcacctcagcatcatggcgggctgcatcgccgtcatccgcgccgccccctacatcctccactacctcacccgcgagcccggcatgacggagctcaagctcgagctctagggcggccccgctgcccccccgccccctgaggtgcgactgggatgttgaagttgctctcaggatcaggctttgaagtaccttgtgaaacatgaaattagttttcctttagtatttcgtctttctatagcgtgagaattcaatgacagtgtctgcataaactcggttggtaatgattaccactgccctggcaactttgtggatttttaacagcagcgatgtgtgtcttacatccagcaactttgttgggtttttaacaatcagtgatgcgtgcctcatatatttcattatagctgggatgtgatttgtcgttgctatactgaatgtgtttccggtggttccaaaattaccactaacaaatagtcgccctg

SEQ ID NO: 36608 - DNA, 1168 bp, Triticum aestivum
  Clone ID: PAT_TA_36608
aatctctactctgtagctctatacaaaaccaattgcttcagccaagacaacacaggttgtgccttgcaaaacacaaactctttgtttattttcaacatctcgcttccttattataacttcacaatgaacgctttccgctgtatgagacctgtggctgctagagtgcctttccaacggtctactcttcctcgagtcgcccgagcttatagctccaagacctacgaatatatccaggtttcacagcccaagcctggtgtcggccaagtgacactgaaccgtcccaaggccctcaatgctctctgcacacctcttatcaaggaacttaaccaggctctccttgaattcaatgcagctgatgacacttcagtcattgttttgactggatcccaaaaggcttttgccgctggtgctgatattaaggagatggctcctctcactttcgctgaagcttacactaattccttcatcgagtcttggtccgacctcactacccaaatcaagaagcccatcattgctgctgtttcaggtcacgccctaggcggaggctgtgagctggctatgatgtgtgaccttatttactgtaccgagaatgccaacttcggtcagcctgagatcaagctcggtactgttcctggtgctggaggcagccaacgccttacccgtgccatcggcaagtcgaaggctatggagctcatccttactggcaagaacttctctggagttgatgctgagaagtggggactcgctgccagaactttcccaactcatgaagctttgatggaggagactctcaaacttgctgaaacaattgctggctactccaaggtcgccgttcaagccgctaacgaggttgtcaacaagagtcacgaccttcctcttcgcgacggagtcgagtttgagcgacgagtattccacagtctgtttggtacccaggaccaaaaaatcgtcatgaacgcattcgcacagaagaagaaagctgagtgcagccactcatgaggaagataatgcgacagatgtgtagatcagggtatgctctttactcagcagtgatgtgagacaaatacataataatctaagcacaaatgaatagaaagtcgacgaaacaggcatcatgatgtgccaccgtgtatacatggccaaaaaaaaaaaaaaaaaaggcccctatggt

SEQ ID NO: 36609 - DNA, 742 bp, Triticum aestivum
  Clone ID: PAT_TA_36609
tcggtggctggcatctctaggggctggcggatgcgcccagacctcgtaccgcccagtcattggtgtatgcccgccctgctcgtttgtgcgggggtgctagctcggttgaatttagtgcccctgcatttacatgactaggtgttatcagtttttgtttcctttgatggctctgagtacaaattggagcttgttgggtacaaaatgttgccaagattagtttaggatcagaattgttgtcatgttgtccagatattgctctaagaggttcctagaattagtttaggatcagagttattgtcatgttgtgtagatattgctctaaagatttcgaacgtacttttctggttgcttggttataatttttgccccccaaaggaaagctttggccagcttcttgctagaatattatcataaggcttgattaatttagaacatacttgtgtcttttctctcgctctttatgttacctagaatctgtctaggatcagagttattgtcatgttgtctatatattactctgaagaacccaaacgagcttttcaggttgtttggttaatttttgccccccaaaggtcagctttggccagtttcttgctagaatattatcataaggcttgattaattttgaacttacctttgtcatttcactcttatgttattttaatagttatttgacatgctgtaaactaattctattatttttctagggagaagtaaaagttgaggggaagctactgcatgc

SEQ ID NO: 36610 - DNA, 1597 bp, Triticum aestivum
  Clone ID: PAT_TA_36610
cgttaccaagaaggggaaaaagggcggacacgccaggaaagaagaacgagaaaggagaccaagaaacgaccagaccaggaggagcccaatccatcgaccctcccccgcgacctcgagttctcgaagaatccatttctccaagaacccggctgcagtacgcagagaggcagagcggagctgtggagccgaggcggcccgcggtccccatccccgcgattcggccgggatccggccgcgccgccgcggccatggacatgatcgacagcatcgagtgcgtgtcgtcgtcggacggcatggaggacgacgacgccatgtcctccaacctgccccgccccttcctcaaggcctcggcggcggccatcgcggcggccagcatcggggtggtccccggcggcgtcggtggcgcgtccggcgccggcgcggccggggggatcgccggcccgctgattccgccggccacgagcgtccacgagctcctcgagtgccccgtctgcaccaactccatgtaccccccgatccaccagtgccaaaatgggcataccctttgttctacttgcaaagctcgggtgcacaaccgctgccctacctgtcgacaagagctgggcgacatcaggtgtttggcattggaaaaggtggctgaatcacttgagctaccatgcaaatactactcactaggttgtccagagatcttcccatactatagcaagctcaagcatgagtcgcagtgcaattttaggccatacagctgcccttatgcgggatctgaatgctccgttgttggggacattcctttccttgtttcacatctgagagatgaccataaggttgacatgcattctgggtgcacattcaaccatcgttatgtcaagtcaaatcccagagaagttgaaaatgcaacttggatgctaactgttttccattgtttcgggcagtatttctgcttgcattttgaggccttccagctcggaatggcgccagtctacatggcattcctccgcttcatgggcgacgagaatgacgcaaggaactacagctatagccttgaggtgggtgccaatggcaggaagatgatatgggagggcacgccccggagcatccgggacagtcaccgcaaagtgcgtgacagccatgacggcctcataatccagcggaacatggcactcttcttctccggtggggagaggaaagagctgaaactgcgggtgactggccgcatctggaaggagcagcagaaccccgactcgggagcctgcatccctaatctcttcagctgaagtgaatagttggcaacaggatatcatgtgattcaggtgtatattgaagaaatgtgattgccgatttgcttttctctctttacagtttgtgtttgtgtcttttcgctttttcagccactttgttgtaacatgctcaatattctttggggtggttggtgttatcaaggacagcacgtgaagcctgctggaaatcacatgatgatcattctcctctgcctggtctgtgtcctgtgattcctaaatgtctgtcatgtgattgtacttttaatgatctagtgatgtatgattgtattaaaaaaaaaaaaaaatcgagactagcccgc

SEQ ID NO: 36611 - DNA, 906 bp, Triticum aestivum
  unsure (1)..(906): unsure at all n locations
  Clone ID: PAT_TA_36611
tcgaggccggccggtccgggttgaagaaatgccggccgtcaaaagaactcgtcgtagaaaatcacttcttctttctcaactatcttcactttctttcaatttggctgtgccaaaccttcattctttctaaacaccatataaatcaacactttgcgaaccctcgcttcattccaatccttaccactttacaagtttttataacaccaaagaaatctatcaagatgcgtttcactgctaccgccgctactctggccatggccaccaccgtctctgcccacgctcaggtctacggcctctgggtcaacggaaaggacctcggtgatggtcgcaacacctacatccgatctcccgagaacaacaaccccgtcaaggacctgaccagccccgacattgtctgcaacgtcaacggtggaaaggctgctcccaagtttgccaccgctgctgccggtgacgaggtcaccttcgagtggtaccacaacactcgaggtgacgatatcattgatggctctcacaagggtcccatcatcacctacatcgccccttacaccgagaccgatggtaccggtgctatctggaccaagatcgccgaggatggtcttgagggtggccagtgggctgtcgacaagctcatcaaggacaagggcaaggctaccttcactctcccctccagcctcaaggccggcaagtacatcgtccgccaggagatcatcgccggtcacgaggccgatgttgccttcaaggacaacagcgcccgtggtgctcagttctacccctcttgcgctcaggttgagatcactggatctggcactgccgtccccgatgagaacttcgacttccagaccggttacacttacaccgacnagggtattgtctttgacgtctacacgcccaatcctactctttccc

SEQ ID NO: 36612 - DNA, 942 bp, Triticum aestivum
  unsure (1)..(942): unsure at all n locations
  Clone ID: PAT_TA_36612
gccggcgccggccggatcttcatcttcatcacatcccttctttaaagactcataatcttcaagataccaaacaccgcaatcatgtctgtccccgccttctccgacattgccaagccggccaacgatctcctcaacaaggatttctaccacctctctgccaccaccttcgagttcaaggacaccgcccccaatggcgttgccttcaaggtcactggcaagtccagccatgagaaggccacctctgctgctattgagggaaaatacaccgacaagcctaccggcctgacccttacccagacctggaacaccgccaacgctctcgacaccaagatcgaggtcgccgactccctcgccaagggtctcaagcttgagggtctcttcaacttcctccctgccaccgccgctaagggtgccaagttcaacctccacttcaagcagcccggtttccacggccgtgctttcttcgatctcctcaagggccccgtcgccaacgtcgatgccgttgtcggccacgagggtttcctggctggtgcttccgctggctacgatgctaacaaggctgctctgactgcttacagcgccgctgttggctacgctgctccccagtacagcgctgccattaccgcttctgacaacctcagcgtcttcgctgcttcttactaccacaaggtcaactcccaggttgaggctggtgccaaggctacctggaactccaagaccggcaacgctgtcggtcttgaggtcgccagcaagtaccgcatcgaccccgtctctttcaccaaggtcaagatcaacgaccgcggtattgctgcccttgcttacaccgttctccctcgtgagggtgtcaccctgggtctcggtggctctttcgacacccagaagctcgacccagctacccancagctcggtgccagcttcaccttcgaggggtaactgcttcta

SEQ ID NO: 36613 - DNA, 825 bp, Triticum aestivum
  Clone ID: PAT_TA_36613
attcggcaccaggggaagcgaggcagcaaggccaagggggccccggcgccggcggccgcggccgcggcgcgcgccgccggcggggagttcccgggctgcctccgcctgatgccgccgtccaccgtcgccatctccgtccacgccaagcccggctccaagatggccaccatcaccgagatcggggaggaggccgtcggggtgcagattgacgcgccggccagggacggggaggccaacgccgccctcgtcgacttcatcagctcggtgcttggggtgaagaaaagagaggtgtccatcggctctggctcgaaatcgagggagaaggtcgtgctagtgcaggacgcgacactcaaaggcgtcttcgaggccttgaagaaggcgtgtggcccttgatgatgtatgttaactgtgagtatgtaatataacctggctgagcagagtgtatcagctgtaggaaccggtgctctttctcccgtataaatcgccgccatacgcgcgacggtgaaccccgtaaaaggctgaaaccatggtaatggccagtcttgtccctgagatggtgacggggaactgctcttttttctgaatcagaacaaagagtaactgaggtgtatgtatggtttgcatcgacaggctgagcctctgtatcgctgtttgacatttgctgttgtgcgtcagatggtgcaattagcagcccatgggtgtgttatgcgttgtttaaaaacacatgtgcctttatatgttgttcaagcctgagaaataagcagtcctgaactgactgtcgaagatgtggatcggcgagtcttgatcaaaaaaaaaaaaaaaaaa

SEQ ID NO: 36614 - DNA, 1970 bp, Triticum aestivum
  unsure (1)..(1970): unsure at all n locations
  Clone ID: PAT_TA_36614
cccacgcgtccgcctgtgggcccctgcttctgcctccccttcctcatcttattactttcctcaccacgccgatccgccggtttgtctcgcaaaccctaaccctagcaagcccgcttcgctcctcctcctccaacaagatctctctccgaatctttggatgcaccggctccgatgtctgccccaccgcccaaatctgccggccatggcgatgtcggatctcgcggccgcggtgatctccaaggccaacggcggcgtggacggcgaggagccggtggagatcccgcctcctccgacgatgatggtaagcccgccgacgaggagggcgccgcgacgtagtcgacgtgggcgaacaacctcgaggcggagttcgccgtccgtggcatcgtctgcgacgattacccgtacatcgccatggacaccgagttcccgggcatcgtgtgccgcccgctcgggagctttcgctccaatgacgagtacaactacgccaccctcaagggcccaacgtcgacatgtccgagcctcatccagcttggtctcaccctctccgacgagaacggcgcactcccggccaggggcaacggggggcgcccccttcgcgcctggcagttcaactttcggggcttcgatccgcgctcagaccccgccaacgctgactccatcgacctgctacgcaacagcgggatcgacttcgaccgcttcaccaccgagggtgctgacacaggccacttcgccgagctgctcatgtcgtcgggcgtcctgctcaacgctgagctccagtgggtcacattccacagcgggtacgacttcgggtacctgctcaagctgctaaccgggcggaacctacccgacaccatgcctggattctttgacctcatcagaatctacttccctgtgctgtacgacatcaagcatctcatgaagtactgcggcagcctccatggtggcttgagcaagcttggtgagctacttggtgtccaacgtgtggggatctgccaccaggctgggtccgactcgctgctgaccttgcggtgcttccaaaagctgaaggaggcatatttcagaggatcgaccgagaattatgccggtgtattgtatggtcttatttctgatggtggggagaacagaccaccagcagctctgctcatcgaatgagtaatggatagtcaaataagacaatgttatggttgaaaaaaaggaaatgtttctgtaaagtatagtttttcagttattcccattgaactagtgttttctactgatgctgttagcttgctcttacatattacattaattgaaagggatcacctccagtagtgacaagggtgtntgtgttttcctcacttacatatatatcgtgcccacgagagggctctggtgggaacagattcaacagtaccattaaaatgtcttctgacggcaagtttgtggagacctccataaagcaacatgcaaaaaagataccgttccatcatgacatccttccagtatcatatcatgaggagaagatgactaatcaacaatcaagggaatggtgtttgccattacaaagatggcgcaagtgctcctataagccgcacagctggtttgcaactgcactcacttggttgattaaacctccaccgaaccgaagcagcggttgatcaacaacaggaaccgcaagctcgcagatccaccaacctagcagatcctagaccttaagtacaggccgtgggtctcttatttcttttatttttcaatgcctgcaataaaaaaatgatgggataatgagcagctaaaaatcagataatgtgtagactaaagacttcatattgcctagcatgagcacaaatagaaatatatcaatgcctgcaataaaaaatgatgctacatgaagaaaaacaacagaaagattgtgaaaccaaagtataacgagaattatacttgcatttcatcaaacaggtagtgtgtatttaattcatacaatagtgtcggac

SEQ ID NO: 36615 - DNA, 2046 bp, Triticum aestivum
  Clone ID: PAT_TA_36615
ccgacccccggttcctccgctcggccgctcgcgccgccgtgcaccgccgcgtgccaatggagcgcctacacctcgcggtgtcccaccgcccggctctccccctccccactcctcacaaccacctacgccgccgccatctccagctgcagccctccactagttctctctccctctgccgccccatctcccctcacatctccctcgcccctcgccgccacctccatcctctcctggcctccgcgtccgccacccaagcttcaagccccaacactgagcccgcaccggcgccggcccccgccgcggcctcgtccggcgcgaagctgctccccctcatcgcctccatcgcggtcggtctcgcagtgcgattcctggcgccgcggccccccgaggtgactccgcaggcgtggcagccggtctaagtttttctcaattgttctttactgcaccagaaacctatgtgcctcaccatttggagtgagctcatctttcttcggaggtgcttggtgaaatgtataataagagagggatgttcaccactcagaactttgaacatgctacatttgtaaagaaagatctacccagaagggttcacatagttttccaagcactgcattgtatctgtatattgcagaactaaatgcaatgtagggacgagtttagactgggactatcctacggtctcaccatcagtgaggcatgcatcgcgccggccatgcccagcaccacggcgagggctggaggggtgttccttcccattgtcaagtcgctgtcgctatcggccggcagcaagccgaatgatccatcagcgaagaaactgggtgcctaccttgtgcagtctcagctgcaggcatctggcaactccagtgctctctttctgaccgctgctgcgcagaatctcttgtgtttgaagttagcggaggaggctggtgtcaaaattgcaagcccgtggatatcatggttcaaggttgcaagtttgcctgccatcatttcgcttttagcaacaccttatttgctatacaaaatattccctccagaaataaaggacactcctgaagcccctgcattagctgctcaaaaactaaagaaaatgggcccagtgacaaaaaatgaatgggtcatggttgctacaatgattcttgcagtctcactctggatttttggggatgctattggtgtgtcgagtgttgttgctgcaatgattgggctttcaattcttcttctacttggagtgatgaactgggatgattgcttgaatgaaaagtctgcatgggacactttagcttggtttgctattctagtgggaatggcagggcagctcactgacctcgggattgtgtcatggatgtcaaactgtgttgcaaaggttcttcagtctttctcattgagttggcctgcagcatttggtgttcttcaggcctcctatttctttattcactatctatttgcaagccaaactgcacatgttggagctctatactcggcgtttcttgccatgcacctagcagctggtgttcctgctatactctcagcacttgctctgacgtacaattcaaatctctttggagcactaacacattatagcagtgggcagtccgcggtttactatggagctgggtatgttgaccttcctgatgtattcaagctggggtttacagcagcagcgattaatgctttgatttggggagtagttggtacattttggtggaaattcttgggtctttactgaggatttctgcggtgtaagttgatggaaattgttctttactgcaccagaaacctatgtggctcaccatttggagtgagctcatctttcttcggaggtgcttgttgaaatgtataataagagagggatgttcaccactcagaactttgaacatgctacatttgtgaagacccagaagggttcacatagttttcaagactgcattgtatctctattttgcagaactaaatgcaatgtagggatgagtttagatctggaagctctgtattttcttgatgtggatattgcgtatgcaatgactttttttgtgtgccaaaaaaaaa

SEQ ID NO: 36616 - DNA, 766 bp, Triticum aestivum
  Clone ID: PAT_TA_36616
ctgtgcggcgctcgaggcggccgggtgggcagccccaaggagatcaccccgtcgttcagcctccccaccctggcaacggcacctacaaccctcccaagcctcagcctcccaaggagacataccctgtccccgttcctgtccccagcaagcctgttgagcctgagcaccccgagcagccccagcagcccgagaagcctcagcaccctcaagagcctgagaagccccagcagcctactcctcccaaggagaccaagcctgttgtccagcctcctgttgagtctcaccctacctaccccgttcctcctcagcctgagcacccccaggagcccgagaagcctgagcagccccagcctcccaaggagaccaagcccgttgttcagcctcctactcccagcaagcccgtcgagagtgctcctcccgctgttaccaagcctgtcgagacctaccccgctcctcctgtttccactcccactgagcccgctcaggttgtcaacgccggtggacgtgtcgctggtagcatccaggctactctcttcgctgctggtatcgtcgctttcttcctgtaaagaaacaactattttttaatttcacttctaatgctcatgaaggagctatgagtatatgacggattggagatttttatatatacgatgtatagttagttactatgcacctatcacctgcacactattacccttccagataaataatttcttagaataatatactaaaaaaaaaaaaaaaaaaggcccctaaaaggccccta

SEQ ID NO: 36617 - DNA, 945 bp, Triticum aestivum
  Clone ID: PAT_TA_36617
gagagacccgaccagcgtcccacccaacgacccagcgtcgacctacctcctaccctcatccatccacccattgatccatcgattgatttggttggattaattgatccgccaccgccaccaccaccgccgtggagaaaggagggatggcggcggcggcgggcaggggcggggggccgaggcgcacgacgcgggtgggcccctacgagctcggcaagaccgtcggcgagggcagcttcgccaaggtcaagatcgccaaggacacccgcaacgccgccacctgcgccatcaaggtgctcgaccgcaaccacgtcctccgccacaagatggtcgagcagattaaacgggagatcgccacaatgaagctaatacgacatccaaatgtggtccagctgcatgaggtgatggctagcaaatcaaagatatacatggttcttgagtttgttgagggaggcgagctttttgataagatcgtcaattctgggaagctaggagaagatgaagcaagaagatacttccaccaacttataaatgcggttgattattgtcatagccgtggagtgtaccatagagatctcaagccagaaaatctgctccttgattcatatggagctctcaaagtttcagacttcggtctcagcgcattttctccgcaaacaaaagaggatggacttctgcatactgcttgtggaactccaaattatgttgcacctgaggtgcttgctgataaaggttatgatggtatggctgctgatgtgtggtcctgtggcataatcttatttgtccttatggctggatatttgcccttcgatgatcccaacttaatgactctgtataaattgatcaccagagctaatgtttcttgtccaccatggttttctaccggtgcaagaaatcttattaagcgcattctcgatcccaatcctcacacgaggataacaatctccc

SEQ ID NO: 36618 - DNA, 557 bp, Triticum aestivum
  Clone ID: PAT_TA_36618
taggggccttttttttttttttttttgtgcaaaagatctgtgtcttggatataatattttatcttaaggtcatcgcaatatcatgatgttacaaacacagtgacggtttcaaacacaaagtgaactattaaagttcaatacaatatatgatatacaatacatatcaaagaatatactgtgtgtgaagatgcaatgatgtgcttcataacaccaaagttgtaaattattacccccaaagccacaagtatagtaaaacaatttgaaataactcacagtttccgtgtcaaggatgattacaatggtggtacataagggaacttgacaaacatccctagtcagccattttgttcaatcgatgaatcatactcctggcaagacgattcccagggtcaatcttcagaaccaaacgcaggtcctcagccccaagcctatatttctcactgctctcatataagagagcacgttgcactagcaccgacacattgtccttatcttgctcgagcaccttcgaacagtcggcaatagccttcttgtactcgcctagttctagatcgcga

SEQ ID NO: 36619 - DNA, 1898 bp, Triticum aestivum
  Clone ID: PAT_TA_36619
cccatgcgtaagaggacgcgaggaccagcgagccagggagagacccgacctcggacccaacgacacagcgtctccctacctcctaccctcatcgatccattgatccatagtttttattgattaattgatacgccaccgcaaccaacaccgacgtggagaaaggagggatggcgagggtgggcgggagaggggggcataggcggacttggcgaacatccctagtcggccatgtcgttcactcggtgaagggcacccctggcaaggcgaatccccgggaggatccccagaacccaacgccatgcgccatcaccaagcctatagaccacaatgccctcctacaaaagatgatggtgcaatagcaccgacacatcgccagtatcaagctagagaaacatccaacccacggccggccgcttgcatgaagtgatggcaagcaaatcaaagatatactttttgagtttgttgatggaagctagcaacgtttttgataagattgtcaattctgggaagaggagaatagatgaagcaggacgatacttccaccaacttataaatgcggttgattattgtcatagtcgtggaatgaaccatagacatctcaagcaatattgttccctgattcatatatagcgcacaaaaactcaggcctactttttgatagcatcactccgcaaccaaacgagggtggacttccgcatacttcttgctgaagcagcagatgccttcaacccgaggggcttgctgataaaggttatgatggtttggctgctgatgcatggttctgtcgcataatcatatttgtccttatggcttccacccaaccatccatctcaccaaacatgtcaccaccaccattactcgccgcagaagcagttggtgcagatgcgcacgaatgaatcaccgtgtcaaaatgatccttgacagagttcacggtcgcagtcataacaccaggaatgacaaccgcccaaatcttggcagatgaatggttcataaaagagtataaaccaccacattctgagcacaatgaggatgtgagcctttaagatgtcgagactgcgctcgcgagttcacaggaacacactgtggcggtgaggggagagaaacccgaatccatgaatgtttttgcccttatttcacggtcgcagggatgcaacctcggaaatttgtttgagaaagagatgatggggatggtaaagcgggaaacatcctttgcgtcgcaacgtacaccacaagagatcatgtctaaaatagaagaagcctgtggccctcttggtttcaatgtgcggaaacaaaattataagatgaaagtgaaaggtgacaagacaggaagaaaaggccatttatctgtagcaacggaggtttttgaggttgctccaacactccatatggttgaacttcgtaaaactggaggggacaccttggagtttcacagttgctacaagattttctcgtcagaactaaaagacattgtgtgggaaactgaatccaacacaattgcgaatacagcgatgatcgaaactttccggaatggaactatcaggcggggctgtatggatggaccaccccttcaggtgatgccgctgggcgctgggtactgtatatttctccggcaccgcatcgatggtccagtccgccgtctcttgctgaagacagcgccttctttttaccgagcgcgattgtacacttacatgtacaacgaggccctcccggacaagctccttgtaatattgcaacggggtgcctaacaggcatcctgaatgtgctttagtttgcaccagggttgtgtgcctttctttatttttgtattgcaagtatttgagaatcgtaagatgaataaaggtagttcagacttgacatagtaatttaaattcttgcttcgtgccgaattccgcgcccca

SEQ ID NO: 36620 - DNA, 1348 bp, Triticum aestivum
  Clone ID: PAT_TA_36620
gcggctccggggtggcaccttggtggggcggctcgtgtcgcgcaacattcctgcgcaggtcgcccactcccccggctgcgcacagagcgcgggggttggccacgttgcaatctggggagcccccgccgatcggagcccccgcctccccccgcctcgcgtcttctactcccccccgttctgctccgatcaactcccagacgctgcctggtacgagaagatggaggcttgtataactccgctgccggaggttagtgacatcaaggaggtcgccggcggtgagctgaagaagtggccgcagaggctcaccgccgtgccacccaggattgctagtggcagtattgagggggtcactgccgaaatgtttaacgaagacaccaagttatggaagaagagagtcgggcactacaagtccgtgataagccagtttgggcagaaggaccggtaccgcaacttgctggatatgaatgcgcgctttggcggcttcgctgcggcattggcgggtgaccctatgtgggtgatgaacatggtcccaaccgttggaaattcaaccacccttggggtgatatacgagcgcggcctcattggaaactaccaagactggtgcgagggcatgtccacctatccccggacctacgacctcatccatgctgattcagttttcagtctgtacaaggacaggtgcgagatggacgccatcctgctggaaatggacagaatcctgaggccggagggcacggtgatcatcagggacgacgtggacctgctagtgaagataaagagcgtcgcggacgggatgagatggaatagccagatcgtggaccacgaagatggtccgctcgtccgggagaagctcctccttgttgtcacgtcgggctggtctctcggcgtcgcctcactggagcagcacccgaaataaaagcatgagaaatgagaaaatcgccagatactgggcacatgccacacgcatccggcttcctctcgccgtgttcgccctgtggttttgaagtttcatcttgtttgggtagttcgtttggtgaaatagtgaaacatagtggagtcatgcccacgtctgttctcagagggcaggcctgcagcgtcgcggacggggggaggggcagccgcccggccgtgggccgcggacagggtccgctcggccgggcgagccgcctcctgggtgggaagacatactggacactcggggacgagaaacaatagcaacgccccgaaataagcatgagaaattgacagatactgggcaaatatcacaactggcttcctctcaccgtgttcgccctatggttttgaagttttatcttgtctgggaaaaaaaaaaaaaaaaaggccccta

SEQ ID NO: 36621 - DNA, 1561 bp, Triticum aestivum
  Clone ID: PAT_TA_36621
gagagagagagagagactccattgttgaagtgtgttcactgaactcctcctcaaacaacaatggcgacgacggttacactcaaatccttcaccggacttcgtcaatcatcaacggagcaaacaaacttcgtctctcatgtaccgtcatcactttctctccctcaacgacggacctctctccgagtaaccgcagccagagccactcccaaactctccaaccgtaaactccgtgtcgccgtcatcggtggtggaccagcaggcggggcagctgcagagactctagcacaaggaggaatcgagacgattctcatcgagcgtaagatggacaattgcaagccttgcggtggcgcgattcctctctgtatggtcggagaattcaacttgccgttggatattattgatcggagagtgacgaagatgaagatgatttcgccgtcgaacattgctgttgatattggtcgtacgcttaaggagcatgagtatataggtatggtgagaagagaagttcttgatgcttatctgagagagagagctgagaagagtggagccactgtgattaacggtctcttccttaagatggatcatccggagaattgggactcgccgtacactttgcattacactgagtacgatggtaaaactggagctacagggacgaagaaaacaatggaggttgatgctgtcattggagctgatggagctaactctagggttgctaaatctattgatgctggtgattacgactacgcaattgcatttcaggagaggattaggattcctgatgagaaaatgacttactatgaggatttagctgagatgtatgttggagatgatgtgtcgccggatttctatggttgggtgttccctaagtgcgaccatgtagctgttggaacaggtactgtgactcacaaaggtgacatcaagaagttccagctcgcgaccagaaacagagctaaggacaagattcttggagggaagatcatccgtgtggaggctcattcgattcctgaacatccgagaccacgtaggctctcgaaacgtgtggctcttgtaggtgatgctgcagggtatgtgactaaatgctctggtgaagggatctactttgctgctaagagtggaagaatgtgtgctgaagccattgtcgaaggttcacagaatggtaagaagatgattgacgaaggggacttgaggaagtacttggagaaatgggataagacatacttgcctacctacagggtacttgatgtgttgcagaaagtgttttacagatcaaatccggctagagaagcgtttgtggagatgtgtaatgatgagtatgttcagaagatgacattcgatagctatctgtacaagcgggttgcgccgggtagtcctttggaggatatcaagttggctgtgaacaccattggaagtttggttagggctaatgctctaaggagagagattgagaagcttagtgtttaagaaacaaataatgaggtctatctcctttcttcatctctatctctctttttttgtctgttagtaatctatctacactaatgttgttactcttcaatgt

SEQ ID NO: 36622 - DNA, 279 bp, Triticum aestivum
  Clone ID: PAT_TA_36622
ccggactccatggcgagggcaacgacactggtgctcgtggccgcgctcgccgtcctcctcctcctcgcctccggccccgcgggcgccacggccgcctggacctcgcccaaggacgtggcaacggcatctcccaacgagaaggtcgcggcggcggcggcggaagaccacgagtgcgagatgagggccggcgagaagcagcgggatgagtgcatggcgaggaggacgctcgcggcgcacaccgactacatctacacccaagatatcaaatggtttgttggc

SEQ ID NO: 36623 - DNA, 489 bp, Triticum aestivum
  Clone ID: PAT_TA_36623
tgagcggataacaatttcacacagaattcattaaagaggagaaattaaccatgtcgtggaaggcgtacgtcgacgaccacctgtgttgcgagatcgacggccagaacctcacctccgccgccatcctcggccacgacggcagcgtctgggcgcagtcccccaacttcccccagttcaagcccgaggagaatgctggcatcgttaaagactttgaagaacctggacaccttgcaccaactggtcttttccttggaggcacaaagtacatggtcatccaaggtgaacctggggttgtcatccgaggaaagaagggcaccggtggcatcactatcaagaagaccggcatggccctgattcttggtatctacgatgaacccatgactcctggccagtgcaatttggtcgtggagaggctcggcgattacctgatcgatcagggttactgtggatctcatcaccatcaccatcactaagcttaattagctgagc

SEQ ID NO: 36624 - DNA, 732 bp, Triticum aestivum
  Clone ID: PAT_TA_36624
ttctaccagtggaaccccgacggcgtgacgtggggcaacggcaacctgtcgtggggccactccgtgtccgtcgaccttgtgaactggttcgccctggacgcggcgctccagcccagccgccctttcgacgccaacggctgctggtcggcctccgccaccatcctccccgacggcggcagccccgtcatgctctacaccggcatcgaccatcccgatattaattatcaggtccagaacgtcgccttccccaagaacgcctccgacccgctccttgtcgagtgggtgaagccgagtgtgaatccagttattccagtgccagcagatatcaagcgtgatgattttcgtgatccaagcactgcatgcagcgcacgtcgtccagtggcacatcgccgtcgcggaccacgtccacattgctggggacgcactctgatttatcgtagcaaggattttctgcgttgggaacgtaatgcagatccactgtatctggcacatgccgcgggaatgtgggaatgtccagattttgaaccagaatggcggttcggaagcggagaacggcgtcggggagaagcacgggcacaagatgaacggcatggacatggaccaggactgctacggggacgggaactacggcggcatggaggacatctgcgtgcagggggtagaagaagactgccagaactgcggctggattatggacatgtttatgccagcaagactttcttcgatagccgg

SEQ ID NO: 36625 - DNA, 2797 bp, Triticum aestivum
  Clone ID: PAT_TA_36625
ccgccgccatcgacgaagatgctctgcctcaccgcctcctcctcgccctcgccctcgccctctctcccgccgcgcccctcccgtcccgctgctgaccggcccggaccggggatctcgggcggcggcaatgtgcggctgagcgcggtgcccgcgccgtcttcgcttcgctggtcgtggccgcggaaggccaagagcaagttctctgttcccgtgtctgcgccaagagaatacaccatggcaacagctgaagatggcttcggcgaccttccgatatacgatctggatcccaagttcgccggcttcaaggaccacttcagttacaggatgaaaaagtatcttgaacagaaacattcgatcgagaaatacgaggggggccttgaagagttctctaaaggctacttgaagtttgggatcaacacagaaaatgacgcaactgtgtaccgggaatgggcccctgcagcaaaggatgcacaacttattggtgacttcaacaactggaatggctctgggcacaggatgacaaaggataattttggtgtttggtcaatcaggatttcccatgtcaatgggaaacctgccatcccccataattccaaggttaaatttcgatttcaccgtggagatggactatgggtcgatcgggttcctgcatggattcgttatgcaacttttgatgcctctaaatttggagctccatatgacggtgttcactgggatccaccaactggtgaaaggtatgtgtttaagcatcctcggcctcgaaagcctgacgctccacgtatttacgaggctcatgtggggatgagtggtgaaaagcctgaagtaagcacatacagagaatttgcagacaatgtgttaccgcgcataaaggcaaacaactacaacacagttcagctgatggcaatcatggaacattcatattatgcttcttttggataccatgtgacgaatttcttcgcagttagcagcagatcaggaacaccagaggacctcaaatatcttgttgacaaggcacatagcttagggttgcgtgttctgatggatgttgtccatagccatgcgagcagtaatatgacagatggtctaaatggctatgatgttggacaaaacacacaggagtcctatttccatacaggagaaaggggttatcataaactgtgggatagtcgcctgttcaactatgccaattgggaggtcttacggtatcttctttctaatctgagatattggatggacgaattcatgtttgacggcttccgatttgatggagtaacatccatgctatataatcaccatggtatcaatatgtcattcgctggaaattacaaggaatattttggtttggataccgatgtagatgcagttgtttacataatgcttgcgaaccatttaatgcacaaaatcttgccagaagcaactgttgttgcagaagatgtttcaggcatgccagtgctttgtcggtcagttgatgaaggtggagtagggtttgactatcgccttgctatggctattcctgatagatggattgactacttgaagaacaaagatgaccttgaatggtcaatgagtgcaatagcacatactctgaccaacaggagatatacggaaaagtgcattgcatatgctgagagccacgatcagtctattgttggcgacaagactatggcatttctcttgatggacaaggaaatgtatactggcatgtcagacttgcagcctgcttcacctacaattgatcgtggaattgcacttcaaaagatgattcacttcatcaccatggcccttggaggtgatggctacttgaattttatgggtaatgagtttggccacccagaatggattgactttccaagagaaggcaacaactggagttatgataaatgcagacgccagtggagcctctcagacattgatcacctacgatacaagtacatgaacgcatttgatcaagcaatgaatgcgctcgacgacaagttttccttcctatcgtcatcaaagcagattgtcagcgacatgaatgaggaaaagaagattattgtatttgaacgtggagatctggtcttcgtcttcaactttcatcccagtaaaacttatgatggttacaaagtcggatgtgatttgcctgggaagtacaaggtagctctggactccgatgctctgatgtttggtggacatggaagagtggcccatgacaacgatcacttcacgtcacctgaaggagtaccaggagtacctgaaacaaacttcaacaaccgccctaattcattcaaagtcctgtctccaccccgcacttgtgtggcttactatcgcgtcgaggaaaaagcggaaaagcctaaggatgaaggagctgcttcttggggcaaagctgctcctgggtacatcgatgttgaagccactcgtgtcaaagacgcagcagatggtgaggcgacttctggttccaaaaaggcgtctacaggaggtgactccagcaagaagggaattaactttgtcttcgggtcacctgacaaagataacaaataagcaccatatcaacgcttgatcagaaccgtgtaccgacgtccttgtaatattcctgctattgctagtagtagcaatactgtcaaactgtgcagacttgagattctggcttggactttgctgaggttacctactatatagaaagataaataagaggtgatggtgcgggtcgagtccggctatatgtgccaaatatgcgccatcccgagtcctctgtcataaaggaagtttcgggctttcagcccagaataaaaacagttgtctgtttgcaaaaaaaaaa

SEQ ID NO: 36626 - DNA, 1869 bp, Triticum aestivum
  Clone ID: PAT_TA_36626
gctttcttccttcttcctcgccaactcccctctcgaccttatcgcccaccacaccaccctcccccgtccccgtccggacacgcaagcgaccgcccggatcgatcgccggccccggccatggatccctacaagcaccggcccacgagcggggccaactccgcctactggaccaccaactccggcgcccccgtctggaacaacaacaacgccctcaccgtcggacaccgaggacctatcctccttgaggattaccatctgattgaaaagcttgcacaatttgaccgggaacgcatacctgaacgtgttgttcatgcacggggagccagtgcaaaggggttctttgaggtgactcatgatgtttctcagctcacatgtgctgactttctccgggctcctggggttcagaccccggttattgtccggttctctaccgttgtgcatgagcgtggaagccctgagaccctcagggatccacgtggttttgcagtgaagttctacaccagagagggtaactttgaccttgttgggaacaatatgcctgtgttttttatccgagatgggatgaagttccctgacatggtccatgctttcaagccaagttcgaagaccaacatgcaggagaactggagagtagttgacttcttttcgcaccacccggagagtctgcacatgttcaccttcctatttgacgatgttggcattccactcaactacaggcacatggacggttttggtgtcaacacctacaccttaatcagcagggatggaaaggctcacctggttaagttccattggaaacctacatgtggtgtgaagtgcctcttggatgatgaagctgttactgttggaggcacctgccacacccatgccacaaaggacttgactgattctattgcagctgggaattacccagaatggaagcttttcatccagaccattgatgctgatcacgaggatagatttgactttgaccctcttgatgtcaccaagacctggccagaggacatcatcccactgcaaccagttggacggatggtactgaacaagaacattgacaatttcttcgcggaaaatgaacagcttgctttctgcccagcagtcactgtccctggaatccactactctgatgataagctgctccagacaaggatcttctcatatgctgatacccaaaggcaccgtcttggtccaaactacttgatgctccccgtgaatgccccgaaatgtgctcaccacaacaaccatcatgatggcttaatgaatttcattcacagggatgaggaggtgaactacttcccttcaagggttgatcctactcgtcatgctgaaaaggaccctatgcctccgcgtgttctatctggctgccgggagaagtgcattatcgacaaggagaacaatttcaagcaggctggtgagagatatcggtccttcgaccctgccaggcaagaccgtttcctccagcggtgggttgatgcgctcacggatgctcgtgtcacccatgaaatccagagcatctgggtctcatactggtcacagtgcgatgcgtccctcgggcagaagctggcgtcgcggctcaagattaagccgaacatgtaagatggacaaggaggagggaggcagtcgctcgcccgcctcagctggcgtcgatcgacggagccaaggaggggtgcagcatgaactgaatctgtcgttgtgtgcgtgtagccttgaataaaaatgtgcagcagcgaaatgaatatcaaaatgtaataccgatgatggtggggtgtcgtcagcgcgttgccgggttcgtctgtgatactttgtctgtgcaaaagagagaataataatagacaataatgtgattggttaaaaaaaaaaaaaaaaaaa

SEQ ID NO: 36627 - DNA, 609 bp, Triticum aestivum
  Clone ID: PAT_TA_36627
ctactcgccatcgtcgtgccgtttactcagacccggacgcagagcgcacgggacaaggctgccatggcggaagacgcggggccgctggtgggaggcatcaaggactcaccgatgggccaggagaacgacctcgacgtcatcgcgctcgcccgcttcgccgtctccgagcacaacaacaaggccaatgccctgctggagttcgagaatgtggtgaagctgaagaagcaaactgttgctggcacgatgcactacattacaattcgggtcactgaaggtggggccaagaagctctatgaagctaaggtgtgggagaaaccatgggagaactttaagcagctccaggagttcaagccggtggaggacgctgcaatcgcatgaggcgcgccccagctttgcaaggatctgcagctatggtgttgatgcacctatcaatcggacatggtttagcgtgttctcgtgtaatatcaagaaagctgctctcttgtgtaatatcaagaacaaatctgcttcttgcgagttctttttaagtccgcttcttgcaagttgttttaaccacgtctctaaataaaattctctgcagtattattgtaaaaaaaaaaaaaaaaaaaa

SEQ ID NO: 36628 - DNA, 365 bp, Triticum aestivum
  Clone ID: PAT_TA_36628
ctcgcccgcttcgccgtctccgagcacaagaacaagaccaacgctctgctggagtttgagaaagtggtgaggctgaagcagcaagttgttgcaggcatgacgtattatattacaattcaggtcaatgagggcggggcaaagaagatgtatgaagccaaggtgtgggagcggccatggatggatttcaagaagctcatggagttcaggccggcagagcgcgcctctgcgagcgcttaaggcgggtcggtcccagctgtgcaaggatatgcagatatggtgtggatatagctatcgtctgtgggacatgtctggaacctgcccattgtgtacatcttgccattcgagtttcagattttcagatggtt

SEQ ID NO: 36629 - DNA, 2475 bp, Triticum aestivum
  Clone ID: PAT_TA_36629
atggaggtcgtgaccggggcgatgagcacgctcctgcccttgcttggcgacctgcttaaggaggagtacaacctgcagaagagcaccaagggtgagatcaagttcctcaaagcagagctggagagcatggaggctgccctcatcaagatctcggaggcacccttggatcagccacctaacattcaggtcaagctctgggcgagggacgtcaaggacctgtcctatgagatcgaagatggcatcgacaaattccgggtgcaccttgagtgccggcaacaaaagaagccacacagctttatgggtttcatccacaaaagcatggacatgctgacaaagggcaagatccgacacaaaataggcatcgatatcaaagacatcaagagccgcatcaaggaggtcagtgacaggcgtgaaaggtacaaggttgatagcgttgcgcccaagcccaccggcacaagtactgatacacttcgccagttagccttgttcaaaaaggcggaagagcttattggcaccaaagaaaagagccttgacatagtcaagatgctgacggaaggagatgaggtcttcaagaaacatcttaagatggtctctattgttggctttggaggcttagggaagacaactcttgctaacgtggtatatgagaagcttcgcggggactttgattgtgcagcttttgtctctgtgtctcttaatcctgacatgaagaagcttttcaagtgtttgctccatcagcttgacaagggcgagtacaagaacatcatggacgagtcagcgtggagcgaaacacaactcataagtgagataagagatttccttcgagacaagaggtacttcattctcattgatgacatatgggataaatctgtgtggaataatattagatgtgctctgattgagaatgaatgtggtagtagagtaatcgcaacaactcgcattctagatgttgccaaagaagttggtggtgtttatcagcttaaacctctttctactagtgactcaggacaattattctatcaaagaatatttggaattggcgacaagcgtcctcctattcagttggctgaagtaagtgagaaaattttagggaaatgtggcggagtaccattagctatcattacactggctagtatgttggctggtaaaaaggaacatgaaaatacatatacttattggtacaaggtgtaccaatctatgggttctgggctagaaaataatcctggcctgatggacatgaggaggatactacatgtcagttactatgacctacctccaaatctgaagacttgtttactgtatctcagtttgtatccagaggattataatattgaaaccaaagagttgatatggaaatggataggcgaaggattcattcatgaagagcaagggaagagcttgtatgaagtaggagaggattacattgctgagctcattaacaaaagcttggtccaaccaatgtatatcaatattgctaataaggcgagctctgtccgtgtacacgacatggtgcttgaccttatcacttccttgtcaaatgaggagaactttctcgcaacattgggtggtcagcagaccaggtcactgccacgtaagatccgtcgactgtctctccaaagcagtaatgaagaggatgtccagccaatgccaaccatgagcagcttgtcccatgtgaggtcacttactgtgttcagtaaagacctcagtttgctgtcggcactttcaggttttcttgtcctgcgtgcattggatttaagtggttgtgaggaagtgggtaatcatcacatgaaggacatttgcaatttatttcacttgaggtatctgagtctagaagggacatctatcactgagatcccgaaagagataagcaatctacggcttctgcaattgctagtcataaggtccacaaaaatgaaaaaatttccatcaacctttgttcagctaggacaactggtgttcattgacatgggtaatagggaagtctctagattgcttctaaaatcaatgtccaccttgccctccctctcttcacttgcaatcggaataggagaactgagagaggaagacctccaaatacttgggagcatgccgtctctgcatgacctctctattgatgtaggttattgggaaagaggcagagataaaaggctagtcattgacagtggttctcccttccggtctctgacaaggttcagtataaagggttgcggcttcattgatttcatgtttgcacaaggaaccttgcaaaagctccagatcctggagttaagtatttttggtaaggcaataaaagacagatttggtgattttcaatttgggctggagaatctctcatcacttgagcatgtctatgtggacgctcgtggtcgtggtataatcccaagtcaagaagctgagctgagcggtgcacttgagaaagagcttgatattaatcccaacaagcccacactgacggtgaaggtaactccacgctga

SEQ ID NO: 36630 - DNA, 316 bp, Triticum aestivum
  Clone ID: PAT_TA_36630
actggctctcaaaataaaaatccttgatatgtagcacttgccaattttcatgaagtaaatacacccactatggccaatgtagtgtccaagctcctgacacaacttcactgaacacccagttgggaagggtctctagcacaccattagttgggagtcacagccactacctgattgacctcagtcactaccttaactcctgtctgcaagtagagaaatgcagcagggccatggctataagaactatgcccaactccagatatcgtccaagattacccaggtattttcttatgcaaaataattgtcctggagagccagt

SEQ ID NO: 36631 - DNA, 660 bp, Triticum aestivum
  Clone ID: PAT_TA_36631
gggagtccgctagacgatcaagctcggagacctattgacctagttcccaatgtcggacgcagatgattaccgttgcttcgttggcagcctgtcatggaacacaactgatgtggatctgaaggatgcttttgggaaatttggtcgagttactgagacaaaggtggttcttgacaagttctctggccgatcacgtggctttggatttgtgacttttgatgacaagaaggccatggaagaagctgttgaggctatgaatggaattgatttggatggaaggaatattactgttgaaagagcacaacctcaaggttcaggcaggaaccgtgatggagatcgagactatcgtggtggtggtgaccgctatggtggtggccgtgattttggtggcggtcgtggtggtggtcgtggtggtggcggtgattgctacaaatgtggcaagcctggtcattttgcaagggagtgcccatctggtgatggtggggacaggtatggtagcagggatgacaggtacagtagcagggatgacaggtacagtagcagggatgacaggtacagtagtagggatgacaggtattggtggcagggatggtgcaagggatgacaagtatggtggtagcaacggcagcagtcgctatggccctgcccgtggtggtgatcgct

SEQ ID NO: 36632 - DNA, 1750 bp, Triticum aestivum
  unsure (1)..(1750): unsure at all n locations
  Clone ID: PAT_TA_36632
tagttttgagtgcaactaggctagctcaagaaagatggaggtgcaggccggctctcatgccgacgccgcggcgagcaagttcacgctgccggtggactccgagcacaaggccaagtccttcaggctcttctccttcgccaacccccacatgcgcacctttcacctctcgtggatctccttcttcacctgcttcgtctccacctttgctgcggcgcccctcgtgcccatcatccgcgacaacctcaaccttgccaaggctgacatcggcaatgccggtgtcgcgtccgtgtctgggtccatcttctccaggctggccatgggcgctatctgtgacttgcttggcccacggtatggttgtgccttcctcgtcatgctctcggcaccgaccgtcttctgcatggccgtcatcgatgatgcctcagggtacatcgccgtccggttcctcattggcttctccctcgccaccttcgtgtcatgccaatactggatgagcaccatgttcaatagcaagatcattggcacggtcaatggcttggctgcaggctggggcaacatgggtggcggcgccacgcagctcatcatgccgcttgtcttccacgcaatccagaagtgtggcgccacgcccttcgtggcatggcgtattgcctacttcgtgccgggaatgatgcacatcgtgatgggcttgctggtcctcaccatggggcaagatctccctgacgggaaccttgcgagcctccaraagaagggagacatggccaaggacaagttctccaaggtcctttggggcgcygtcaccaactaccggacatggatcttcgtcctcctctacggctactgcatgggygtcgagctcaccacsgacaatgtcatcgccgagtactactacgaccacttccacctagacctccgcgcygcwggcaccattgcygcttgyttyggcatggcaaacatygtcgcgcgtcctatgggkggctacctctcygaccttggtgcccgctactttggcatgcgtgctcgcctttggaacatctggatcctmcaaacygccggtggcgctttctgcatctggctcggtcgtgcgtcagccctccctgcctcagtgactgccatggttctcttctccatctgcgcccaagccgcgtgtggtgctgtatttggcgtcgcacccttcgtttctagacgttcccttggcatcatctcngggctgaccggtgctggtggaaacgtgggtgcrgggctcacgcagcttctcttctttacttcatcacaatactccacyggaaggggtctcgagtacatgggcatcatgatcatggcatgcacgctgcctgtcgctcttgtgcacttcccacagtggggctcgatgttcttcccggccagcgccgacgccacagaggaggaatactatgcctctgagtggtcggaggaggagaagaacaagggtctccatattgctggccaaaagtttgccgagaactcacgatcggagcgtggaaggcgcaacgtcatccttgccacgtccgccacgccacccaacaatacgccccagcacgtataagaccggattgtttttcatatactatgtacaagtactgaacatcggctgtaataaggtgtacgcatttatatttccagtgtagacttgtgtaatgcgtttcttacgcacgaaatgttttggtgtgtgcatgcacgcatgcgaggtacctgtggtctgaatttacagcaactttgagactaaaaaaaaaaaaaa

SEQ ID NO: 36633 - DNA, 2726 bp, Triticum aestivum
  Clone ID: PAT_TA_36633
acgttgctcccccttctcatcgcttctcaattaatatctccatcactcggttccgcgctgcatttcggccggcgggttgagtgagatctgggccactgaccgactcactcgctcgctgcggggatggcgacgttcgcggtgtccggcgcgaccctcggtgtggcgcggccgccggcggcggcgcaacctgaagaattacagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccgatacagcgaatacaggagaattcgtgctgctattgaccaacatgaaggtggattggaagcattttctcgtggttatgaaaagcttggatttacccgcagtgctgaaggtatcacttaccgagaatgggctcctggagcgcattctgcagcattagtaggtgacttcaacaattggaatccgaatgcagatactatgaccagagatgattatggtgtttgggagattttcctccctaacaatgctgatggatccccagctattcctcatggctcacgtgtaaagatacggatggatactccatctggtgtgaaggattcaatttctgcttggatcaagttctctgtgcaggctccaggtgaaataccattcaatggcatatattatgatccacctgaagaggagaagtatgtcttccaacatcctcaacctaaacgaccagagtcactgaggatttatgaatcacacattggaatgagcagcccagaaccgaagataaattcatatgctaattttagggatgaggtgctgccaagaattaaaaggcttggatacaatgcagtgcagataatggcaatccaggagcattcatactatgcgagctttgggtaccatgttactaatttttttgcaccaagtagccgttttggaactccagaggacttaaaatccctgatcgatagagcacatgagcttggtttgcttgttcttatggatattgttcatagtcattcatcaaataatacccttgacggcttgaatggtttcgatggcactgatacacattacttccacggtggtccacgtggccatcattggatgtgggattctcgtctattcaactatgggagttgggaagtattgagattcttactgtcaaacgcgagatggtggcttgaagaatataagtttgatggatttcgatttgatggggtgacctccatgatgtatactcaccatggattacaaatgacatttactgggaactatggcgagtattttggatttgctactgatgttgatgcggtagtttacttgatgctggtcaacgatctaattcatggacttcatcctgatgctgtatccattggtgaagatgtcagtggaatgcccacattttgcatccctgttccagatggtggtgttggttttgactatcgcttgcatatggctgtagcagataaatggattgaactcctcaagcaaagtgacgaatcttggaaaatgggtgatattgtgcacaccctaacaaatagaaggtggcttgagaagtgtgtaacttatgcagaaagtcatgatcaagcactagttggtgacaagactattgcattctggttgatggataaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctgaatggatagattttccaagaggtccgcaaactcttccaaccggcaaagttctccctggaaataacaatagttatgataaatgccgccgtagatttgatcttggagatgcagattttcttagatatcatggtatgcaagagttcgatcaggcaatgcagcatcttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaggcctgggaagtacaaggtggccttagactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagctgcttgttacaaggcaaagagagaactccagagagctcgtggatcgtgagcgaagcgacgggcaacggcgcgaggctgctctaagcgccatgactgggaggggatcgtgcctcttccccagatgccaggaggagcagatggataggtagcttgttggtgagcgctcgaaagaaaatggacgggcctgggtgtttgtcgtgctgcactaccctcctcctatcttgcacattcccggttgtttttgtacatataactaataattgcccgtgcgctcaacgtgaacaa

SEQ ID NO: 36634 - DNA, 1957 bp, Triticum aestivum
  Clone ID: PAT_TA_36634
gatactctcttcccgtatcatctcaaagtttgcaagaagcaacccggtggtcacttgccaattagcttccaccggtacggtgccatggaggagtggctcctaagcttgtgtttcatagccctctccacggccacggtgctggccttttggtttctcaagctctctggtggcaaggccgacccccacaagaagcagctgcctcctgggccatggacgctcccggtcatcggcagcctccaccacgtcatcagcgccctcccgcatcgcacgatgatgcagctgtcttgccggcacgggccgctgatgctcctcaggctaggtgaagtccccgccgtggtggtgtccaccgccgacgccgcggcgctggtgatgaagacccacgacctcgtgttcgtggaccggccgcgcagcccgaccatggacatcgccagctccggcggcaaggacatcgtgttcgccccgtatggcggccactggcgtcagatgcgcaagatctgcgtcgtgcagctcctcagctccacgcaggtgagtcgcatggagggcgtcagggccgaggaggtgggcagcctcctccgcgacatcacggccgccgcctccaccggcgccaccatcaacgtcagcgagaaggtgatggcactcaccaacgacatcgtgacaagggcggttttcggcggcaagttcgcacggcagtgcgagttcctccgggagatggacaaggcgtttaagctcgtgggcggcttttgtctggccgacctcttcccgtcatcgaggttggtacggtggctgagcaatggcgagcgcgacatgaagagatgccatggcctcatccatcacatcattgccgaggtcgtcgaaaatcgcaaggccgcgcgagcttctggcgtgggtcgttccatcccaggcgatgaggacatgttggacgtgttgctcacgctccaggaggacgactctttggaatttcctctcaccacggagacaatgggggccgtcttgcatgacgtatttgcaggggctacggagaccacagggaacactttggcatgggtcatatcagagcttatgcacaaccctcacactatggctaaagcacagcatgaagtacgcgatgtgttgggtgaaggtcgatctgtcatcactaatagtgaccttggtgaactccactatatgccgatgatcctcaaggaggcccttaggttgcatccgccgggtcctctgattccccgcatggctagagaggattgtacagttatgggttatgatatccctaaaggtactaatgtttatattaatattttcgcaatttctagggatcctagatattggatcaatcctgaagagttcatgccagagagatttgaaaataacaatgtgaactacaaagggacatactttgagttcattcccttcggagctgggagacggcaatgcccggggattcagtttagctcatcaatcactgagatggcactagcaaaccttttgtatcacttcgattggatgctccctgatggtgctaaccttgcttcgtttgacatgtccgagaaatttgggtttgcggtaagcaaaaagtatgacctgaaattgagagctattccacatgtgtggtccaatgctatgacgttgaagtgacacgaggagcctgcatattcaggtagcaatgcatgtttacatacctgcactttcagcacgtgtcaatgatgtcactgttttggtgcatggttgtatctttatgcaagcaaacattatggtattgcatctacagactattacggtactatgctaccttttgtatattagttcaggtcagaagatattgcattctacttcatgatcatataggacacaattgtattattctactatcaattaactatgcgattttcctatataacttgctggatttcagtaggtacaattgatttgtgatcagaaaaaaaaaaaaaaaaaaaaaaaaaaa

SEQ ID NO: 36635 - DNA, 554 bp, Triticum aestivum
  Clone ID: PAT_TA_36635
aaatatccgtatatcgcggggatgggagtctatgtcttcaaaagagatgttctgctcaaccttctaaagtcaagatacgcagaactacatgactttgggtctgaaatcctcccgagagctctgcatgaccacaatgtacaggcttatgtcttcactgactactgggaggacattggaacaatcagatccttcttcgatgcgaacatggccctctgcgagcagcccccaaagttcgagttttatgatcccaaaactcccttcttcacctcgcctcgatacttgccaccaacaaagtcagacaagtgcaggatcaaagaagcgatcatttcgcacggctgcttcttgcgtgaatgcaaaatcgagcactccatcatcggcgttcgttcacgcctaaactccggaagcgaactcaagaacgcgatgatgatgggtgcggattcgtacgagaccgaggatgagatctcgaggctgatgtccgagggcaaggtccccatcggcgtcggggagaacacaaagatcagcaactgcatcatcgataaaaatcgcagcatcgg

SEQ ID NO: 36636 - DNA, 2997 bp, Triticum aestivum
  Clone ID: PAT_TA_36636
ggtcggggccggcgccgcgcctgcgacggtggcgacccaatgcgacggcggggaagggggtcggcgaggtgtgcgccgcggttgtcgaggcggcgacgaaggtagaggacgagggggaggaggacgagccggtggcggaggacaggtacgcgctcggcggcgcgtgcagggtgctcgccggaatgcccgcgccgctgggcgccaccgcgctcgccggcggggtcaatttcgccgtctattccggcggagccaccgccgcggcgctctgcctcttcacgccagaagatctcaaggcggtggggttgcctcccgagtagagttcatcagctttgcgtgcgccgcgcgccccttttttgggcctgcaatttaagttttgtactggggcaaatgctgcaggatagggtgaccgaggaggttccccttgaccccctgatgaatcggaccgggaacgtgtggcatgtcttcatcgaaggcgagctgcacaacatgctttacgggtacaggttcgacggcacctttgctcctcactgcgggcactaccttgatgtttccaatgtcgtggtggatccttatgctaaggcagtgataagccgaggggagtatggtgttccagcgcgtggtaacaattgctggcctcagatggctggcatgatccctcttccatatagcacgtttgattgggaaggcgacctacctctaagatatcctcaaaaggacctggtaatatatgagatgcacttgcgtggattcacgaagcatgattcaagcaatgtagaacatccgggtactttcattggagctgtgtcgaagcttgactatttgaaggagcttggagttaattgtattgaattaatgccctgccatgagttcaacgagctggagtactcaacctcttcttccaagatgaacttttggggatattctaccataaacttcttttcaccaatgacaagatacacatcaggcgggataaaaaactgtgggcgtgatgccataaatgagttcaaaacttttgtaagagaggctcacaaacggggaattgaggtgatcctggatgttgtcttcaaccatacagctgagggtaatgagaatggtccaatattatcatttaagggggtcgataatactacatactatatgcttgcacccaagggagagttttataactattctggctgtgggaataccttcaactgtaatcatcctgtggttcgtcaattcattgtagattgtttaagatactgggtgacggaaatgcatgttgatggttttcgttttgatcttgcatccataatgaccagaggttccagtctgtgggatccagttaacgtgtatggagctccaatagaaggtgacatgatcacaacagggacacctcttgttactccaccacttattgacatgatcagcaatgacccaattcttggaggcgtcaagctcattgctgaagcatgggatgcaggaggcctctatcaagtaggtcaattccctcactggaatgtttggtctgagtggaatgggaagtaccgggacattgtgcgtcaattcattaaaggcactgatggatttgctggtggttttgccgaatgtctttgtggaagtccacacctataccaggtaagttgtggcaatacttgtaaatgagttgagtgaatgtcacctggattttttatatataccacatgatgatacacatctaaatatataacaatcatagtgtatgcatatgcatttggctaagaagtattagtgtatacactagtgctatatataggttttaacacccaacttgccaatgaaggaacatagggctttctagttatcttatttatttgtccggtgaataatccactgaaaaattccagccatgtcattttttagggggggagaagaaactatattgatttgcccccctaaaagaagccatctcagaattcataggtaagttgcttttctgtaaagaaaggaaaacgacttcatactttctatcggtgctaacttagctcgatgtatatttgtaagatgaatgccaaatttaatttgtcggataatttgatctgttattcacaaatttctatttggtttctctagaaatcaaaccagtaacttgttattggcactgcaacttcttattgattaatcaggcaggaggaaggaaaccttggcacagtatcaactttgtatgtgcacatgatggatttacactggctgatttggtaacatataataagaagtacaatttaccaaatggggagaacaacagagatggagaaaatcacaatcttagctggaattgtggggaggaaggagaattcgcaagattgtctgtcaaaagattgaggaagaggcagatgcgcaatttctttgtttgtctcatggtttctcaaggagttccaatgttctacatgggtgatgaatatggccacacaaaagggggcaacaacaatacatactgccatgattcttatgtcaattattttcgctgggataaaaaagaacaatactctgagttgcaccgattctgctgcctcatgaccaaattccgcaaggagtgcgagggtcttggccttgaggactttccaacggccaaacggctgcagtggcatggtcatcagcctgggaagcctgattggtctgagaatagccgattcgttgccttttccatgaaagatgaaagacagggcgagatctatgtggccttcaacaccagccacttaccggccgttgttgagctcccagagcgcgcagggcgccggtgggaaccggtggtggacacaggcaagccagcaccatacgacttcctcaccgacgacttacctgatcgcgctctcaccatacaccagttctcgcatttcctctactccaacctctaccccatgctcagctactcatcggtcatcctagtattgcgccctgatgtttgagagaccaatatatacagtaaataatatgtctatatgtaaaaaaaaaaaaaaaaaaaaaaaaaaaaaaaaaaaa

SEQ ID NO: 36637 - DNA, 1819 bp, Triticum aestivum
  Clone ID: PAT_TA_36637
ggccgcgggaattcgattgtgcatctgcgtgtgcgtacgtacgttttcgttttcctttcttgctccggccggccggccggccacgtagaatagatacctgcccaggtacgtacctcgttggctcagacgatcggcggttggacttgggtgcgcgccctgccctgctccggccaaggaaagaggttgcgctaaagacgggcggatggcaaaggacgacgggtaccccccggcgcggacgctgccggagacgccgtcctgggcggtggcgctggtcttcgccgtcatgatcatcgtctccgtcctcctggagcacgcgctccacaagctcggccattggttccacaagcggcacaagaacgcgctggcggaggcgctggagaagatgaaggcggagctgatgctggtgggattcatctcgctgctgctcgccgtcacgcaggacccaatctccgggatatgcatctcccagaaggccgccagcatcatgcgcccctgcaaggtggaacccggttccgtcaagagcaagtacaaggactactactgcgccaaagagggcaaggtggcgctcatgtccacgggcagcctgcaccagctccacatattcatcttcgtgctagccgtcttccatgtcacctacagcgtcatcatcatggctctaagccgtctcaagatgagaacatggaagaaatgggagacagagaccgcctccttggaataccagttcgcaaatgatcctgcgcggttccgcttcacgcaccagacgtcgttcgtgaagcggcacctgggcctgtccagcacccccggcgtcagatgggtggtggccttcttcaggcagttcttcaggtcggtcaccaaggtggactacctcatcttgagggcaggcttcatcaacgcgcacttgtcgcagaacagcaagttcgacttccacaagtacatcaagaggtccatggaggacgacttcaaagtcgtcgttggcatcagcctcccgctgtgggctgtggcgatcctcaccctcttccttgatatcgacgggatcggcacactcacctgggtttctttcatccctctcatcatcctcttgtgtgttggaaccaagctagagatgatcatcatggagatggccctggagatccaggaccggtcgagcgtcatcaagggggcacccgtggtcgagcccagcaacaagttcttctggttccaccgccccgactgggtcctcttcttcatacacctgacgctgttccagaacgcgtttcagatggcacatttcgtgtggacagtggccacgcccggcttgaaggactgcttccatatgaacatcgggctgagcatcatgaaggtcgtgctggggctggctctccagttcctgtgcagctacatcaccttccccctctacgcgctagtcacacagatgggatcaaacatgaagaggtccatctttgacgagcagacagccaaggcgctgaccaactggcggaacacggccaaggagaagaagaaggtccgagacacggacatgctgatggcgcagatgatcggcgacgcaacacccagccgaggcacgtccccgatgcctagccggggctcatcgccggtgcacctgcttcagaagggcatgggacggtctgacgatccccagagcgcaccgacctcgccaaggaccatggaggaggctagggacatgtacccggttgtggtggcgcatcctgtacacagactaaatcctgctgacaggcggaggtcggtctcttcatcagccctcgatgccgacatccccagcgcagatttttccttcagccagggatgagacaagtttctg

SEQ ID NO: 36638 - DNA, 430 bp, Triticum aestivum
  Clone ID: PAT_TA_36638
atggagaggatgggcgtgggcaagagcggcaagccgctgcactacaaggggagcgcgttccaccgcgtgatccccgacttcatgtgccagggcggcgacttcaccaggggcaacgggacgggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtcgtcttcggcgaggtcgtcgagggcatggacgtcgtcaagaacatcgagaaggtgggctcccgcagcggcaccaccgccaagcaggtcgtcatcgccgactgcggccagctctagatccgttcgcctgccgcccgtcctccccgtgccc

SEQ ID NO: 36639 - DNA, 601 bp, Triticum aestivum
  Clone ID: PAT_TA_36639
tgagttttgtcatcgaagggtgtttacataagcccaaaaattctaccagcttttggtacggtgcgtcatagcacgcataaatgttgcgagccattggatagatattgtgagtcatagcatgcatttgtgttgcctaaaaattcaactacatgaaaagaaacaaaacataaatgtgattttgaaagatgatttatcaactttccttatccatgcaagctaccttccactgcataaccacttcttttagataaaaatagcagatcgatatacaaacgtctacacttctgtaaacagtacccaaaagccagaattaggattgaactgattacgtggctttagcagaccgtccaaaaatctgttttgcaaagctccaattgctccttgcttatccagcttcttttgtgttggcaaattgctcttttacaactgactttattcttcttgtgtttcttaggctgaactaacatcaccgtacacacaaccattgtcatgaaccttcaccacgtccctataaaagcccaaccaatccccacaatctcatcatcacccacaacaccgagcaccacaaaatagagatcaattcactgacagtccaccgaga

SEQ ID NO: 36640 - DNA, 1744 bp, Triticum aestivum
  Clone ID: PAT_TA_36640
gcagtataatcaagcaagctagctgcaagccgaggagcctagctcgatcaagcaaggtcgaaatggaggtggagtctagcgcccatggcgacgccgcggcgagcaagttcacgctgcctgtggactccgagcacaaggccaagtccttcaggctcttctccttcgccaacccccacatgcgcaccttccacctctcctggatatccttcttcacctgctttgtctccaccttcgccgccgcgccgttggtgcccatcatccgtgacaacctcaacctcgccaaggccgacatagggaatgccggtgtggcatctgtgtcagggtccatcttctccaggcttgccatgggcgccgtctgcgaccttttggggccgcggtatggctgtgccttcctcgtcatgctctcagcgccaacggtcttctgcatggccgtcatcgatgacgcctcggggtacatcgctgtacgcttcctcattggcttctccctcgccgcctttgtgtcctgccaatactggatgagcaccatgttcaacagtaagatcattggcacggtgaatggcctcgcggccggctggggcaacatggggggcggtgccacacaactcattatgccacttgttttccatgccatccaaaagtgcggtgccacacccttcgtggcatggcgtatcgcctacttcgtgccgggaatgatgcacatcgtcatggggttgcttgtcctcacaatgggccaagatctccccgacggcaaccttgcgagcctccagaagaagggagacatggccaaggacaagttctccaaggtcctttggggcgccgtcaccaactaccggacatggatcttcgtcctcctctacggctactgcatgggtgtcgagctcaccactgacaacgtcatcgccgagtactactacgaccatttccacctacaccttcgcgctgcaggcaccatcgccgcctgctttggcatggccaatatcgtcgcacgtcctatgggaggttacctctctgaccttggcgctcgctactttggtatgcgtgctcgcctatggaacatctggatcctccagaccgccggcggcgctttctgcatctggctcggtcgtgcatcggccctccccgcctcagtgactgccatggttctcttctccatctgcgcccaagctgcatgtggcgctgtctttggtgttgcaccattcgtttccaggcgttcccttggcatcatctctgggttaaccggcgctggtggcaatgtgggcgcggggctcacacaacttctcttcttcacttcgtcgcaatactccaccgggaggggtctcgagtacatgggcatcatgatcatggcatgcacattacctatcactctggtgcacttcccacaatggggctccatgttcttcccggccagtgctgatgctacggaggaggagtactacgcttccgagtggtcagaggaggagaagggcaagggtctccatatcgcaggccagaagtttgcagagaactcccgctcggagcgtggtaggcgcaatgttatcctcgccacatccgccacgccgcccaacaatacaccccagcatgtataaggcccttgttttctgtcacctatgaattgtacggttcgtcacgtacatatacaaaccgtatatctacgtcggcagccccagcgtaataagttgtatggggatttatctttctactagtaaacttaaggaaacgctggttttgcgttcctgctctgtac

SEQ ID NO: 36641 - DNA, 465 bp, Triticum aestivum
  Clone ID: PAT_TA_36641
cagcagcactagctagtagatttcccgagtgacaggttgagcgcaagatggagcaccagggacacggcaccggcgagaagaaaggcatcatggagaacatcaaggagaagctccccggtggccaccagcagaccgctggcacccacgggcagcagggacacactggaatgaccggcacggagatgcatgacaccacggccaccggcggcacctttgggcagcagggacacaccggaacgactggcactgggacacacggcacagccgggaccggcgagaagaagagcctcatggacaaggtcaaggagaagctgcctggacagcactaagcccggtgtgcccacgaccgctaccttcgcagaataatactccaccgtatatgaattgatcgagtctagttcacctagctcacttggtcattggaggagcgaatgtatctttgctttaagttttcacggaaatgtg

SEQ ID NO: 36642 - DNA, 621 bp, Triticum aestivum
  unsure (1)..(621): unsure at all n locations
  Clone ID: PAT_TA_36642
tcagcagcatgcattctgccagtttgtaaccggcgcttcttgggcttcccaactggtggtttggctgcccttagtcccaagcttaccatagttcgaaagcacccttcgagtggggtgagtagtttgaatacaagcggggtaacagacgccgcggacgacgatttgcccagtgtcatgacatgcgccaattatctcaagctacccccatattccacaaaggaagtcatgcgcaagaagctgctntacgccatcctagaaggccgtggatcttttgatctatcctgagctgataactaacgatacagggctcaccattggacgcccgtcaattttatcccgaattagttttcttcttggttgcctgtaataacatcataggttgaggttaccagccgctccgcataaagcttgaaagttgaacttgctgaagcggcgagcctcgtgagcaccaccaccaccgacaagtatcaggagcacctttccctccagtacatgtaaataaaaaggagtatacatatttgtcctatgtatcgatttgagaatgttgctgtgtttgctttgacattgtgtacatgtgtaactcgataataaatccgcgcgctctagtgtatttgagctcgt

SEQ ID NO: 36643 - DNA, 1517 bp, Triticum aestivum
  Clone ID: PAT_TA_36643
ctcccacgaagaaccaacaggaggcgcggatcccaccgataaataaccccgcctcgccgctcctccccaaaatcaatcaccgatcgctcggggttcccggcatgacaatgatggccatgcccgaggcgccctgcctctgcgcgcgcccgtccctcgccgcgcgcgcgaggcggccggggtcggggccggcgccgcgcctgcgacggtggcgacccaatgcgacggcggggaagggggtcggcgaggtgtgcgccgcggttgtcgaggcggcgacgaaggtagaggacgagggggaggaggacgagccggtggcggaggacaggtacgcgctcggcggcgcgtgcagggtgctcgccggaatgcccgcgccgctgggcgccaccgcgctcgccggcggggtcaatttcgccgtctattccggcggagccaccgccgcggcgctctgcctcttcacgccagaagatctcaaggcggatagggtgaccgaggaggttccccttgaccccctgatgaatcggaccgggaacgtgtggcatgtcttcatcgaaggcgagctgcacaacatgctttacgggtacaggttcgacggcacctttgctcctcactgcgggcactaccttgatgtttccaatgtcgtggtggatccttatgctaaggcagtgataagccgaggggagtatggtgttccagcgcgtggtaacaattgctggcctcagatggctggcatgatccctcttccatatagcacgtttgattgggaaggcgacctacctctaagatatcctcaaaaggacctggtaatatatgagatgcacttgcgtggattcacgaagcatgattcaagcaatgtagaacatccgggtactttcattggagctgtgtcgaagcttgactatttgaaggagcttggagttaattgtattgaattaatgccctgccatgagttcaacgagctggagtactcaacctcttcttccaagatgaacttttggggatattctaccataaacttcttttcaccaatgacaagatacacatcaggcgggataaaaaactgtgggcgtgatgccataaatgagttcaaaacttttgtaagagaggctcacaaacggggaattgaggtgatcctggatgttgtcttcaaccatacagctgagggtaatgagaatggtccaatattatcatttaggggggtcgataatactacatactatatgcttgcacccaagggagagttttataactattctggctgtgggaataccttcaactgtaatcatcctgtggttcgtcaattcattgtagattgtttaagatactgggtgacggaaatgcatgttgatggttttcgttttgatcttgcatccataatgaccagaggttccagtctgtgggatccagttaacgtgtatggagctccatgagagaccaatatatacagtaaataatatgtctatatgtagtcctttggcgtattatcagtgtgcacaattgctctaaaaaaaaaaaaaaaaaaa

SEQ ID NO: 36644 - DNA, 1361 bp, Triticum aestivum
  Clone ID: PAT_TA_36644
caaattccaaaaccctcgcctggttcgctggttttcactcgaaggacgacaatgatggcggcgcagccgacggctaacccgggggtccgcctcggctggaaggcccccggcgctctagcatccccgccgcgcctggctctgtctcgctccgccgcggccccgctcgcgtcacacagggttggcagaggaaagttttcagctgcggccatcactactgatgattatcttccaatgcgaagtactgaagtgaaaaatcggacatcagtagatggaatcaaaagtctcagactaatcacagcggtcaaaaccccctatttgccagatggaagatttgatcttgaagcatatgattctttgataaacacgcaaataaacgggggcgccgaaggtgtaattgttggtggaacaacaggagaaggtcatcttatgagctgggatgaacacatcatgctcatcgggcacactgttaactgctttggaactaacattaaagtgataggcaacacgggaagtaactcaactagagaagcgattcacgcttcagagcagggatttgctgttggcatgcatgcagctctccatgtcaatccttactatgggaagacctcaactgcaggactgatctctcatttcgacgaagtcctcccgatgggtccaacaatcatttacaatgtgccatccaggactggtcaggacatacctcctgcagtcattgaggcactctcaacttatccaaacatggcaggagtgaaagaatgtgttggacatgaacgagtgaagtgctacacagacaaaggtataacaatatggagtggcaatgatgacgaatgccatgattcaaggtggaagtatggtgctactggagtcatttctgtgactagcaaccttgttcctggtctcatgcgcagtctcatgtttgaaggggagaatgcggccctaaatgagaagctactgcctctgatgaaatggttattttctgagcctaatccgattggtctcaacactgccctggctcagctcggtgtagtgaggcctgttttcaggagaccgtatgcccctctctctcttgaaaagaggaccgagtttgtccggattgttgaagcaatcgggcgggagaactttgtgggacagaaagaggtgcgggttctggatgatgatgattttgtgttgatcagtaggtattaaataagtgagttcattgtgcgctatgtacgttacgaacagcggcggttctccttttagacatttcatcagttgttcaacagccatatgttttatcttttctgtgattggaagttaacttggaaccctgtggggtttctttgcaccctataatgccagttctagtgagaaatgaggat

SEQ ID NO: 36645 - DNA, 818 bp, Triticum aestivum
  Clone ID: PAT_TA_36645
caacaaccaccgttttcgcaacaacaacaaccagtactaccgcaacaaccaccattttcgcaacaacaacaaccaattctaccacaacaaccaccattttcgcaacaacaacaacaaccagttctaccacaacaacaaatactatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgctgcaaatcccccagcaatcccgctatgaggcaatccgtgctatcatctactccatcatcctgcaagaacaacaacaggttcagggttccatccaaactcagcagcagcaaccccaagagttgggccaatgtgtttcccaaccccaacagcagcagtcgcagcagcaactcgggcaacaacctcaacaacaacaattggcacagggtacctttttgcagccacagcaggtagctcagcttgaggtgatgacttccattgcgctccgtaccctaccaacgatgtgccgtgtcaatgtgccgttgtctagaaccaccactagtgtgccattcggcgttggcgccggagttggtgcctactgataaggtttggtctctagtaatatatagttggatcaccgttgtttagtcgatggatatgtcgatgcagcggtgacaaataaagtgtcacacaacgtcgtgtgtgacccgcccaaactagttgtttaaattctgaaataaaatacaaataaagttgtatc

SEQ ID NO: 36646 - DNA, 950 bp, Triticum aestivum
  Clone ID: PAT_TA_36646
agagcgcatcatttaagccaagcaagctgtggtcaatacaaatccaccatgaaaacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgaggaaataaggaacctagccctacagacgctacctgcaatgtgcaatgtctacatccctccatattgcaccatcgcgccatttggcatcttcggtactaactgagaagaaaataactctagt

SEQ ID NO: 36647 - DNA, 802 bp, Triticum aestivum
  Clone ID: PAT_TA_36647
aattattcctccgccccgcccgccgcgaaaaccctagccgccgccgatcccatggccaccgctccagccaggcgagcctcctcctccagaagcagctccgagatctcgcgaacgaccccgtcgatgggttttcagctgggcttcgtcgacgacagcaacgtcttcgagtggcaggtcaccatcatcggcccgcccgagaccctatatgatggaggctatttcaatgcaattatgagcttcccacaaaattatccgaacagccctccaacagtcagattcacttctgaaatgtggcatcctaatgtttatccagatgggcgggtatgcatttctattcatccacctggtgatgatccaaacggatatgagctcgcaagtgagcgttggacaccagtccatacggttgagagtatagtattaagcatcatttcgatgctttctagtccaaatgatgaatcaccggcaaatattgaagcagctaaggactggagagagaagcaggatgagttcaagaagaaggtcaggcgcgccgtacggaaatcccaggaaatgctctgaataaaatgggagtactggggaagttagccatgccatttcaggtgtggagggttttgctgttgatctccaaatgtccatccgacactagcaatttcacttctcccctgtatattttccattagcctgtctcctgtggaggtcttggttttgactctgaaaacgcaacacatattctaagggtttggttgttgtaattgtgtggcttcggctatcaatattgagaaacttgggagagctgctactt

SEQ ID NO: 36648 - DNA, 621 bp, Triticum aestivum
  Clone ID: PAT_TA_36648
ggatgaggaggagatgcaacttgtcaacgacaaataaactatcaatggcatccaaccatcgtcgcttcctcctctccggcgccgtcttgctctcagtcctcgccgccgtggccgccctggagagcgttgaggacgagtgccagccaggggtggccttcccgcacaacgcattagccacctgccacacctacgtgatcaaacgggtctgcggccgcggtcccagccggcccatgctggtgaaggagcggtgttgccgggagctggcggtcgtcccggattactgccggtgcgaggcactgcgcgtcctcatggatggggtgcgcgcggaggagggccacgtggtggagggccgccttggtgacagacgtgactgcccgagggaggcgcagcgggagttcgccgccacgctggtcacggcggcggagtgcaacctgccgaccgtctcgggagtcgggagtacacttggtgcgaccggcagatggatgacgatcgaattgcccaagtaatgaagcgatcaagcgaagtactctactggcagatggagtactgcatgtagaataaaagtactcaagtgaaaacaaataaataaagcttgtgagctgtatgcgtatgaaaaaaaaa

SEQ ID NO: 36649 - DNA, 527 bp, Triticum aestivum
  Clone ID: PAT_TA_36649
ataaagattctgaatcgtcggaagattaagaatatggaaatggaagagaaagtgagaagagaaatcaaaatcttgagattattcatgcatccccatatcatcagactttatgaagttattgaaactccgtcggacatatatgttgtgatggagtatgtcaagtcaggagaactatttgactacattgtagaaaagggtaggttacaagaggatgaagcgcgtaattttttccaacagataatatcaggagtagagtattgtcacaggaatatggttgttcatagagacttgaagcctgaaaatcttctattagattcgcatcacaatgtgaagatagcggattttggtttgagcaacataatgcgagatggtcatttcctcaagaccagttgtggaagccctaattatgcagccccagaggtaatttctgggaaactctatgctggtcctgaggttgatgtttggagttgtggcgttatcttatatgctcttctttgtggtaccctcccattcgacgacgaaaacat

SEQ ID NO: 36650 - DNA, 105 bp, Triticum aestivum
  Clone ID: PAT_TA_36650
gactgcgtaccaattcgtgggagtatatgttcagtactatcatggtcactactgccatggtgtctattgcaaattgattgcaagcactgttactcaggactcatc

SEQ ID NO: 36651 - DNA, 800 bp, Triticum aestivum
  Clone ID: PAT_TA_36651
ggccgcgggaattcgattactggaccacgcccggcagcatctcgcgatcccaaagtccaaccagcctccgccgcctctcctcgcctgcgaggtcagcgccgccttctcccctgtctgtttcgtcggagaagaaaaatgtcaactgccactgctccaggagtgtcctttgctaaatccggggctggttcccgggccgttgctccggcgatcaggagcgcttccttcatcggttacgccaagcaaccaccaaacttgtcttgcctaaggatgtcaaacaagttcagggtgtctgctgcggccgtgcacaaggtgaagctcataagcccggacggtgaagagcatgagtttgaggcccctgaagacacctacattcttgaggcagctgaaaatgccggagtggagctgccattctcctgccgcgccggatcgtgctccacatgcgcgggcaagatgactaccggggaggtcgatcagtcggagggctccttccttgatgagaaccagatgggcgaggggtaccttctgacctgcatctcataccccaaggcagattgcgtcattcaaacccaccaagaggaggaactctactaattgttgaagtttcgtggtggattcattgttcggttgccttctgttatctagagatatggctaggtgggcgtatcttcctagaaatcacttcagtcttttgatgggatcgtgatatatgagttgtgacaataattgatgtaaaatggtttgtcagttcaaactgcatttgtccagattgcagcaaaaaaaaaaaaaaaaaaaaaaaaaaa

SEQ ID NO: 36652 - DNA, 1136 bp, Triticum aestivum
  Clone ID: PAT_TA_36652
gcgagcctacgaccacgagtttcgcgagcagagcggcagcccaccaagcaggctcgtcaccttcggcgatgagctcccgcgtcgccggatccgtcctcctccgccacctgggcccgcgcgtcttcgggccgaccactccggccgcgcagaggcccctgcttgccggaggggaagggggcgccgtggccgtggcaatgtgggcgcggccgctgtccacctccgccgccgaggcggcgagggaggaggcgaccgcgtccaaggacaacgtggcgagcaccgccgccgcgacggccgaggcgatgcaggccgccaaggccggcgctgtgcaggccgcgaaggagggcaagagccccgcggcgagcagctactggggcatcgtgcctgccaagctggtgaacaaggacggcgccgagtggaagtggtcttgcttcaggccgtgggaggcgtacacgtcggacacgaccatcgatctctccaagcaccacaagcccaaggtgctgctcgacaagatcgcctactggaccgtcaagtcgctgcgcgtgcccaccgacatcttcttccagcggaggtacgggtgccgggcgatgatgctggagacggtggcggcggtgccggggatggtggacgggatgctgctgcacctgcggtcgctgcggcggttcgagcagagcggcgggtggatccgggcgctgctggaggaggcggagaacgagcggatgcacctgatgaccttcatggaggtggccaaccccaagtggtacgagcgcgcgctggtgctggcggtgcagggcgtcttcttcaacgcctacttcctggggtacatcgtgtcccccaagttcgcgcaccgcgtcgtgggctacctggaggaggaggccatccactcctacaccgagttcctccgcgacctggaggccggcaggatcgagaacgtccccgccccgcgcatcgccatcgactactggcgcctccccgccgacgccaggctcaaggacgtcgtcaccgtcgtgcgcgccgacgaggcgcaccaccgcgatgtcaaccacttcgccgcggacatccatttccaggggctggagctcaacaagacgcctgccccgctaggatatcactgacggatgaatgcccagaccgcctag

SEQ ID NO: 36653 - DNA, 2021 bp, Triticum aestivum
  Clone ID: PAT_TA_36653
cccttcttccccggcgttgatccgatcgacgtcctccctcctccccggcgttgatccgacgcgccgtagagttgataggcgaacgaacggggcggtgatcgtccgggcggcccccctgcgacgatggcgcgcggcggcggcaacggcgaggtggagctctcggtgggggtcggcggaggcggcgccggcgccggcggggcggacgcccccgccgtggacatcagcctcggcaggctcatcctcgccggcatggtcgccggcggcgtgcagtacggatgggcgctccagctctccctgctcaccccctacgtccagactctgggactttcgcatgctctgacttcattcatgtggctctgcggccctattgctggattagtggttcaaccatgcgttgggctctacagtgacaagtgcacttctagatggggaagacgcagaccgtttattctgacaggatatatcctcatctgcattgctgtcgtagtcgtcggcttctcggctgacattggagctgctctgggtgacagcaaggaagagtgcagtctctatcatgggcctcgttggcacgctgcaattgtgtatgttcttggattctggctccttgacttctccaacaacactgtgcaaggtccagcgcgtgctctgatggctgatttatcagctcaacatggacccagtgcagcaaattcaatcttctgttcttggatggcactaggaaatatccttggatactcctctggttccacaaataactggcacaagtggtttccgttcctccggacaagggcttgctgtgaagcctgcgcaaatctgaaaggcgcatttctggtggcagtgctgttcctggccttctgtttggtgataactgtgatcttcgccaaggagataccgtacaaggcgatcgcgcccctcccaacaaaggccaatggccaggttgaagtcgagcccactgggccgctcgccgtgttcaaaggcttcaagaacttgcctcctggaatgccatcagtgctcctcgtcactggcctcacctggctgtcctggttccccttcatcctctacgacaccgactggatgggtcgtgagatctaccacggtgaccccaagggaacccccgacgaggccaacgcgttccaggcaggtgtcagggccggggcgttcggcctgctactcaactcggtcgtcctggggttcagctccttcctgatcgagccgctgtgcaagaggctaggcccgcgggtggtgtgggtgtcgagcaacttcctcgtctgcctctccatggcggccatttgcatcataagctggtgggctactcaggacatgcatgggtacatccagcacgccatcaccgccagcaaggagatcaagatcgtctccctcgccctcttcgccttcctcggagtccctctcgccattctgtacagtgtccctttcgcggtgacggcgcagctggcggcgaacagaggcggtggccaagggctgtgcacgggcgtgctgaacatcgccatcgtgataccccaggtgatcatcgcggtgggggcggggccgtgggacgagctgttcggcaagggcaacatcccggcgttcggcatggcgtccgccttcgcgctcatcggcggcatcgtcggcatattcctgctgcccaagatctccaggcgccagttccgggccgtcagcggcggcggtcactgaccgcgccgcgcgtcggtcggcctgagcatggccaaggccggaggtcccagcccagcccgccatttaccaaattttcgcataggcgtaactaggtggctctcgcctaaggactccgtagagcagaataagaattgtgaggaaccgtatgtgttgtgtctgtatgtgcgtgtaagtcagtgcgtgtagcagaaaatggacagaggaatgcgggcatccatcaccggctggggtgtcgtctttgggttgtgacttgtgtgtagcaaaccaaggtgatcaagtgaggggaaaagaatggatgatgaactttcagcgacaaaaaaaaaaaaaaa

SEQ ID NO: 36654 - DNA, 2106 bp, Triticum aestivum
  Clone ID: PAT_TA_36654
ctcactccacgctccttccctcacaccacaccacacctctctctctctcactcgcactttccgctctcgtctcctcctcttcctcctcccgtcagacccttcttccccggcgttgatccgatcaacgtcctcctccgtcctgcccctagatccttggccgggcagggatacgccgtagaattgataggcgaacggacgaggtggtgatcgccagggcggcctctctgccatggcgcgcggcggaggcaacggcgaggtggagctctcggtcggggtcggcggcggaggcggcggcgccgccggcgggggggagcaacccgccgtggacatcagcctcggcagactcatcctcgccggcatggtcgccggcggcgtgcagtacggatgggcgctccagctctccctgctcaccccctacgtccagactctgggactttcgcatgctctgacttcattcatgtggctctgcggccctattgctggattagtggttcaaccatgcgttgggctctacagtgacaagtgcacatctagatggggaagacgcagaccgtttattctgacaggatgcatcctcatctgcattgctgttgtggtcgtcggcttctcggctgacattggagctgctctgggtgacagcaaggaagagtgcagtctctatcatgggcctcgttggcacgctgcaattgtgtatgttcttggattctggctccttgacttctccaacaacactgtgcaaggtccagcgcgtgctctgatggctgatttatcagctcagcatggacccagtgcagcaaattcaatcttctgttcttggatggcgctaggaaatatccttggatactcctctggttccacaaacaactggcacaagtggtttccgttcctccggacaagggcttgctgtgaagcctgcgcaaatctgaaaggcgcatttctggtggcagtgctgttcctggccttctgtttggtgataactgtgatcttcgccaaggagataccgtacaaggcgattgcgcccctcccaacaaaggccaatggccaggttgaagtcgagcccaccgggccgctcgccgtgttcaaaggcttcaagaacttgcctcctggaatgccgtcggtgctcctcgtcactggcctcacctggctgtcctggttccccttcatcctgtacgacaccgactggatgggtcgtgagatctaccacggtgaccccaagggaacccccgacgaggccaacgcgttccaggcaggtgtcagggccggggcgttcggcctgctactcaactcggtcgtcctggggttcagctcgttcctgatcgagccgctgtgcaagaggctaggcccgcgggtggtgtgggtgtcgagcaacttcctcgtctgcctctccatggccgcgatttgcatcataagctggtgggctactcaggacttgcatgggtatatccagcacgccatcaccgccagcaaggagatcaagatcgtctccctcgccctcttcgccttcctcggaatccctctcgccattctgtacagtgtccctttcgcggtgacggcgcagctggcggcgaagagaggcggtggccaagggctgtgcacgggcgtgctcaacatcgccatcgtgataccccaggtgatcatcgcggtgggggcggggccgtgggacgagctgttcggcaagggcaacatcccggcgttcggcatggcctccgccttcgcgctcatcggcggcatcgtcggcatattcctgctgcccaagatctccaggcgccagttccgggccgtcagcggcggcggtcactgagcatggccaaggccggaggtcccagcccagcccgccatttaccaaattttcgcataggcgtaactaggtggctctcgcctaaggactccgtagagcagaataagaattgtgaggaacctgtatgtgttgtgtctgtatgtgcgtgtaagtcagtgcgtgtagcggaaaatggacagaggaatgtgggcatccatcaccggctggggtgtcgtctttgggttgtgacttgtgtgtagcaaaccaaggtgatcaagtgaggggaaatgaatggatgatgaactttcagcgaaaaaaaaaaaaaaaaa

SEQ ID NO: 36655 - DNA, 571 bp, Triticum aestivum
  Clone ID: PAT_TA_36655
taataaatcctagaggtccacgcagcccattcgtgcaagacatgaggtggaactaaaagtttagtcccaccttgctagtttagggggagttggtcctttttataaggggggctccttccccacttgcatgagcatgcgaacaagagggacattcacgcgcgctcctcctccgccgccgcccgcctcgccgctgtctttctcatcccggcttgcggcgtgcaccgcacgtcgggacagtaggcctccgagaccgcaccttttgagtcctgtatgggtttttggggaggcgaggacaccgaccttctgtttcgacttgcaagccaagctatgggcccacgaggtcagagagctctcctacaacatggaggacgtcgtcgacaagttcctcatacgtgtcgacagcgacggcattcaacagcctcacgacaactccagcagattcaaggagctcaagaacaagataatcggcttgttcaagaaaggcaagaatcaccatcgcatagctgacgcgatcaaggaaatcaaggagcaagtccaggaggtggcagataggcgtgacaggaacaaggta

SEQ ID NO: 36656 - DNA, 657 bp, Triticum aestivum
  Clone ID: PAT_TA_36656
tgagggcaagatggagcaccaggggcacggcgcaggcgagaagaagggcgtcatggaaagcatcacggagaagctcccccgtggccatggtgatcaccagcaggccaccggtggcacgtacgggcagcaaggacacaccggagttaccggcacaggcaccggcaccggcgagaagaagggcgtcgtcgagaacatcaaggagaagcttcccggtgggcacggtgaccaccagcacaccactggaatgagcggctcgaagacgcatgccaccacagccaccaccgatggcaactacgggaagtcgggacacaccggcactgacagcaccggtgagaacaagagcatgatggacaagatcaaggacaagctgcctggacagcactaagcccagccggtctgcccacgcccgcgcccgacccgctactttgcagaatatataataagatggccaacttccaccgtgtatacatgaatttaagctttcatggaggagcgccccaattcatctgggtttaagctttcatggacaacagtgtgtcgagggttttcgtttgtttacaatttgcatactttgacatggaaatttccttttggttcaaccggtgcatggtatgctatggcatctaatataaatataagcaaaatgttaagtttgca

SEQ ID NO: 36657 - DNA, 2204 bp, Triticum aestivum
  Clone ID: PAT_TA_36657
gaattccggcgacggcggcagtctactaccccgtagttcggatagaggcccctcttcctatcgagtgtttaggcatatatctgcagctttgtcacaacaaaggaatctctctgggagttacattgagcactatgaataatctgcaatggcagaggccagccctagaacagaaacgtcaacagatgatactgatgaaaatcttatgcttgaaccagggaatgctgctcttgctgttgtttctgactctagtgacagatccagagacaaaaacggagatcaaaagacaatgcgtcggcttgctcaaaatcgcgaggctgctaggaaaagtcgtttgaggaaaaaggcatatgttcaacaattggagaacagcaggctaaagcttacccagctagagcaggagttgcaacgagctcgtcaacaaggcatttttatatctagttcagcagaccagtcccattccatgagtggaaatggggcgttggcttttgacacggagtacgcacggtggttggaagaacacaatcgacaagttaatgagctgagagctgcagttaatgctcatgcaggcgatactgagctgcgtagtgttgttgagaagatcatgtcacactatgatgagatttttaagcaaaaaggaaatgcagccaaagcagatgtctttcatgtgttatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttagtcaggctgacaacctgcggcagcagactcttcagcagatgcaaaggatcctgaccacaaggcagtctgcccgtgcacttcttgtgataagtgattactcatcccggcttcgtgccctaagttctctttggcttgctcgaccgaaggaataacaagcgcgtgtgatttgactgcaatacattttcgcaatttgggggtgatggtggtggcagtcatgcaacagacttgattcagagaaacttgcacatactataatccaaagagatgctgtgttcaggtagcttagccatatagtgaagttgagtgcattagggaagggtccttgttgtaccgttaaccgctgtaaaattggcatctaatggttgccaagtaatctttaagatactaatttgcagagagccatccctttagatgtgcatttataactcttttgttgctaatcggaaaaaaaaaaggaggaagagcgagctaggcaagaggctatcgcgaaaaaggctgcagaagacaacaaggatcagccctcaagctctaccgatgctattatggctgaagcggaacttaccttaaatgctcctgctgatcttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacggaattc

SEQ ID NO: 36658 - DNA, 434 bp, Triticum aestivum
  Clone ID: PAT_TA_36658
gagaagttaggacaagggcaacagccaagacaatggctgcaaccaagacaagggcaacaaggatactacccaacttctccgcagcagtcaggacaagggcaacaattaggacaagggcaacaaggatactacccaacttctccgcagcagtcaggacaagggcaacaaggctacgacagcccataccatgttagcgcggagcaccaggcggccagcctaaaggtggcaaaggcacagcagctcgcggcacagctgccggcaatgtgccggctagagggcggcgacgcattgttggccagccagtgatagaactctctgcagctcgcttggtgcttaggcatgcatgcaccttagctatacaataaatgtggcgtgtgttcaagtttttcatgtaactaatgtaaagcccagtaatgatgcaaaatgaaaagctt

SEQ ID NO: 36659 - DNA, 1007 bp, Triticum aestivum
  Clone ID: PAT_TA_36659
gggccgggtcgctgccgtagtcccactggtccgcccacgacgagcccgacatttaatcttccaaagctccgtatctggtgcaatggccgcagcgaatgcccccttcgctctcagccgcctctccccggccgcgcgcctgccgttccgtgcctggagagccgcgaggccggccccggtctggaccgggagaacccgcccgctctccgtggcctccgcggcgcaggagaacagagacaactccgtcgacgtccaagtcagccaggcccagaacgccggcaaccagcagggcaatgcagtccagcgccgccctcgtcgcgctggatttgacatctccccgttcgggctagtggacccgatgtcgccgatgaggacgatgcggcagatgctggacacgatggaccggctgttcgacgacgccgtggggttccccacggcgcgctcgccggcgcggcgagcgaagacgccgcggatgccgtgggacattatggaggacgagaaggaggtgaagatgcggtttgacatgcctgggctgtcgcgggaggaggtgagggtgatggtggaggacgacgcgctggtcatccgcggcgagcacaagaaggaggccggcgaagggcagggcgaaggcggcgacgggtggtggaaggagcgcagcttgagctcctacgacatgcgactggctctgccggacgagtgcgacaagagccaggtgcgcgccgagctcaagaacggcgtgctgctcgtgtccgtgcccaagagggagaccgagcgcaaggtcatcgacgtgcaggtccagtgatgagtttgtgcgagactctgtaccctgcatctgaggctttgagatttcagctgtccgaggcgtgaccgtgcgagtgcgtgctctttgtagacgtagggtgccgttcttctccgaccctatctgcgcgctcgttgcgcagaacatgtcgtgctgtacgtaaatgtacttggcaaatcaatggaataagtgttcggctggcggccgcgaattc

SEQ ID NO: 36660 - DNA, 650 bp, Triticum aestivum
  Clone ID: PAT_TA_36660
gacctccacgagttgctcatcactagctagtacgttgtactgttagctacagattaagaagtgatcatggcccgcgctcaggtactgctcatggccgccgccttggtgctgatgctcacggcggccccgcgcgctgccgtggccctcaactgcggccaggttgacagcaagatgaaaccttgcctgacctacgttcagggcggccccggcccgtccggcgaatgctgcaacggcgtcagggatctccataaccaggcgcaatcctcgggcgaccgccaaaccgtttgcaactgcctgaaggggatcgctcgcggcatccacaatctcaacctcaacaacgccgccagcatcccctccaagtgcaatgtcaacgtcccatacaccatcagccccgacatcgactgctccaggatttactgagcgacgatccgtcaagctggtgctcagctcatcgatccacgtggagctgaagcgcgcagcctctgtccctatgtagtatggctaccagttatgccgagtttatgctgaataagaactctctcctgtactcctttggaggagatcagtatctatgtacgtagagttgagagtttgtaccatgggcactcccagtgttcatggactatatgcatacacctccttctgtgctc

SEQ ID NO: 36661 - DNA, 303 bp, Triticum aestivum
  unsure (1)..(303): unsure at all n locations
  Clone ID: PAT_TA_36661
nccgagctagttgcgggagcttgtcacccatgtgggggcattgaggcggtgtggatgcttggtgcggtttgttggcctgggcttgtgatgtaaccttgctggcctgcccgttccaagttggtagtgggctgggtggctggggcgaaagcttcgccttctcaggccttaagtggcaggcaccacgttaggctggtttcacagagcagcgacaactgcccgcttccaacggtggaaggataacaggccgctgcagcatgggcccgctctgggcctcctaccccgccatagcagaccaccatcttt

SEQ ID NO: 36662 - DNA, 1919 bp, Triticum aestivum
  Clone ID: PAT_TA_36662
ctcctctctctctctctctctctctctctctcgcacgcacgcacgcacgcacacaagaaaaaaatcaagatggttgacacactgagtgaagagaacatcattggatacttcaagaacaagagcatcctcatcactggatcaacaggctttcttggaaagatactggtggagaagatactgagagttcaacctgatgtgaagaagatctacctcccggtgcgagcggtggatgccgcggcggcaaagcatcgggtggagactgaggtggtagggaaggagttgttcgggcttctgagggagaagcacgggggcaggtttcaatctttcatctgggaaaagatcgtcccattggccggagacgtgatgcgcgaggacttcggcgtcgacagcgagaccctgagggagctccgggtgacccaggagctcgatgtcatcgttaatggcgccgccaccaccaacttctacgaaaggtatgatgtggctctagacgtgaacgtgatgggagtgaagcatatgtgcaacttcgccaagaagtgccccaatctcaaggtgctcctccatgtctccacggcttacgtggcgggtgagaagcaagggctggtgcaagagagaccattcaagaatggcgagacgctgctcgaggggacccgcctcgacatcgacactgagctgaaactggccaaggacctgaaaaagcagcttgaggccgacgttgattcgtcgcccaaggccgaaaggaaggccatgaaggatcttggccttaccagggcccggcacttcaggtggccaaacacatacgtgttcaccaagtcgatgggggagatggtgctaagccagttgcagtgtgatgtccccgttgtcatcgtccgtcccagcatcatcacaagtgtccagaacgacccactgcccggatggatcgaaggcaccaggacgatcgacacgatcgtgatcggctatgcgaagcagaacctgacatacttcttggccgacctcaacctcaccatggatgtgatgccgggcgacatggtggtgaatgcgatgatggcggcaatagtggcacacagctcgtcctcattggagaagacaaagtcacatcccaagcaacatgcaccggcggtgtaccacgtgagctcgtcgctgcgtaatccggcaccatacaatgtgcttcatgaggctgggtttcggtacttcacggagcaccctcgcgtgggccctgacggtcgcaccgtgcgtacccataagatgacattcctcagcagcatggcttccttccacctatttatgatgctcaggtaccgcctcctcctcgagctcctccacctgctctccatcctctgctgcggcctcttcggcctcgacaccctctaccacgaccaagcacgcaagtacaggttcgtgatgcacctggtggatctgtacgggccctttgcgctgttcaaggggtgcttcgatgacgtcaacctaaacaagctcaggctcgccatgaccagcaaccatggtagcctcttcaatttcgacccgaagaccattgattgggacgagtacttctacagggtccacatccccggggtcataaagtacatgctcaagtgaaatatccgtgcaccgaaattcaggcgttgccttaataattaaataatcgtacgattgtaagaaatgtcctcccaaattgggttctaaccgttaaataatctatatgaaagaggaaaatgtgtctgtcgcttgatagagcaggcatcaacgttgcataagtttcttgaagacaaggaatgctacattatgtagtcccattctggttcatgtattgtattgctaattatgactagtattgattgttgttaccaagccgaattccagcacactggcggccgttactagtggatccgagctcggtaccaaaaaaaaaaaaaaaaaaaaaa

SEQ ID NO: 36663 - DNA, 1949 bp, Triticum aestivum
  Clone ID: PAT_TA_36663
ctctcttcttcctccgtctctcattctctcctcccgagcttcatagctcacacgcacacaaaaccaaggcaagatggtgggcacgctggatgaggggaagatcgtcgactacttcaggaacaagagcgtgctcatcaccggagccacgggattccttggcaagataatggtggagaagatcctgcgggtccagccggacgtgaagaggatctacctgccggtgcgggcggccgacgccgcggcggcgaggcgccgggtggagaccgaggtggtggggaaggagctgttctgcgtgctgcgggagcgccacggcgccgggttcgacgccttcgtcgccgacaaggtggtggggctggccggcgacgtcatgcgcgagggcttcggcgtcgaccccgccacgctgcgggacctccggctcgccgacgagctcaacgtcatcgtcaacggcgccgccaccaccaacttctacgaaaggtacgacgtggccctggacgtgaacgtggtgggggtgaagcacatgtgcgacttcgcccggaggtgccccaacctcgaggtgctcatgcacgtctccacggcctacgtcgccggcgagaagcaggggctggttccggagaggccgttcagggacggcgagacgctgcgcgacgacggcacccaactcgacatcgacgccgagatgaggctggccaaggacctcaggaagcagatggaggccgacgacgatgtggaccccaaggcccagaggaaggccatgaaggacctcggcctcaccagggccaggcactttgggtggcccaacacgtacgtgttcaccaaatccatgggggagatgatgctggcccagatgatgcgcgggggcgacgtgcccgtcgtcatcgtccggcccagcatcatcaccagcgtccagaacgacccactgccaggatggatcgaaggcaccaggacgatcgacgcaatcctgatcgggtacgcgaagcagagcctgtcgtgcttcctcgccgacctcgacctaaccatggacgtgatgcccggcgacatggtggtgaacgcgatgatggcggccacggtggcacatgcctcctccactcagacatcagagccagagaagaagccgcctccgcagcagcaacaccctcactcggtgccggcagcgccaacggtgtaccacgtgagctcgtcgctgcggcacccggctccgtacgcggtgttgtaccgaacggggatccggtacttcgaggagcacccacgggtggggcctgatggccgccccgtgcgcacccgtaaggtgcggttcctcggcagcatcgcggcgttccacctattcatggtgctcaagtaccgtgtcccccttgaactcctccgcctgctctccatcctctgttgcggcctctttggccttgccgccctctaccacgacctcgcccgcaagtacaggttcgtgatgcagctggtggacctgtacgggcccttctcgctcttcaagggttgcttcgacgatgtaaacctcaacaagctcaggctcgccatggccgacggtgaccatgccgattccgcattcaactttgaccccaagaccattgactgggacgactacttcttcaaggtccacatccctggtgtcatgaagtacgtccacaagtgatgttctgtgtgcgatctgcttctgcgtgctgagaaggaatggaggaaatcaaattaatggtagcgctagtgtgccttgcttgtgttgtgtaacctccttcttcgttcatcgagtattattggttgagtattgattgtattgtcattggaagttaaattaaccagtgactatgagtataactaagatgaaattacttgcatcatggcgggtctctaaaactaagatagtacaaggatcctatgaagtacattgaaattacttagtacttttcatggtactatcataatacaaaaaaaaaaaaaaaaaa

SEQ ID NO: 36664 - DNA, 804 bp, Triticum aestivum
  Clone ID: PAT_TA_36664
tacggcctctttccactactaccaccgagccaccatcccctacaagggagagcagagaacacacattcactttgttgcttcaggttgcaacacctaaattaggctacaatggctctgaggctgtgggcgagctcagctgccaatgccctcaagatttcaagcagcggcgccagggctgctgccccggcctattcgatctccagatacttctccactgttattgatggcttgaagtacacttcctcccacgagtgggtcaagaacgacggctccgtggccacgattggcatcagtgaccacgcccagggccatctcggggaggtggtgttcgtggagctgccggaggccggcacgaaggtgagccagggcggagccttcggcaacgtggagagtgtgaaggccaccagcgacgtcaactcgcccatctccggcgaggtcgtcgaggtcaactcaaagctgtccgagacccccggccttgtacgcacagcaaacacctcgcctccgtcgattagcaatcctttcagtctttcacgtccgtgtagcgatcctaatgaactgtgttgttgcgattgcgccgtggcctggcagatcaactcgagcccgtacgaggaggggtggatgatcaaggtgaagccgagcagcccggcggagctggagggcctgctggactcggccaagtacaccaagcactgcgaggaggaggacgcccactagtgctccttgctcgattatcgttccttttttgttgcaaccatgtcgactactcttgtctacaataattaaaccagcttcaccatgcgttcg

SEQ ID NO: 36665 - DNA, 1446 bp, Triticum aestivum
  Clone ID: PAT_TA_36665
ggcacgagatcctctcctcctcctcctcctcctcctcctcactccagtgagctcgagtcggcactgcactctctcccagctccagatcgatcgagtcgccgagcatactcggcttcttgatcgatcgtttgttgtctagcctagcataccctgcttcttggtcgagtcgtcgatcatggtgcagccggtgttcgacgcggcggtgctgagcggccgggcggacatcccgtcgcagttcatctggcccgagggcgagagcccgaccccggacgccgccgaggagctgcacgtcccgctcatcgacatcggcggcatgctctccggcgacccccgcgcgaccgccgaggtgacgcgcctcgtgggcgaggcctgcgagcggcacggcttcttccaggtcgtcaaccacggcatcgacgccgagctgctggcggacgcgcaccgctgcgtggacgccttcttcaccatgcccctcccggagaagcagcgcgcgctgcgccgccccggcgagtcctgcggctacgccagcagcttcaccggccggttcgcctccaagctgccctggaaggagacgctgtccttccgctcctgcccctccgaccccgccctcgtcgtcgactacatcgtcgccaccctcggcgaggaccaccgccgcctcggggaggtgtacgcccggtactgctcggagatgagccggctgtccctggagatcatggaggtgctcggggagagcctgggcgtcggccgcgcacactaccggcgcttcttcgagggcaacgactccatcatgcgcctcaactactacccgccgtgccagcggccgatggagacgctggggacgggcccgcattgcgacccgacgtcgctgaccatcctccaccaggacaacgtcggcgggctgcaggtgcacacggagggccggtggcgttccatccggccgcgggccgacgccttcgtcgtcaacatcggcgacaccttcatggcgctctcaaacgggcggtacaagagttgtctccaccgcgctgtcgtgaacagcaaggtcccgaggaagtcgctggccttcttcctgtgcccggagatggacaaggtggtggcgccgccggggacgctggtggacgccgccaacccgcgcgcctacccggacttcacgtggcggtcgctgctcgacttcacgcagaagcactaccgcgccgacatgaagaccctcgaggtcttctcctcctggatcgtccagcagcagcagggccagctcctcccaccattagccagccattgattcagcttagctgctgagactgagaaaatgaaaatcatccgtcgatcgaatgttattattattacagcttacttaattggttgatctagttgtagcacgtactacgtacgaagaagcatggacggatggcaagatttcctagatgataatttcctaaaaaaaaaaaaaaaaaa

SEQ ID NO: 36666 - DNA, 1451 bp, Triticum aestivum
  Clone ID: PAT_TA_36666
ggcacgagctcctcctcctcctcctcactccagtgagctcgagtcggcactgcactctccatcgtttcttctctggcctagcatactccggttcttggtccagtcgatcatggtgcggccggtgttcgacgcggcggtgctgagcgggcggtcggacatcccctcgcagttcatctggcccgagggcgagagcccgaccccggacgccgccgaggagctgcacgtgcccctcatcaacatcggcggcatgctctccggcgacgccgctgcggcggccgaggtgacgcgcctcgtgggcgaggcctgcgagcggcacggcttcttccaggtcgtcaaccacggcatcgacgccgagctgctggcggacgcgcaccgctgcgtggacaacttcttcaccatgcccctcccggagaagcagcgcgccctgcgccgccccggcgagtcctgcggctacgccagcagcttcaccggccggttcgcctccaagctgccgtggaaggagaccctctccttccggtcctgcccgtccgaccccgccctcgtcgtcgactacatcgtcgccaccctcggcgaggaccaccgccgcctcggggaggtgtacgcgcgctactgctcggagatgagccgtctgtcgctggagatcatggaggtgctcggggagagcctcggggtcggccgtgcccactaccggcgcttcttcgagggcaacgactccatcatgcgcctcaactactacccgccgtgccagcggccgttggagacgctgggcacgggcccgcattgcgacccgacgtcgctgaccatcctccaccaggacaacgtcggcggcctgcaggtgcacacggagggccggtggcggtccatccgaccccgcgccgacgccttcgtcgtcaacatcggcgacaccttcatggcgctctcgaacgggaggtacaagagctgcctccaccgcgcagtcgtgaacagcagggtccccaggaagtcgctggccttcttcctctgcccggagatggacaaggtggtggcgccgccggggacgctggtggacgcctccaacccgcgcgcctacccggacttcacgtggcggtcgctgctggacttcacgcagaagcactaccgggcggacatgaagaccctcgaggtcttctcctcgtggatcgtccagcagcagcagggccagctcgccctccagccagccatgacatgaaggattgaacctaccagacagaggatggagctctctgctctgctctaatctgtattgctcctcccattagccattgattcagcttagctgctgagactgagaaaagagaaacgtcgtccgtcgatcgaatgttattattacagcttaattggttgatctagtgatagcacgtacgcgcgtaccaagaagcatggatgaatttcctagatgataatttcctaaaaaaaaaaaaaaaaaaaaaaaa

SEQ ID NO: 36667 - DNA, 2219 bp, Triticum aestivum
  Clone ID: PAT_TA_36667
tcgccaccgacgctgacatctccaccgccctccgctgtgccgtcgacgacgatgctgtgcctcagctcctctctcttgccgcgcccgtctgccgctgctgaccggccgcttcccggcatcatcgcgggtggcggcggcggcaagcggctgagcgtggtgccgtctgttccgtttctgcttcgctggttgtggccacggaaggccaagagcaagtcttttgtttccgtgactgcacgaggaaacaaaatcgcggcaacaactggatatggttctgaccaccttcccatatatgatctggacctgaagttggccgaattcaaagaccacttcgattatacgaggaataggtacattgaacagaaacatttgattgagaaacatgagggaagcctagaagaattctctaaaggctatttgaagtttgggatcaacacagagcatggcgcatccgtgtacagggaatgggcccctgcagcagaggaagcacaacttgttggcgacttcaacaactggaatggttctgggcacaagatggcgaaggataattttggcgtttggtcaatcaggatttcccatgtcaatgggaaacctgccattcctcacaattccaaggttaaatttcgatttaggcatcatggagtatgggttgaacagattcctgcatggattcgttatgcaactgttactgcctctgaatctggagctccatacgatggtcttcactgggatccaccaagtagtgaaaggtatgtatttaaccatcctcgacctccaaagcctgatgttccacgtatctacgaggctcatgtgggggtgagtggtggaaagcttgaagcaggcacatacagggaatttccagacaatgtgttaccgtgcttaagggcaactaactacaacacagttcagttgatgggaatcatggaacattctgactctgcttcttttgggtatcatgtgacgaatttcttcgcagttagcagcagatcaggcacaccagaggacctcaaatatcttattgacaaggcacatagtcttggattgcgtgttctgatggatgttgtccacagccatgcgagtaataatgtgatagatggtctcaatggctatgatgttggacaaagtgcacacgaatcctatttctacacaggagacaagggctataataagatgtggaatggccgcatgttcaactatgccaattgggaggtcctgagatttcttctttccaatttgagatattggatggatgaattcatgtttgatggcttccgatttgttggggttacatcgatgctatataatcacaatggtatcaatatgtcattcaatggaaattacaaagattacattggtttggataccaatgtagatgcatttgtttatatgatgctcgcaaaccatttaatgcacaaactcttcccagaagcaattgttgtggcagtagatgtttcaggcatgccagttctttgttggccagttgatgaaggtggattagggtttgactatcgccaagctatgactattcctgatagatggattgactacttggagaacaaaggtgatcaacagtggtcaatgagtagtgtaatatcacaaactttgactaacaggcgatatccggaaaagttcattgcatatgctgagagacaaaatcattctattattggcagcaagactatggcatttctcttgatggaatgggaaacgtattccggtatgtcggccatggatcctgattcacctacaatagatcgtgccattgcacttcaaaagatgattcacttcatcacgatggcctttggaggtgatagctacctaaaatttatgggtaatgagtacatgaatgcatttgttcaagcagtggacacgcccagcgataaatgttcattcctatcatcatcaaatcagactgccagccacatgaatgaggaagaaaagggaagtgctttaactaaaggctacacccacttaagaagtggttgctttgatccttcgcttccctcgacatcgtcatgtgcctttctaggtccctcgaatcaaagtcctttctccaagcctttcattggattccctggatgtatattttgttgtggtttattcaagggagagtgaatgattatatatccatatatgggggtgggtataaaggttgacgatattcgacatatatagaccatgttggagtatggaggaaatggtggtgcatgataaaaaaaaaa

SEQ ID NO: 36668 - DNA, 682 bp, Triticum aestivum
  Clone ID: PAT_TA_36668
ggcacgaggccacgtagacgcagcagcagcagcagcgagctctgtcggttctctatctagcatctccggtgtgaagcgagcaagcagagagagagagagatggcgtccactcgtcgcatggctgccgcgccggccgtcctccttctcctcctcctgctcgtcgccacagagatggggacgatgaagacggcggaggcccggacgtgcctgtcgcagagccacaagttcaagggcacctgcctcagcaacagcaactgcgccgccgtgtgccgcaccgagaacttccccgacggcgagtgcaacacgcacctcgtcgagcgcaagtgctactgcaagcggacctgctaagcaacaccagtccgcgcgacgtcctccgatggatgcttgctactgggctagagcatccatgccgtcccttagatctgttcgtccctactccgtctatttccgtttcctttacgttgctcctagggatgactgaaaataaagtagctacctgcaccctcggcattggctgttcgtctgcatgtatgctgtttaagtgttcgtggctttagtttgtgctgttgatgtaataacgatgccactgacaatttggcttctatgtcttgtgttggaactttgaatcagcaggtttgttggcttgtctgttaaaaaaaaaaaaaaaaaaaaaaaaaaaaaa

SEQ ID NO: 36669 - DNA, 1721 bp, Triticum aestivum
  Clone ID: PAT_TA_36669
ttccggaccatttttcctcctccatgccctctattgcagataatctcaagtggacagtgtattccttgctcatcaaccggaatgcataggaggatctgtccgtctgtctttgcaaggaagcatgagaccacgcgcccgtctagagcaataatgtccatgctcgcgtgcgcgcttcaaaccatgggctcctcctgcagcagacctcactccgtaaacgaggccgaggcagccgacaacacaagatctgcagacatcgaccggcggattctgcaagagacaaaggccgatcagcacgtccacaagctcttgcttctcggtgctggagaatcaggaaagtccacgatatttaagcagattaagcttctttttcgaaccggcttcgacgaggcagaactcaagggctatacgccggtcatccatgccaacgtgttccagacaatcaaagtatgccaatactgggaaaggatactgtatgatggagctaaagagcttgcccaactggaaactgagtctttaaaacatgttatatccccggataatcaggagattggagaaaaactatcagaaatcggaggcaggttggattacccactccttaacaaagaactcgtacaggatgtaagaaaattatgggaagatccagccattcaggaaacttactcgtgtggaagtgtgctgcaagttcctgactgtgcacactacttcatggagaatctggaccgattagctgaaccagattatataccaacaaaggaggatgtgctccatgccagagtacggacaaatggggttgtggaaattcaatttagcccccttggagagagcaaaagaggcggagaggtatacaggttgtacgatgtaggaggtcaaaggaatgagaggaggaagtggattcatctttttgaaggcgtcgatgccgtcatcttttgcgctgccattagcgagtatgatcagctgttgtttgaggacgagacacagaacagaatgatggagacaaaggaactgttcgacttggtactaaagcaaagatgttttgagaaaacatcgttcatgctgttcctcaacaaattcgacatatttgagaggaaaatacaaaaggttcctttgaccgtgtgcgagtggtttaaagactatgagccgatcgcgcctggcaaagtacaggatgtggaacatgcctatgagtttgtgaagaagaaatttgaggaggtctacttccagagcagcaagccggagcgtgtggaccgggtgttcaagatctacagaacgacggcgctggaccagaaacttgtaaagaagacgttcaagctgatcgacgagagtatgagacgctccagggagggaacggggacgtgatgaagactaggttgttgtgactgagccacaggagggggaaaacggcaattaggatgacacattaagtttacggtgtcgcaactctgttgtaattcattctttagtgtaaagaggaagaagactgatttgatccctttgtgcttgctttcacaaacaagctccaggaaacaaatctgatgaatacagtacagtagtacgcaaagtttggatctgtcattttgctttctacctggccgtaaaatatttgcagattttgttggtcatcactttgttgcctcatggctattttggggacaggctgaggtcgtatgttatggtattctggccattatggcctgtgaaaaaaaaaaaaaaaaaaaaaaaaaaaa

SEQ ID NO: 36670 - DNA, 2081 bp, Triticum aestivum
  Clone ID: PAT_TA_36670
atggcggctctggtcacgtcccagctcgccacctccggcaccgtcttcagcgtcaccgacagattccggcgtccaggttttcagggtgtgaggccccggagcccggcagatgcgccgctcggcatgaggactaccggagcgagcgccgccccgaagcaacaaagccggaaagcgcaccgcgggacccggcggtgcctctccatggtggtgcgcgccacgggcagcgccggcatgaacctcgtgttcgtcggcgccgagatggcgccctggagcaagaccggcggcctcggcgacgtcctcgggggcctccccccagccatggccgccaacggtcaccgggtcatggtcatctccccgcgctacgaccagtacaaggacgcctgggacaccagcgtcgtctccgagatcaaggtcgcggacgagtacgagagggtgaggtacttccactgctacaagcgcggggtggaccgcgtgttcgtcgaccacccgtgcttcctggagaaggcccggggcaagaccaaggagaagatctacgggcccgatgccggcacggactacgaggacaaccagctacgcttcagcctgctctgccaggcagcgcttgaggcacccaggatcctcgacctcaacaacaacccatacttctccggaccctacggggaagacgtggtgttcgtgtgcaacgactggcacacgggccttctggcctgctacctcaagagcaactaccagtccagtggcatctataggacggccttggtagcgttctgcatccacaacatctcgtatcagggccgcttctccttcgacgacttcgcgcagctcaacctgcccgacaggttcaagtcgtccttcgacttcatcgacggctacgacaagccggtggaggggcgcaagatcaactggatgaaggccgggatcctgactgtgagcccctactatgctgaggagctaatctctggcgaagccaggggctgcgagctcgacaacatcatgcgcctcactgggatcaccggcatcgtcaacggcatggacgtcagcgagtgggaccccatcaaggacaagttcctcaccgtcaactacgacgtcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcttgaaggaggaggacgtccagatcgttctcctgggcaccgggaagaagaagtttgagcggctgctcaagagcgtggaggagaagttcccgagcaaggtgagggccgtggtcaggttcaacgcgccgctggctcaccagatgatggccggcgccgacgtcctcgccgtcaccagccgcttcgagccctgcggcctcatccagctccaggggatgcgctacggaacgccgtgcgcgtgcgcgtccaccggcgggcttgtcgacacgatcatggagggcaagaccgggttccacatgggccacctcagcgttgactgcaacgtggtggagccggccgacgtgaagaaggtggtcaccaccctgaagcgcgccgtcaaggtcgtcggcacgccggcgtaccatgagatggtcaagaactgcatgatacaggatctctcctggaaggggcctgccaagaactgggaggacgtgcttctggaactgggggtcgaggggagcgagccgggggtcatcggcgaggagattgcgccgctcgccatggagaacgtcgccgctccctgaagagaggaaagaggtttttggtgcatggagcattcatccatcttcagggttcccgtgtgaggagatagccgcttgttgtagcgaagggccgatatatacatatttatatatagactaataagtacttatgctttgttgtgccgcttgcctctttattacaaacaaaaaaaaggtaagaagttaggggttgtgcttgtgagaggtgtgtacttaatcgtgcttgcattttggtgtggtatattgcaaataaacaaaggatttgttaaaaaaaaaaaaaaaaa

SEQ ID NO: 36671 - DNA, 187 bp, Triticum aestivum
  Clone ID: PAT_TA_36671
cgaccgggtggtcggctgcgaccgggtgctgtcggagacggacttcccaaacctgccctacctgcaggccgtcgtgaaggagtcgctccggctgcacccggcgacgccgctgatgctcccgcacagggccagcgccgccgtgaatgtcgccggctacaacatccccaagggagccagcgtcacggtg

SEQ ID NO: 36672 - DNA, 597 bp, Triticum aestivum
  Clone ID: PAT_TA_36672
gggattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacaacctcaacagcaactgggtcaacagcctcaacaacaacaacaacaggtactacagggtacctttttgcagccacaccagatagctcaccttgaggcggtgacttccattgcactccgtaccttgccaacgatgtgcagtgtcaatgtgccgttgtacagcgccaccaccagtgtgccattcggcgttggcaccggagttggtgcctactgataagaaaagttgtctagtaatatatagttggaccaccgtcgtctagtcgatcgacatgtcgaggaagcggtgacaaataaagtgtcacacaacgtcatgtgtgacccgcccaaagtagtagttaaattctggaataaatacaaatgaagtgttctc

SEQ ID NO: 36673 - DNA, 1290 bp, Triticum aestivum
  Clone ID: PAT_TA_36673
tttagcaaaccttcgatcgcctcactgacgtctcaaatgagcttcaagcacttggtgccactgacatcgccgaccatgaagtggtgaagaaattgctgagatcgcttgattcctcatttgacacccttgcactgatgatacaagaacgtggagagtacaagtcacttgatcctgctgatatccttgagaggctaaacactcatgagttccagcttgctgagaagagagatctctatggaccgaggtatggcggatcacgtgctctgaaggccaaggcagtatctgaatctgaaggtgaggattctggtagcagccttggtgatcctgaagaactgagccaggagctagcaatactcgtgaggaaattccagaagttctcaaggcgtggtcgctttggaaaatcctcaagaaatgatgacgtaagatcagattcctcatcccgtgactacaagaaaagaacttgccacaaatgcaagaaacctggtcactacattcaagattgtcccctgtgggaaaaggaatcaaataagaagaaatacaaggattacagttctgatgactcaaagaagaagaagaaatcttctaagtcctcatcatcaaaatcctcgaagtcttcatctcacaagaagagcagctccaaaaaggctcgggccttcattgtcaaggaaatggactctgaagctgaatctgaggaaaatgaggaagaggaggcatctgaggagtaagaatctggtgtgacgagtctagccctcgctactgcgttcgtcaccaagtccatcttcaactctgaggagaatggcttccccaacaaggctgacgatggcgatgatgactatgctcccacctattgcttcatggcaaagggtgccaaggtactcaaatatccctcccctaaatcaagtgaggatgaatctgatgaaaacctcatgcctagttattctaaacttgctaagattgctgtgaaacaacaaaaggcttttgaaaaggttcaaaatatgctagacaaaagcgataacctgttgggtgaagaaatggatcgcactcaaaccttgagttataatcttcaaagacttcagtccaagtttgataaccttcagagtcatcataacactctcttatctgaccatgagaagctttcttatgaatttcttcaaagaaagcaagatcttgagaagctaagggagagttttgaagatcttcagaaggaacgtgattcattgcttgctcagtagatcattgctgctcaggaagaattcattccaccatgtttaaagtgcattgaacgtgaat

SEQ ID NO: 36674 - DNA, 383 bp, Triticum aestivum
  Clone ID: PAT_TA_36674
ggaccaggggcgtcccccctgggggcctttctcccctcaaaggacaagcagccggcacgccgagttcgagatctccgagttccctgcgcccgcttcgggctggatcgtgcccgctacaccatgccccccgacgcgcagcacggtcaccgtgctccggcgtcgtcatccgcgaggacttcagccgcaccttcgccgagcgcctcgtcatcgacatcgagaaggtgctccacgagctcgacgcgctcccctcgcgcagcagcgggcccgccctgcagcaccccaacggcgacacggtgagcgagaaggacctcgccaggcagcgcgaggtggtgtccgtctggaagagggccgtcgccgccaggaagaagacccagggcgtctgc

SEQ ID NO: 36675 - DNA, 452 bp, Triticum aestivum
  Clone ID: PAT_TA_36675
ttgggcaacgcggatgggatttcccatgttaacattgataaatcagttgaacaggacatggcaaaacgtatcgtattggatgcaaaggttgattatcctgcagcatgcaatgttatggaaacactacttgttcataaagatctgaacaagacagagggtcttgatgatttattgatggaacttgcgaaagaaggagttgttatttatggtgggcctgtcgcacaagacacattgaaagtaccgaaggtagattcatttcatcatgagtatagctcaatggcatgcaccctcgaatttgttgatgatgtgcagtcagcgattgaccatataaatcgttatggaagtgcacacacagattgtattatcacaactgataagaagtcagcggatacttttctacaacaagttgacagtgctgctgtgttccacaacgccagcacccgattcagaga

SEQ ID NO: 36676 - DNA, 372 bp, Triticum aestivum
  Clone ID: PAT_TA_36676
tctggtccatggatgtgttacccaggtcaagcattccaggttccggctctgccggcttgccgtccgctgctgcgtctgcagtgcaacggatcccaggttccggaagctgttctgcgtgactgctgccagcagctggctcacatctctgaatggtgccgttgcggtgctctgtacagcatgctggactctatgtacaaagaacacggcgcgcaggaaggtcaggctggtaccggtgctttcccgcggtgccgtcgtgaagttgttaaactgactgctgcttctatcactgcagtttgccgtctgccgatcgttgttgatgcatctggtgacggtgcttacgtatgcaaagacgttgctgcttacccggacgct

SEQ ID NO: 36677 - DNA, 776 bp, Triticum aestivum
  Clone ID: PAT_TA_36677
atggcctccaaccagaaccaggccagctaccacgccggcgagaccaaggcccgcaccgaggagaagaccgggcaggtgatgggcgcgaccaaggacaaggcggggcagaccacggaggccaccaagcagaaggccggacagaccaccgaggccaccaagcagaaggccggcgagacggccgaggcaacgaagcagaaggccggtcaggccacggaggccacgaagcagaaggccggcgagacggccgaggccaccaagcagaaggccgccgaggccaaggacaagactgcgcagacggcgcaggcggccaaggagcgcgccgccgagaccaaggaccagaccggcagctacctcggcgagaagacagagatggccaagcagaaggccgccgagacgaccgaggctgccaagcagaaggcctcggagacggcgcagtacaccaaggagtccgtcgccggcaaggacaagaccggcagcgtcctccagcaggccggcgagacggtggtgaacgccgtggatggcgccaaggacgccgtggccaacacgctgggcaatgggccggacaacgccaccaaggacacctccaccggcgccaccacgaaggacaccaccaccaccaccaccaggaatcactagacgcatcgttcgcgcttgatttgctttcctttagtcctgtttggtcgttcgcgggccttcgacatatttgtatgtttccactctttcgtgatttcagctcatttagtgttaagtttgccttcgatttgatgtactcctcg

SEQ ID NO: 36678 - DNA, 1236 bp, Triticum aestivum
  Clone ID: PAT_TA_36678
ccgcggctacgggtggtccgatgcatggcggcgtcggaggcggcgcagctcaagagcgcgcgggaggacatcaaggagatcctcaaaaccacctactgccaccccatcctggtccgtttgggatggcatgattcaggtacatatgacaaaaatatcgaggagtggccgcagagaggtggagccgacggaagcttaagatttgatcctgagttgagtcacggagccaatgctggtcttactaacactttaaagcttattcaaccaatcaaggacaaatacccaggtatcacctatgcggatttgttccaactggcgagtgctacaacaattgaggaaaccggtggacccaaactttcaatgaagtatgggcgggtagatatcacagcacctgagcaatgtccgcctgaggggaggctttctgatgctggcccacgtatacctgctgaacacctgagggaggtattctataggatgggccttgatgacaaggaaattgttgcattatctggagcacatacacttgaaaggtcacgccctgataggagtggctggggaaagccagaaacaaaatatacaaaggatgggcctggtgaacctggagggcaatcatggacggctgaatggttgaagtttgataacagctacttcaaggacataaaagagaaaagggatcaggagcttctagtattgcctacagatgctgcactatttgatgacccatcattcaaggtgtatgcggagaagtacgcagaggaccaggatgcattcttcaaagactacgccgaagcccatgctaaactcagcaaccttggtgcaaagtttgatcctcctgagggattctcgttggacgatgacaagggtgccgcggtaaccaacgagaaggtggttgctgatccagcaccagcgagtgatactaatggcgcagggccgcagccagagcccttcgttgccgccaaatactcctacaagaagagagagctatctgacacgatgaagcagaagatcagagccgagtacgagggccttggaggcagcccgaataagcctatgaagtccaactacttcctcaacattatgatcgtgatcgcaggattggcattcttgacgtctctggtcgggaactaagagcggtgctctgacgagtctgtttttttttcatcttctgtaattaaccattttccagggattggtcggcatgcaagatgagcatgtgaaacaaatgcaatgcttttgggc

SEQ ID NO: 36679 - DNA, 1208 bp, Triticum aestivum
  Clone ID: PAT_TA_36679
ccgcggctacgggtggtccgatgcatggcggcgtcggaggcggcgcagctcaagagcgcgcgggaggacatcaaggagatcctcaaaaccacctactgccaccctatcctggtccgtttgggatggcatgattcaggtacatatgacaaaaatatcgaggagtggccgcagagaggcggagccgacggaagcttacgatttgatcctgagttgagtcatggagccaatgctggtcttactaatgctttaaagcttattcaaccaatcaaggacaaataccccggtatcacttatgcggatttgttccagttggcgagtgctacagcaattgaggaagccggtggcccgaaactcccgatgaagtatgggcgggtagatatcacagcacccgagcaatgtccacctgaggggaggcttcctgatgctggcccacgtttacctgctgaacaccttagggaggaaattgttgcattgtccggagcacatacacttggaaggtcgcgccctgacaggagtggctggggaaagccagaaacaaaatatacaaaggatgggcctggtgaacctggagggcaatcatggacggctgaatggttgaagtttgataatagttacttcaaggacataaaagagcaaagggatcaggagcttctagtattgcctacagatgctgcgctatttgatgacccatcattcaaggtatacgcggagaagtacgcagaggaccaggaggcattcttcaaagactacgccgaagcccatgctaaactgagcaaccttggtgcaaagtttgatcctcctgagggattctcgctggacgctgacaagggtgccgtggcaactgaagagaaggcggttgctgatccagcaccaacaagtgataccaatggcgcaggaccacagccagagcccttcgttgccgccaaatactcttacaagaagagagagctatccgacacgatgaaacagaagatcagagccgagtacgagggccttggaggcagcccaaataagcctatgaagtccaactacttcctcaacattatgatcgtgatcgcaggattggcattcttgacgtctctggtcgggaactaagagcggtgctctgacgagtctgtctttttttttcatctactgtaattaaccattttccagggactgatcgacatgcaagatgagcatgtgaaacaaatgcaatgcttttgggc

SEQ ID NO: 36680 - DNA, 310 bp, Triticum aestivum
  Clone ID: PAT_TA_36680
ggaccagccatagaaattccacctgcaacattattcactacaattaccccaacagcaccagcatcttgagcattttttactttaattacaaacgaacaagtacctcttctaatcactgcaattttaccatttaaagctgcagcatttactggaacttcacatgcatctgaagtatcaggagctccatcatcgtataaaactaaatcattagttaaagtagctggaaagattggtaaattaacgtgaccaggattaaaagcattgtcatttacattgtaatttgtacctgctaaagttcctgtgttaaccc

SEQ ID NO: 36681 - DNA, 1721 bp, Triticum aestivum
  Clone ID: PAT_TA_36681
ccacgcgtccgagccattgtaggcttcctgatcagttgtgtggaccacatggctcttgaagcagcgttccactacctgcagctcgccggcatccatggcacatccacgccggcagtactactcaccattctcctgctactcatcattcgactagcatgggtgaggaccacaactgcgtcaacaagattcggtaagcagcaacagctcccgccttcacccccaggcaagctgcccatcatcggccacctccacctcctcggctcccagacacacatatccatccgggacctcgatgccaagcatggccgcaatggcctcttgctcctccgcatcggtgccgtacccaccttattcgtgtcctcgccgagtgccgccgaggctgtcctgcgtacccacgaccaaatctttgcgtcgcggccaccatccatggccgctgacatcattcgctacggccccacagacatcgcatttgcaccctatggtgagtactggcggcaggccaggaagctcttaaccacacatatgctcagcgccaaggtggtgcactccttccgccatggtcgtcaagaagaggtgcgcctcgttatcaacaagatccatgaggcggccaccagaggcacggcggtggacatgagcgagctcctgtccggctacaccaacgacgtcgtatgccgtgcagtcctcggagaatcccaccgcaaggaaggccggaacaggcttttcagcgagctcacagagatcaacgtctcccttcttggcgggttcagcctcgagaattacatccccccaaacatggtaatggcggatgtgctcttgaggctggtttccgtcaaggctcggcggctcaacaagaggtgggacgaattgttcaacgagatcattgaagaacacctacaccccagcaaaccatcatctggcgaccagcaagcggtagatttcatagatcttctgctctctctcaaggaagagtacggtctcactacagataacatcaaggccatcttggtggacatgtttgaggcaggcatagaaacatcttatctgacgttggagtacggcatggctgagctcatgaacaacagacacattctgaaaaaattacaggaggaggtaagatcccaaggcaaaaagttagacatgataacggaggaggaccttggcagcatggcctacctaagggcaaccatcaaggagacgctgcgcttgcacccaccagcgcccttcctcctcccacacttctccaccgctgactgcaagatcgacggatacttgataccctccaacacacgcgtccttgtgaatgcttgggcccttgggagggatccatcgtcttgggagaggccagaggatttcttgcctgagaggtttctacaagatcaagatggtgatgttgacacccaaatgaggggtaaggatcttaggttcctgccatttgggttcgggcggaggatttgtccagggatgaatttcgggttcgccaccatggaggttatgttagcaaatctcatgtaccattttgattgggatgttccgaatatggtgggtaccggcgcaggggttgatatggccgagtcgttcgggttaacgcttcgccgaaaggagaagcttcaacttgttcctcggattccctaaacctactatgtataagtttatttcgacatgagcacaagaataaaggcaaggaataaaatgactaataaaaaaaaaaaaaaaaaaaaaaa

SEQ ID NO: 36682 - DNA, 541 bp, Triticum aestivum
  Clone ID: PAT_TA_36682
ggcgctgcaggaacgatgcagtcgctgcaggacaaggcgtcggagtggagcggcgtggcggccgccgacgccttcgccatcgacgaagtcaacgtcttcgaggcgctcggcggcaccccgcagcccttcgtcgacctctccaccaacttctacaccagggtttatgaggacgaggaggagtggtttccggagattttctcggggtccaggaaggaggacgcgatccagaaccagtacgagttcttggtgcagcgcatgggcggcccgccgctattctcccagaggagaggacatcctgccttgataggacgacatcggccatttccagttacccaccaagctgcggagcgatggctacaccacatgcagcaagctttggagactacagaaagcataaacccagatacaaaaaccaaaatgatgatttttttcaggcacactgcatatttccttgtcgccggtaatgagatgacaaggcaaacccaaagtgtacctccctgcaaacatgcaacgagcaaaccagccgagtaaccgctcaaac

SEQ ID NO: 36683 - DNA, 271 bp, Triticum aestivum
  Clone ID: PAT_TA_36683
ggaatgggtggggtggggaaaacaacccttgtgaaaaatgtgtatgatcgggagaaaaccaacttccctgatgcgcatgcttggattgtggtgtcacaggcatatgatgtagtggatttactgaagacattgctcactaagatacacgacacacaagagtcacctccgccgtcacctctcagggcgggcgccaaacctgatgtttatgagttaacaggggcgataaagaagatattgcaagataggaagtcctacttgtgcttgatgatgt

SEQ ID NO: 36684 - DNA, 265 bp, Triticum aestivum
  Clone ID: PAT_TA_36684
ggccctcactgcgctgactacccaccgggcacctccctcttagccggcccatgaacctccattaggcgttagaccccattaccccgccctgctcgaccatgcggcacctcgcccctctatcccgcctatgcgccccttacgcaacccccgaacccatcacctgccctgcacgcgctccccgacccgagccccggcaacgcatcctctatgcctcatcccactctccgacctccttcacccgctcctcatgaaaaaaaaaaaaaaa

SEQ ID NO: 36685 - DNA, 997 bp, Triticum aestivum
  Clone ID: PAT_TA_36685
atggccgcacaactgttcaatcgaattggtcaattaggccttggtctagcagtagctggcagtgtagctaatacagcattatataatgttgatggtggtcatcgagctgtcatatttgacagatttacaggaataaaaaataccgtggttggagaaggaacacattttttaataccctgggtacagaagccaatcatttttgatgttcgatcacgtcccaggaatgttccagtcattactggtagcaaagatttgcaaaacgttaacatcaccctcagaatattgttcagaccccttccagagcaattgcccaaaatatacactattttaggtgtagattacgatgaacgtgtcttaccctcaatcaccactgaagtcttaaaggctgttgtggcacaatttgatgctggtgaacttattactcagagagaaaatgtttctcgtaaagttagcgaaactcttattgaacgtgctggacagtttggtgttgtattagatgatatttcaattacccatttaacatttggtaaggagttcactcaagctgtagagttgaaacaagtggctcaacaagatgcagaaagagctcgatttttggtagaaaaagcagaacaacaaaaacaggcttctattatttctgcccaaggagattcggaagctgcttcaatgttggcaaaatcgtttggagatgcgggtgaaggtttggtagagttgagaagaattgaagctgcagaggatatagcttatcaactatctagatctagacaagtgtcatatttccccccaggacaaaacattcttcttaacttaccaacacaataatttccaataatgtatttagaaactatttagacagttatgaatttttttttttttttcgtcacaatgtaatataaaatccaactatacattaaatctgtatttttttttttttattataaaatatgattttgttgcaataaagtcagagttatataggaaaaaaaaaaaaaaaaaa

SEQ ID NO: 36686 - DNA, 509 bp, Triticum aestivum
  Clone ID: PAT_TA_36686
ggaatggggggggtggggaaaacaacacttgctgctgcagtttataattccatcgctgaccattttgaagctttgtgtttccttgaaaacgtgagagaaacttcaaaaaaacatgggatacaacatctccaaagcaaccttctttctgaaacagttggagagcataagttaataggtgtgaaacaaggaatttccataatacagcataggcttcagcaacagaagattcttttgattctagatgatgttgacaaaagggagcagctacaggcgcttgctggaagacctgatttgtttggtcttggcagtagagtcatcatcacgactcgggacaaacaattgctagcatgtcacggtgttgaacgaacatatgaggtgaatgaattgaacgaggaacatgctcttgaattacttagttggaaagctttcaagttggaaaaagttgatccattttacaaggatgttctgaatcgagcagcaacttatgcttcgggcctgcctctcgcctt

SEQ ID NO: 36687 - DNA, 557 bp, Triticum aestivum
  Clone ID: PAT_TA_36687
atagtctccttaccagagctagctagcatcaatggcttctggtgctcagaagaagatggttgccgtcggcatgatgctggccatcctgttcatcgctgcagctcatgcagaaccagcgcctgcagaaacttgcatcgacaagaccgaaaaagttggtcttgtcactgactgcatctgctccaagaactgtgcttgtgcaggaaagtgcatcttagaaggcggcgagggtggcgaaatccagaagtgctttgtcgaatgcgtgctgaaaaatgactgcaactgcaatgctaagcaccacagtgccgcagcccctcagtaaggagactcctgattggagcttcttcagccatgctatgaggcctgcgtccacaagtccacagtcaacatttgagtaaattaataaacctcttatacctgcgttcttggcatgcgcttattgcttgcagcgaatgtatgttgagagttggtttcccggtcacagctcatatacatgctgccagtcacgtgtacgacgactgccacatgtattgctggaaatgaatatgtatgtgtatttg

SEQ ID NO: 36688 - DNA, 1243 bp, Triticum aestivum
  Clone ID: PAT_TA_36688
gtaaacacatcagcactagtagatttcacgagtcagaagctcagcgcaagatggagaaccaggcacacatcgccggcgagaagaagggcatcatggagaagatcaaggagaagctccccggcggccacggcgaccacaaggagaccgctggtacccacgggcacgccgccacggcgacgcatggtgccccggccaccggtggtgcctacgggcagcagggtcacgctggaaccaccggcacggggttgcatggcgcccacgccggcgagaagaagggcgtgatggagaacatcaaggacaagctccctggtggccacgaggaccaccagcagaccggtggccactacgggcagcagggacacgccggcacggcgacgcatggcaccccggctaccgctggcacctatgggcaacaggggcataccggcacggcgacgcatggcaccccagcgaccggtggcacctatggggagcagggacacaccggagtgaccggcacggggacgcacggcaccggcgagaagaagggcctcatggagaacatcaaggagaagctccctggtggccatggtgaccaccagcagaccgctggcacctacgggcagcagggacacgtcggcacggggacacatggcgccccggctaccggcggggcctacgggcagcatgaacacgccggagtggccggcgcgggaacatacggcaccggcgagaagaagggcgtcatggagaacatcaaggacaagctccctggcggccacggcgaccaccagcagaccggtggcacctacgggcagcagggacacaccggcacggcgacgcatggcaccccggccggcggcggcacctatgagcagcacggacacaccgggatgaccggcacggggacacacggcaccggcgagaagaagggcgtcatggagaacatcaaggagaagctccccggtggccacggcgaccaccagcagaccggtggagcctacgggcagcagggacacaccggcacggcgacgcatggcactccggctggcggcggcacctacgggcagcatgcacacactggaatgaccggcacggagacgcacggcaccacggccaccggcggcacccatgggcagcacggacacgccggaacgactggcactgggacacacggcaccgacggggtgggcgagaagaagagcctcatggacaagatcaaggacaagctgcctggacagcactgagcccggtgtgccgacgg

SEQ ID NO: 36689 - DNA, 369 bp, Triticum aestivum
  Clone ID: PAT_TA_36689
atgtccatggcgtcctcctcaagcagcagcttgctggccatggcggtgctggcggcgctgtttgccggcgcgtggtgcgtcccgaaggtgacgttcacggtggagaaggggtccaacgagaagcacctggcggtgctggtgaagtacgagggggacaccatggcggaggtggagctccgggagcacggctccgacgagtgggtcgccatgaccaagggggagggcggcgtgtggacgttcgacagcgaggagccgctccaggggcccttcaacttccggttcctcaccgagaagggcatgaagaacgtcttcgacgacgtcgtcccagagaagtacaccattggggccacctacgcgccagaagagtag

SEQ ID NO: 36690 - DNA, 1079 bp, Triticum aestivum
  Clone ID: PAT_TA_36690
gcacgagaagaaccgcttagctgcaattcgtagcacatcggcttccaagttccaacgatctcgtagacactctctcgtttcaattctcgagcgacttttaatctttcaaagtgcaatggctgctgcgaatgcccccttcgctctcagtcgcctctccccggccgcgcgcctgccgatccgtgcctggagagccgcgaggccggccccggtctggaccgggagaacccgcccgctctccgtggcctccgcggcgcaagagaatagggacaactccgtcgacgtccaagtcagccaggcccagaacggcggcaaccagcagggcaacgctgtccagcgccggccgcgccgcgccggatttgacatctccccgttcgggctagtggacccgatgtcgccgatgaggacgatgcggcagatgctggacacgatggaccggctgttcgatgacgccgtagggttccccacggcgcggcgctcgccggcggcggctagcgagatgccgcggatgccgtgggacatcatggaggacgacaaggaggtgaagatgcggttcgacatgcccgggctgtcgcggaaggaggtgaaggtgatggtggagggcgacgcgctcgtcatccgcggcgagcacaagaaggaggccggcgaagggcaggtcgaaggcggcgacgggtggtggaaggagcgcagcgtgagctcctacgacatgcgcctggctctgccagacgagtgcgacaagagccaggtgcgcgccgagctcaagaacggcgtgctgctcgtgtccgtgcccaagagggagaccgagcgcaaggtcatcgacgtgcaggtccagtgatgagtgtgtgtgagactctacccagtaccctgcatctgaggctttaagatttcagctgtccgaggtgtgaccgtgcgagtgcgtgctctttgtaggcgtagtgtgccgttcttctccgatcctctctgcgcgcacgttgcgcagaacatgtcgtgctgtatgtaaatgtacttggcaaatctatgaataaatgttcggctgcttgatcagctggatacacttcgattaaaaaaaaaaaaaaaaaaaa

SEQ ID NO: 36691 - DNA, 223 bp, Triticum aestivum
  Clone ID: PAT_TA_36691
aggaaaaagttgctatattcgtcaagttgcactaattactattatggcccaggttggttcctttgtaccagcttcatcagcaacacttcatgttgttgatggaatttatactcggatgggtgcatctgacagtattcaacaaggaacaagtaccttttatgaagagatgaatgaagcttccagcatattacagaactgctcatctcgatccctagttatcatt

SEQ ID NO: 36692 - DNA, 223 bp, Triticum aestivum
  Clone ID: PAT_TA_36692
tggaaaatccacttttatacgtcaggttggcgtaaatgtcttgatggcacaagttggttcctttgttccttgtgatcaggcaagcattagtgtgagagattgtatttttgctcgtgttggtgctggtgattgccaactccgtggtgtttcaacctttatgcaagagatgcttgaaacagcatccattttgaaaggtgcatctgagaaatctctcataattatc

SEQ ID NO: 36693 - DNA, 1646 bp, Triticum aestivum
  Clone ID: PAT_TA_36693
ccgtccgctcccctctcgccgccgattgttctgcctgcgggaaccatctcatatctcggcgaagatgagggaaatcctgcacatccagggtgggcaatgtggcaaccagatcggtgccaagttctgggaggtggtgtgtgatgagcatggcattgacccaactgggcgctacaccggtacctctgacctgcagttggagcgtgtcaatgtctactacaatgaggcctcgtgtggtcgctttgtgccccgtgctgttcttatggaccttgagcccggtaccatggacagtgtccgcactgggccttatgggcagatcttccgccctgacaactttgtctttgggcaatctggtgcgggtaacaactgggccaagggccactacaccgagggtgctgagcttatcgattctgttttggatgttgtgaggaaggaggctgagaactgtgactgtctgcaaggattccaagtatgccactctcttggtggtggtaccggatctggcatgggtaccctcttgatatctaaaatcagggaggagtaccctgaccgcatgatgctgacgttctcagtgttcccctcaccaaaagtatctgatactgtggttgagccatacaatgcaactctctcagtccatcagctggttgagaatgctgatgagtgcatggttcttgacaacgaggctctgtatgacatctgtttcaggactcttaagctgaccacacctagctttggggacttgaaccatctaatctctgctaccatgagtggagtcacctgctgcctaaggttccctggtcagctgaattccgacctccggaagctggcagtgaaccttatcccattccctcgcctccacttcttcatggtgggcttcgctccattgacatcccgtgggtctcagcagtaccgtgccctcacggtcccagagctcacacagcaaatgtgggatgccaagaacatgatgtgcgccgccgatcctcgtcatggccgttacctcaccgcctctgccatgttccgtggaaagatgagcacaaaggaggtggacgagcagatgatcaacgtccagaacaagaactcgtcctactttgtggagtggatccccaacaatgtcaagtccagcgtctgtgacatcccgccgacggggctctccatggcgtccaccttcgttggcaactcgacctccatccaggagatgttccggagggtgagcgaacagttcacttccatgttcaggaggaaggcttttcttcattggtacactggtgaaggcatggacgagatggagttcaccgaggcggagagcaacatgaacgacctcgtctcggagtaccagcagtaccaggatgccacttctgacgaggagggcgagtacgaggatgaggatcaggagcctgaggaggacatgtaaggtgggatgtccatgtcgtgctttgctgggtgggggttctgggggcagagtttgatctgtttggtgctttgttataaatctgtttatcatcccaactaccgcttgtacgccacccccattcttcctgcctttcctaagctctgtatttcctatgttatggcaccttttcggtattgtatcacttgatgccgtgcggtaaaaaaaaaaaaaaaaaaaaaaaaaaaaaaaaaaaaaaaaa

SEQ ID NO: 36694 - DNA, 1067 bp, Triticum aestivum
  Clone ID: PAT_TA_36694
gaattcaaataactcacgcgatctccgcatactgcagaggattgttcaaaaatacgatatcgagttcctctttctgctttcaaccatcaacgcgtaataagccacctgtgcaactttcagggccacccaacaaaataacaaccgttccgaacccttagtgcgaaacgcctttcaacagcaccatgtcgaagcgagccaccagaagcgtgtccggtggcctggataaggaacctaggcttcctacgtcccaaaagcagaaaacgctgctctccgcagacgttggccatttctccctcgttcgtgccctgcacatggcggatctgattacgcttatgaacgggttctgtggtgtgatgtctgtgttctcgtcgctgcgatactgcctcggcgccccggacaaccacagcaacgtgtggttggcactctacttcctccctttcggcctttttttcgatttcttcgacggcaaggtagcgcgctggaggaacaagagcagtctgatgggccaggagcttgattcgctagccgacttgatttcttttggcgttgccccagccatggttgccttttccattggcctgcgcacgtttgcagatacggtcggccttacgttctttgtgctttgcggcctcactcgtctggctcgattcaatgttactgtcgctgtgcttcccaaggacgctacaggaaagagtaaatacttcgagggcacgccaattcccacgtctttggttttggatggtgtcatggcatactgggtgtacaatggcctcattctggacaatgtaccgttcggcgtgctcgctgaagggactatgttggaggtccaccctgccgttttgctcttcatgattcatgggtgtttgatgaccagcaaaactatccgcatacccaagccttagggtacttctgccaaagcatggattgtgctatctacccataaggccctactggttctgcacacacagcctctggctggttcatgacgcaggtacgcagggccagtgccacactttttagatacacgacaccttgaataacctttccacttgaaaaaaaaaaaaaaa

SEQ ID NO: 36695 - DNA, 1436 bp, Triticum aestivum
  Clone ID: PAT_TA_36695
ggaacacgtgactttgggagagagcaaatggccataagggagcgcgcgttttcaataattacaagtgtatttaagatgcacggtggtgttgcacttgatacccctgtattcgagttgagagaaaccttgatgggcaaatatggtgaagactccaagttggtatatgaccttgctgatcagggtggtgagctttgttcgttgcgctatgatctgactgttccatttgcccgttatgttgccatgaataacataagtgccatcaagagataccagatagccaaagtatacaggagagataacccttcaaagggaagatatcgagaattctaccagtgtgacttcgacattgccggagtatatgagcctatggaaccagatttcgaggttgtcaaagttttgactgaattactggataagttggatattggcgtctatgagataaagttaaatcacagaaagttacttgatggaatgttggagatctgtggtgtgcctgctgagaaattcagaacagtttgctcaagtattgacaagctagacaaactaacctttgaagaggtgaaaaaagaactggtggaagagaaaggtgtatcaaatgaaaccgctgaaaatattggcagtttagtgaagacaaaaggacctccactagaagttttgctagagttgcgaaaggagggcagcaagttcatggagaacgaggggtctgttgttgcattaaatgagctggagatattattcaaagctctagaaaaagcgaatgcccttgacaggataagttttgatttaagccttgctagaggccttgattactacactggtgtgatatatgaagctgtgttcaagggcgtcacacaggttggctctattgctgctggtggcaggtacgacaagcttgtcggcatgttcagcaacaagcaagtccctgctgttggcgtcagccttggaatagaaagagtttttgctatcatggagcaacaggagaaagaaaagaaccaggtgatccgggccaccgagacggaggttttggtgtcgattctgggcaaggacctcatattggccgccgagcttgtgaacgagctgtggagtgctgggataaaggcagagttcaagctcaccaccagggtgcagaaccacataaagtatgcgacgcagacaggcatcccgtggatggtgctggtcggcgagtccgagttgagggacgggaaggtgaaactgaaggacattagggctaaccaggaagaggaggttccaaggaaagatttcgttgaggtgctgaagcagagattatctaacccttagagatgaaatcttcgaaagatgtagaatgtgtgtgactgggcgatacatcgttgttggttttcttgtgcatccattttgctgatgctgagatgtgtacacaagacggtgcggctccttgatttaatactgatgatcac

SEQ ID NO: 36696 - DNA, 791 bp, Triticum aestivum
  Clone ID: PAT_TA_36696
ccccgctaagcatcagcattcagcagcacctcccttctacctcctctgctttgcattcctccttccggtttcaaccgcaatcaatggctgccatgaagatcaccctccttgccgtggccgcgatggccgccttattaggcaccgcgtcagcggtaacctacaacgtcggcgagcagggcggttggaccctcaacaccgactacagcagctgggtgtccggcaagaagttcaacgtgggtgatgagatcgtcttcaagtactcgtccgccgcgcacgatgtggtggaggtcagcaaggccggctacgactcctgcagcatcgacggcgccatcaacaccttcaagtccggcaacgacgtcatccccctcagcgccaccggcacccgctacttcatctgcggcatcactggccactgcagccccaccgccgcggccagcatgaaggtcatgatcgacgtcgcctcgggctcctcttcgccgtcctcacccatgccagccgcaggtcctggcgcgagcaactctcccccggcgccaccctcctccgccgctacctccgtcggtgccacagcaggatttggcctcgtcgccctactggcggctggtctcatggcttgaacgcatatattgatcagctgccacgcgcacatatgagcttatatattgttaaccactgctgtagtcattatcacggatgaatacatgtattcttttttagagtgagaatgtgatagttacttgtatctatcacgtctatatgtaatctgcagaccttcatgtcttttatataatcat

SEQ ID NO: 36697 - DNA, 2032 bp, Triticum aestivum
  Clone ID: PAT_TA_36697
gataaagaaaatcaagaaccgtatgcacaccatgctcgcgaccacgccgtcgtcgtcaggggtcaagttacagccatgggggagttgccggagaagggcggcatcacctgctcttcttccagcgacggccaccggaagaatcatcgtcgattccgggaggatgcctccctcccctcttcctctacgagctgtcgcctccgagagcgcgcagacctctcgtgcaccacagccacagcctccgccgatggatgtcgacgaggagaagatgctggccaactacgtcccggtgttcgtcatgctccccctagaagcgatcaccgccgagaacaaggtgggtgacgctgagggcctgagggcgcagctgcggcggctgagggaggccggcgtcgacggcatcatggcggacgtgtggtggggcatcgtggagggcgccgggccggggcggtacgagtggcgcgcgtacagggagctcttccggttggcgcaggaggaaggcctgaagctgcaggtcatcatgtcgttccacgcgtgcggcggcaacgtcggcgacgccgtgaacatcccgataccggcgtgggtgcgcgacgtcggcgaggcggacccggacgtgtactacactagccccggcggggcccggaaccaggagtacctcaccatcggcgtggacgatcggcccttgttccacggcagaaccgccatccagctctacgcggatttcatggagagcttcagagagaacatggcggacttgttggagtgtggcctgatcgtggacatagaggttgggcttggccctgccggcgagctgaggtacccatcctacccggagagccaggggtgggcgttccccggcatcgggcagttccaatgctacgacaagtacctagaggaggatttcagagcggcagcgacggatgccggacacccggagtgggagctccctgacgacgccggggaatacaacgacgcccctgacgacacgcgcttcttcacggcggacggcgccggcgcgacgtacctcaccgagaaggggaggttcttccttacatggtactccagcaagctgatcgaccacggcgacaggatactggacgaagccaacagggtcttcctgggctgcactgtcaagctcgccgcaaaggtgtcggggatacactggtggtacaggcacccgagccacgccgcggagctcaccgccgggtactacaacgtcgacggccgggacggctaccggccgatcgcgcgcatgctggcgcggcacgacggcgccgtcctcaacttcacctgcgcggagatgcggaactcggagcaggccgaggaggccatgagcgccccggaggagctcgtccagcaggtgctgagcgccgggtggagagaggggaccgaggtggcgtgcgagaacgcgctgcccaggtacgaccggcgggcgtacaaccagatgctgaagaacgcgcgtcccaacggcgtcgacctcggcggcgtcccggcgcgccgcgtcgccgcggtgacgtacctcaggctcacggacgaactcctggccgggagcaagtaccgggccttcaaaaccttcgtcaggaaaatgcacgctgatcaggattactgtgccgatccggcccagtaccatcggcccctgaagcctttggagcggtcgaggccggcggtacccatggaccggctgctggacgcgacgacgccggaggcgtacccgttcgatcccgagacggacatgagcgtcggcggcgacctcgcggggctcatcgacagggtgttcgacaagatcgaatggatattgggttgaaaatgccgctttttccccccgcaaaaaaagataatgccgctctttgtaaccaccccggcaaatcgggtgggtcgatacacgcacgcttgccgtaactagtaggccaatgatcgtagtagcggacgtctctcactctcagcaatatgtccaccaaaaagaatagtaattcattcgtgggatactaatacaagaagcacgcattgtttaaaaaaaaaaaaaaaaaaaaaaaaaaaa

SEQ ID NO: 36698 - DNA, 292 bp, Triticum aestivum
  Clone ID: PAT_TA_36698
aattacttatatatattatccatccggatatcacaatcgatgccggtacatggcaaagagtctcgccgtcgcgctcctcctactggtggcgctcgcgtactgcgacgggagggagctgaaccagaaggatcaggcactagcaacggcacgcggtgccggtgctggtggtgctgtcgacgagtccaaagcactagggctgccagacctgccgcttgtcggaaccgttaccggtaccagcaccattaccggcccgctggtggtgcttcctgggatccctgctctcggcccatga

SEQ ID NO: 36699 - DNA, 2028 bp, Triticum aestivum
  Clone ID: PAT_TA_36699
gctgcaggtagccacaccctgcgcgcgccatggcggctctggtcacgtcccagctcgccacctccggcaccgtcctcggcatcaccgacaggttccggcgtgcaggtttccagggcgtgaggccccggagcccggcggatgcggctctcggcatgaggaccgtcggagctagcgccgccccaacgcaaagccggaaagcgcaccgcgggacccggcggtgcctctccatggtggtgcgcgccaccggcagcggcggcatgaacctcgtgttcgtcggcgccgagatggcgccctggagcaagaccggcggcctcggcgacgtcctcgggggcctccccccagccatggccgccaacggccaccgggtcatggtcatctccccgcgctacgaccagtacaaggacgcctgggacaccagcgtcgtctccgagatcaaggtcgttgacaagtacgagagggtgaggtacttccactgctacaagcgcggggtggaccgcgtgttcgtcgaccacccgtgcttcctggagaaggtccggggcaagaccaaggagaagatctacgggcccgacgccggcacggactacgaggacaaccagcagcgcttcagccttctctgccaggcggcgctggaagtgccgaggatcctgaacctcgacaataacccctacttttctgggccctacggggaggacgtggtgttcgtgtgcaatgactggcacacgggccttctggcctgctacctcaagagcaactaccagtccaatggcatctacagggccgcaaaggtggcattctgcatccacaacatctcgtaccagggccgcttctccttcgacgacttcgcgcagctcaacctgcccgacaggttcaagtcgtccttcgacttcatcgacggctacgacaagccggtggaggggcgcaagatcaactggatgaaggccgggatcctgcaggccgacaaggtgctgacggtgagcccctactacgcggaggagctcatctctggcgaagccaggggctgcgagctcgacaacatcatgcgcctcactgggatcaccggcatcgtcaacggcatggatgttagcgagtgggaccccaccaaggacaagttcctcgccgtcaactacgacatcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcctgaaggaggaggacgtccagatcgttcttctgggcaccgggaagaagaagttcgagcggctactcaagagcattgaggagaaattcccgagcaaggtgagggccgtggtcaggttcaacgcgccgctggctcaccagatgatggccggcgccgacgtgctcgccgtcaccagccgcttcgagccctgcggcctcatccagctccaggggatgcgctacggaacgccgtgcgcgtgcgcgtccaccggcgggcttgtcgacacgatcgtggagggcaagaccgggttccacatgggccggctcagtgtcgattgcaacgtggtggagccggccgacgtgaagaaggtggtgaccaccctgaagcgcgccgtcaaggtcgtcggcacgccggcataccatgagatggtcaagaactgcatgatacaggatctctcctggaaggggccagcctggaaggtaagtcgatgaccgccaagatcaatgcgacacaaccaggaaatgacagatgaccgccaagatcaacgcacacaacaaatgacgcaaggggagcgatcatggctgaaacagcttcactattttccttgctagtacagtactacttgctcagtttgctgttaaactgtgagtctgtgacgcactaaacttatttaataagttgtgcagcagcaacttatttaatgtaagtcatgcaaagagccagcttctaaatacttcctaaaatacaaaaaaaaaaaaaaaaaaa

SEQ ID NO: 36700 - DNA, 2687 bp, Triticum aestivum
  Clone ID: PAT_TA_36700
atcgacgaagatgctctgcctcaccgccccctcctgctcgccatctctcccgccgcgcccctcccgtcccgctgctgaccggcccggaccggggatttcggccaagagcaagttctctgttcccgtgtctgcgccaagagactacaccatggcaacagctgaagatggtgttggcgaccttccgatatacgatctggatccgaagtttgccggcttcaaggaacacttcagttataggatgaaaaagtaccttgaccagaaacattcgattgagaagcacgagggaggccttgaagagttctctaaaggctatttgaagtttgggatcaacacagaaaatgacgcaactgtgtaccgggaatgggcccctgcagcaatggatgcacaacttattggtgacttcaacaactggaatggctctgggcacaggatgacaaaggataattatggtgtttggtcaatcaggatttcccatgtcaatgggaaacctgccatcccccataattccaaggttaaatttcgatttcaccgtggagatggactatgggtcgatcgggttcctgcatggattcgttatgcaacttttgacgcctctaaatttggagctccatatgacggtgttcactgggatccaccttctggtgaaaggtatgtgtttaagcatcctcggcctcgaaagcctgacgctccacgtatttacgaggctcatgtggggatgagtggtgagaggcctgaagtaagcacatacagagaatttgcagacaatgtgttaccgcgcataaaggcaaacaactacaacacagttcagctgatggcaatcatggaacattccatattatgcttcttttggtaccatgtgacgaatttcttcgcagttagcagcagatcaggaacaccagaggacctcaaatatcttgttgacaaggcacatagcttagggttgcgtgttctgatggatgttgtccatagccatgcgagcagtaatatgacagatggtctaaatggctatgatgttggacaaaacacacaggagtcctatttccatacaggagaaaggggttatcataaactgtgggatagtcgcctgttcaactatgccaattgggaggtcttacggtatcttctttctaatctgagatattggatggacgaattcatgtttgacggcttccgatttgatggagtaacatccatgctatataatcaccatggtatcaatatgtcattcgctggaaattacaaggaatattttggtttggataccgatgtagatgcagttgtttacatgatgcttgcgaaccatttaatgcacaaaatcttgccagaagcaactgttgttgcagaagatgtttcaggcatgccagtgctttgtcggtcagttgatgaaggtggagtagggtttgactatcgccttgctatggctattcctgatagatggattgactacttgaagaacaaagatgaccttgaatggtcaatgagtgcaatagcacatactctgaccaacaggagatatacggaaaagtgcattgcatatgctgagagccacgatcagtctattgttggcgacaagactatggcatttctcttgatggacaaggaaatgtatactggcatgtcagacttgcagcctgcttcacctacaattgatcgtggaattgcacttcaaaagatgattcacttcatcaccatggcccttggaggtgatggctacttgaattttatgggtaatgagtttggccacccagaatggattgactttccaagagaaggcaacaactggagttatgataaatgcagacgccagtggagcctctcagacattgatcacctacgatacaagtacatgaacgcatttgatcaagcaatgaatgcgctcgacgacaagttttccttcctatcgtcatcaaagcagattgtcagcgacatgaatgaggaaaagaagattattgtatttgaacgtggagatctggtcttcgtcttcaattttcatcccagtaaaacttatgatggttacaaagtcggatgtgatttgcctgggaagtacaaggtagctctggactccgatgctctgatgtttggtggacatggaagagtggcccagtacaacgatcacttcacgtcacctgaaggagtaccaggagtacctgaaacaaacttcaacaaccgccctaattcattcaaagtcctgtctccaccccgcacttgtgtggcttactatcgcgtcgaggaaaaagcggaaaagcctaaggatgaaggagctgcttcttggggcaaagctgctcctgggtacatcgatgttgaagccactcgtgtcaaagacgcagcagatggtgaggcgacttctggttccaaaaaggcgtctacaggaggtgactccagcaagaagggaattaactttgtcttcgggtcacctgacaaagataacaaataagcaccatatcaacgcttgatcagaaccgtgtaccgacgtccttgtaatattcctgctattgctagtagtagcaatactgtcaaactgtgcagacttgagattctggcttggactttgctgaggttacctactatatagaaagataaataagaggtgatggtgcgggtcgagtccggctatatgtgccaaatatgcgccatcccgagtcctctgtcataaaggaagtttcgggctttcagcccagaataaaaaa

SEQ ID NO: 36701 - DNA, 945 bp, Triticum aestivum
  Clone ID: PAT_TA_36701
gcggccgcggaaagggaccagtacccgaaagcggcgagccggcgagccgccaccgccccccgcctcccctcgcccccgcgcgcggtatcctccccgccactccacccagcggccgcagcgccccgcagatcgacccctcacgcgcgcgcgcgcgccatggcgtcctcctccgcgacgtccggcgacgaccggccgccggccgccgggggcgggggcgggacccccgcgcaggcgcacgcggagtgggccgcctcgatgcacgcgtactacgcggccgccgcctccgccgccgggcacccctacgccgcgtggccgctgccgccgcaggcacagcagcacggcctggtggcggccgggccgggggcggcgtacggcgcgccggtgccgttccccatgtaccaccaccccgcggcggcgtactacgcgcacgcgcacgcctccatggccgcgggggtgccttacatggccggcgagtctgcgtcggcggcggggaaagggaagagggcggggaagacacggcgtgtcccttccggcgagatcaattccagttccgggagcggggatgccgggagccaggggtcatctgagaagggaaacgccggcgccaatcagaagggctcatcatcatccgcgaagaggaggaagtccggcgctgcaaatacagaaggtgagccatctcaggctaccacagtgcagaatgctgtaaccgagccgccattggaagacaaggagaggtctgcatccaaactgttggttttggcacctgggagggcggcactcaccagtgctgcaccaaacttgaatattgggatggatcccttgagcgcttctccatcctccttagtacagggggaggtgaacgccgcagcttcttcccagagtaacgcttcgctgtctcagatggatgaacgggaactgaagagggagagaaggaaacaatccaac

SEQ ID NO: 36702 - DNA, 772 bp, Triticum aestivum
  Clone ID: PAT_TA_36702
ccatcagatatcacttcccttgatgcagtaataagtttgaatttatcatcaaaccatctgagcggaatgattccaaatgatattggtgccttgcattcattggaatctcttgacctctccatgaacaagcttactagtgaaatcccatcgagtttatcaagtttgacatccctgagttacttgaacttgtcctacaacaatttatctggaaggataccctcaagccgccaacttggcaccctcaatgtagacaacccagcacttatgtacattggcaacagtggactttgtgggcctcctctccagaagaattgttcaggaaatgatacgggcactagtcatgttggaagcaacaaccatgaggaatttgaactgatgaccttcaaatttggtcttgtcctgggacttgtggcggggctttggagtgtgtcctgtgcacttttgttcaagaaggcatggaggacagcttattttcaactctttgatgagatgtatgatgcagaatctatgtatacgtggttgtgaaatgggcaagcttggtaaggaaaacagatgaaaatgaacaagttgccctgaaggagccaatgtctgtgccacgaccaatagaatgggggctctatacacaacgcgttgtctagctagcgtgccttgcctaattttttatattctgaataaagatggagatgttgattagtccttcttatacatgtaaaacttcagatgttataaatcagaacttcaatgaccagttattttggtgaataaggaattt

SEQ ID NO: 36703 - DNA, 592 bp, Triticum aestivum
  Clone ID: PAT_TA_36703
ctgcctcccagcgaaacaccacacctctcctcgtcgaagcagcagcagcagccgcggcatccatggcccccaaggcggagaagaagccggtggcggagaaggccgagaagacgacggcggcgaagaagaccaaggccgagaagcggccgccggcgtccaaggagggcggcgacaagaaggggaagaagaagtcgaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatggtactctgtaatagtcaggtgttcggaccatgtcgtcttgtaactgtttcattatcttgtgaaatagtaatggcgcttca

SEQ ID NO: 36704 - DNA, 3058 bp, Triticum aestivum
  Clone ID: PAT_TA_36704
tcggcacgaggaagaagacaccaaggcgaatcccccccaatcgccattgccagttccgttgcagttaatccgtagctcgcagaagcggaagccatgaatcccgacaagttcacgcacaagaccaatgaggcgctcgcggcggcgcacgagatggcgtccgaggccggccacgcgcagctcacgccgctgcacctcgccgcggcgctcgcggcggacaggtcgggcatcctccgccaggccatcgcccacgcgtccggcggcaacgacgccgcggccgagtcgttcgagcgcgtcgcgtccgccgcgctcaagcggctgccctcgcagtccccgccgcccgacaccgtcccggcctccacctcgctggtcaaggccgtccgccgcgcgcagtcggcgcagaagtcgcgcggcgactcgcacctcgccgtcgaccagctgctcatgggcctcctcgaggacccgcagatctccgacgcgctcaaggaggccggcatctccgctgcgcgggtgaaggccgaggtcgagaagctccggggaggcgacaaccggcgcgtggagtccgcgtcgggggacaccaacttccaggccctcaagacgtacggccgcgacctcgtggaggtggcgggcaagctggacccggtcatcggccgcgacgaggagatccggcgcgtggtgcggatcctgtcgcggcgcacaaagaacaaccccgtcctcatcggcgagcccggcgtgggcaagaccgccgtggtggaggggctcgcgcagcgcgtcgtgcgcggcgacgtccccagcaacctcctggacgtgcgcctggtcgcgctcgacatgggcgcgctcgtggccggcgccaagtaccgcggcgagttcgaggagcggctcaaggccgtgctcaaggaggtggaggaggccgaggggaaggtgatactgttcatcgacgagatacacctggtgctcggcgccgggcggacggaggggtcaatggacgcggccaacctgttcaagccgatgctggcgagggggcagctcaggtgcattggcgcgacgaccctcgaggagtacaggaagtacgtcgagaaggacgccgcgttcgagaggcggttccagcaggtgttcgtggcggagcccagcgtcccggacaccgtcagcatactcagagggctcaaggagaagtacgaggggcaccatggcgtgaggattcaggaccgcgcgctcgtcattgccgcgcagctctcgtcgaggtacatcatgggtcgccatttgcctgataaagcaatcgatttggttgacgaggcctgcgcaaatgtgagggtgcaacttgacagccagcctgaagagatcgacaacctcgagaggaagaggatccagttggaagtcgagctccatgccctcgagaaggagaaggacaaggctagcaaagctcggctagttgatgtgaggaaagagttggacgatctgagagacaagctgcagccgctgcagatgaagtatcgcaaggagaaagagaggatcgacgagatcaggagcctgaagcagcgccgcgaagagctgcagttcactctgcaggaggccgagcgccggatggatttggcccgcgtggctgatctcagatacggtgctctgcaggaggttgacgctgccattgctaagctggagggtgagaccggcgagaatttgatgttaacagagactgtcggcccggaccagattgctgaggtggtgagccgctggactggtattcctgtcaccaggctcggacagaatgagaaggcgaggctgatcgggctggcagatcgactgcatcagagggtcgttggacagtatgaggccgtcaatgcagttggagaggctgttctacggtcgagggctggccttggacgcccgcagcagcctactggttcattcctcttccttggaccgaccggtgtcggaaaaaccgagctcgccaaggctctagctgagcagctgtttgatgacgagaacctgctcgtccgcatcgacatgtctgaatacatggagcagcattcggttgcccggctaatcggagccccacctggatatgttggtcatgaagaaggggggcagctgaccgagcaagtgaggaggaggccatacagtgtcatcctcttcgacgaggttgagaaggcgcatgtggcggtgttcaacactctgctccaggtcctggacgatgggcggttgaccgacgggcaaggcaggacggttgattttaggaacacggtgatcatcatgacctcaaaccttggcgcggagcacctcctcgccggaatggtgggcaattcgatgaaggttgctcgtgatctggtcatgcaggaggtgaggaggcatttccgcccggagctgctgaaccgtctggacgagatcgtcatcttcgaccctctgtcgcatgagcagctgcggaaggtcgctcggcttcagatgaaagatgtggcagtccgtcttgccgagaggggcgttgctctggccgtcaccgacgccgccctggacgtcatcctgtcactgtcttacgatccggtctatggcgccaggccaatccggagatggatcgagaagaggatagtgacggagctctccaagatgttgatccgcgaggagatcgacgagaactccacggtgtacatcgacgctgcgcccagcaaggacgagctgacctatggcgtcgacaagcacggagggctggtgaacgcgcgcacgggccacaagtccgacatcctgatccaggttcctagcggagctgttgggggcgatgcggcgcacgccgtgaagaagatgaagatcatgcaggacagcggagaggtggacgacatggaggaagagtagatggaaaccgcatcgattgatccctttctgactgtagttccaagtgcctgcaccaggcagtcgtatgagctctgtttttgcttttggaccgtgctgatttaggtagttcggaatcgtatctgttgaattgggggtgaaatgaattgtagttgaggatggaaaaaaaaaaaaaaaaaaaaaaaaaaaaaaaaaaaaaaaaaaaaaaaaaaaaaaaaaaaaaaaa

SEQ ID NO: 36705 - DNA, 1499 bp, Triticum aestivum
  Clone ID: PAT_TA_36705
gattccgctcaaggcaaggcaggcaggagctagctcggggacagcgtcgccgggagagctcgatcgctgcaccactacatcactagagatagcccatggaggagatcggccaccacttcgggctgggagccaccgcccacggccagcaccacagccagctcccatggggctcttcgccgctcagcgccgtcatcgcgccgcccccacagcaacagcagcagcagcagcagtccgccggctatctggcgcacagccccctctccctgaacacggcgccgcccagtggaagccacggcggcggcagcgggtgtagcaacccggtgctgcagctggccaacggcagcctcctggaggcgtgcgccaaggcggccaaggagccgtcgtcgtcgtcctacgccgccgacgtcgaggccatcaaggccaagatcatctcccacccccactactcctccctcctcgccgcctacctcgactgccagaaggtgggggcgccgccggaggtgttggcgagattgacggcggtggcgcaggacctggagctgcgacagcgcacggcgctcggcagcctcggcaccgcgacggagccggagctggaccagttcatggaggcgtaccatgagatgctggtgaagtaccgggaggagctgacgaggccgctgcaggaggccatggagttcctgaggagggtggagacgcaactcaactccctctccatctccggcagatcgctgcgcaatatcctttcctccggctcatctgaggaagatcaagaaggtagcggaggagagacagagcttcctgagattgatgcccacggcgtggaccaggagctgaagcaccatctcctgaagaagtacagtgggtacctgagctccctcaagcaagagctgtcaaagaagaagaagaaaggaaagctcccgaaggatgctcgccagcagctcctcagctggtgggagatgcactacaaatggccttatccctcggagagccagaaggtggcgctggccgagtcgacgggcctggacctgaagcagatcaacaactggttcatcaaccagaggaagcgccactggaagccgtcggacgagatgcagttcgtcatgatggacgcgtaccacccccctaacgccgccttctacatggacggccacttcgtcaacgacagcgggctctacaggttcggctagctcggccaggcctcgtctcttgccggtcaccttggtcggcgccaatggcggcgactgagtgccttatgctgaagcacttggggaccgacgaccgaagctagttaagttagcgtttgtgtgccgcatgcgagctggaaggaggccgcatgcgagctggaaggaggccgcatgcttattttgtttatcatcactacttatacctacctacctatcatttatgcatggactcgatcgcttttgtgtggttttgtagcgattgacgcgaccatatggacaaccgcctgtttgctgcgaaaaaaaaaaaaaaaaaaa

SEQ ID NO: 36706 - DNA, 837 bp, Triticum aestivum
  Clone ID: PAT_TA_36706
cctccttgtttctcctcgccgtgcttcttgcgctggtctcatggcaggccactgcctatgatcctagccctctgcaagacttctgcgtcgccgacatgaagtcacctgtgcgagtaaatggatttccttgcaaggacccaatggccgtcaacccggaagatttcttcaatccagccatgcttgaccaacctagggatactaagaacagcaaggttgggtccaacgtcaccaacattaacgtcatcaactttcctggcctcaacacccttggtatctcgctggcacgcatcgactatggaccattgggcgtgaacaccccgcatatacatccccgtgccactgagctccttactgtgcttgagggaactctctaccttggatttgtcacatccaacccaaataggctcttctccagggtggtcaagaagggtgacgtatttgtgttcccgaaggcaatgatccacttccaaatgaatctagcgcatgacaagccagcagctgcgttgtcgtcactcagcagccaaaacccaggagttatttctattgccaatgcagtctttggatcaaacccacccatttcggatgatgttttggccacggcgtttcaggtggaaaagaaactgattgattggctccaatctcagttctgggagaataaccactactaatatgttgtagtgtttacacctataaatagtataaagaataaatgatcatttccttttgaatcgtgacaatatatgttgtttgttggattgatatagtaatatggtgacagtgtaagcatttggttgtttaataaatggaatacagtggtgtcctcttccctcgtaactg

SEQ ID NO: 36707 - DNA, 755 bp, Triticum aestivum
  Clone ID: PAT_TA_36707
gccggcgacaggccgagggtgtgggacccggcgagggtgacgttgaggaagtagcactccttggccctcgccgaccgctcgccgtgctagtcgggccgcatggtccgcgacgacctccgcgacacgggccgcttgtgctcggtcaagtggttgcactgctgcctgtagctggactcgtgcggccaccacgacctgttgttgatgatgttcgaccacgtcgagttggacccggacgtgaagaggctgctggtcgagtaggcgttgcggtgggagttcccgaagcacctgcggaagcggcggttgctctgcgacaccttcctcttcaagtagcggcggtactagttctacccgttgtagcgggggttctagccgtgcgtccccctctaggcggagttgacgtcgtagcagttgggcaggaggagaagaagcaggccaatgcgtccccactagctctacgaggcggcgggcccgaggctgctattcgagcggtacccgactacgcatcacacatgtgtcacacaacacaaccgtgcaggaacttacgcacgaccggccagccacaggccagtgcgatctgtaacaactacttattattttcgacagctcgagactcaacggctcagtacgtactcgatctagaccaacctcgtccttaccaggttgtgtagtggccgtggtacgcgcgcgcagcgtcacgaggtaataacggttgagcgaacaaaaatctagatttttattgagcagacgtcaggaag

SEQ ID NO: 36708 - DNA, 1455 bp, Triticum aestivum
  Clone ID: PAT_TA_36708
cttaagcgccggcgatcttttaggggggttacctagtagcggagcaccggcgagaggagcaggaggacccggaggaggagaggggcccgggccgtcgccgccggcgccccctgctcctcggggactaggccgtccagcagccgccgcggctgggggagctgttgctggacctcgagctgagcgtcaaggagccgaagcacgtcgccaagcccttctggatgtccctgcgcctcctcgtgcgcgtgtccgagaggcagaagttccggttggaggcggcgcgcgcggccgtggtctacgagctgggcaggcggctcgtgccccagtggttcaagaggctggagtggggccggctcaaggcggcctggaaggacccggagttctgcagggccgccagcaaggacgccctctaccggcccagccgcgtgctgcgcgggcaggaggggtggctgccggaggggctcctgaagctgacctccctggtgccgcggcagccggggcagttcttggtcccaagcacgcccagcacgaccagcaagtcgcgcaggccccgcaacctccctcggttgatggaccggtgcccgttctacctccacgagaggctcgtcgtcgaccagctgacgctggtactcacgctgggtcgtcttggactaagtacgctacgacctacgttaccacccaactactgaagtcggaaatcgatagacaactttagaccaccggaactctctcttttcctaatgggaatgtggcccttcctgccatggacgtttaaactcttcaggttctaacgacgaagtcaagttttgaagtcgcaacagcgacaactacttcttgtctaacgacgattggaacactttatacctggcgaccggatgccaatgttgcggcgtatgtacgtctgtatgtagccgcctcacagtacgggtatgtagacgccgtccgtggagctggtgccacaggaagagcagccgatgccccgcagaccgaagcgcggaagggcgaagttcctcttcgggatgacctagtagttcttgagtaccccgctcttgacccccctgttcccaatgatgttctagacgtccccgagcttgcacgcgttgttcacaccgcagctgaggtaccagaggtgccacaggcggtgagtgcggaggttcctgctcatccgagaccagactagactagactagccgccgggaggaccacagctagaaccaaagccacacacatagcgatctttctttgaaattatcatgcatcatcagccgatccgaggtagcagcaacaccatagtcgtcgcttctacgcttgcgttatcttacgagcgacatattgaatacgtaaacgatttaaacgatgcggtacgtacagacggtgtgcgataaacctacaccgatttcttgaggacttattaagacatgtattaaacataacgaaggtagtcttaccacaaggcag

SEQ ID NO: 36709 - DNA, 813 bp, Triticum aestivum
  Clone ID: PAT_TA_36709
atggttagagttccaatgccacaattgcagccacaagatccatctcagcaacagccacaagagcaagttccattggtacaacaacagcaatttctagggcagcaacaaccatttccaccacaacaaccatatccgcagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaagaacaacaaatccttcaacaaattttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagggctccttccggccatctcagcaaaactcacaggcccagggctctgtccagcctcaacaactgccccagttcgaggaaataaggaacctagcgctacagaccctacctgcaatgtgcaatgtctacatccctccatattgcaccatcgcgccatttggcatcttcggtactaactatcgatga

SEQ ID NO: 36710 - DNA, 1271 bp, Triticum aestivum
  Clone ID: PAT_TA_36710
cacacacacacatcatctcctccacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggcggtgttctacatcgtgatgcagtgcctgggggccatatgcggcgctggggttgtcaaggggttccagaccacgctgtaccagggcaacggcggcggcgccaactccgtcgcgccggggtacaccaagggggacggcttggggctgagattggtggggacgttcgtgctggtgtacaccgtctttttccgccaccgacgccaaagcgcaagcgccagaagacttcccacgtccccattttggcgcccgcccgcggcgaaggctagcccaagcgccacaaggaccacgtggaccggtgctaggggtagtgcccgtggccgtagttgggccgctccagggacccgcggcggtagtagatgttgttcttcgtccgcaccctgctggtgacctagaagacccacccaggcaagtagccgcgccgcgaccgccggtagatggtgcaccaccactagtcccggtaggggaagttctcggcgctgatcaggtggttagttggtcgacgtacgcctaccttagaatagcgacaagtagcagccagctagctagtacaccaccaccaccaacgagcgcgcgcgcatcctgcacctagtacagagccggcgcgtgcgacactagtagatatagatggcacgacaaggaggagaggagccacacacacggacagccgtcgcagtggacaagttcagacgctcaaagtcatgagggacaacatgaaagggaaggaaaacataacgtgcgccaaattacctcgcacgtatacatacatttaatgataatacttccttgc

SEQ ID NO: 36711 - DNA, 548 bp, Triticum aestivum
  Clone ID: PAT_TA_36711
aagctagactatctcctcagtagtattaccagagcctcccagttagcaatggcgaagtgtctcgccgccgcgctcctgctactggcggtgctcgcgtcctgcgacgggagggagctgaacgagaaggttgcagcgacacgcggtgccggcgtcggcgagtccaaggcgatggggttgccggacttgccagctgtgactctccccacggccccgacgctgcccacactcccgacgctcccgacgctccccacactcccgacgctcccgacgctcccgctggtgggagccattaccggtaccagtacaattaccggcccggcggtggcgcttccggcgatccctgctcacccttgattatctctctacctgtacgcactgtccggagggaaaaacatcggcgttgcgctcatgtccatgttccttccttgatgagcgtctgtaactctgtatttatcttcagttaatgttcttgtatttttacgttccttgatgtgctacatgtatcatggacgtaataaatacttacttcaaaaaaaaaaaaaaaaaaa

SEQ ID NO: 36712 - DNA, 2421 bp, Triticum aestivum
  Clone ID: PAT_TA_36712
cggcacgagggcagcagcagcaccgcagtgggagagagaggcttcgccccggcccgcaccgagcgcgcggggcgatccaccgtccgcccgtccgcacctcctcctctgctccgcgggcccgcacccatggcggcgacgggcgtcggcgccgggtgcctcgcccccagcgtccgcctgcgcgccgatccggcgacggcggcccgagcgtccgcctgcgtcgtccgcgcgcggctccggcgcgtcgcgcggggccgctacgtcgccgagctcagcagggagggccccgcggcgcgccccgcgcagcagcagcagctggccccgccgctcgtgccaggcttcctcgcgccgccgccgcccgcgcccgcccagtcgccggccccgacgcagccgcccctgccggacgccggcgtgggggaactcgcgcccgacctcctgctcgaagggattgctgaggattccattgacagcataattgtggctgcaagtgagcaggattctgagatcatggatgccaaggatcaacctcaagctaaagttactcgcagcatcgtgtttgtgactggggaagctgctccttatgcaaagtcaggggggttgggagatgtttgtggttcgttaccaattgctcttgctgctcgtggtcaccgagtgatggttgtaatgccaagatacttaaatgggtcctctgataaaaactatgcaaaggcattatacactgcgaagcacattaagattccatgctttgggggatcacatgaagtgaccttttttcatgagtatagagacaacgtcgattgggtgtttgtcgatcatccgtcatatcacagaccaggaagtttatatggagataattttggtgcttttggtgataatcagttcagatacacactcctttgctatgctgcatgcgaggccccactaatccttgaattgggaggatatatttatggacagaattgcatgtttgttgtgaacgattggcatgccagccttgtgccagtccttcttgctgcaaaatatagaccatacggtgtttacagagattcccgcagcacccttgttatacataatttagcacatcagggtgtggagcctgcaagtacatatcctgatctgggattgcctcctgaatggtatggagctttagaatgggtatttccagaatgggcaaggaggcatgcccttgacaagggtgaggcagttaactttttgaaaggagcagttgtgacagcagatcggattgtgaccgtcagtcagggttattcatgggaggtcacaactgctgaaggtggacagggcctcaatgagctcttaagctcccgaaaaagtgtattgaatggaattgtaaatggaattgacattaatgattggaaccccaccacagacaagtgtctccctcatcattattctgtcgatgacctctctggaaaggccaaatgtaaagctgaattgcagaaggagttgggtttacctgtaagggaggatgttcctctgattggctttattggaagactggattaccagaaaggcattgatctcattaaaatggccattccagagctcatgagggaggacgtgcaatttgtcatgcttggatctggggatccaatttttgaaggctggatgagatctaccgagtcgagttacaaggataaattccgtggatgggttggatttagtgttccagtttcccacagaataactgcaggttgcgatatattgttaatgccatcgagatttgaaccttgcggtcttaatcagctatatgctatgcaatatggtacagttcctgtagttcatggaactgggggcctccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacgaaagaccatacgtgggaccatgccgccgagcagtacgagcagatcttcgagtgggccttcgtggaccaaccctacgtcatgtagacggggactggggaggtccaagtgcgagtctccttgagctctgaagacatcctcttcatccttccgcggcccggaaggatacccctgtacattgcgttgtcctgctacagtagagtcgcaatgcgcctgcttgctttggttcgccggttcgagaacatatgacggctgtgctgctgcggcggtgacagcttcgggtggacgacagttacagtttgggggaataaggaagggatgtgctgcaggatggttaacagcaaagcaccactcagatggcagcctctctgtccgtgttacagctgaaatcagaaaccaactggtgactctttagccttagtgattgtgaagtttgtt

SEQ ID NO: 36713 - DNA, 395 bp, Triticum aestivum
  Clone ID: PAT_TA_36713
gggagggactggcttgtgtgggctaccagacgctggccagatgccgtctcagtgtctgctcttccggccgcatctgcagcatgctgtgcattgctcgcaacctcttgaatgcttgccaccatttggcggaggcggaggagaggcggtaagccagagggggcagcgtggcgtgcgaggaggaagggggttatttgtgacggcgggtggggaagcggcggctttggggctttggaagctcaagcaagagcacgagcacaggcgggcactcgcgatctggcggcgtgaacccaccgtaggagtcatgttcctgtactgcaaaatctggcctacaatgtgctacccctacgggggaattgaccgctgaacccaccatggcccagaggccaattttcctc

SEQ ID NO: 36714 - DNA, 465 bp, Triticum aestivum
  Clone ID: PAT_TA_36714
ggccggcgtaggcgagcaggcgctgcctgaagctgcgggcattcccgactacaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgccacagtcaaggtgactgttcaataattagtagctataagatggatacaactgattctgtttgcccttcgagggttcgtgctatgtttgcttcgagatggctcccatccacagt

SEQ ID NO: 36715 - DNA, 512 bp, Triticum aestivum
  Clone ID: PAT_TA_36715
tcgcccgcacgggaggccaacgaagacgaaaactcgggaagtcttagcgtaaaggaagaaataggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccatacatagatctgtaagccgttcgggagcttcgtttgtatcgtgtggtttatgaaggttaacctagatcttgctgaacggcataagtgactggttcgacgatgcccctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcacacgggaaccactgggaagttaaagtttgcttaa

SEQ ID NO: 36716 - DNA, 245 bp, Triticum aestivum
  Clone ID: PAT_TA_36716
ctccatgaatgcacgcatttcatcgccccaaccacaacgcagcagcagccccagcagcagcagcggcctcggcgacgcggcgcgcatttatagcacgcaatccctcgttgcctccgccgccgccgctgcctgcctgcctgcgtctcctggatctccatctgtccgcgccgcggcattccgtcgaacggcttcgcggcgcgcctccgggcggactcgcgtgctgaaggtcggagggggcaataatg

SEQ ID NO: 36717 - DNA, 318 bp, Triticum aestivum
  Clone ID: PAT_TA_36717
ccgcccaagcagggccatgaggaccaactacccgtcgtccccgtctagaccacaccccccacctgcccccaccctccctcccccaactcctccatgaatgcacgcatttcatcatcgccccaaccacaacgcagcagcagcggcctcggcgacgcgccgcgcatttatagcacgcaattcctcgttgcctccgccgccgccgcctgcctgcctctcctggatctccatctctccttcgcggcgcggcattccgtcgaacgcctccgcggcgcgcctccgggcggactcacgtgctgaaggttggagggggcaataatg

SEQ ID NO: 36718 - DNA, 315 bp, Triticum aestivum
  Clone ID: PAT_TA_36718
gcccgcccaaccagggccatgcggcccaactacccgtcgtccccgtctagaccacgccccccacctgccccgccccaccccacccccaactcctccatgaatgcacgcatttcatcgctccaaccacaacgcagcagccccagcaccagcggcctcggcgacgcggcgcgcatttataccacgcaattccatctggatctccacctggccgcagcacgggtttcctcctccctccccgcgcggcattccgtcgaacggcttggcggcgcgcctccggacggacccacgcgctgaaggttggagggggcaataatg

SEQ ID NO: 36719 - DNA, 234 bp, Triticum aestivum
  Clone ID: PAT_TA_36719
tcgggatatccgcccgcgctccactctccccccgtctccggcaccgtgcgcgccgccgccgccgctaagatccagcccctcgtccgctccgccacgcgccagcgcccagcacgcgtcggcccgtccgcccccgccgcccccgaggttccaagacctggggtttacacacctttgatggcactgtctctttgaagaacactgcatctgcgctgtttgtccaaagggaggacgatg

SEQ ID NO: 36720 - DNA, 179 bp, Triticum aestivum
  Clone ID: PAT_TA_36720
ctccccccattccccctgtcgcttccccccaggtcaggtcaggtcaggccaggccagatccgccgcccgatccgcctccgctcccggaggttccaagacctggggtttacacacctttgatggcactgtctctttgaagaacactgcatctgcgctgtttgtccaaagggaggacgatg

SEQ ID NO: 36721 - DNA, 109 bp, Triticum aestivum
  Clone ID: PAT_TA_36721
accgggttatctttccctccatcgtcctggggttcttaaatttgctgaaactagcaagatttgctgagtcatgtcatcgtagcccccgagtctcaaggcgactcgaggc

SEQ ID NO: 36722 - DNA, 345 bp, Triticum aestivum
  Clone ID: PAT_TA_36722
agatccgtaaactctgcagcctatctttccatacatatagccatgccgatcgcagtcttgcgaaacgtgctggtgggtcagttacatcctgttcgtgcttgtccattgtcgcctgtgtcaaatcatcagtatgacatcgtggaatacgtaactcacctaacttgttctgtcctacagtcaatcttgaatcaatgcccatcccggtcgaccgtccaaggggatccaagcctatctaagcctgcatccaatatcaaattgtcaccaatgagttctcgaaaatcaaaactgtggccattctcttacaaagaccatactgggaaaaacctggcgttaaccaacttaaac

SEQ ID NO: 36723 - DNA, 218 bp, Triticum aestivum
  Clone ID: PAT_TA_36723
gaccacaaagtgaagaaggacaagaagaacgaggagcaacaaaaacgcccacgcgcattgaccaccagaccggcatcatcacatcgaatgcgaactcatacgattttccgctgaaaaaaatagcggaaagcatcaccgccatggccagcatcattgccaaaatgaaggagaagctccggataggtggcagcagcgaagaattcaagaaggaacacgag

SEQ ID NO: 36724 - DNA, 277 bp, Triticum aestivum
  Clone ID: PAT_TA_36724
gggtcgacaggcagccattacagttgcatagcagtatataagtcaatcacatccccataaaatttgagggttgcccaggagtaacggtatcaccctcagactttacaggtgcactagtagtatcgcaactgggtgcaacctcgaggattctagctgcgacaaacgtttcacatcaattgacatagtcaccacgtgtgctagttgcacaagactatgtatctagttagcatccttaggaaatccatatgcccacagagcataatagagatttggcagc

SEQ ID NO: 36725 - DNA, 361 bp, Triticum aestivum
  Clone ID: PAT_TA_36725
agggacgcaagcaccgccattctcacccgtccccctgtcctcacctccacaggagattaagcctacgcacgcgttgagagcttccaatctgctaccatggataacgttccacataccaatacgacctactgcaacaacatagatgtgcaagaagcacaccctccacagcgttacacaatacagggcccgcaacgatagtctttctgctcacggcaatcgtcgttatgaccgcaatcagtcaggatatcgtggccagaccaagcctgttttccacaagaatgccacgacaacatataatattgtactgaatctgcagtgccagagcttcatgcattactcgcaacgcgccatcatgaggtgc

SEQ ID NO: 36726 - DNA, 227 bp, Triticum aestivum
  Clone ID: PAT_TA_36726
gggtccacgtgtcatcttcgacctcgtcttcttcttaatcatcatcatctccgccgtatacatcctctgggacaacctcatcttcttcaacttgctatactactccatgtgcgtcatctacaccttctgcgcctgatacatcgtgtccgactgcttcacctacatcttttagaccatcgtggtgggccacttctgcataaactgctacttactcacgcttcacttat

SEQ ID NO: 36727 - DNA, 130 bp, Triticum aestivum
  Clone ID: PAT_TA_36727
gggtccacaggtgcaccataaatatgcccatggaagtcgtcaatttgattgatcactggaagagccccgatgagttcaccaatgacttgttcaaaagctgcgtcgccaagaaccacatcactaggggcat

SEQ ID NO: 36728 - DNA, 438 bp, Triticum aestivum
  unsure (1)..(438): unsure at all n locations
  Clone ID: PAT_TA_36728
cctgcccgtaccgtgtcttatactctcgggtccacgggtcaagcataagtcgtatagaagatacgatcaacatgaagatgttcatcgatgttgactagtccgtctcacgtgatgatcagacacggcctagttgactcggatcatgtttcacttagatgactggagggatgcctatctaagtgggagttcattatataatttgattagatgaacttaattatcatgaacttagtctaaaatctttacaatatgtcttgtagatcaaatggccaacgttgtcctcaacttcaacgcgttcctagagaaaaccaagctgaaagacgatggcagcaattatacgtactgggtccgaaactcgaggatcatcctcatagctgcaaagaaagattatgtcctaaaagcatcactangtgacacacctatcccacaggaccaagg

SEQ ID NO: 36729 - DNA, 201 bp, Triticum aestivum
  Clone ID: PAT_TA_36729
cgggtcgacaggacagcccaaactgcgtctgatatatattgcaaagtgtccccttggaattgacttccatatgttcttaagtcacatatcacaccatcgacttcgcctatcaactattccccgaagatcaggtgtatcggtactttgattctagggaaagtacacctttgcaactagtacaagacttatatcagaggattg

SEQ ID NO: 36730 - DNA, 162 bp, Triticum aestivum
  Clone ID: PAT_TA_36730
cgcgtcctgcagaccaagattgtccagttcgctgagcggtaaccggacgtgcggttccagcaagtcacctatcagaggcacacgtccatgtgcaagagccgccatgtccatgtcctcacgttcgtcaggttctacatgcggagggcaacgcacggtcagcag

SEQ ID NO: 36731 - DNA, 464 bp, Triticum aestivum
  Clone ID: PAT_TA_36731
tgtacgccggcaggtaccgtgtcgaggctcccgggtcgaagggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcctcgagaagctcgccggcgaggccgccaagctggcgcggtacaacaagaagcccaccatcacgtcgcgggagattcagacctccgtccgcctcgtcctcgccggcgagctcgccaagcacgccgtctccgagggcaccaaggccgtcaccaagttcacctcctcgtagagtgctcctgcccctgtgtctcgtactcagctgtccgggtgtgtttgtggcc

SEQ ID NO: 36732 - DNA, 318 bp, Triticum aestivum
  Clone ID: PAT_TA_36732
agatccgtatcctctggagcctacctttacatacatgtagccgtggcgatcgcagttttgcgaaacgtgctgttggagtagtgaaatctgtccgtcgcttgccattgttgcctgtgcgaagcatcatgctattatgaacattcgtaggatgtacgtatctcactaagcatgttctgtactactgtcactcttgaattcattgcccatcacggtcggccgtccaaggcgatcaaagctaatctaaccttgtacgagatatcagatcgcaccattgagtcgtcaatattcagatctgtgacgatcatcttacatagtcca

SEQ ID NO: 36733 - DNA, 445 bp, Triticum aestivum
  unsure (1)..(445): unsure at all n locations
  Clone ID: PAT_TA_36733
tcgcgggtcgacgggaccgcggagtcctcctcttccttcctgcccgtgaccccacgcctcctccccatctagatctcctctgctcatcaaccgccgctgcccttcgatccgcccgcgctgcaagagctcgccgccgcgctagcaggaggccgtcgcgggatcctccttctcctccctgccacgggatccttctccttgaccacgaccccgtgcttcctcctgatctcgagatcgcctgctcgtcaatcatcgcgccgcagcttcgtcaagagctcgccggagctaccctgcagcacccctttctcctaacgtctccctcgccggagcttctttctgccatgataaaatccgctcaaggccatcgtccaccgcctcgagctcgacgctcacgctcggatctagccgctggcaagggccagtgcgtaacttttntgtgaaatattgt

SEQ ID NO: 36734 - DNA, 103 bp, Triticum aestivum
  Clone ID: PAT_TA_36734
tgtgacattaatctggggaagatagcaggagctgaagctggcccggatcagcgttggcgtgaagcggagcatggacggcggcagagagcgacattaatctgcg

SEQ ID NO: 36735 - DNA, 258 bp, Triticum aestivum
  Clone ID: PAT_TA_36735
gaccacaaagtgaaaaaagacaagaagaaggaggagcacaaaaagcggcgacgcgaattgaccgacagaccgggagcatcgcatcgaatgagcactcaacgatgtccctcggaaagaaataaccggaagcatcaccgccatggccggcgtcatgcgcagaatgaaggagacgctccagataggtggcagcagcgacgagtccaagacggacaaggagcacaggacaggcggaggaacacaggacgaaggacggggagc

SEQ ID NO: 36736 - DNA, 397 bp, Triticum aestivum
  unsure (1)..(397): unsure at all n locations
  Clone ID: PAT_TA_36736
cagccattctagttgcacaacagtatataatttagtctcatctccaaaaaatttgagggttgcccaagagtatctttagcaccctcagactttatacttgcacagtagtatccaattaattggcatcctcgacaattctagttgcacaatacttttctaactagttgacatactcaagactttttctagttgcacaagagtatgtatttagttggcatccttagcatttctagttgcacagtaaacaaaatactgtgttggcatcctcaacttttttaatccagatttctaaagaacaacanaaaaattatgcagtgttaactaatcaccttttttcaccttcatgatattgtgcaggggggtgagggtaatgaagaagataatgcagaacgacagt

SEQ ID NO: 36737 - DNA, 383 bp, Triticum aestivum
  Clone ID: PAT_TA_36737
gacgcaagcgccgccgttcgcacccgtctccctgtcctcaccgtgcgcatggagatttgagcactgcgctacgcgattgaggaagcttgccaaatgcttgttgacacagtggatgtaacgtgtccagcatgaccaataccaccttactgacaagcaacattagatgtgcatttaagcataccctccacagcgttacacattacagggaacgcaacgatagtctttctgctcacggcaagcgtcattatgaccgctatcagtcaggatatcgtggccagacaaagcctgttttccacaagattgccacgacatcattgaatattgtgctgaagctgcagtgccatagctgcatgcattacgcgcaacgcgccatcatgaggtgc

SEQ ID NO: 36738 - DNA, 349 bp, Triticum aestivum
  Clone ID: PAT_TA_36738
gaacaaacttggtctctgtgtgcttaggatggagtcccgcatttgctttgagaactgtaagcgtgtttaacctgacagcgcctgtaattgtaggccctttccgcatacttcacagcttgttgtcttatgaggtgctgcagggcagcaggctggtttatgccgcctcggtcattattatcatttgtaacttgttagagtgcacattaatctcaggaggacatagacataatacttatgctgctgttgttgtaacgacctttatgcctctgccttgtgttgctattcataaaaaaaaaattaagaaaaaaaaaaaaaaaaaaaaaaaccaacacacacgagaaaaacaaac

SEQ ID NO: 36739 - DNA, 445 bp, Triticum aestivum
  Clone ID: PAT_TA_36739
tagcataattcaattcatggggtttaagttgtcgtgaggcatatgaaacaactctcccctcctgcataagcactcctccaagtcctcgatgtgaagcatcacaatacacttgataatccttatgttgatctggaagaattaacacgggggctgtaaccaaaggtttcttcaactcctgaaaactggcttcacattcctcagtccatttgaacttggtgtccttctttagcaactccgtcacaggtttcacaatcttagacaaattctcaatgaatcttctgtcgtatcttgcgattccaagagaactccagatctccccaaatgacgtgggtgcttcccaatttgttacactgacaaccttggtggggtctactgctattccttcttcggatatagatgtccgaggaatccaacttccttcaacaaaaactcacatttgctgaac

SEQ ID NO: 36740 - DNA, 391 bp, Triticum aestivum
  Clone ID: PAT_TA_36740
tagccactgactctgggcacgtacgttcaaagggtaatgctcctcactccgcacccatatctcggcctcatagccgtgtcaacgacattggtgtctgccctaatccacattaaagctatttcacagcagacgttacgggactctcccagtgacacaatcaatgggaagactctgtcgtccaccgctcacactatcatgcaacgcgaatcatctactcaattcattaagctgaatgcgtatcacgtccagaacttgataagcatcttcaaaggtcatcaatgagtggccaatacttgagtcaagggaagcacaatgtcatatgtagaccaccattatgggaacttacatgcatatccgtaggagaattgtgcctctcacgaatagtccagaa

SEQ ID NO: 36741 - DNA, 122 bp, Triticum aestivum
  Clone ID: PAT_TA_36741
gatattgtaactgggaaatcctttatgttgcagaggaagtttggcgatccacggtatgcccctctggatcggctgtggagttcggaggatgggcacgtcacaacagaatcaacatgtgcaaa

SEQ ID NO: 36742 - DNA, 272 bp, Triticum aestivum
  Clone ID: PAT_TA_36742
tgatgcacgaaaaggccgtcatgatatctgagccgaacaggtgagcttaggccacgaccgatgatcgctaaccttcagtgccttcttaaacaacggactcaagcatcattcttaaagacgatgacactatggtcatcacacttatgggaccaatctcagtgtcagaacaggcggatttcgagtacggtatgttgctcaggacttccagatcaacgattgctagatacaagacatatgagtttcacacgcacaatcgggcgatcaccaggtac

SEQ ID NO: 36743 - DNA, 403 bp, Triticum aestivum
  Clone ID: PAT_TA_36743
tagccagtgtcgctgcgcacgtaccttcgaggggtagtaatagtgatcacgcacccatacatcggcctcctatccgtgtcagcgtcagtggcgtcgcccctaacgcacactaaagagatttggcagcggcctgcacgggcctcgccgatggccacaatcaaggggaagacgctgtcgtcctcctccgagactagcaggcagcgctgatcctccagcgactccagcatggtgaacgggtagcacgtcttgtacttgatactcttccccaagggccattagtgattgccgcatgcctgcgtcaggtgatgcacaatgtccgccgacgagccccaaaatggcaccgggcactcatagtagtagacgaagtgctccttggaggcatcgaccaggccgtccatgaaac

SEQ ID NO: 36744 - DNA, 441 bp, Triticum aestivum
  Clone ID: PAT_TA_36744
cgggtcgacggggtaatctaaaccccccataccctaccttgcatccaaacccctctatggtcggtcgtccgctccgatctactatggtcgtcgcctgcatctgctgtcttaagtttactatatgctaccgctgatgctgctgctgctgctgctctaaaatattgatgctgttgctgctgctgatgcgtgtggtgtgtcgtgtgctagacgcgtgatttttttttacctgtacacatgaggccgtgtggcctcattgccatgtttaattacctgtcgctactctaagatgctggcaaattgtttgctgatgttaatgtctagtggcgctcgagagatctgaaagatctgctgtcgatccagttcctccaattggcggctaaagtgcatgaatcggggatttgcgcttgagtttcttatcccgccgtaagaagtattttacct

SEQ ID NO: 36745 - DNA, 403 bp, Triticum aestivum
  Clone ID: PAT_TA_36745
tgatggacgacaaggcggtcatgatatctgagccggacaggtaagcctgggccacgactgatgctcgctaaccttcggtgccttctttatcaacggaatcaggcatccttgcgaatggcgatgacactatggtcaccacacttatgggatcaatctcagtgtcagaacccgcggatttccagtacggtatgtcgctgaggacttccaggttgacggttgctagttccaagacatttgagtttcacatccacgattgggcgatcaccaggtacgcgataagtgcgacatgctaccgtaagggtaatcatgtggctaataccagcatggctctaccctcagatgattaacgctacacccacgagtctttccgagtatcttattgtagcacgaccaactgggcgac

SEQ ID NO: 36746 - DNA, 434 bp, Triticum aestivum
  unsure (1)..(434): unsure at all n locations
  Clone ID: PAT_TA_36746
gcgagtcgacgggagacactagagtgagtcgtcttagcacccggggggtccaaccgcaaacaaacattagcatacataggcaccaggaaaggaggcacaggcaaaacctcaggttaaaggggtctcaccagaggattcagcttaataactcgggttcgcaaaaggattcaaaacaaacggagcaacgaaactcaaacggcgaaggaaacaggatccgtttactaatctggacctatgtcaaattttatagtagcaaaaacttgttcaggttgattaagcagaaagagggtctcgggacgaagatctaggcgcttgaatcgcctgattccgactaacgagcgaaaagataaacagaaactaagatcggatcanaaatcgcgatcagaaaaatcgcggaataaatccgataaaaagaaaattgacgaatagactaa

SEQ ID NO: 36747 - DNA, 379 bp, Triticum aestivum
  Clone ID: PAT_TA_36747
ggaaccccaaaattaatccttgtaagcaacagaagggccagaagaaaggccacaataaccttgaaaacttacaaattcaacaccttcaaggtgctaaaccaggttaaccccaaaatcggcatctcctctaaggcaatttcaatcataaactccttcatcaacaacatcttctaaaagctcgccggcgaggccgccaagctggcgcggtacaacaagaagcccaccatcacgtcccgggagatccagacctccgtccgcctcgtcctccccggcgagctcgccaagcacgccgtctccgagggcaccaacgccgtcaccaagttcaactcctcgtacagtgctcctgctcctgtgtctcgtagttagctgtccgggtgtg

SEQ ID NO: 36748 - DNA, 418 bp, Triticum aestivum
  unsure (1)..(418): unsure at all n locations
  Clone ID: PAT_TA_36748
gaaagcattgttggacaaggcttacatgaacgccaaaacgcttctcacaaaccacaacaaggtgctccacgcgctagcaaatgccctcctgaagcatgaaactctcagtggtgacccgatcagggagctagtttcgacaggacgacaaggagatggtcctagcagtagccagcaaaatcagggaacaccttctcctggtgacgagttctcgaaactagtatcgactgaacaacaagaagatggtcataacaatagcanacaggatcaggtaacaccttctcccaccggtgacgagattaaggaatcagcanggagatgatcctaacaatggtcagcagaatcagggaacacctttctcaccctagccttggagacgcttatacaggaagaaatatttctttgcctgatagatactaca

SEQ ID NO: 36749 - DNA, 311 bp, Triticum aestivum
  unsure (1)..(311): unsure at all n locations
  Clone ID: PAT_TA_36749
actaggatgcagccaaggaacggtgatctgtgttgaatattcccccaaagggaacccttattcacataaccgttactaaggtgaactttaccggaaccaaccttatccaattccaaaaaggaattttccaaggtttcatccaccccaatgacaaatgcacgtttttcagggaggtatcanaccagccaatatattaataggggataacctttgtcctaaaatctatgacttcggtctctcccagatgttttaagaagaagaaacggaacgtattgttgaaaatgtcgccggaacattcggatatatggcac

SEQ ID NO: 36750 - DNA, 419 bp, Triticum aestivum
  Clone ID: PAT_TA_36750
tgtgccttaaggtttaataaatcaccaattgaatgttacctaagatgctctggcgctccaaaaaatgttgggaacctttcaatcctcaacttaatccagtgaggaaacccatatacagctatgccatccactagttccttgacctcttgagatgtccaatgggcgttgtttcttctctgcccacgtttttggcctctacctgcagagtgcatgtaccgagagcatggttccgtggtaatcgaccaagttcctctcttgtgtgcacttctcacgcgactctcatgcctccaatcactttctagcatctgatctgaaacacaaaatgtatgcgtttaactacctgaactatgaaaaatgatatagttcaactagtggccttcaaaattcataccccagtagatcgcagcccccctcctccg

SEQ ID NO: 36751 - DNA, 210 bp, Triticum aestivum
  Clone ID: PAT_TA_36751
tctaaaattaccatcttcatatctcaaaacaatcatcaagtaacaaccttctcatagtattcaatgcactccatatgaaagtttttaatacatccctaatggatgcctatcagagtaagactaaattcatcaccaaagaaaataggaaccgtgacatacctccttgggcgaacaaatgcttgtatgggaaaagtgaaaaaaacaccaatc

SEQ ID NO: 36752 - DNA, 397 bp, Triticum aestivum
  Clone ID: PAT_TA_36752
ctcccgagtccacggggatcagactgatcaggaaaacagatatccagccggatagcctgtatgtcctagcccgctatagcctgatgctcatgtcgagtacgattgatcgtcaatcgcacagactacgtccactgcccacaatgataccaccgtcaccaagaaccacggaactactgacagggttgattcatccacatcggatggaccagataccaccacttctatcctagatgttgatgcgggcagccatcaagagggatcaactgttcctgctgctacaaatgtacatgtacggaacacacctgtatcttcagatcaagctgtctcgaatgaacagcgtgacatagtctctgaactaaacatcttctacataccacatctgcggggcacgtcacaa

SEQ ID NO: 36753 - DNA, 344 bp, Triticum aestivum
  Clone ID: PAT_TA_36753
taatagacagattcctcatgtccaccaatttatttcagaactttctgagttacagaagtattcgaaagttacagattactacagattgttctatttttgacagattctatttttcgcgtgttgtttgcttattttgatgaatctatgagtaggggtatgaaccatggagaacatggaatgcagtagatattacaccagtataaataaagaatgagttcacaacactaccttaaaatggtgatttattttcttatactaacgaagctcatgagattttctgttgtgaagttttaatgttttgggtaacgatttgatggattttggaataaggagtggcaagagcc

SEQ ID NO: 36754 - DNA, 407 bp, Triticum aestivum
  Clone ID: PAT_TA_36754
cacgggaaacgaggaagatggtgagggtggggtttggattacctgaccatatcgacgaagccgcacaacaagaagaagggtcggcggcaaggacgccccgcagcacgaagaagggtcgccggcgatgaagcaacgctgcaagaagaagggtctccggtgaggaggcggcgcttcaagaagaaggttcaccggcgaggaggcggcgctgcaagaagaagggtagccggcgaggaggctgagctgccagtaagcaccagtgaaggtttgaacttggaaagtgatacgtccattttgcatcatgcttttatatcgatatttattgcattatgggctgttattacacattatgtcacaatacttatgcatattcccgcttaatctgcaaggtttgcataaagagggagaat

SEQ ID NO: 36755 - DNA, 175 bp, Triticum aestivum
  Clone ID: PAT_TA_36755
cgggacagaatgacgaacctatataaccagacaatcccaggaaaatggagctcggaagtcgagcttccagaggagaaaccttaactagtgtggctcgggtatttcatctaacaccctcatggtgcataaggaaggtgaagctaagaggcaacccaagatgcccctccccctcctt

SEQ ID NO: 36756 - DNA, 415 bp, Triticum aestivum
  Clone ID: PAT_TA_36756
ggtcgacgacgaggatgcaggctaggcatcattgacatcgagaacaaattctatgcaaatttaacattttttaaatgcttggattgcgatttcttatatacgagaaacctttagtccgtggctaggaatatgattcagaatcataaagaattctcttaacctttaagggatttaacaaaatggtgtcattctggatgtgcagaaaatggtccatatttttcatgatctcatctacccttctatatgccatgttgtctagtgtcaagggattcaataaaaccatggcttcatcattagctggaagtaacaggcgcatgatggtacgaagctctccaaagtcgtcttggaacggaatcccggataggataattagctttatggtatgaagttcagcaagagccttccgaatatcgct

SEQ ID NO: 36757 - DNA, 440 bp, Triticum aestivum
  Clone ID: PAT_TA_36757
ctcgcgggtcgacgggatgcttggactcgctgaatcgtattatcagccgactaggagagaaggctctccccctgtactgactcatgaagaagtccactcacttcgagtggaatgaccaagccgaccaagccttccatgagttgaagaaaatgctgaccactccgcctatcctggcagcgccgactgaaaaggagcccatgctcctctacatcgccgcgactagccgagtcgtcagtactcttgttgtggtccagcgcccagaagaaggccgagcccagctagtccagaggctggtgtactacctaagcgaagtgctatccagctcaaagcagaactacccgcactaccagaagatgtgctatggggtatatttcgccgccaagaaactgaagccctacttccaagagcaccccatcacggtcgtgtgcaccgccccgctc

SEQ ID NO: 36758 - DNA, 403 bp, Triticum aestivum
  Clone ID: PAT_TA_36758
aaggcatgatgtgatctaatacgagctatcgcctcacgggcagccatctgcatagcatgcctctctgtaggcatggctctccccaagaacaagaagcggcgtatcttagcacgccctcgcttgaattgcaccgcggcctggtgcatggtcaggctatcgttgatcttgtgtgggtaaagtgtgaagactgggcgcactgacggccccatcgcgacctgaacgatgaacgagaagagcttgacgaacccctcaagcacgttggcgaacatctgtgattcacagtcgttgccagccatctacaaaagtaggcaaaaattctaaacgatcagatcataaattttatgctgactgtcagaaaaatgactacatttggaaaaacatgaataaactctatcatgctaat

SEQ ID NO: 36759 - DNA, 419 bp, Triticum aestivum
  Clone ID: PAT_TA_36759
agtccatgatcggaaaggacaatgacgccgagctgcttcaagttctgaaggtcgcctgttcctgcgtgctttctgctccaaaggaaagacctacaatgtttgaagtgtaccagcttctgagggctgttggggagaaataccattttagcgccgctgatgatgaactggcgctccgaccacaggatgcagactctaagaagctggatgagcttattgtggcgaaatagacgggtctgtctggtacgttgatgctgggtgtttgttgtatcttgtgaatggtcaggttgagatggtagtaatgtactactactatctggactccttcgctagctagcgaaaccatcggaagctcaatcaatgttcatggtcctggaaatagcatgttgttgtaagatgtgtatgacttgtgagttccacgt

SEQ ID NO: 36760 - DNA, 413 bp, Triticum aestivum
  Clone ID: PAT_TA_36760
gatgggggaggccgttggagaggctcggagcgcgccacgtcgccgggcagggaaggtcagtgttttttgagtttcaccggaccggcaaaacctctcgggacgagtgcttcgccccggcgtgcgattggacacgaggccgcccgtctcctgttttcgtccaaaggagaagaaacaacaaattacgccctgcctctgattgtgaccggggatgcatgaaactatcaacatctctttctttcttttttttgtcttttgaaatgatcaacatctcacttttgacatgttcaaaaaaaaaacatctcacttttgacacgttgtgagctatatcaccagtcctgagttgaaaaacaaggagaacttgcaggtaggaatatggatgataatttttgactcaagtgatatttgcaccgggt

SEQ ID NO: 36761 - DNA, 190 bp, Triticum aestivum
  Clone ID: PAT_TA_36761
gagacaaacagggacgagagtgcactctggatccagcccaaggagctgggctcttacaccagcaacgaggacaactggatcgaaggtgtgaacgaaacgacgcatcggcctcaggggagccttggacactacagtctccttctgtagtctcctctaaaccgagacaaaagtgcaaattaagcgctacccc

SEQ ID NO: 36762 - DNA, 190 bp, Triticum aestivum
  unsure (1)..(190): unsure at all n locations
  Clone ID: PAT_TA_36762
actcccgggacgaaggagatgggggattaatttctagagttttgaaagtggaaggactaaaatgcaaaaaatcaaatgtactatcnccgcgacattattttcaagacggagggagtagtagtattatttcctgaaaaaaaaaaaaaaaaaggaaaaaaaaaaaagaaaaaagaaaaaaaaaaaagggggc

SEQ ID NO: 36763 - DNA, 398 bp, Triticum aestivum
  Clone ID: PAT_TA_36763
tagtgaaaaggtggtgcatgcaacagagttaacgagtaggcatgtttagatgctctatgcactcactacagatcatgtcatgacaaacgagtcatacacgcatcaagagtacataccataaaagttacatatggcactaatcataacatagcatgcacggctgaataggagcatcctcggcaaaatcgctaaacatgtcaacattctgccaggaacattttatagcgacacgtacagctcgattgacacaagttatggtgctctatagctgcaaacagatacatgtacggatagatgaacacaatattgacagtgcattattactgatcaacatcagcagatgcacgggtcacgatgatacaacatgaacatatggcatcgggtcggatagttaggtt

SEQ ID NO: 36764 - DNA, 402 bp, Triticum aestivum
  Clone ID: PAT_TA_36764
catgggggtcttagtcgtacttatcaaaaagataagggaggcaagttgggaaggacggagctcagcacgttaggcacctagtgtcatctcagtgaatgaggcatagatgaacctctcgagtggaatttcaagaaaaacatcgagagcgagtacgaggtacaataagaagttccaagttgttagataatcgttcgatgtctgaaacaaagtgtgaaaggggtactgactaacgcgagaaagtattgcgtctgatgccagaatagatcagtaggaaggtggctcatggtctacataagaagccaagcgtggggaataactttgggaacagggggtgtacaccaaagtcaggttttgatcgtgtggaagggttatgggcccaccatgtgggaaaagtaggaagag

SEQ ID NO: 36765 - DNA, 426 bp, Triticum aestivum
  Clone ID: PAT_TA_36765
acggtatattttcacctgcatgagcttgatcttcgttatcatctaagccgtcaaactggagctctaaatcgcataattgaccgaggcagtcgtgccataaattacattcttacagtgatggtgttcaatgttgttcccacaatactagagattggtatggtgtcaagtatacttgcgtaccagtttggttccacttttgcttggattacttcagtttcagttgctacctacattgttttcactttggctatcacacagtggcggactcagttcaggacagccatgaacaaagctgataatgcttctagtacagtggcagttgactccctgctcaattatgagactgttaaatacttcaacaatgagcaatttgaagttcagaagtatgataaatacttaaagagttacgacgatgctgcactgaaa

SEQ ID NO: 36766 - DNA, 208 bp, Triticum aestivum
  Clone ID: PAT_TA_36766
acgggacaacggataatggttcgtaggatttatgaggtctcgttgtttttgcatgctagcaaattactccgggatgcgagttttatgatttcgcttgtgttcaaggattttactattattagtgcttgtatcctacctgtggtatcgtcatagtttgctgggtatggaagcccttttatcctgcttaaaaactgtattttgcctggaa

SEQ ID NO: 36767 - DNA, 413 bp, Triticum aestivum
  Clone ID: PAT_TA_36767
acaagctaaaggtatatcactctttctaacttctgtgaggtctctaaataaggtttggtggttggcccacccagtagtggctgaaagagacgttaatcgatcatctatgggcgataatactacacgcatggacaaaagccgaaatcactaaaaaaatttaagcatcagtacatacgcaggcgctcatatacacgcgcatacactcacccctatgaacgcacacacgcacaccctacccttatgagcacctccgagagactgagccggcatatcatcttgagatttacgaagccaccgtagacgcctcatcatcgacgagaacgtctcctcccactgaaagcgcatcgccggaaatcctgaaataaatccaggaataatgcgagcaccaggatttgaaaccctggtgggttggg

SEQ ID NO: 36768 - DNA, 391 bp, Triticum aestivum
  Clone ID: PAT_TA_36768
ggcgatgacaaaagcgacggccggagctcggtggttgcggctgagagggctagagctcgcgggcgaggaagctgagcagcgcagcggcatctacatagcacgtggaagaagtctgcgaggtcggcttggtcattcgggcttgctagcgatggcagtgacaagagcgacggcgagaagccctcggtcatggcggggctacggcgtagagggcgggcgcgaccatgggagaagggggagatgatgcgggtgctcacaacgcgtccgatggcgtcgtcggcgatgtcgggggcggtcgggttgctgcgaatcgacaacgacggctgtcggtggagaggacgaagacaacagcgatggaagcactactgggcgctccggcatcgtttgtctcggc

SEQ ID NO: 36769 - DNA, 413 bp, Triticum aestivum
  Clone ID: PAT_TA_36769
ctcacgggtcgacgggatactgcaacttggccctgcctatcttttttcattgtagaggtgacctttggattttaaagaaattacgtcaaaccaattgagggatttatttatcacggaaagttgaacgaaaaccatgcaattttctatggttttgcattcctacacccagattcgttaagatttctagcaaacaggttaggcctcaaggggtcttctatgtgtcttacatgcatcttctatgttttcaaaactcttagaaaacatcttgtagaacacacaaagagctttacacataaatccaagtgtgttgattccttgtaaagttgtaaaattcaagaagttgtgtcattttcaatcgtgcattttattacttgtcttatgagaattctgcgctccaatggaacggttcccaa

SEQ ID NO: 36770 - DNA, 297 bp, Triticum aestivum
  Clone ID: PAT_TA_36770
ctcgcgggtcgacgggacacatcacaattagtcgtcccagtcgcccatatgtgcttaccacgtacaccgaccgtcccaggatcaaagatcattcgggagcggccgcattataatccggacccatgttctccgcagcagtggaacgacttgtggataggaactgcatccaaaacatgataatccagcacgtgtccgtgtaagactgcgtcagtcctaccttgtagattacctaaaggttcaagtacgaaagagtacacgggcagtagtgtcacgaatgtttcagtgtaaaggaccgat

SEQ ID NO: 36771 - DNA, 438 bp, Triticum aestivum
  Clone ID: PAT_TA_36771
tcccgggtcgacggatgagatgaacagtatcccgtggagtcccgttttgcggtatgccacacccctcccgatgaacaggacctccgttttgaccatagcgctccaacacaagtccgtttcatccgttttgtggtacgccacgcccctcctgatcaacaggaccctgtttcgactgtaggaggtccaacacaagtccttttcctccgttttgcggtacactagacccctcccgatgaacaggatcccgtttcaaacgtggtcggtcgaacaaaaggccgtttccttcgttgtgcggtacgccaggcctcgtttccattgggtgttctgtccaagccggttggctcccatgtgttccattgcctcccgatgaacacgacgcattccgttgcctctcgatgaacacgacgcattccgttgcctcctcatgaacatgacgat

SEQ ID NO: 36772 - DNA, 172 bp, Triticum aestivum
  Clone ID: PAT_TA_36772
acaataaaattatcggggagggggtatatcgaccccccctcgtgttgacgttatcgggagaggggtatatcgacgacgacggacccgataaaacagaagaaaacgaagaacaaatagatagaggagaagaagaacatgaatacacgcgaagatcaaatcaataatgtcacct

SEQ ID NO: 36773 - DNA, 204 bp, Triticum aestivum
  Clone ID: PAT_TA_36773
aattcgaacggccgctctttttatttttttttttttacaaaaactaaaaccttagcctgcgattctgcctctcgaattcaatacaacacacaacaaaagaagaaaatctgtacagaaatggccggattcggcctggtctcgagttactatcttccagaggggatcagcgagccattctcagatcccagagtgagaggctgcgtc

SEQ ID NO: 36774 - DNA, 385 bp, Triticum aestivum
  Clone ID: PAT_TA_36774
gaagtcgaccgccaaggagggcggcgacaagaagggcaagaagaacgccaagaagagcgtggagacgtacaagatctacatcttcaaggtgctgaagcaggtgcaccccgacatcggaatctcctccaaggccatgtccatcatgaaactccttcatcaaggacatcttcaaaaagctccccggcaaggccgccaagctggcgcggtacaccaggaagccagccatcacgtcccgggagatccagacctccgtcggcctcgtcttccccggcaacctcgcaaagcacgccgtctccgacggcaccaaggctgtcaccaagttcacctcctcttacgctgttcgtcttcctgtgtctcgtagttagctgttcgggtgtgtatgtgg

SEQ ID NO: 36775 - DNA, 141 bp, Triticum aestivum
  Clone ID: PAT_TA_36775
cacgccagctgatatggaccctatgcatagttgcccatccttactgggtaacgcgattctcaatgtgttcggacatatcacaccatgagtctggaaacataacccactgttatagctagccgtacgaacatgtaaggatcc

SEQ ID NO: 36776 - DNA, 442 bp, Triticum aestivum
  Clone ID: PAT_TA_36776
aggtgtgagagagtagaggaatggcctggccaacaatgaagtagggtggggcggtgcggcctgtgcggcagcacagccggccatgggaggcgggagcaggcagtcccaccggagctggtttgggcggctggagtaagaagatcagatattgaagaagcagcacatccgttagattaacatccaacggtcactgctgctagaatcgtttatggactaagttgacaaagccaaagtacacgtcaacctagtagacccacaagtcagcctccaaatctgtcccaaacagcatacaacccgaaatttctaaccagattcaaattaattttaaatctaaatataccttaatttaaattcaatgaaacttacccgcacaaaaacaatgaaatttaaaatatcaaaatccgaaagaaaacagtattttggaactaattgcctaattgtt

SEQ ID NO: 36777 - DNA, 448 bp, Triticum aestivum
  Clone ID: PAT_TA_36777
agaacgtgatataatcttggcctttcatcgatgacttaatatcaataggaaggcccgtactcatctttgaccaaataagtgcctgtttaatacacgttaaactaactggaatttgtgcagtgcaattcaattagacagaacaggcaacaaagagtattaactcctaactgcaaacatgttcataactacagagtaacagaataagataatcatctatcagaatatccattacaggtccaatgttcaaagtctgcttaccgcagctagttactcttactcaactgaggcaaaatgtcacacacattctgtatgcatgggacagcttaaccatcagaacacaaagtttacaagcgtacaacataattgtacatgtctcactattgaagattaaacacaaatttagtgagaaaataggacaaccgttataactaaaatgttgattttcttt

SEQ ID NO: 36778 - DNA, 384 bp, Triticum aestivum
  Clone ID: PAT_TA_36778
caatgggagtgagcagatgtgatctgttggtggtggctagggttaggagacaccgcacacttatataggcgcagccgcgtggagagacgtgggcggcccacgtccgagtccgtgacagcccacgatccgacgtctcagattgtggcccagctgtcaaaaactctccgttagtgactggcaaaaaaataagcacgtatgtgtgagctcggctcgctcattcccgcaacccgcagcgtgacgcgcggcggaggaggagtgcgcgagggccttttctattctcaagccccaatagcatgtgaaagacaatccttctccactagcggggtgagactaaacttcccgctacacctagtgccaataaacccacatgggctagatttttca

SEQ ID NO: 36779 - DNA, 428 bp, Triticum aestivum
  Clone ID: PAT_TA_36779
cgggtcgacggaattctctaaccgcaaaaagggtgaactattgttaatccatataaccaaacgaaaatacgtgttgatagatagtcaagttatttgtatcatcttctctgcaagaaaaggaagttatacgtatgaagcaaagttttgtagtacgatttacctggtccattggatataacatccagctagtaactcgttgattttctggttccacctaatcatcctggagaaagtaactcgttgttcttctcccgcgcttaacaggaatcgaacgctgaatctcccgctattgtgggggcaacgatagccaacagaccaatcaaaccttggtgacggacatgctgtaggtactgtaggagtactgtagctagtgcgttttttaagacgaacatgaaatattaatttgaactccagaaaatatttttttt

SEQ ID NO: 36780 - DNA, 420 bp, Triticum aestivum
  Clone ID: PAT_TA_36780
gtcgacgggacttgggaacgggggaacctgaacagttaccagtgcttgtcaatttcaggaaatgacttaacagaactttacgaaatgcattaaaactttaaaaagtgatacaacatataccgtttatcagatgacactacttcacacatgacatatgctcatcactacgaaacaggtccgaatacacaatctgttcaaccaccacacatcactagcataccgaacatgcaaacgtccccctctggtcagtctgtccaaaaatgccaaacatcggggatactttactggatgttttcccccttcgcgagtagcacctagtactgcgttagatcaccctagcaccgtatattgccatgttatgctttgtgatgcttcaaatgctctgttaattactgtgttccccctccgttacctctttcc

SEQ ID NO: 36781 - DNA, 419 bp, Triticum aestivum
  Clone ID: PAT_TA_36781
aagcactacgatccggtaagactttcctgaaatctggcatgacacgtcaggtcagtacattgaatggacttccaaactcacaacaagtaaaagcataatggcaaacaataacatgacaattaagcaagttaaatgcaaggctataatatactactcatgaagtgatcatgcttgtgcaatgagtccctcggactcccttaccatacgggttacctcgtaaccaacatcatcaatatggtgatcacctccggatcacgaacgaaaccaacccttgggttccaacatcaaccatcttcacggtttcaacattatcatcgcataatcagtgtcatctgtatgaccttattgtgcaaaattaacttattgttgttgatccatggtgtgacctactacgaactgtgtccgtaaccgtggacgcg

SEQ ID NO: 36782 - DNA, 359 bp, Triticum aestivum
  Clone ID: PAT_TA_36782
ttcagttaccgtgcgtgtccttgtgcaggaaatgactagaaagagcatcgccgccatcatcgaccggggacaaggctgtcgtgcccgtgctcatcccgaacagtcgctgcatgcgcgccgcgtcagcacatcctacggcaggagggcctctgcgcggccctgttccaggagcaccatccagcaggtggcaggggatggagacaatccgcccgagccactccggcgacgaaaccctagctaataagatgggttgagagcgagcgttggtggccgggtgtagtaaatctaaccggatgggatgaaagagccgagcgaggggaacatgggggtgtgctgggcgccggccatacctgacagaa

SEQ ID NO: 36783 - DNA, 438 bp, Triticum aestivum
  Clone ID: PAT_TA_36783
ggataccaacaagtcaggggctgctccatcaaagcccaagactgcccccaaggttgctgctgctcaagcctctaagctaacagcaccaaagagatcaactagaaacataccagcagctgagaagaacaaggcccagtgccttaaatggaagaagaagaagagccccaagtgctcagaaaactcaaactaaagattcctgatgatgatgacaatcatccagttgttgataatatgaagaaaagaaaacatgtaggactcatattgtggagacactcagacccctatgctctgagaagaaggactattgtggactacatgtttcacactaaggaacaacaggacttctatgagattgtgctcttggacaagaagcccattgtgtgtgacatgaaatgggtggactggaaatacattgaaaacaatgaagatcactttcct

SEQ ID NO: 36784 - DNA, 104 bp, Triticum aestivum
  Clone ID: PAT_TA_36784
gccaggtggctacctaaaagcccggcctaagtgggccaaggctgagaatgatatgcttgataaaaggatcgaaccagagacagcagacagacgcgccaatcaag

SEQ ID NO: 36785 - DNA, 420 bp, Triticum aestivum
  unsure (1)..(420): unsure at all n locations
  Clone ID: PAT_TA_36785
taagccgacgcgtgttgatgagccgctagctgagccgccagcttggcctcccgacgtgctctgccctgatccaccaaagactgggcattggcaccattgcgcgttgggtcatgtccacggggttggttacgatgttgttcagtacttgaaaccgctggcgagtcgatgtgcctgctgtaactccggcttggacgaggggttgagtgaatccactcacgactataagaataagccgcttgctgctccaatgctgtttgaagaagctctctggccctccgcgtttcaaccgccgatggagactcgccttcaagtggtagagccgccaatcgtatcgccgcaacaatcatattgtccaaagggttggaataatgactcgacggcgtcaaaaactgctgaggcggngtattattcacacgcgga

SEQ ID NO: 36786 - DNA, 378 bp, Triticum aestivum
  Clone ID: PAT_TA_36786
tatcatcatcatcacttgtaacgaatcaaggcgggtgaggatctccatctgaactatataactcaaaaagtctacatgttagagcaacgctagcacagttactgtgtgccctcctccattataagcgtcgatatgggggttgggtagcgaaaatgcagcctaaccaaatcgtcaaaacaatcgccgtcgccatacattttggagcaccctccatatttgcctctcaagcctttgtatttgcagttttcggggcctcttttggagcaccctcagtccacgaaaaaagtgcgcgatgaaaatttcaggatgctccaacccccatggccacccgcgctggacgtggaacatcacagtaagagcttcgcctcaacccatgcc

SEQ ID NO: 36787 - DNA, 193 bp, Triticum aestivum
  Clone ID: PAT_TA_36787
agaagtatatcacatgaatgggccaaaagtcaagaggcagaatggccgcagtgggtgaccgcttgctccctcatgcactggacctaattatggctaagagtgtaccaggagctggacagaacacgcattgttttctttgacaactatctataacagatggggaaaaccatcccctttgtggtatcatcaaaat

SEQ ID NO: 36788 - DNA, 441 bp, Triticum aestivum
  Clone ID: PAT_TA_36788
tgtttattaataattgacatcttattttctttctccaagaaatactcagagggctgtatacaagatgtattacaattatggctccgagctaacttatgaggagaaaggatctcttgtcacgctaataaatgatgttgagatttttaagaccaattatcaaattagccaaaattatagtggatacatgccactagtatacgagttgcatgatggcaacttcattgcagaaaacatggtatgattttgttaactatggttgcatacattcttcttaagtaaactatattgctaactatatatgttactattatgttcttcaacagaagctcgcgatggagtttttacctgacatgatgtttaccgaaggtcatatgcatatggttaccttaagaccgactccgccgacggcttaccatagtgcatactcgatttctctaaaag

SEQ ID NO: 36789 - DNA, 427 bp, Triticum aestivum
  Clone ID: PAT_TA_36789
tcgacgggggtgtcgaaatatattcgtactatatgatgcatgccatgcatataggccaagcgtttagagaatcgtttccaacagtaatgacgcctcggtaaaatccattttcgactcctcatggcttgacatcattgccgagaaaacttttctacatcagaagtgaacaaataattcttagattaaaacacgaaatacaccaaattacaacttgatttgagtcaccaaagtgatattcatttcaacacggatttttcaatctagacgcgataattatgaaaattgggggaatctccaactgtctagagttacagagaattataaaaagaatccacaggactgacgaatgaaatcccatgccacaattttgtgctaaagccatgcagaatcattcagctcgatatcaacgcatcagtcacgaaattcc

SEQ ID NO: 36790 - DNA, 405 bp, Triticum aestivum
  Clone ID: PAT_TA_36790
tggttgtttggtggtctcgaattttgatgtaatttttattatgttcaattaagatgccttgtactttcgatgaacttttgtatataataatatatttgatcctttcccgacacacatacgtgcggttttaagccatgaaacattgagtcacaaccttaacatgttcttcttacatgagtttttgtaataaatagcaacgacctcatcatctgacgaggactttccttgctcgatctctgcgcagaaaccagaccaacgtggataatgtacgtctgtaaatacctaaaggttcggacgctgacgttggtgtgggaagatgatagcactgaatttgctatgatcgtggacaacgtcagtgccgagatagggacaacaacaaggcggtatgggactttactgttttct

SEQ ID NO: 36791 - DNA, 405 bp, Triticum aestivum
  Clone ID: PAT_TA_36791
cagacggaaacggtgcacttcgacaagatcacggtgcggctcaagaagctcagctatgggctcatccaggagcactgtgaccccgtgctcgtcgcgcagaaggtctgcgtagaatgtctgcgtcagggtatacatgggcgtcaccaccagccagctcgacgagctcgccgccgagaccgtcgccgagctcaccgcctcccagcctgactatgcctccctcgcggcgaggattgctgtgtctaacctgccgccaagtggaaatagtctgtgtggcgcccgtaaatagagaacattttggtagaaaggtacaggaaagaatagggaaacttctgtcattttctttggtctttggaaaataaatggtgatatgggctgatacattgctaaattacatgatacggactc

SEQ ID NO: 36792 - DNA, 432 bp, Triticum aestivum
  Clone ID: PAT_TA_36792
gtttacgcaggttgttatcgtgctgaggatgctatgggaaaacagggacatgtttgatcttgttatcagtgatgtgcacatgccagacatggatggctttaagcttcttgagcttgatatggacctccctgtcatcagagtaatggaatgttaattggctggtggcggcatgttcaactatgggaaatgatgagctcctacttttatgccagctctatgtcgtaggttgaccatactattgtgagaatctcggccaggatcattctttatatcatgttggttcatcttggaattcgtacagccgtttatcgtcgaaggatttactcacagaacacaatcagtgtgattatgcttttctacacttctgtccagagcaatggatatgtattttgtattgtacgactaccctctaatgcactactcagccttcag

SEQ ID NO: 36793 - DNA, 213 bp, Triticum aestivum
  Clone ID: PAT_TA_36793
cgggcaaggatgatgattccatcttaggaggccaaacttcgaacaaaataggtagtacaatcagcagacgcttcaagatgactgactgggagctaaacatttatatgattacttgctgtattgggtctgttgttgtatgggagtttgtgagggatgttctaaaaacctctgcaccgggaaatccttggcgattaatctatgacctcccatagt

SEQ ID NO: 36794 - DNA, 407 bp, Triticum aestivum
  Clone ID: PAT_TA_36794
gggtccacggcgtactagtaaatgattgtggttagtaagaatattggtgttaaggtttgtgattcttgaagcatgcactatagtctctcgttatgctataaagttggagcatgatttattattgattgtctttcttatgaatggcggtcggggacgagtgttggtcttttcctaccaatctatccccccaggggcatgcatagtagtactttgcttcaagggataataaacttttgaaataagtatatgagttctttatgactaatgtgagtccatggattatacacactcttacctttctgcaatttgctagcctctacagtaccgtgcattgccctttctcacctcaagacgtggtgcaaactttgccggtgcataccaaactccgtgatactctatcacaagac

SEQ ID NO: 36795 - DNA, 384 bp, Triticum aestivum
  Clone ID: PAT_TA_36795
ctcacacgcgaaaatgagtcgcgggatgatggccccaagacataggaatcctcaaacataaagtggctgctcaacagtttgatcggcaagccggagccagacaaagtgtctgtcgaacatgcatacccctttgcacagggcaagctctttgtcctaaccatcacagtcggcctcgaaagctaccatgtcaatgtccattagcgacatggtacatccttcccttaacgcactggttacaacctcgaagacgcaacgggcctgtcgttgaacggggaccttgacatcgactcggtttctgcagcccatctgcccaaatcacaccctagcttcgacccacagcgatacctcgaaatgtctgaacagtggaaggcctcgcctctgcca

SEQ ID NO: 36796 - DNA, 385 bp, Triticum aestivum
  Clone ID: PAT_TA_36796
gggtccacaccattttggcaagcgatgcccgaaatcttgagcacctttacatcattgggaatgtcaaccgaaccaaacatttattgggggctgtatacaaacctggcaaacaactcccaaggccttgtggcaagcaagtaaaggtacacaaggacatcgctgcgcatgcacatctaagcgacgacgaccttgggacgagacccgacacgagtgccggtgtactcgatgtcgaacccgaccaccttgtacttctcctcggcaagcaacaactccatgatgtggatggagtgctccacccagaccgggttgttggtgtacaccaccgagagctccgtgaacattctgtgggtgtccaacacggcatgcattgtgaactgctgctcat

SEQ ID NO: 36797 - DNA, 401 bp, Triticum aestivum
  Clone ID: PAT_TA_36797
gtcaggtgactacctcgtagcccggcctaagtggtccaagactgagaatgatctggttgataaagggatcgaaccagagacaattaactggccagaccgttgtcggacttggttcttcggggctggcggaaccttggaccctgtaacagggaagtgcatttggacgaacgatcaaatggacataccagtcaggaagcttaagcagtatatcaaagtagcacaggaagggacgttctttccagacagagagaacgacgagctcacaatggccctcgggaatcctgatcaccctggacggacacgaggcacgccaggccccattccgtggaaggttgggtttccggaagcaggcggttacaaatcccatgagaagacgaaaaaagtgcagcaggcccaaatgc

SEQ ID NO: 36798 - DNA, 426 bp, Triticum aestivum
  Clone ID: PAT_TA_36798
atctgagtctttgatgtgttgtgatgtctgattataaatgacagactgtttatgtgcatcttattttgctacagtatataataagagctgtaatgtaatgaagtctcatgcgatttactgataatatggttatcgctaaatatgtttgatgtgcatcttaacgtctggtaatatatttgatatgaacctagcctgtttcgagaaactacagagcaaagaatgagagatggcaatgttaaatactaaaaggactttggatggtttcactcggctcagtgatattcactcatgttgtttcgccaaatgaatcaggggcttatcagtctctcaaaccaacttcacagttcaattttcacaaattcggttctttaacttgatctgccaaagcataggcctctggtgaatcagcaacagtaacttgaagat

SEQ ID NO: 36799 - DNA, 389 bp, Triticum aestivum
  Clone ID: PAT_TA_36799
tcacgggtccacgggtatcgctgaaataagacgacagaagtcgacggggagtatatgggccttattgggccatacgggaatagaggagagagaccaaaaggaaggaggcatgtgccctccctctggtccgaattggacaaggggcgcagcccccttttccttcttcctctccccctctttccccttctcctactccaacaaggaaggagggagtcctaccgggagtaggactctccttggtgcccccctcctaggccggccgccccctccccccttgctcctttatatacggggggaggggggaacctctagacacaacaacaattgatcccttggatctcttagccgtgtatggtgcccccctccaacatagtccaactcaataatat

SEQ ID NO: 36800 - DNA, 220 bp, Triticum aestivum
  Clone ID: PAT_TA_36800
ctgagacgaactcgacatctggggtggagatgctcaacgggctgctttgcccaagtccggattgaacatgcttaagatcaatacatctatcacatctgtgatacctgcagttcaactatagcctcaacgatgttcatttaatcctccacatcaagtccatcatgacgcacttgcgcaagccgttgcggaaaacatgcacagtatctaccccaatgagtta

SEQ ID NO: 36801 - DNA, 396 bp, Triticum aestivum
  Clone ID: PAT_TA_36801
acacatgaatcggaagttagtagtatactatatgtgcttcacgtacatcttttgagttatatactttttgctctagtgcttcagttatatcttttagagcacgtcggtggatttgttttatagaaacctttgttctcgcacgcgtcacttatattaatttgagagtccaacagaacatcatggaaattttctctaattatttgaagcattctagataaattcaatcaaattttcttaagatcgtgttgaatactatgaaaactttgatacgtgataattgttttgatatatggagatggtgatattacagtcgtactagttgagtacttgtgaatttgagaaatgcttgtgttgaactttgtgagtcccgtaacatgcacgtaatgtgaaccgtta

SEQ ID NO: 36802 - DNA, 425 bp, Triticum aestivum
  unsure (1)..(425): unsure at all n locations
  Clone ID: PAT_TA_36802
cgggtcgacggggagggacaaatcggcaagatccggtcaccacgcgacctgaagagcaacagtgatctccacaagctgtaggccgatggcgtgctccatcccctgcgatggggtgaccatggcggtggccacaactcctcatgctcgcctcgatcttggcgacacaccctgagtgtangaggcagcaacgacctcgacgaaatcatggcctccatccaggaacgcaatcatgtcgctctaaataaatggattcgatcatgtgactctaattacttcggattgttatgtgcacactaagcggggtgcagttaggaaagaaaatgttctctaattaaagtgattgagtgatttaaggtaaggttaattaatttagatttgatttttagtgattgttagtaaagtacgatgcgtctttaaaatctttt

SEQ ID NO: 36803 - DNA, 307 bp, Triticum aestivum
  Clone ID: PAT_TA_36803
aggtccagggcttgctgcaaaatgaatctaataaatgtggggcacaggtagtagatcgggcggctatcacgtccggcatccaacgaccgttaaagtgacggataaaatcaagaaatctgccggcggacgcgtatggtcacccatacaatatgcgttacgagaactatgtcatgatcacatgcctgcctgaactactgttgtgcggacggtaactggctaaagactttcatcactatgcctgtagatatttgttaatacaaggttagttcatgacatactctgcatgacttaccggaaccctacatta

SEQ ID NO: 36804 - DNA, 243 bp, Triticum aestivum
  Clone ID: PAT_TA_36804
gggtcgacggggcagactaaatctagccgtcataaacctccttatatcttcctcagaacaaccaccacacgtacctattatggcatttctataaccattccgagatacattgccatgcaacgtgccatcgttccatttatcattatgacacgcaggacttttgtcatagtgccattgcatgatcatgtagctcacatcgtatttgtggcaaagccatcgtgcagaatttttcatacatgtcac

SEQ ID NO: 36805 - DNA, 127 bp, Triticum aestivum
  Clone ID: PAT_TA_36805
gggtcgacgaaacagtcaaatgttaagttgcagaggcggcgaagcctgctgcttattataccgtgtctgtgttatctgagacttgaggttgtggtggttattgttttgcttccgaatggtcggagtt

SEQ ID NO: 36806 - DNA, 426 bp, Triticum aestivum
  unsure (1)..(426): unsure at all n locations
  Clone ID: PAT_TA_36806
agaagggtactagggtacctagggtttatggcgtctcgttgtttttgcaagctagcatgtgactccgggatgcctgttttaagattaagatttcgcttgtgttgagagatattattatttactgcttgtagcctacctgggataccatcatattttgttgattatggaacagcttttatcctgcttaagctctgtattttgcccgagttgaaatggcctgaccagttgaaatccttcggtaccctagtatggttacctacctgcattttgaatgaatttctcgtgtagcggtttggctttaagctgttcatttgtttgtagaattgttaactggttgcttggtangggatagttgtattgtggttagtgtagaatacctgttgtaggcatgtgtaattcctgngtgacttgcctagtatcctgcac

SEQ ID NO: 36807 - DNA, 181 bp, Triticum aestivum
  Clone ID: PAT_TA_36807
cagtaggaaaccacacacaagtccctcgtacctacacaacaaagatagcaactcgcaaccaacgcttatgggttgtcaatcccttcacggtcacttacgagagtgagatctgatagagataatatttttggtatttttgatagatatatacaaaaaaaaaaaaaaaaatcaaaaaaaacaa

SEQ ID NO: 36808 - DNA, 423 bp, Triticum aestivum
  Clone ID: PAT_TA_36808
atatcattatgaagttggattgcctgtttctcttcacatagaaaaccgccatttgtagaatgttgtttcgcttcacttatatttgttagagcgtgggaatatcttttgtagaaagaattaaactctcttgcttcacttatatctatttagagagatgacaggaattggtcattcacatggttagtcataaaatcctacataaacttgtagatcgctgaatatgatatgtttgattccttgcaatagttttgcgatataaagatggtgatattagagttatgctagtgggtgacagtggattgtagagacacttgtgttgaggtttgcaagtcccatagcatgcacgtatggtaaccgttgtgtgacaaatttgaagcatggggtgtttctttgattgtcttccttatgagtggcggtcgggga

SEQ ID NO: 36809 - DNA, 134 bp, Triticum aestivum
  Clone ID: PAT_TA_36809
aggttaatagtattcctgcatgacatgtgtaacagatatatttcaaccaacacaatcaacactcattatatcttactatgccataccgaacatacccgtcacgacggagaccggcggaaagctcacgcctaccc

SEQ ID NO: 36810 - DNA, 417 bp, Triticum aestivum
  Clone ID: PAT_TA_36810
gacaaccaatcccaccacttcgagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtacccaagcagattcgagctggcattccatgtagccgggcgaacaactattaccgtgcagatggccagaacacgggcaacttccttactgaccgtcgttcaaccacagttcatgctgctcctggcggtggctcctccctgggctaacttgttgggcggaaagcaatgttaatgatggtgcctgcttaatgaacg

SEQ ID NO: 36811 - DNA, 418 bp, Triticum aestivum
  Clone ID: PAT_TA_36811
atccgggtcgacgggggaggaaaaagatgagagattgaagatggatgccggtcgttggatgtaaatccaacgactaacatgtcagaatcatttgttgactaaattgacaacacttgcgttgtctttgacctattggcccacatttcagcctccaagaatgtggcacgtattcaacccattttttcagaatttacagtctttttttgcgcagtaaaatttacagtcaatttgatctttttttttgaattacaacaataacctgggctgggtgaccaattaaggtaccttcaagttaaccaattaatttaattcccaaaaagttacaaggcaattgcaacttaaccaaaatcacgaatttgccgaaccgaatccaattaaaatgttgggttgggccaacaatgttatccaaaaattaaaa

SEQ ID NO: 36812 - DNA, 420 bp, Triticum aestivum
  unsure (1)..(420): unsure at all n locations
  Clone ID: PAT_TA_36812
ttcacgggtcgacgacaaatttccatcggaagaagactccatgatatctgctccagcttcgtcttcataatcatcatcattgtcggggtcggagtcggtgtcgtcgatgatgatgtagtcttcgggatggtcgtcacctcctggcatagggtctcccatgaatactcctagcttcttcttcaggtcttcattcttctctagtagtactgcaatttcctcttcatattcatcgcgtgtagacttgagttcctcttctagctccatgttcctggtcatcaccttctttaggtatatcatgctggcgcacatctggttctcctgacgacgaatgtgttggttcaactcttggatgtaggctgcaatggacttgtcnctcctggtgcaaatcatctaccatttctcatcttggcgttcacatat

SEQ ID NO: 36813 - DNA, 384 bp, Triticum aestivum
  Clone ID: PAT_TA_36813
ggtggctagtagaatcatccttgatctatatttttgggttggttagtcaaagagcacgtgattaaattagaggaagtacatgttactttgttgtttaccctggatgtgttcctacgaacatgcatatgcatcaaaacaatccaattcatcaagaataattgatccaaagcagttaattcacaaaatccttggacaaccttccaaataagtttcaacaatccaatttccaacctcaattttaaaaaagggccaaccaacaaaccaatccatttatccggcaaatttggtccaaccgaacattgataaattgcatgttaaaatttgggtcccaaaaatttccccggtaagtcaaaggcacaaaggaacaattttttccaacccaat

SEQ ID NO: 36814 - DNA, 325 bp, Triticum aestivum
  Clone ID: PAT_TA_36814
ccgggtcgacggctaacgctacacctgttagtcacatccgctcattaagttgagttgaagatgaacctctatctcaaagacgccagtagtagctactacgtcggcgctattgcatattctgcaaaaatgtatctcggctaccaatttgttggaacgactcatttagctattttcgacaaatgaattggataaaataagaacatctatgttgtggtcgtgcagtaacgtgcttatgttgaatacagtcaatattccgttcgaaaaaagaaaaaagagtaaaccgcataaaagaagcaggaaaaaaaaaagaagaagagtttttttt

SEQ ID NO: 36815 - DNA, 419 bp, Triticum aestivum
  Clone ID: PAT_TA_36815
tcagagcagtctaatgccgagccaagcgatcgggttgtgtttcttgagaagaagattgcagaacttgagaggcgggctaaagctagaggcgaatctcaagagtaataagctaacaggtaagttttgatcgagcacgtgaatcctatcctaaagaagcactgtttgtaacctctgtctggtggcgaaggggtatctggcaccgacttacccatatagcaccaagatttgacttggactatccaattttgtgagcatgtgtgtgtggcaactgttgtttcgagcgaataaagagggatcctggcagataaaatcgccagtgtttgttgggttaaccgcagtgatgctggtcgagcagaaaccagagggtacttattattcttgtatcacttgcttgacatttgagaatcgaacgatgtaat

SEQ ID NO: 36816 - DNA, 430 bp, Triticum aestivum
  Clone ID: PAT_TA_36816
aggatgaaaaggtgtggtcccgaagaactcctcctcctccgaacacctcgatcaccgaagaccaggagggaacgtccctcttggacagcgagggaaaggagtccgggccatctggaccccctccgacgaccactcccgagcgtccaaggcccccaacagcacaggttccttccaactgggaggggggcgggagccaatgccagtaccgaacacctccgcatgggcggcggttgactggccggatacgctagaggagttggtgagcaactccgtcatagttgaatggcaccgcacccttatgggtgcagttatgcagagtgttcggtctgtccaatccgtactgaacgacgatgtccaaggccttctaacatgctttgaggtaagtcaagtaatgatatttcctcataatgtggttatagttgtttaattt

SEQ ID NO: 36817 - DNA, 375 bp, Triticum aestivum
  Clone ID: PAT_TA_36817
cggggatgccctagtgaaacaacatgctaaagttgctgaagaagctgtatcaggttgggagaaagctgaagcggaggcctcggcactgaaggttcagctagaaactgttacattgtctaagctagcagctgaggaaagagctgcccatctggatggtgctctaaaggaatgcatgaagcaagtaagaactgtgaaggaagaaggcgagcagaagctacatgatgtagtttttgcgaaaaccaaacagtgggagaagataaaggccgagttggaagaaaagttgccttgaatttgacatgagctcataagggctggtgctgagaatgatgcactctcaagatcactccaagagcgggcagatttgttgatgaaaat

SEQ ID NO: 36818 - DNA, 413 bp, Triticum aestivum
  Clone ID: PAT_TA_36818
ctaacggaagcaagccggtgacacaacggttacccaggttcgggccaccttgcagtgtaaaaccctactcctgcttggttttggattgcaatagcgaaagagaatgagagtacaagggttggggatcaagtggtcgaactcctctacggcggctccctgccatccttttatatctaccttggtcctcttccaccgaaaacattggcgagaagggttggcacacaatggcaattttcacgggggacagggatgtagtctatcgctagaaaaggtggtcttcaccttcaaagacaccgtccatgacgcattggtgggctctggaatgatctctaccctacacgcccatcgtcatggtcatcttgcaccgatcgggcaatatttggggttgctattggaacctgcatgctgccctt

SEQ ID NO: 36819 - DNA, 428 bp, Triticum aestivum
  Clone ID: PAT_TA_36819
gggtccacggcacccgtgtatataaatttgataatgatgaatcaattagtgacattagtattacattcaagaaaaagtaaaagataacaaatctaaaacaaacaacaacaaaatttgcacacaattttgagacaagttgcacttttttaatatggaagaataagcatataatagtgtaattttcaaaaagaagaagctttttagtaaggaatgaattagtggcatttgtattttccttaaagaataaataaaatgaaataaaaaataaaactaaataaaataaatcaagtttctaaagaaaatgaattagtaacattggtattgccctttaagaagacatgaatatgacaaaatttacacataaattgcactttttataatatgtaaaataaatgtataatagtgaatatttcgtgaaaatgaacttt

SEQ ID NO: 36820 - DNA, 428 bp, Triticum aestivum
  unsure (1)..(428): unsure at all n locations
  Clone ID: PAT_TA_36820
cgggatanaccaaaacgaagtcattggtgtacgcattgaagatgaagttcatcatgcgagagaatgtcggaggagcattgacgaggccaaaagacatgacagtgtattcgtatgaaccatagcttgtcctgaaagccgtcttgggaatatcttgctcacgaattcgaatctgatgataacccatatggagatcaagcttggagaatacttgggcacctttgagttgttcgaactcctcattgatgttgggaagtgggtatttgttcttgatggtcttcttgttcaatggacggtaatcaacacaaagtcggtccgttccatccttcttcttcacaaaaagaacaccacaaccccacggagaagaactaggtcggatgagacccattttctcttgaatatcgagttgcatcttcagattcttcaactct

SEQ ID NO: 36821 - DNA, 412 bp, Triticum aestivum
  Clone ID: PAT_TA_36821
ttgctctgcttcgagtatctcagtggcggaagcatcgataagcttatctataagggaagtgggtacgtgctagattggagcggacgctacaagattgtgcaaggaatatgttcaggcctgcactacctacaccacgaactagaccatgagcagaacatcgttcacctggatttgaaagcgagcaacgtactggtcagccgcggcgatgggggagacatcacctgtgtgaagatcgccgactttggcctctcaaagttcttcaaagcggatctaacacactcgtacacggagcaggtcgttggtctattggcgtacatggcaccggaatacgtctgcaagggcagaatttcacccaaggccgatatatacagctttggcattcttattctggagatagtcactgggcgatgcg

SEQ ID NO: 36822 - DNA, 444 bp, Triticum aestivum
  Clone ID: PAT_TA_36822
cccgggtcgacggggaggcccaattgttatagtttccttttcatcaaggctatccattcttccgtgaggaaactgtaagacttattctacaagttgttcctgatgagtccttcgcgtatcgaaagtctgacatttgcttgaagacaatgtcaatgctatctcgaagcatgtctgtggtaatccaattttcaataagtgcatttgaagcacaatgctaaattttctttagcatttatcctaacaccgttgtatgggtaatatcatgagattcctccccccttacctaaatgattttctactttctatcctgtcatggatatcatgatccgcttgtccttggaaaggatatacccctgaaatatgtgtttaaacacattttcctttccgttgttctgtttaaccttcttgaggtttatatgatctaagcagtaatacgtcactact

SEQ ID NO: 36823 - DNA, 185 bp, Triticum aestivum
  Clone ID: PAT_TA_36823
tgagtcgtattaatgttgaaacttggcatggtatcatcatttcacccgcatagcatgtgcgaaagagtagagagggtcacggcaaaaattggacgcacttcgtgtacaaactggaaatagaagaaaagaaataatgcagaaaagaaaaaaaactatacaaaaaattactaaaaaataattagaag

SEQ ID NO: 36824 - DNA, 412 bp, Triticum aestivum
  Clone ID: PAT_TA_36824
gatgctggatccggcacctcacgtggtgccggagaagaaggccacgggaactcgaaggagttcccggcgccaggtgttgtcggactcatcgtccgatgactccgaggcggactcctcccgcgaagacgaggaggaggaaaaagaggcctctcccccggcagggatagagaagaaaaggaaggccgccccaactggggaggccggagggtccaagaagggaaggaccccccccctccgaactactccaccaacgccgacgacggcgaggaggagtggccaccaagggctaagcccttggcgaaatcgtaagcgtccgggtaccagaataactcatggcgtttcatttgttgcacagaatctcctaacgccgaatataaccctgcagcccgcccaaggaccagcttgatgcctc

SEQ ID NO: 36825 - DNA, 149 bp, Triticum aestivum
  Clone ID: PAT_TA_36825
gggtccacgggatacactaaagggcatacgtttatattttcaaccaatttatatgcactggagcatgtgcctgtagttcaaatttgaattatgcacataaaataaattgaaaactcagttaatgcataaaaatgtccaaacgaaccccg

SEQ ID NO: 36826 - DNA, 170 bp, Triticum aestivum
  Clone ID: PAT_TA_36826
atacactcacatgaagtcttattaacattacaaccaagggacatgcactggaccatgtccctgtagggcacattataatcatgcacatagaataagttgactactcagttaatgcataacactgtcaagatcatcaccgaataaagggacatcatcttggatttcaacat

SEQ ID NO: 36827 - DNA, 444 bp, Triticum aestivum
  unsure (1)..(444): unsure at all n locations
  Clone ID: PAT_TA_36827
gggtccacggctgcccatcatggaattgataagcacctgaatatgtggagcatacccacaagatctcttctgatctgtagctgtcctcttgattgtctcaacaatcaagctcatcactttgaacttttgagggacatcaaatatatgtaacaagttgatggagtgtcctgttatcattctgtgatctcctgatttcgggaaaagtgtgtgcctcagaatggtattggtagtagacagccctgccagcaaatgcttcacagagccaaacttgtgagtctcaagatcttcatctggaatctctttgtacatgttgtccatagagttgtgatccttcttcatctttgcatagacatctaggtcatcctcatgagtttctggagcattgatcaatttggcncactcatcaactgtggattggtaccttgtaccctcagacatccatac

SEQ ID NO: 36828 - DNA, 326 bp, Triticum aestivum
  Clone ID: PAT_TA_36828
ttcacgggtccacggcggatccccaatcgatagacaattcccctaatagagtcccactgcccacgaacgttcacgtctacgtcggctaacgacatgtcacatggcaggtgatgtatcgactatgtgcaatcatctggtggatcgatcagcactgccaatcgtgccttgtccggattgcagcatgaacgtctatacgatacattgctacgtgtgcgtacatcccacgtcagcgttcctccaaatgcccgactcacatcacttcagcgggcgtattctaattcgatcggtactagcaaagccatgtcgcgcatcacgccaatcgccat

SEQ ID NO: 36829 - DNA, 418 bp, Triticum aestivum
  unsure (1)..(418): unsure at all n locations
  Clone ID: PAT_TA_36829
gggtccacgggacgcataaacaagaaactatatatgaaaatgctggtcctatacaaaacaaaagtcatggtttanaaacccactaacgaccaacatacccactaacatttatgtctacatggttcanaaatccccactcatcgaagaaaaaacatttcctgcattatgcaagcataaaaaacaaaatgcatacataaataaatccacaaatagagatttggcataaaagaggggaaaacagaagaaaaaaatgcaactgaagaaccccgagggacaaagacccctcccttgagacaagtactccgtggtagatatggtgtctacatggcaattgaaaagttcaacaaaaacaatgaaaaatgcctctcacaaccagcacatcacgcatcaataccgaacacgagaaaaanaannanac

SEQ ID NO: 36830 - DNA, 429 bp, Triticum aestivum
  Clone ID: PAT_TA_36830
gatcccaaattgtcttttttgctgagagctactcagatgttcaatgatttgaaatttgagcgcacctcacgtaccaaattatctagtacttggaaaaaacttggaattttttgattttatttctagtatttgttttgaattgtttttcaacgcgggtgcagatgagtctgggcaccaaatcgctgcactcgttctcacaggatcttccgcctatgactcgcttatagccagatgtatggctgcctcgcccaatccagcatgagactatgccgacccagcgtgtggtaggctataggcctcgaaacactctttttcccctctttttttttgaccttttgtggtcttagttttttagtttttttacttttatttagacttccaaatttttttgtataagaaatgttaatcatgcattcgataaatattaaa

SEQ ID NO: 36831 - DNA, 426 bp, Triticum aestivum
  Clone ID: PAT_TA_36831
ccataaacatgtacccacagtcattcttgaagccgttgcttcaccagacctttggatttggcattctttctttggtttaccaggatctcataatgatataaatgttctccaccgttcacccatgtttgcaaatctagttgaagggcatgctccagaggcgaattataccatcaatggtcacaactacaaacacagtgtattaccttgccgatggcatatatccgcagtgggcaacatttgtgaagacaattccaaatccaaacggtgagaagaacaaaaatttctcccggtttcaagaagcatgtcggaaggatgtcgaacgagcctttggtgttctgcaagctcgttttattattgtacgtggaccggcaaggtattgggatctggagacactcggagaagtgatgacagcttgcatcatcctgc

SEQ ID NO: 36832 - DNA, 418 bp, Triticum aestivum
  Clone ID: PAT_TA_36832
atgcacaaatcctatgcttcaggtgagacagccacgatgggaacacgactcatattctaaagttctctatttcgactgagctgtgattagagatgtcagttatatacagaaaaacttgaatggatgtgcgtttggggattatacaatttaaaggcaactttatttttttgcttttagcgtatggacctgcaggttatatctaatagtagtagcttattgacttctgaaagcaatataagcccaatagtctttgcaaaaaaaaaaacccaccaactactggttttatagccagttagaccgtatcatcacacttattttttctcttattggttgaactccaattattctataattgctacattaacaaactgttcttcacattcggttgtgatttggtttcagaagttcatttttacat

SEQ ID NO: 36833 - DNA, 411 bp, Triticum aestivum
  Clone ID: PAT_TA_36833
cgggtccacatccagggccaatacaaaatctaaggaagcaaggagcatgagaaggactcactggttcacctcgccgaggccatcatcgacccctactacagagacatgaaggattcatgcaacaaggacaagcgtgcctggcacttggcctgtatggagaaactcgacaaagctcacgtcgtgtacgcagccaatgaggagtacacgagctacgacatgtacaagcggatcgttgacatgaggaagtgcctccttccccaaaacatccagggatccagcccgaagcagagcaatggcaagcgtcatcacaacaataactagatgattagatcctcgcttctcctactttagtatgcatgtacatgcttactttggtgtgtggaaatactacgtatgtagtcacttatgtaa

SEQ ID NO: 36834 - DNA, 441 bp, Triticum aestivum
  Clone ID: PAT_TA_36834
gggtcgacatcctggtacaaacttaactgccgggctactctttccgcttcttcttgctcttcgggaagttctcctgtctgaaggaaacgtacaatctgctgtgcccttgctggagcttgcggctcgacaacaacgactaaaggcacatctgccgctgcgggaacatccgcttctacgtctagaacctgcggctcagccggagcttgatgttccccggcaagtttgcctgagcaaaacttgtcgggaacgtctgcttccacggaacaaagcctaaggcttgccggatcatactgctcctcagcacccttggtgttgatcatgatgaccttcttggctgcggcttcggggagctctgccggaaaatagtcaccataaatcaacttcctcttcatgctctgtccagttgatggcattatagacggttgagtcagcttgagcaca

SEQ ID NO: 36835 - DNA, 119 bp, Triticum aestivum
  Clone ID: PAT_TA_36835
gggtcaccctaaactgagtcttatgaagtctccgtgtaatgtcgctactacgccgtcacttttcaagtccgggcggtatctgctgcagtgctctagctggatcatgctgctcaatgaat

SEQ ID NO: 36836 - DNA, 424 bp, Triticum aestivum
  Clone ID: PAT_TA_36836
attacatggacaaaggtatacatatagcctttattatcaaaaacattgtttttaaaatcaaaatacatgtcattggaacatgatattctttgagcactgagcctctatgaaacgggcaccttctaagacttcttcaaaatagtgctcgggcgagtcctggcccctgggtggaacactagttgcaatatcggtggcctccatcttcgcccagtatgttttaacatgggcaaggtccatccgcgcaccctctatgcacgctgatcgcttgacagcgtcgatatgcggcacatcacaaataaatcgttgcaccaaaccaaaataactatccagacttggttccttcatccacaggtgatccaagacggccttcatggcaagcccggataacctatggagctcggcccattcagccatttgctcgttc

SEQ ID NO: 36837 - DNA, 351 bp, Triticum aestivum
  Clone ID: PAT_TA_36837
gggtcgacgggaaaccggagcatcagtcacatacgaagcatattgagctcgatattcacttcctgcacgatcatgttgctcctggccgtgttcgggttctccacgtgctgacgtcgcaacagtttgccgatgtgatgactaccggattgcctagctctgtctacgaggagtttcggtctagtctcagtgtctctggtgacgcatccactgcaatgggtgtttagtatgtatattgtgttgcatgtacattggagttgtggcctacatcctattcttgtatacttgaagtagaggcctagcctttagttaactatacgtgcatcagcatcacatcaatagaacttctactgt

SEQ ID NO: 36838 - DNA, 204 bp, Triticum aestivum
  Clone ID: PAT_TA_36838
gtcagaattacgggtcgacggcgttcggagagggatagagatgtcgctccgtgcttaccaaggagtatgtcggtgtagatatggatgtctgctgtgtccatatcgttttgcaagacttgttgtggtgctcaaatgttgagtgacaactgtgagacgctttagtccatcgaggatctgtgttccatccatgtacgtgaatgtgat

SEQ ID NO: 36839 - DNA, 441 bp, Triticum aestivum
  Clone ID: PAT_TA_36839
gggtcgacggcagtatgaaatgttgattaataattttagtgattttctatagaagagtatgataaggtttttgcattggtttatactaacttatctcacgagtccttgttgagttttgtgtggatgaagcttttgagatttagggagaccgtgatatgagaggaattaaggagacacaaaatctcaagcttgtggattcccaaggcatcccaagataatatttcaagaagtctcaagcgtctaagcttggggatgccccggttggcaccccacctttcttcttcaacaactatcggttagtattggttgatcctaattttttgcttcttcacatgatgtttgctattcttagatgtcattttattttgttttgcttgctgtttgaataaagtatcgagatctgaaattattaaatgggagagtcttcacgtagctaaataa

SEQ ID NO: 36840 - DNA, 398 bp, Triticum aestivum
  Clone ID: PAT_TA_36840
taaatcattaaactgtgatcccctcctaacggtggcactaatcaacaacttgccgacaacgccaagcaatgggaatggatcaccgataacaacgtgcggcgaaagggatcggcatactggttaggctcatattgatacggataagcaaaacttattaactgatcgcacattcagtcaattagggaaccaggactgttctgtctcagtccatgaccacacaaagcaattcagcaggtggaggatacggaaacggaagctacaaaccgatcctaatcaagcatgatctgtcagatttctaacggaaacaaagataggattatttttagagagaattattggactactatatggggcagaagcctatcctaagctagcctgcgagactactgtttctgatg

SEQ ID NO: 36841 - DNA, 391 bp, Triticum aestivum
  Clone ID: PAT_TA_36841
tcatacataaaaaatactacaatcactggagatttttatgaattaagagaatactgcctcattatgatctgttgtgtataattagaacttcttgtgggtaaaaaaaacaaaggttgggataaggaaaagctgaacttaaaaactgtacgtgagttcatagatagttgtacataccttgatggatagattagatggcaattctttactgttgatcacgccaaggatcaggttcagggccaccgatgctatgtattccactgtagccatgaagagcagacctccaaaggcgctcaatgctctctgcagcgtgctgcatgtgcatcgctaagttcagttaccgccaacaacggcgccgacagatggtggcgaaaggagatcagcaactcaataa

SEQ ID NO: 36842 - DNA, 427 bp, Triticum aestivum
  Clone ID: PAT_TA_36842
cgggtcgacggcgagcaagagcttcatcggctggtgcaagcaccatggcccatcggcagcgatattggtgtgacagtccttgagcgcacaatcgacatattgcagaagatgtgtgatgagcaatttgccatacaccatgcaaaagatccagacgtgctcgacggcatgatagacgacccacctgaagagccgccatcaccagagctcatcgagagcctgatgccctgcaaggaatgggtagaggacctccgcaatccagtcaagagacaggaagcctgcagcttcatcattgcccgtggtggccgtgtcaacctcgatcccgatgatgtggtggctaggctcgagcacatccttggcggagctgacgtcgccgacgaagtagaacatcgccaacgtgatatcttgaggatgcaggtgatggacggaa

SEQ ID NO: 36843 - DNA, 436 bp, Triticum aestivum
  Clone ID: PAT_TA_36843
gggtccacggctcttttgaacttgagcttccaactggtgtaatttcttatgaaaaaaatgcagtgttgacaaaagaatgattgtttttcttccacaaatagagcctaattttgattcgcacagggcctctcatttccctagtacggccctgctcataaacttaatatccaataaatttaagcctattctacaagcattgatgccagtttcgaccttctctgctggatatcagatgcaatctagtcgttgtccacacatgtgagaatacgaagaaagaaaatattttggcgccgcgataacttgcggccttttaggatatttcccatagctttatattagactgacactgacacccaagatgacacaagacaataggatgccatccggaatacaactcgaaccccgatttacaacaccttcacacgacatttgactc

SEQ ID NO: 36844 - DNA, 422 bp, Triticum aestivum
  Clone ID: PAT_TA_36844
taaagctgaaagaagacgacagaagtgacgggcatgggaaagccataaaacgagtggggtgggcatatctctggtgcattgcaaggctggttactgttgggagcgtctatacccttgctcattgcaaggcatgtgagatgctcgccttaccttaaatgggttgagaccaagtcttcgctcgattagctctcaccttacccattatacagctcaacgtacacacgttttctcttcttttttcccttctttccacctttagtttttatttatttaatattttctattcgtaaacaataatgtttttggcaaaatatgctatttttatgtaatttcgaaaaattcctcctgaagttcaaaaaagtgtttcacgtactttaaaaaatgttcttatttcatgcatctaggaaacagtttatgaaaat

SEQ ID NO: 36845 - DNA, 418 bp, Triticum aestivum
  Clone ID: PAT_TA_36845
tgggcagagaaacattactcaccgccggctcccgactccactcattggcgcatgcatttcgatgggtccaagatgcgcaccggcttgggagccggtgtcatcctcacctctcccaaaggggacaagctcagatacacgctgcaaattcacattaccgcctccaacaacgtggccgagtacgaggcgctcatacacgggctccggcttgccaaagaactcggcattcgccggatcctatgttatggcgactcggacttggtggtccaacaatcatccggtgactgggatgccaatgacgcaaatatggcaagctatcgcttcctcgttcagcagatcagtgggtattttgaaggatgcgagttcctccacgtaccacgaacccacaacgagccagctgatgccctggctccaataagct

SEQ ID NO: 36846 - DNA, 406 bp, Triticum aestivum
  unsure (1)..(406): unsure at all n locations
  Clone ID: PAT_TA_36846
gggtcgacggcggtatacaactagaatccctttgtatgtttacgccggactcgtctagccatgtccggggtttgaacgacctgtttaggtgctttggctagcanagctggtttagtgtgtggttgtcaaggcaggcgcacagtcctccgcgctcgagaaacactcgatatttccctttaacgagatgatgcctcgtggactgggcattttaagcgtaagggatacataatgcggtattgcgttaaagcgggcgaaagcttcgcgtcncagtagttcttgatagctatttgtaaatggggcgatgtgaaaggttagcttttcgtggcggaatttgtcggggaagccgaacacaacttctagcagccaaaaaaaaaattgagacagaacaaaaaaaagcggccgctct

SEQ ID NO: 36847 - DNA, 433 bp, Triticum aestivum
  Clone ID: PAT_TA_36847
cccgggtcgatgcgacaccctaactggagtcgcgcaaaccggaagcaaacccggagaagttctgggagagtccgaacatccttctggccaatcaacagccaccacgtacccctctctccgctggggatgcgttgttatttgggtttggcggaaggccgccgctgggatgcattgttatttgggtttggcggaagatgattagcatgcttggctatggcggataacatgtctgaagttcgcggaagccacaaatcactttgtttcactttattttcttcatatgctacaagatttgacgaaagtaggctacttggctactagatttggcggaagctacgctagaagcaccaagattagtagcttcctgccaaacaaaaatcgactactaattaatcacgtagtttctttaagggcatcatgtaattggggggat

SEQ ID NO: 36848 - DNA, 401 bp, Triticum aestivum
  Clone ID: PAT_TA_36848
ccgggtccacggggaatttaaatgggtaaagtcatgtttaggtcagctaactctgtttaagtgctgaacttgctcgattaaaaaatgtgggtgagctgtaatctccgttacgtacccaaagtaagcaatgtcatggatgaccactgtaaccaaggaaattcacaccaagattcttgacattcagactcatcacacatgggttgggctatcagaaccacttgagatgttcacatatcgtatatcgctctgaacaacggaccgtgtctgaggatacattgcgcgccaactttttcgatgaagcaattccaagttttccgcatctgcggcaatatctatctcactgcctctctccttagcataagccacatttcccctgtttacgccttcctttgcaagttgaa

SEQ ID NO: 36849 - DNA, 438 bp, Triticum aestivum
  Clone ID: PAT_TA_36849
cgggtccacggccccaagaaacttcacggtggcttgcaagtccaaactggcccgttaacctcgtacatgtactgctactacttgtagccgttccctgatttccttctctcttgcctagggattgggcggctgaggccggcttgtaatcagatagatagatgcgtgggtggttgggaggaactcatctttgaattcaaatcgtaactaatttccaagaaaccttagttcatgtgagccacaaccagagagtagctcacaccggcccttgtaaataaaatatactatggtgatcaccttgtactaaactcccaagctcaggatacgtgtggatgacaacacgaatgggatgtggaataggataaggcacgcgaagtcgtccatgcatgcccacgaaggcacgcatcgcatcgctaaaggcctggttgcgcatcccatggt

SEQ ID NO: 36850 - DNA, 383 bp, Triticum aestivum
  Clone ID: PAT_TA_36850
ggtcgacgggcgaatgcaatcaaagctggatgccggtgacaccaaggtggatgtacacagatagcccctcagccatcttgttcgtcacacatcgttgacactggacgactaccataccctcaacagttatattgatgacttgtgactagaattgtaatggtaagtgctatgatcaagttgataatgtatgatgacaaccaaacatcaagtagtcgcattgtaatgacatccactgaccttctgtactacaaggttcaacccagtctcgtgcaagggaatgggggagcccggcgacggtccaccgactccgtcatcttttgtaatgaatatcccgtgaaggaaccccgtgccaggccccaagttcacctcacacgtcgggtagc

SEQ ID NO: 36851 - DNA, 338 bp, Triticum aestivum
  Clone ID: PAT_TA_36851
ggtccagggcggacttcaaagttacaagaggcggtggccgactccaacccgccacctcccaccccaactgtcctagtcacagtggccgtgttggcaatagaagaaatcacagctccatcatgggcccagcccatcctcaagtttctagtaaacagagagctgccgactgacgagatctcggcaagacaagtcctacgctgagccggagcctacgcaatagtaaacaaagagctcgttaggcacagcgtgactggagtcttccagcgttgcgttgagccagaaagggcgtagcaatcctcaaagaaattcatcaaggcgagtgtggccaccacgggggc

SEQ ID NO: 36852 - DNA, 340 bp, Triticum aestivum
  Clone ID: PAT_TA_36852
actgactgggagaacatgatgaataaggagttgcatgataaatttcagcaaatgatgagtgaacaggtgcaagatgtggtaaacagatttgaagaggccatggagaagatagatggcatggagaagacgttcgaaacaaagctcgataacaaatttaatgaattgctcgcgcgtcttccaccaccaccacaggctgcccctaacgcaccactccaacaacaacaagaacaacaagaacaacaacaacaacaacgccgctttccaaatcaagtgggacgagcacatcgcgttcccattgaccctaagcaaacttctggtgtcgctgttgatgcctctaacg

SEQ ID NO: 36853 - DNA, 321 bp, Triticum aestivum
  Clone ID: PAT_TA_36853
gagtcgtattatggtggtggtcacggttgattatgggtcatggtcttctcaacctcggccaatgcccatggccattttctgaacatgttatggattagtaaggcttgaaggtttcatggattctaaggtgcaattgaacgtttatccttgtgcacacttccagagatgccaaatgcactacttattcttccacacatcatcaacttatactgctgaatgcatcatttcgtaaagatcaactccaatcaacacacaagctattcacatcatcttgagcctcaataagacgtcagaaatatcatacacttcaactacccacat

SEQ ID NO: 36854 - DNA, 383 bp, Triticum aestivum
  unsure (1)..(383): unsure at all n locations
  Clone ID: PAT_TA_36854
ggcaattcggggcatttagtcacactgtgactttacattcatacgatcgagatacaatgttaaacccgaataaaataattgcagcgcggtggaggtggcgtgctccgttggtgttgttgtcctccatgacaccattgttcaagtctctaagccagcctagaatgttcttgacatggaaacaaagaccctgtcgtcgcgagatcgacaggcggggcgcgggaggacaacatcttgcggtgttgcgcagtagtggtcgatggcggcatcccacgacactgagagggctgcacgcacgggcacggccgcggtgggtgcaggcaaacacacggggactagtgtcgcggtgggtgcagtggtcaggacggacacangcgggggcactg

SEQ ID NO: 36855 - DNA, 400 bp, Triticum aestivum
  Clone ID: PAT_TA_36855
tggatttgagggaaaatggtaggggcgatggaggtggttgccctctttatatgatgggacgtttcgggcatgtccatggacacgtgctagcccacgaccacagtcttgcatgcgcccacgtatacgcgaccccactcgtcagctaacggtcaaaggcattgacccaacggcaacgtccgttataacctcttatgagggtttcgggcaagggagtggggaaaagtgagcaaaagttaacagagtggggatgaatgagtagagctaaggaaccaggggcacagaaataaaaatccctagaaaataacgatacccgccgcgagcctcaatgttcattggaccacatacatcagtatgtatgatttccaataaatatgtttctcgctccattgttccggagaac

SEQ ID NO: 36856 - DNA, 426 bp, Triticum aestivum
  Clone ID: PAT_TA_36856
gatgggatatcctacagcagctaatcagccgatccccactgattgaagcggtggacgacactgaatgcatgcgagatccgctgcggcgaatggctgccttgacggttgttggtgtggattaggtgccggcgccggccgcgagtgcagacgcacagatctgctcgagcgtggtgtggttggcagaaggaagaactcgtcgccgccctcgcaggtctccacgggaaggccagcccacatgctccgcggtggttaaagagaacggctgcttcttcagtgcccaggcttgaaagatgttcatgtctatcgatgttgtgatatgttgatcggagcattcataaacgacgtgagccgtggatcaggttctcgatttctgtccggtctgtggctcacaaatgtcgatgactccatggattcaatgcaaggtga

SEQ ID NO: 36857 - DNA, 384 bp, Triticum aestivum
  Clone ID: PAT_TA_36857
gtacagtctagcgggtcgacgggccatactgcaagatccatcgaaccaagggccacgaccttcgagagtactatcaggttgagcagttcgtcaagagacaaagagctgagtgtgagaagcgtgacaaggacaaaggccagaatgccgctgatggcaagggccgaggcggtgaagcaaatcgccctggcaagccctttaggagcaaaggaaaacccgccaggcgtcaggtgaaggaagcgtgtgatcatgagagtgatggaggggatgaagaggaaaccagtgagcaagagtttcagaaggccaatgacgccctatgcattgatgggagtgcatctttgcacaccactacaggaattaggcactttgccgtcagccatggctgac

SEQ ID NO: 36858 - DNA, 406 bp, Triticum aestivum
  Clone ID: PAT_TA_36858
gatcactgcctttgcttcgcgccgccgcggaattgacgaccgcacgacccggaacagtatccagttgggcgcgtttgacattcgcgggaaaatatgctccgcccaggtagacgtgctctcctctcgtacgtaaacaaagccttgagcaatctttgatcaaacttaaacacctgtctcctactccctccgttcggaattacttgtcgcgaaagtagatatatctaaacatattttaggtcgagatacatccatttccaatacacatgattttcagaggacggagtatttgtgaatgcacggtggagtagcatgtgtataattcataaaggactgaggtaccggggcattttcaaaagctaacatcagcggcaaacggtatcatcgaaattcattggtttcggtttgt

SEQ ID NO: 36859 - DNA, 282 bp, Triticum aestivum
  Clone ID: PAT_TA_36859
gatggacacatatgaagatgcatatcgcttaccatcagtatctcattttgggtacgcagcaatgcggcatcattgggtacggtgcaggcttacagttccacgctgattacactggttccagtcatttacgtgtgtcttatttagcatgcaagtagcagtctagtgtctgtttctcccagtttagttcaatctagtttgactatcaccggtccttcacgaaggttagaatagcaacacttgatgatcgttgttgtggtttttgcgtacttaacgatcgctctt

SEQ ID NO: 36860 - DNA, 222 bp, Triticum aestivum
  Clone ID: PAT_TA_36860
agcactgtgtcaagaggtgactcgcaacgatggcaggacgttgcgatcagcttagtgatgcacaacgggatcgatgctgacgtcaacatcactagttcacagcgatatgatacctcggatcacgtaccaggatgcaatctagactgggcaaagcccaccatcgcccgcctgatcgtccaaacgtgcactagcgtcatctgcacacctcaggcaacctcttca

SEQ ID NO: 36861 - DNA, 421 bp, Triticum aestivum
  Clone ID: PAT_TA_36861
cgacaaggagacgatccggagaccttggaggcagagcgagctattgcgcgggcgaaggggttcggaggaatttctaaatttttgcccgtgactatatatagcccgaccctgtcggtgtgaccgagtggaacaactcggtggcaccgagatgcataactatgttacaattgtgggaggcctggacactattccaatgagtgtacgacaccctacaaaagaagagaagattctccaagaagaagaagtaaaagagaagaatcaccaccaagagagaggaggagtagagatgatcgttatgaacgaagaccctcacggagaagcaaggattcggaaaggaaggacaagtcatcaaggagctgcacaaaacgaagacatcaagctcatgttggtgaatgggtatccggctccgactccgacaatc

SEQ ID NO: 36862 - DNA, 413 bp, Triticum aestivum
  Clone ID: PAT_TA_36862
gggtcgacgcggaagtataacaacagtgtccctgaaggatcccgcattatagagggcctgtgttcaaaggatatcatgtttgaatgaatgtatttgcgattcccaaactttgcaatgacaacaaagcgttcgtataattatttatcctccattgcatccgtttatgaaatctgagagtcgtccagtcgtcggcttcagcccctcacgtaaatactatgggggtgttcggaacagcacaaaagaacatttaacccaataatttggtccttaaaggaggtgttagtgcggcgaaccaggcaatcggaccatgcggctttatcactctcacttagccataggagttttacaataagattgtacgcttagccctggtattgttcctgtatctgaactcgggtgttgtagacacctga

SEQ ID NO: 36863 - DNA, 128 bp, Triticum aestivum
  Clone ID: PAT_TA_36863
cggtccgaataatccgggtcgacgggctatggagatgaccatcaattgatgtcaatgcgaggagtagggatttccatgcaacggatgcactagagctataaaagaaagagagaaagaaatcagaaaaa

SEQ ID NO: 36864 - DNA, 426 bp, Triticum aestivum
  Clone ID: PAT_TA_36864
ctcgacatgaacccttcactaagctcgatgactatctccctgacatggatggatggcacgacatgatggagtgattgtcgatatatgacaatgtgtccgtttagtccatactttcttttatgacaaaactttgagttatgcacggtgaaactttatttgtgatgtaattaaaccgtcctcctcctcgactagcaaaaatcactctagtcaggtcattttgggtacgatgaactttgttatttatgcttatgatatgttgtttctaattttgccaagtctgtctctttctgttgctcaactatatatgttgcatatcatcgactcatgtgatgatgcaggtgcatagatcatagatggcgaagaagtgctacgccaggagtatatatacgacaagtggccgagtgtcaggccctggtgtaccggttt

SEQ ID NO: 36865 - DNA, 420 bp, Triticum aestivum
  Clone ID: PAT_TA_36865
gggtcgacgggatgtgagaaggatagagctcccagggccgttcctttgagtcatgtaatcaccaataaataaaatgtcaatagagtctcaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaggggcggctcaaaaggatcaaagttaagttacgcgtgaatgaaaggtaaaagctcttcaaaagggtaaccaaaattaaattaaggggccgtcgtttaaaaaggtcgtaatgggaaaaaccttggggtaaccaaattaaatcgctttgaagaaaatccccttttcgcaaatgggggtaaaaccaaaaaggcccgaaccaattgcccttccaaaaat

SEQ ID NO: 36866 - DNA, 401 bp, Triticum aestivum
  Clone ID: PAT_TA_36866
cgggtcgacgcgatacactatgagatcacgggtcaccagtacaacaagggacactatctacctgatggtatatatcctcagtagtcaacttttgtgaaggcaatctcgaagccccaaggtgagaagagaaagagatttgcccaaatgcaagagagtgctacaaaggatgtggaacgtgcttttggtgtgcttcaatcccgatggggtatagttcgataccctgcactgtgatgggatgaaagtaagctttgggaggtgatgactgcttgtgtgatcatgcacaacatgatcgtcaaggaagagcgtgatgaaactatcttcgaccaatgatttgattttcaacgtgacaatgttgatcccctgcatcatgaattcggcacgtttgatcagtttgtccagtt

SEQ ID NO: 36867 - DNA, 360 bp, Triticum aestivum
  Clone ID: PAT_TA_36867
cgagctcatgtaggaagaagacgacgcgagctctggaggaggaagacgactcaaatttcaaatcgagggattcgttggaagccacacagggcacctgagaaggagaggaggagaatgctctgaagagaagaaatgataggttttattgttttgttttaagagcaagggagttgatatgtagtcccctggcttatttgtattctactatgtgtatggcaaagaaatcatgattttatacacacatatatttttaaacaaaagcctatgtatttttttgctcaaacacagtcatcggaaagcgcacatattttcaatgcgtaaaaaaaaaaaaaaaaaaaaaaagcggccgctcaaaaagct

SEQ ID NO: 36868 - DNA, 448 bp, Triticum aestivum
  Clone ID: PAT_TA_36868
gggtcgacgggatcaagttggattgaacttgatgaggcattccatgagttcacggtgggggacagaaaacactcagactcggaccagatatccgagatggttgataggctgagttcacatgttaaggatgttggctgccttccaacagctcatgagctgcttgtgcagtgagtcctttgccaagggtgtgctaaattgctcatgttgcagtcacaaatgtgaaatgctttcgtgaggtgttagcattgcacggtgcaatctatgtaagcaagcaccggctccagtgaatcctgcaatcaagaagatgctgtgacgtggtacagaattacccacgatggactgtaaacccagacatgtgttcaagcatttctcagcatgtgctcttctgccatcaggtttgctctgtcgaaaactgcaactatgttaagacgaaagctggtgatgggat

SEQ ID NO: 36869 - DNA, 436 bp, Triticum aestivum
  Clone ID: PAT_TA_36869
gctcctaaagtcggggaaggctctaattaccaacttgtaacgccctcgatgcggctatagctcccacgtgtcgaggcacgacttagagacataaccgcattgaaagcaatgtcgcaagttaggcaatcttcacaacatcccatgtaacataaataataaaggggagatacatagttggcttacactcgccacgtcaatcaaagtgcatcaataacattacatcatccaaacactcatggcccgactacggcgccaaaataaaagataacccaacatgcgacacggtcccgatcaccccaactgggcaccactactgatcatgagggaaatacacgtagtatcattgagagtcctcgtcgaacttccacttgagctcaagcgcgtcacctggagcggaatcatcaggccctgcatccggtttggaagtaatctgtga

SEQ ID NO: 36870 - DNA, 385 bp, Triticum aestivum
  unsure (1)..(385): unsure at all n locations
  Clone ID: PAT_TA_36870
ccttaatatgtgtgggccacttggttttacgggaacgaggcatcattttgggtttggggaccagtggagatatacatacaaaaaattgtggacgtaggttcgaccgaaaggcaatgatgcatgggccctgcattttgatatacccgctgccgtgtgaaatttgctactctactcaaaactagtaaggtacacatgcattaaatgcatgagatttggaaaccaaattatgaataagtacacactatagcatgtaaagctttgagtcatatatgtatgatgtagatgttcatttagttcttatagttaataccattcaaagtcaattagttttataaaaaggttaaaattcatggcattgtgcattgtaaagcataaagtanaaaac

SEQ ID NO: 36871 - DNA, 416 bp, Triticum aestivum
  Clone ID: PAT_TA_36871
cgggttcatatatgtaaatctgtattattacttatatcttcagcagtgacactaacttcaaaataagctgatagtttttttttcgaaacggaaagtaagctgatagtttaaatattgtgtcattttcctaagcacctcgagcgtgcctggttaattatctcgttttgaccgcccgcaaaagatcatctcgttttgatacatcttagttcaaatttacttgcaatctttaaatgcaagtttgaaaataaataaatatacttgcagttcatatttagattacactagtaaacatgcccatgcgttgtgacgggaaaaatttgtatattcctagcacaataagcacgactgaagacccctccactggtgcacattatcaatttgaacatggcgccaagtccgtgttgtcacttaacctc

SEQ ID NO: 36872 - DNA, 429 bp, Triticum aestivum
  Clone ID: PAT_TA_36872
attcacaaaattttttatggtgtacggcgcagaggcagtactgccatgcgacataatccatgactcacctcgagtgcgcatgtacgaagaaagagaagccgagctcgatcggcaggacagcttggacgcattggaagaggagggcaatgtggcaaaggctcgttccgcattctatcaacagcaggctcgaagatatcaaagcagagaagtatgggccaaaacatataacgttggcgaactagttctacgcctgccggacaagaaaatggataaattaaagcccaaatgggagggccccttcatcatcgaccaagtactgaccggcggagcgtaccgtctacgaggcgcatcggacaaccgactcgagccgaacccatggaatgcagcacgcctacgaaggttctacgcctagcaccggactccgtgttc

SEQ ID NO: 36873 - DNA, 445 bp, Triticum aestivum
  Clone ID: PAT_TA_36873
cctgagcgtacggtcggatgtccgggtcgacgggggaaacaaacaaggtgttaatgcctccatacatgttttggccccgaaggaaaacttgtaaaggtggtgtccaatctttcctgccacactcgacctttgtcctatgtggagtcttgagcatgctttccgagggaaagagaacggctgtttagactgatcgatagcagtaagagacatggggtcttaattattagtggtgatgttcattttggagaaatcgctcgttttgactgcggtgttcaatatccattgtatgatattacctcgagtggtcctactcagtctgtcgagaattctgtaccagcaatatttcaatctgttatgagacttctggcttggctgacaacaacccccatgccagtcctcagccctaactgccgtcacaaatcatgctcatatggtcagccaaatt

SEQ ID NO: 36874 - DNA, 383 bp, Triticum aestivum
  Clone ID: PAT_TA_36874
tggatctgatgcttggaagacccctagttggtgtgtggccgcctgataagagtggccatcgcttggtgggcgtggtgctggtagtagagtaggatagtgttcttcgggacatgcttgtaaaattaaggtttttgggtctttttttccgctcctgtacaagtgtatttttggatctgttgttgtaattttctttttctaatgacatgagcatatactttctgtcaaaaaaaaaaaaaaaaaaaaaaaaaaaaaaaaaaaaaaaaaaaaaaaaaaaaaaaaaaaaaaaaaaaaaaaaaaaaaaaaaaaaacaatacgatacaatcaaaagttatcatatcatccaaaataatgtcaaaaatctgctagtcacgtaaatttaattc

SEQ ID NO: 36875 - DNA, 196 bp, Triticum aestivum
  Clone ID: PAT_TA_36875
ggagactactacacgaagacagccgtgaacgcgctcgtcgccaaggcaggtctaggcgctcccagtatctatgaatcctgatgaaattgttcgctcagcgacatctcgctgcatgttgccgatatgctatctccgtatcacacagtaactctcgcgacaaatctgcgacctcctgagaatctcagtcgcttgagtc

SEQ ID NO: 36876 - DNA, 396 bp, Triticum aestivum
  Clone ID: PAT_TA_36876
gggtatcgctaaaataagtcgtcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaaaaaggggggcccttaaaggttttaattttttttttccttttaatgaaattttaaacctttttaaattttcccccaattttaatttcaggggctttttttttaaaattttttaaggggaaaacccttggttttcccaattttaaccccttttaaaaaattccctttttcccaatttggtttttttccaaaagggccccaactttttccctttccaaaatttttccccccttaattggaaattgtgaaccc

SEQ ID NO: 36877 - DNA, 380 bp, Triticum aestivum
  Clone ID: PAT_TA_36877
agcatgcactgaggcgggaagtggaaaaggaatacatcgccaagcgaactcaatggtacgatgctggaggtggaagacgtggccaacatggcgctgtatgtcgagtcggacgaggctaggtagctctcaaactgcgcagagtcaagattgatgctatggtaccattaatgattccagctgaagatatttgcaacctgaagtgttacacaagtttactattgtgccaatgtgtcatcatgtgtttccatgatttttgcaaacctttaatatatccccgggttccttttcttctatgctagaattggtttggaaaaactgtatgcaactatggccatgaaattgtattaagaattatgcaaggagtgagtcatcatttcttg

SEQ ID NO: 36878 - DNA, 436 bp, Triticum aestivum
  Clone ID: PAT_TA_36878
aaataggtagggagagagagagagagggagaggggtagagtgctggatgggtgatggagttgcttctcgaagatggtgggagatgcctactagacaaacttagggtagaacttcaatattatcaataagagtggggatgtgtttccgtgtgtgcgtgtgcgtgatagatgtgtcgggacgcatgcatggatgatgaaggggaaccatgtgtttggtaagcaaatctaactagatcggtagatcaattgttgtttatcggaggaaggaagagacataactaataggtagatcgatcgacgcgttgggaaaaacgagttataacgacctagctagccatatgtatagcgggagatcggtcggtgtacatccatttgttagaggcaaacaaggcccagtgagatggatagacagagagaatggagcctagaggtggtgc

SEQ ID NO: 36879 - DNA, 373 bp, Triticum aestivum
  Clone ID: PAT_TA_36879
gaggctaacaaaggccgccgaatacatttaggccgcctcgatgctccaaggatcacacccaatagaaagtccccgaacgctccgattgggcaatttgaaaaactttaaggttcctttttttgtcagtcacatttccatctcttccaccataattcgggtacataacttgggagacattttatgctggctacctgtagcgtgtactcccaggatccactgtgctgctgttgtcgacaaaagctgtaactggttgctaagtgatttgcctacctggtatggcagtataaagcatatgtatcaatatcaagcgctaccacataagtagaagtttacaatgagtcgtcagacaacactgcgggtgtggtggttaaac

SEQ ID NO: 36880 - DNA, 427 bp, Triticum aestivum
  unsure (1)..(427): unsure at all n locations
  Clone ID: PAT_TA_36880
tccatttatctcaattctattttcagacctcgatttcttggagatctccctccttagccaaccaaagctcttgatcttttaagaagcgaaggagaagtgctcgatctacacattcaccaaagcgaaagttgattcttcccttgtttttgtggtgcatcttgttactcttggaggttggagactcctaggcagtangagtgctccggcgaggaatcgaccattgtgatttcccccggaaagtttgtgagggtttggagaccacccaaggtttaccactagtggttgagaaacgccttggtggtgttgtctcaaagagagaatagggtgagccttcgtggcgttggtgccttcgtggtaacatccacctgtctaaatggtgacgtagcttccctccaaggaagtgaacatcgacatacatcctcgtctc

SEQ ID NO: 36881 - DNA, 415 bp, Triticum aestivum
  unsure (1)..(415): unsure at all n locations
  Clone ID: PAT_TA_36881
cacggggccgcacaaaaaataatattttaaattcaacaagcattgcttaaacgacatcgacgacggtttcactgcacatgctgtggacgagcgagtttattcgagagctagatccttagtacattgagacgccacaaggcgggcacccgcaagaacattcttgtaatagttctcgggcttgctatgcgccttggtgtacgaatgggtgggcggatgggatgggagtggggaaacatggcttatggacgcgcttatctgaaatgtggggtaagtcacgaaattacccctaccgatttgagctaggcggttctttcggtttaagggtatcacgggcatttcacgtgtcgagatttcacaggaggtgggagtttttgcgcgcgttgtaattttggaatangaaggtgtgggttgagat

SEQ ID NO: 36882 - DNA, 404 bp, Triticum aestivum
  Clone ID: PAT_TA_36882
ggggccgcacaaaaaataatattttaaattcaacaagcattgcttaagcgcctatgaacaagttttcagtgcacaggataaaaacgagcgagtttattcaaaaattacatccttggtacattcatccgccacaaggcgggcacccgcaagaacattcctggaataattccccggccttgcaatgctccttccccggcggcggcccgtccttcacaagcttctcaccgtccagcttaccccagtgcacctttgcacgggcaaagggcccgacggcaccttttgatgcagacggagtgcttgatgacctcaagccttggacaggcctccaccagccgccgcaccatcccgaagtagctcccaagcagggcctctccgggccacagctgaactatgaagcctttcat

SEQ ID NO: 36883 - DNA, 396 bp, Triticum aestivum
  Clone ID: PAT_TA_36883
atgtgttaggtcttattatgtgtgatgaatgggaagttcatgtctctgcctacgacgacgacgatgtttcgtcccttttatgcattttcagtgactcgtttaaaaaaaaaaaaaaaaaaaaaaaaaaaaaaaaaaaaggtaaaaaaaaaaaaaaaaaaaaaaaaaaaaaaaaggggcggcccaaaaggatcaaagctaaggtaagcgtgaaggcaacttaaaagatcttcaaaagggtaaccaaaattaaattaacgggccgtcgtttaaaaagttcgtaacgggaaaaaccctggggttaacaaatttaaaccccttagaaaaaaaacccctttccgcaactgggggaataaccaaaaaggccggaacggatggcctttccaaaaatttggaaac

SEQ ID NO: 36884 - DNA, 325 bp, Triticum aestivum
  unsure (1)..(325): unsure at all n locations
  Clone ID: PAT_TA_36884
ttggcgccaaaaggaaatttggtgaaaattgttccaacattgcttatgaaaataaagaaggaataataagagtacttcccccacaaaaagggactacatcttactcaagaaagaaaccaaattttagacaaattgtgtgaattgcaaaaatctattgagcctcttaaaaatgttgttgggaaccttcaccgtatgaatacattgatcactctttgtaataaagcggttggatgctctagatctaaaaatctccgagcatgaagggaaacgtaagaaacctcactgattcgagcacaactccattaanagataagtaccaaaagag

SEQ ID NO: 36885 - DNA, 359 bp, Triticum aestivum
  Clone ID: PAT_TA_36885
tgccgcaaatgtttggcgcccaacgtgtcggtctgggctcatacgtggtcgtgtcacgtcgtagtgacgttactatcctacgcctatttagagcagtgggaatcgggccgatggattgtccgataaatgggtacacagtcatttccatctccgaaacacttggtttcgggcatccgacgtgggagtggacattttgctgcttctttcgaagtttgggacaatcatcatccacgtttaccctagatactacattcgaatccattttgtattcctatacgactctttatcaatcattctatgtgtatttatatatcttcacaatgatgacagcgatgtactccactgtcatatatgaatat

SEQ ID NO: 36886 - DNA, 391 bp, Triticum aestivum
  Clone ID: PAT_TA_36886
acgggtcatagaagtagacagagggctccttggaggcatcgaacaagccgtccatgaaacgggagtggttgtacgggacgttccgacagttgaatatatgagcacgttactacgagatttactacaatataaatcatgacggctataacatagattaaactaatcatgcggactagcatagtagatgaacacatcaaatctaggacacagactatacacatgaattctaccacgatttcgaacaggaaggacagacacacataccgtgcaacaggagcagcaccattggcgttgaggttgtcgcccatgccgttgaggaagaggttgccgacgtctgggaagaagtcgtcgttggtgaagtcgtcgctgctagcactcgcaagagtgcact

SEQ ID NO: 36887 - DNA, 379 bp, Triticum aestivum
  unsure (1)..(379): unsure at all n locations
  Clone ID: PAT_TA_36887
tccgtccagtttggaccatatactcgatcgctcatgccaaatacatggcacccccgacaagccagccaagcacaccaacagggaatgttggatgttcaagcaggccggcaagttaagcgccgaagacaaagataaggggctacatagcgatgacgaggaggagccccggcagccgaacacccgagggcagaagaggttcccccaacaagtgcggacggtgaacatgatatacgcaacccacatccctaagagggagcggtagcgtgcgttaagggatgtatacgtgttggagccagtcgccccaaagttcaacccatggtcctcctgtccgatcaccttcaatcgtanggaccatcccactagtatccgtcatggcgga

SEQ ID NO: 36888 - DNA, 209 bp, Triticum aestivum
  Clone ID: PAT_TA_36888
gtaaaaccgctcattcggtccgttgaaatttggtataaacgttgccggtaaaaataggttttccaagctgaaaagctcaagtagtacaaatgtacgtaccttgtatgacatgctacctgattcttgttcatttaccaagacttgcataagaataaattattaaatattatggaaaaaaaacagaaggtgttgcaaaataaacaaagcaa

SEQ ID NO: 36889 - DNA, 355 bp, Triticum aestivum
  Clone ID: PAT_TA_36889
cctgttaagactttagcatgttgtaaaacaacacatatgcatataataatatctaaagatgtataaacaatggtagaaaatatatttgattggaagatctgacagatgataaggcacttgagttcgcctatacttatacacacctgaaaccagtatacgcctcgaaactataacttagacaaaactaatatttcatatgattccatactttctaactttcgaccacatgtctgcactgtgatgcctccttatcctcaataatccatcaacggaaccagtgcatacatagtgatgaccaagcataactatcgcctcagaatacataatataatagattgaattacgagtagtgtgt

SEQ ID NO: 36890 - DNA, 363 bp, Triticum aestivum
  Clone ID: PAT_TA_36890
actactaacgtctcacgcacacaaacaccccccccctggatcgtcttttaggttttaaaaaaataaaaggaaatgataaaagattaaaaaaattcaaaaaaatagatgcccatgtgttatgtgtcctatttgttaggaaaattaacaaacatgaattttgaatttttttgcaaaaggccgcgtgtttcggtaaaatggccgtaacttttgcatacgacctccgatgaaaaagtttttttatatgaaaaatcatctacttgaaaagttacatccaaattcaattagggggacactatgggagatttttagaatcccctaaaacctgacagaataaaagatacggggcttttaagatctggaggc

SEQ ID NO: 36891 - DNA, 377 bp, Triticum aestivum
  Clone ID: PAT_TA_36891
gtaataagcactgcagcacgtgcatgtagttcaaatttgaattgttcacctgaaatggctacaatacatttcaatgtcatataatgttcattcatatccggaaaaaatccacttcgtttacgacacacatatagttgcatgttcaccccaaatctaaggtcgagcacttcatacatcatcgattgccgctgtgaccccatgatgtacctcatagattgattagatttcatgctagatctcaacaatttactatcagcatcgtgtgacatgtgttacagtgtatcttggtgcatcatcagtgtatagtacgcatatagcctacgcgagacagtgcgtcggctacattccacattcagcgtgtcaagcacactatctcg

SEQ ID NO: 36892 - DNA, 409 bp, Triticum aestivum
  Clone ID: PAT_TA_36892
gcagagatgctggtgatggcctacgcaaggtcctataatcttccggtgatcaccacacgaggtaacaatgtgtatgggccaaaccagttccccgagaagctcatccccaaatttgctctcctggcaatgagaggcctgccactcccggtttatgggaatggctcgaatgccaggagctacttgtactgtgaggatgtcgcagaagcctttgatgttgttcttcacagatgagaggttgggcatgtgtataacatcgccgcggctaatgagaggggagtggtggatgtggccagggacatatgtgagattcttggggtggaccctgagaaggccatcaagttcgtggatgacaggccgttcaatgagcataggtactttgtggacggtgagaagatgacgaggctggggt

SEQ ID NO: 36893 - DNA, 298 bp, Triticum aestivum
  Clone ID: PAT_TA_36893
tcaactcattgggagagggaaatctccatcaacatgttcacaagcacaatctaactccaaaccctaattcaactcctgcatccaattcctgtctcaaagttcgggaatggtgctagtaagttgctagtagacaccttgtaattggtgctagttggtttaattggtggaagatcatatgttcagatcctatatgcatattattatccctttgattatgaacatgaatatgctttgtgagtaaatacattcgttcctgaggacaagagagaaatcttgcgatgagtagtcacgtgaaatt

SEQ ID NO: 36894 - DNA, 306 bp, Triticum aestivum
  Clone ID: PAT_TA_36894
gtggcgtcatgggctccaactcgcaggcgaatatcaatgtcaggcacacgctcatcgccatggacgctgcgcagatgattcactaagcctagccctacaagtattgtcacatcagtctccgtttctgtcccccttcactctgtcctgattttgacgaggaatgctcccgctttaatcagtactgttgaatcgttgtgtcggtttctgacattgcggtaccaacgacctcctgggcagtccactctgaccattgtttcggccctccagttggggaaccccgtttccatgtccccagctggctggtca

SEQ ID NO: 36895 - DNA, 389 bp, Triticum aestivum
  Clone ID: PAT_TA_36895
gggtcgaccgccccatgaggcgcggagatagggggaggcgtttcgctctccatcatctccggaagaagatcccccgaagacgaactctgtcgagaagggctacgattcgagctgcaagacatatgtctcggttattgtcctcggagatgaagcatgatatatttaccaaaagtactcttgttcacttacagctcggtggagggctgacccccttgcgggcagtgcggtaagaacgccctccggggcagggccccctgacgaaggtttcttccctcgtttggaaaccctcgtttccaagtcttcagaggcggtccttttccatccttggggagagggaattttagattcttctccccaattatcctccttcacgaagacactaattcccc

SEQ ID NO: 36896 - DNA, 360 bp, Triticum aestivum
  Clone ID: PAT_TA_36896
tcctttatttacaggagacgatgaagagaagattctctcctagtttctttagtaagatcgatccttatggtacttttgactggaactggatcccttcgattggcaaggctgggggtctcctctgtgcggtcaagagacaacatctggaagtttttttcgtggtccttggggaaatcttagccttcatgttactatcttcgatgttaaaaaaacagtgtgtttggtctttgcttaatgtgtatggtgcagcccatgatgagtccatacatgaattccttgaggaattggccaactattgtatccacttatcaatgccttacattgtgggtggtgatttcaacatccttagacactagtggg

SEQ ID NO: 36897 - DNA, 391 bp, Triticum aestivum
  unsure (1)..(391): unsure at all n locations
  Clone ID: PAT_TA_36897
attcgcgagtcgacggggtctgtcagagccgacgaagaatccggtagcatggaccgcgttgcgggggcatccggctcgtcctcatgcttgggaaggacgacgacganggcggcggtcgtcctgcacaccatggcatagctcggggagganggggtggccgcgggtatgccggagccacggttaccgcggcgctcggctccggtccagatcgaaagagaggcgagtgaagggaaagtgggactgctacggttcgaggtagangaagcgggggccatgggttgctcttatccaccaaggaaaacgtcggggaggcgcgggatggctgccatagcgtcatcggtggccatggcaccggtggatcgtttccacgattcctgtgtgtgaacaggga

SEQ ID NO: 36898 - DNA, 375 bp, Triticum aestivum
  unsure (1)..(375): unsure at all n locations
  Clone ID: PAT_TA_36898
caaatttgacaatgaaaaagatcttgacgccatccgcagtgctgtcctgcgctacaacgttactcatccagttgtaaatgacggtgacatgtacttgtggagagaactgggggtgaactcttggccgacgtttgtggttgtcgcgcccaatggaaaggttctagcacagatatcaggcgaaggccacagaaaggaccttgatgacgtagttggtgcagcacttgagttttatgatgaaaggaaattactacagaataattccctccccttggcgttggagaacgacagggataatcgactaataacttcaccactaaagtttcctgngaaacttgcaattgatgtacagaacaatcgattacttatatcagacag

SEQ ID NO: 36899 - DNA, 400 bp, Triticum aestivum
  unsure (1)..(400): unsure at all n locations
  Clone ID: PAT_TA_36899
agatggaggtaactcgatctcatgtgaggaattcaatgtgtcgttggacacattgaaaacctccatgacaaccgaggtcaaggacatgtttaaggaattcttagaagggcttaaactttccaccgcgcccgtgaaagtgggtgatcccgccaacacggtgacggatgctaaccccaaaaagggggaagctactagtgagaaagctccgttgtctagtggtaaaaatggcaccggcatctttgcccatgtggaacctccaatttatggagggccgattccctctactcatttaaatcatgctggtcctcctcctaagtatgagaaacatgaagattttgattcttgggtttatcgcttcaagcgtcatttanaacatgtgaatactaacctttggagaatc

SEQ ID NO: 36900 - DNA, 373 bp, Triticum aestivum
  Clone ID: PAT_TA_36900
aacgatacgtacacgcagtttggagggaaaggcggaaatgcccagggtgacatgaatggaacaaacagctccgacgatggcgtgtccgacatagagtccgtcctcgagcagctgaagaaggagcttgggctcagctgaacggttgcctgtcggctgcatacgacgggggcaactgcggccaccttgatcggtaccaacccggtgttcatatggaggtccgctgttctcccggatcgatggcggtaatggtacgtactaccagatgttgtaatttagctggtatagctttccggtggggcgacggatccagcgttttgcagaatgtttttgttcttggttcgtagggctgcagtttgttatggacagagaagag

SEQ ID NO: 36901 - DNA, 424 bp, Triticum aestivum
  Clone ID: PAT_TA_36901
tatcctaactcgtatcacctttgatgatcttccatcgagaagcgcaacacggttggcaaggagatagcgcggctttaggccgctgagttcatctgagaggtgtaccactccgagtggctcgccaacgtcgtcatggtgcccaaaaagaataactccctccggatatgtattgattttaagcacatcaatcgggcctgcccaaaagatcatttccatcttcctcgcatagatcagatagtagattctactgccgggttagagcggttatcatttttggttgcgtactccgggtaccaccaggtccgaatatatggtcctaatgaaataaaaacagcgtccattcgggtgtttttgttatatcactatgccattcgggttgaaaaatgttggggccatgattcagcctatgattcagaagtaccac

SEQ ID NO: 36902 - DNA, 394 bp, Triticum aestivum
  Clone ID: PAT_TA_36902
actcgtgagtcgatgggcgcccggacactaaatcaataaacgtgcatattgactaagttgacaaagccctccgtccccgtcaacttagtaggcccacaagtcagcctctcactatactaagtctcagctagcacggggagtattcatttttgtgtgcgtaataaggatgcacttccttgcgtgcgaagatatagctggtgggtccgagctgtcagcggcggtaacatttttttcgcaaaatacagacgccctttcggtgggtcccagatgttacgtggaggaatcattattttgcgcataataatgatgcatgtccttgcatgcagccgtggacccagctgtcagcctctccacgtacagtccacttcagatgcatgtcggtcgttgaccacat

SEQ ID NO: 36903 - DNA, 232 bp, Triticum aestivum
  Clone ID: PAT_TA_36903
agggtcgggagcggcctcgagttcaaggtcggacgtggcatctagaggcatgtgtttggctatttagtgaatagatggcatcacatcatacactcacgttgctacattaatcctcaacttgtatcatttattgcattcgtatggaatctgatctcagaattattttgtcactagatgggtatcaatcactgctttataaaaaaattcattcaatactaaaaaaaaataaaat

SEQ ID NO: 36904 - DNA, 350 bp, Triticum aestivum
  Clone ID: PAT_TA_36904
ggacggaacggactccaccaaggctgcaatgaagcttcgtcggagctgcattgaagctttcggcggagttgcaatgaagcttcgtcgggggcgtcgcggccggtgttgccatggagcagtccctggtggttcccgcagcggttgccggcgggatctgggagttgcgctgcagcgctcgccggcggctccgtccacccgcagcactgatagtgttgcaacgcagcacgacggtggcgagccaccggagacgagggagattccctggcgcgtcccagcgagcacacatcagaagcccttgcaatcagacgcctcgccacagcagtagcggtgttgcaacacagcacggcaac

SEQ ID NO: 36905 - DNA, 457 bp, Triticum aestivum
  Clone ID: PAT_TA_36905
ccgggtcgacgggctatctcatctccaacgacccttctcttctcttctgacagtcggggcaagggctgcctgactggcttggcatcaggtcggacatgtagcttgtgctcggcgaaatccgtcggaacacccagcatgtccttaggagaccatgcaaagatgttccgattctcacggaggaaatcgacgagctcgccttcctatttgctgtcaagatttgcgcctatgacagcgtgcctctctgggtgctccgggtccaagggtaacttatttgcttcttttgccggcttgaacgagccctcagcttccgactccttggggtttggcgacatttccggctgcttgcctgccattgccaccacccggtcaaggagccgcttctctgctgcaatcacgagggactcggctagccggctgctgtctgccgcgcaagcggacgacttcttgtagtctccga

SEQ ID NO: 36906 - DNA, 308 bp, Triticum aestivum
  Clone ID: PAT_TA_36906
attcccgtcccgacgggcgctctagactgtgcagcggtggatgcttctgaggaagcacgtgcacgggatctaaggttaagtgcgggcgggatggaggatttacacatagtcgacgtgcacccgagctccgtccgctcgcacatcgtctccggctctgtcttcactatcagtcactctatacagtcataaatggtaaaacacgataggtatcaaatttaatctggttgtactacatccaggtttcgtcagctggcgcaacgcacaactcgccagcaccgatcgcacttcgcaacagttcctgaaactga

SEQ ID NO: 36907 - DNA, 374 bp, Triticum aestivum
  Clone ID: PAT_TA_36907
caatagataaataccacacgtccatcaatttatttactaatttctggaggtccataagtatacgtctgatccatattactacagactgttctgtttttgacagattctgtttttcgtgtgttgtttgcctactttgatgaatctatggctactatcggggggtatgaaccatagagaagttggaatatagtacgtctaacacttacaacttggaatgggttcattacactgcctttaactggtgatttgttttcttagacgtactgagctcatcagattttctgtttaagttttgtgttgtgaagttttcaagtttttgggtaacgacttgacggattttggaatatcaactggcattcaccttaacctgggga

SEQ ID NO: 36908 - DNA, 379 bp, Triticum aestivum
  Clone ID: PAT_TA_36908
cggatacacttactcatcatgccgcagctcgtagcaagcgccgcacgtgacgccgccatgtcaaggcgctggatgggatgattggctggaaactaattccggatgtctcttggtctgcctgtggtaccgactgttaactgcgccaacaatacgggcgccaagaacctgtacatcatctccttgaatggcatcaagggaaggctcaaccacctgccgtccgcttgcttcagccacatggtcatggccaccatcaataatgggaatcccgacctcacgaataaggtcatgccagcggtcatcgtgctccagcgcaggccatggcaccaaaaggacgatgtcctcatgtacttcgaatataatgctgcgggtgattgtgaat

SEQ ID NO: 36909 - DNA, 324 bp, Triticum aestivum
  Clone ID: PAT_TA_36909
gacggcccatttcagggttcatcttaccgcagcgctttgcatgcgccccacgggactccgccatgtcgaggcactattacgggattatctgcggggaacagattcccgctgtcgcctggtctgcccgtggcagctaccgtcaactgcgccgacaacactggctccattaacctgttcatcatctccgtgaatggcatcgacggaaggctcaatcacctgcccttgggctgcgtcagtgacatggtcatcgtgaccatcaacaatggcaatcccgacctcacgaaaagggtcatgcccaccatcatcgttctccagccacaagcc

SEQ ID NO: 36910 - DNA, 423 bp, Triticum aestivum
  Clone ID: PAT_TA_36910
ggtcgacaggacaagaaattgacttacatatcactgatagaaaaggagtcgagaaccccgtagctgataacttgtctaggttagaaaatattcttgacgatccacaacctattaatgatagttttcctgatgagcaattagccgcaattaatgtttctcataacacttgcagcgacccgacctcggacggtcaagtctctgtccttaagtgtcatccctggatcggtatgctgacacacacagtactcgaggatttataacagaggtaaatcacatgtataaactaacgtaaatactattacctcaatccaaatagcggaaataacaacaaggttgtggattcccatcaacaccaacggcaaggttgagtgtggaaatcgtaaccttaatgtatcatttactcgtcataagaatcctgcaaca

SEQ ID NO: 36911 - DNA, 247 bp, Triticum aestivum
  Clone ID: PAT_TA_36911
cccaggaaagactggcacacagaggttaacgccgttgtaaacttggaacatcgctatgcaaacgtactctttatggaaacagacgaagagctcgatgctcttccttgtcaccatccagcagcatctgtcatatctctcactcatgactatcttcaagacatgtcaaatcctacaactcattaatacctgttgtagcacccatgccataccatgttcaaattcaggataggcaacgtgactctcattc

SEQ ID NO: 36912 - DNA, 404 bp, Triticum aestivum
  Clone ID: PAT_TA_36912
gcagatggtgttcgtgggcgggccgaccaagccgctggagctgccggcgttcgccatcgtgccgggagggaagggcatcgccgggaactgcgtcggcggcatgagggactgccaggccatgttggaattcgcggcaaagcacggcatcaccgcggaggtggaggtgatcaagatggactacgtcaacacggcgctcgagcggctcgcgaagaacgacgtccgctaccgcttcgtcatcgacatcgcaggcagcctcggctcaacctcgtgagctggaatagccaccttgttgatggttgcgttagtttgcttcggcgaacgcgtgcagatttagagcttttagtaactgtacccgttgagtaaattgcaaaaaaacattataattggcgaccctaattcaaaaa

SEQ ID NO: 36913 - DNA, 340 bp, Triticum aestivum
  Clone ID: PAT_TA_36913
ctaatatgaaatacgaaaatatggctgtcaaaattttcaagctactagagtacctcaccttacgttgagagagcgacagcttctttcagcgtctctgccgaatgaaggattttgcttgccttgagaaattgtctgcctatcacaggatcatgcataaggtctatgtgatacttagatgtatttgtcaagtgttctaaaatgctgtccttgtgcctaaattcacgtctgtcacggtcagcatcatcgcaggtctcaatggctaactacgggcatcaagcgaaaccacctgtttgaaggcatcctaagtttacttctgtgaacccttacatatgtacctgtt

SEQ ID NO: 36914 - DNA, 395 bp, Triticum aestivum
  Clone ID: PAT_TA_36914
gcgggggcggactgcaactcgatccacgagcaggggccgtgctacaaccccaacaacgtcgtctcgcactgctcctgggcggccaccagctacttccagaagaagagggccatgggcgccacctgcgacttcggcggcaccgccctcgtcgtctccaccgacccaagttcttcaggctgctcctacccctcaagtgcaagtgctgctggaacatcaacgaccccgaccgggactgggactgggatcggaggcacaacagggggaaccccaggcaccttcacgcccggtgccggcactagcaccggtggcatgggaggaaccggcacggggacggacaccaccaccgggttcggcggcctgggtccaacaggcacgagcaacatggacacggcagc

SEQ ID NO: 36915 - DNA, 410 bp, Triticum aestivum
  Clone ID: PAT_TA_36915
ccataagatttacttgataggtgagtgaacaagtatggtaccaattccactattctttcatttcacattgagtgaaaagggatacatcctcaactttgggaaaatgtaacttggtattgtttatctcatttcctactcatctttgctcgagtcttgtgatggatagacaaagcacacctccttcggtctacaacaacaacgacaagttcgatgccatgaaatacaacttggacgccaaaatggatgctcaattggaggagatcaaagccctcatcaaggcctacaagcggtcttcctcatcttcgagaagacgctcaagtgcacatacttccgagctaccatctctggctagatcacattggcattaacaccaccaccgacaagaacatgaaggtcaacagctcaacagc

SEQ ID NO: 36916 - DNA, 392 bp, Triticum aestivum
  Clone ID: PAT_TA_36916
gggtcgacggctacggttgagacggggacactccggtttcgccgggaaagaaaggaaatgacaacgcgcaaagcatttccaataccaaggtgaatgcttctaaagttgagcaataggaaaccggttctgatcatgaatgcaagccaaaatctcataagacaagtccatctgccgccaaacccaagatttccaagagttaagaaaccaaacgatgaatatcatacaaacgacgaaaggaacataaggaatgaacttgatatcaacaaagatgaataaaaggctgctgtggtgaaggggggctattgtggtgaagaaggatagaaagttctattaaatgccatagcagttacatgatcctcatcctgaaacggatccagtgaagatattttatg

SEQ ID NO: 36917 - DNA, 415 bp, Triticum aestivum
  Clone ID: PAT_TA_36917
ttgagcaaaaacatgattagatcatgtttattgcaatatggttattcatttaagtaagagaataatgcttattctgtttacataattaacaccttctatggtcatgcacccaatatgaatggtttattgaatctcggttgtagtgatacacatgttcataacgttgatgccaaaagatgaagagttgataatgatagtaccactttcttgtggcactgccgcttaggtcatattggtgtaaagcgcatgaggaatctccatgccgatggacttttgaagtcgcttgattttgaatcgcttgacacatgcgaaccatgcctcattggcaagatgactaaaaccccattctttggaacaatggaacgggcaagtgacttgttggaaatcatacatgctggtgtgtgcttgtcctgtg

SEQ ID NO: 36918 - DNA, 422 bp, Triticum aestivum
  Clone ID: PAT_TA_36918
gaaaagaaactgaaaacattgaacaacaaagaggacagtcgatgctaaccgacgtaaaacacaatagccgcagagcaaaggataagacgatcgacggaggagaggaggtggagaaacaacatccggacatgaagccaggaccgacacgaggggcggcgccggatgaaacaagacagacggtgatggcgcgaggggggaggggaggaagacagaccgggggaacaaaagaaaagatacattataaaacctgaaatgtttaaggactaaagtgtaaaaggaaaaataataaacagagaaaatttggtttaggcaaataaacagagaaagttttttttttgagacaaataaacagagaaagtgaaaactttttttttgaagctaagaaactgagaactggaaacaggaaaacacgcggccgctct

SEQ ID NO: 36919 - DNA, 284 bp, Triticum aestivum
  Clone ID: PAT_TA_36919
cgtagtggatgtggattggatagacacttgtgtcgaggtttgcatgtctcgtagcattcacgtatgatgaccgttgtgtggcaaatttgaagcatggggtgtttcgctcaatgacatccatactaatgtacgtctgcgaccaacgatagacctcttctatcaagtccatcacctaagggcatgcgtagtagtacttttcttccatggctaagaaaattttgcaattactaaacgaattctttatgacaaatatgactctatcggtaactggcatatttaccatt

SEQ ID NO: 36920 - DNA, 444 bp, Triticum aestivum
  Clone ID: PAT_TA_36920
cgggtcgacggggatcaagagaccgcgtgggaggccgagaaaggagagaccgccagaagaaatgtctacagaaactggagatgcaatgcctgctcctgaaactggagatgcagcgcctgatgaaaatggagcagcaatgcctggtgaagctggagatgcttctccaactggattcaagaaactgcgtgggaggccgagaaaggagagaccaccagcatcaatctctgctgaaactgaagatgcaacccctgctgaggctggtgatgcaaggcctgctgaaactggagcagcaacgcctgctgaagctggaaatgctgcatcgacaggtatcaagagaccgcttggaaggcctagaaaggtgaagaagcttgggaagccaagaaaggagaagccggaagcagcaatatctggtgaaaacggagatgatgctgcagcagctatatt

SEQ ID NO: 36921 - DNA, 401 bp, Triticum aestivum
  unsure (1)..(401): unsure at all n locations
  Clone ID: PAT_TA_36921
cgggccnacgggccggaccaccatgaggtctatcgtggatcatctgtggccggaaaggccaaagtcgaacaactattttagccttggtgcaacagttccttggtgtggtgccacgttttaatgcgaagaagaggtcggcgtgcatagaaggctcgcggatggcccttgcccgtgtcaaaacatactgggtggagatggatgccaccactgtcgcggtgtanggttcgaccataggccgagtggcagccgagcactattttgaagaagttcttgaaggcgctccttcgatagaggcccaatgctcgaagaatgttatgtttgagtgacatgtaatcccattgtaacgttttagtgaatttatcaaagctgtatttatactttttcccgaaagtattgtgatg

SEQ ID NO: 36922 - DNA, 393 bp, Triticum aestivum
  Clone ID: PAT_TA_36922
gtttgccagcaggcggcgagctaagtggttaccaccacaataggcggtgccatgcatagacgcggaggagcttgtgtaggtgtgaatggggaccggaggggtggcgggcggggtgagggtttttatgatgtggggatggtgagagttttctttttttctttttgaattgggtggtgagggttttctgtcccacaaagaatttcagaggcaacaatttgctagagccaaccatgtgtggttgacgtaacaggcaaaatgaaagtcattgcacatagttccaattttgggaatcgtgtgtgattgacgtactaccttcgtcctggtttattggtcccctttgtaatttgtagcagattttgaccaaatatttaactaagagatgtttatgcatgt

SEQ ID NO: 36923 - DNA, 438 bp, Triticum aestivum
  Clone ID: PAT_TA_36923
gggccgacgggctggcatgatcgctgcctccttctcctgcgaaccggccttctgtccaccacgacgcgacggcttgcgctccgcagccttggaaaaccccttctctccaccacgacgcgtcggcatggtcgccgccacctcctccgacgaaccggccgagaaagaaggcccctttcgaaccctagcttccgactcggggcgattcagactggggaggagacgacgccgcgtcttccatctatagggagcgaagcctagtcggtgtcggctcgctcttgggctccaactaggcttctcgtgccacgccggccaggtaagcgcccgatgcggcccggccagcccagcacccagacgcacgattccatcctctcgcctgaagagacgttgtaatgggccagcccagtagcactttttgttcagctcattttttttgtccgc

SEQ ID NO: 36924 - DNA, 418 bp, Triticum aestivum
  Clone ID: PAT_TA_36924
gggctcttatcctactcaggggtgtctgcagatgatcaacacggcgatatccgcggccatggaggcgtggatgtgcgccacagtgcgcccctagggaaggcctcaaggtgggctggcccatgtactgtatcactctcagcccatgcgcccagtaggatttagtattttcacttttcttttctattttcttttctagcctctgttttgcgtttagttggggtactaaatgaatttttccaggggtggaacttggcacataattccattgcagtattttggtgttgtacaaaaagtctcagagcatttggagttgtataagcattttcaaaaattgaaattgttggttaaaatggttgctgatccactgtttaatttttaagggcactttaacaacttaaataatgttgggttcttcata

SEQ ID NO: 36925 - DNA, 395 bp, Triticum aestivum
  Clone ID: PAT_TA_36925
gacgacgtggagtccagcgcggggcccgagagcgaccaccccgacgccctatagcgcttgctgcgcttcgccttgagcgggactacggcttcaccaaactcacggccttcagccacgcctcgcttctcttcgagtacaagatgaccagtgatggcgaagtgtatgacaacttcaccatccacagggactaccgcgacgtgctcggctgcgtgcacgacagttgcttccccaccacactcgctacgtgactgtcgagccgccatggagccaaccagcggctaataaagggagttggccctgtattttcatgtagtttcatggtgtgcgcatgttgtggtctctgttcttcgcagtctgttgcgctagactgtggaggttttctgtcactgttgctg

SEQ ID NO: 36926 - DNA, 413 bp, Triticum aestivum
  Clone ID: PAT_TA_36926
gtcgacggcacatcatatatttaaagaacgtcgaacgtgtatctgaaaaatgtttgacgtctgctctaaaaatgcatattttataccgagaaatagtgataaaacagcacacctatatcaacaaacgatccaatcagataaccagagaaacaaacagtaaggaaacaaggataatcaaagtatagcatacagaagatgaaaacaaatgttcacatcgattaaattgatttgtagttccattaaaatttgcatgtgacatttttggaaacaatcacatgtttccaaacaaatccatgaagaaattcaagtagattttcacaaagaatacaaatgttcctgtagtttttgtcttaaagattgattacttccattagcatataaaacttatgtttgggaaatgttgccatgtatgc

SEQ ID NO: 36927 - DNA, 426 bp, Triticum aestivum
  Clone ID: PAT_TA_36927
tccgggtcgacgggacccaatattagttttgttctttactttttgttcttgtttagtaataaataatttatctaccctatgttattattgtgtttttatgttttaattagtgtttgtgccaagtaaagcctttaggatcttcttgggtgattattgtttgatcttgctgataaaaacagaaagtatgcgctctcaaaaataattttcattttttaccagagagcgataaaataccaattccaactgcagtagatcaatatacaaattatttaggtccttctaatttttttataatttttggagttacagaagtattcgaaacctccagatttctacagactattatgttttgacagattctgtttttcgtgtgttgtttatttattttgatgaatctataagtagtatctggggtatgaaacatag

SEQ ID NO: 36928 - DNA, 427 bp, Triticum aestivum
  Clone ID: PAT_TA_36928
ctcgcgcgtcgacacacgcatctagttcgttcagaataaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaaga

SEQ ID NO: 36929 - DNA, 328 bp, Triticum aestivum
  Clone ID: PAT_TA_36929
acgaatctacccagacttctgccaacgcgtccgcccacgcgtccgcccacgcgtccgtgtgcgtgtcatccagcgtgcggggagctgatctgactcttaccctgttttatgaaggaaggtgccctgcttgtcatgaatttattctaacacagctatatccttcatacgctaaattaacagatagcttaaaattggacctagtgccctttggatggagtgaatcttcacgtagcgcaaatggaagagtatcatttacttgccagcatggtgatgaggaatgttatattaacagaatacatgcttgtgttcttgatcaaaatccaacctc

SEQ ID NO: 36930 - DNA, 390 bp, Triticum aestivum
  Clone ID: PAT_TA_36930
caaagattattaattctattgtctaacttcatttcgttttagactaagttctaaattagaactgagccaaaagacaaagtgcacgtgagggtgcacatataccaggtcatgtcaacttgctttggttttgggggtcgtcaggtcaacttgctaacttagacggcttgcctaccttcctatttttatcttctgagtatctacctaatcctgtttgaaggcgattaattagaagcctctatttatttaaggacaccaatatcaatctgacatcagatttaggaggggactccttaaaattaggctttcacctcattttataaataaatcaatcatcaggtacaggatcaccgagataaccaaatctgctagggcatcagcacaagcacaccc

SEQ ID NO: 36931 - DNA, 426 bp, Triticum aestivum
  Clone ID: PAT_TA_36931
gtgtgatgatctaactgtggaaattgagcatgtggatgctgtggcacttgagaagcttgaaaaacagggtgttgtttgtgaacccaaagcctctaccatcgcgattattcaggacaagtacaggcagaaaggccatttctcaaaatttggaattccgatagctgactttgttgaagttgatactttaagtagcatagagaatgctggggaaatgtttggctatcccttaatggttaaaagcaaaagattggcatatgatggtcgtgggaatgctgttgcccaaaataaagaagagctatcctccggtgtttcttcactgggtggattttagcatggcctgtatgttgagcggtggacaccttttgcgaaggagctatctgtaattgtggcaaggagcagagatggttgtacagtctgttatcctgt

SEQ ID NO: 36932 - DNA, 348 bp, Triticum aestivum
  Clone ID: PAT_TA_36932
agagcgatatataacttgccaaatttcgattcccagactccagatctagcctcatggtttgttctgctgctcctgaaatcgatggcggtccgcctctccgacatcctcctccacggagagccgcccaagcaacgtgatgcattttcttctcccatgaacgcttcaccaagtagcagcacatggagttggtcgcattaagaggaggagcaagattgggatgactcgggcgactatttcctcccctgatctctaatgtctagggcccagatacgcggttgttcatcccacatcttgatgccatttgctttcctgcgaatcttcaagtgtcactgttagattttgatgggt

SEQ ID NO: 36933 - DNA, 414 bp, Triticum aestivum
  unsure (1)..(414): unsure at all n locations
  Clone ID: PAT_TA_36933
gggtcgacgcgacacatgtgctgactgaggaatcagaaagggaggcgatgtgcgaggatgacggaaagaaaaaagttgagccggatgattgggaggatgcagcagacatgtctactccaaagctggaaagttcggactctggaaaccaggctagtgcagttcaactgccagattctgatatgactgaagctaatggccgaaagaaatattctcgtgattttctgctaacttttgcacatcagtattctagtcttcctgttggcatccagatggatactgtcactagtacgctattcaaagatttggcaggaaaatcctatgttattgatcgggaacctcacccaagttctgcaaggggatctgatnagacaacatctcgtggtgatcgccgtggtcctgctatggatgatgata

SEQ ID NO: 36934 - DNA, 376 bp, Triticum aestivum
  Clone ID: PAT_TA_36934
ggaaagggcaaaaattataaaaacaactgaataccacaagattataacacaggaaccaaattacaatttaccgaattccggtttcgggaaacacaatatcatccaggcaaaaaatttaacgcaaagtttgcgatgtaacgcaccaaagtcaggagcggctaccataagaagcatatataccatgtctggttcatacttcagcacatctaaaatacttccactcgccacacgcattgtgcagcagatgcaatgcctggttcctacttcatcaaatccaataaacttcgactgctccggagtgaataagctgctctccactatcgaaaaacggtcctcgcatgacaaatcacttccttgtttaaaactccatgctttg

SEQ ID NO: 36935 - DNA, 392 bp, Triticum aestivum
  Clone ID: PAT_TA_36935
ctcgcgggtcgatacacgcgtctatacagacaccactgaccctgtgaagtacccttcgattatggccgagggacaactattgctgtcagatataattgacgaatcaaacgaaataattaaatcagaaaatgttatgtcgatggaaaggttacctataaataacaattctggtcaaagttacggctatattgtctatagacagtataatctgtatctggcagccaattctgtactaacaatatctggatacgtgagagatacagtacttgttttattaaatggagagctggtatcacctgcacctgtcaacgaaaagagcatcgaaggattcggcttctggaagctctacaactctaccctaagtctacgcaataaagaacttcaaaacgcta

SEQ ID NO: 36936 - DNA, 411 bp, Triticum aestivum
  Clone ID: PAT_TA_36936
accggtctatcacattcagagccgtatgtattttgcaaaattttctatgtctacaattctctgtacggagctactctagctaattgctcccactttcaatatgtatccagattgagacttacagtcatctggatctgtgtcaaaacttgtatcgacgtaaccctttacgacgaacctcttgtcacctccataatcgagaaacatatccttattctactaaggatatttttgaccaatgcccagtgatctactcctagatcactattggtagagtatacaataggtctggtccatagcatggcatccatggatcctatctcagatttcatggcctctagccatttcgcggaatctgggctcatcatagcttcttcatagttcgtaggtttatcatggtctagtaacatgact

SEQ ID NO: 36937 - DNA, 409 bp, Triticum aestivum
  unsure (1)..(409): unsure at all n locations
  Clone ID: PAT_TA_36937
gatagggagccttgatgcatacagttgtccctctataaccgtttccgataactcgaatatcgcaaacgcttcatccttgctactcatttgtgctcgcattgccatcgcagtcagagttttctggttctgcctaaaaccaggcagattctaggcacgggagctttccaggcagattctaggcagattccaggcatggaagatttacgatgtctggcacatcacaaacagttcatgattataaaccgtatacgataggtagacaatcacacacatttagttttcccgcaccgtatgtgatagtgtctgacatcacacacgctttgcgaacggcaactgtgtgcatgcttgcacacgtttcctctctgtgaaccgtctcggattatgggtgtatacgcanaaattttgtgtt

SEQ ID NO: 36938 - DNA, 428 bp, Triticum aestivum
  Clone ID: PAT_TA_36938
acaagagtctacactgacgtcgtactagcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactg

SEQ ID NO: 36939 - DNA, 385 bp, Triticum aestivum
  Clone ID: PAT_TA_36939
tcgacattcgccagcgggaaagcaacgagcgcgctttcctatttggggtcaatagtggcgcttatggtgaaggtaccaccagtgccatcctccttggcggacaccttcttagtctcaggtggagctgccattgccttcttacacttgccggtggagctcgatggtgcgtcctcgacggtagcgcagcactccaaggaggtgcgcttgccggagtaggcatcagggctcttaccggacttggtcttcttcttcccaagtgtcctccgttctgctgcagctgctgcttcccggtagatcttgtcggcacaaataagagcatccttcttgtcgccaaggacagatatgacacttattggccctggcattttcagtacgttgtacgcat

SEQ ID NO: 36940 - DNA, 424 bp, Triticum aestivum
  Clone ID: PAT_TA_36940
tacacgaatctacagtgattcgtgcaagtcttgttggaggattaggtcttactccttctggtaacatcggccttaacggtgctctatttgagtcggtgcatggtacagctcccgacatagctggtcaagacaaagccaaccccaccgccttgctcctttcagccgtcatgatgctgaggtatatgggccttaacaaccacgcgaccaaaatcgaaaacgcctgcttcgagaccatcaaggaagccaaatacctaacaggcgatcttggaggcaaagccaaatgttcagagttcacgaacagcatctgcgagaaaatagcataagtccctaaaggaaaaaacgtcgcagtgaccctcgttaaagaagatagacgttattgtgttgagtttaataatatttgtacataataagcacaacatttttt

SEQ ID NO: 36941 - DNA, 334 bp, Triticum aestivum
  Clone ID: PAT_TA_36941
gagtcatattacggtagggttcatgaatgtggtgatggaagagaaactactagaattcccgaacataatttgtgtcgatgggacacatgggacaaataaaaaaggactggatttgacgattttgctggtgaaagacgatagaaatgctggattccctgttgcgttccttctgtcaaatagattggaccaacgaattcaagaagtttttttagatgccctcaagaataagatacagacagaagttaatgcggaatatttcatgagtgatgatgatcctaaatattataatgcatggaagaagataatgagacatgaaccaaagagactattatgt

SEQ ID NO: 36942 - DNA, 393 bp, Triticum aestivum
  Clone ID: PAT_TA_36942
cggatacttgcattattgaagggctagaggaggtcaccattcggatagatggaaacaactgtggctgtaataatacaactcagaaaaaaatgaattggaaagaaatacatcgcttatggaaacagattcgagttgcacgaagcggattgagcgttgacgcgcgcgctcgtgaaagagtcctttcgttagttttaacaaggatgacgggcaccaactaacagggagcagcacaaacgaccaatcagaactcgccaaatgaaccaacgctcgacctgcgtttcgaccttaatgggtttatagcctgaattatagcaatactgagttcgccgttgctcatttcagcctccatatttttccaccattgtgctcataacgattttggtggtccaaaat

SEQ ID NO: 36943 - DNA, 416 bp, Triticum aestivum
  unsure (1)..(416): unsure at all n locations
  Clone ID: PAT_TA_36943
tactatttaaatagtacaaaacatttttaattacatcaatatttgttttacgttctataccatttttctaaaatgtcgcgtacattattttggaacacatgcacatttcttaatgtcatgatttttttggactgctaccaacatcatttataaattacacctttttttacactgttaaaaattcatgacgttttttaaagaagtaagtaaattattttttgtaatatatttatttataatattttcaaaagtaaaaaaataaagaggccaaaagttactggtgcatgtgtacctgcatgatcatgggcgcccatttanggcatccttgaggtgagacgtgctattgttactgttttttgagataccttaccaggcttgatgccgggagcacctatgtgccgcttactgcagaaatc

SEQ ID NO: 36944 - DNA, 376 bp, Triticum aestivum
  Clone ID: PAT_TA_36944
atacaagaatctataatggtgtcgtagtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcatacacccagataaagaatttgggaaatttgttaggacagctggaaaattctttaatgatgacgaagaagataaaggtcttcagacatctgaagatgcacgtttctatgccttaagtagaaaattcaaatccttctccacagaaggtaaagatctagttatccaatttactgtgaaacacgaacaaaacattgtttgtggaggtg

SEQ ID NO: 36945 - DNA, 246 bp, Triticum aestivum
  Clone ID: PAT_TA_36945
gagtcgtattaaaccgtcggttgcttctcatagattactattcatctgtttgaaattagtatgacattgaacttggaaatcatcatattctccatcacgtggagggtcggtgttaatatctagtgtaacaggtaattcataattcagtcgttttctgccgcattacagtcacaacatgagatcaatgtgtctcaggtgcccataaatcgccaagtgtaagtctccatagatcttccaggccgtttg

SEQ ID NO: 36946 - DNA, 434 bp, Triticum aestivum
  unsure (1)..(434): unsure at all n locations
  Clone ID: PAT_TA_36946
aaatatttatcaaagcaaatttcaagcaaagggaatgataaaaccatttgcaaaaagaggctattgatccgatcaaatggcgttaccatggtcggacacgaccaagcccccgataggcgtagctatggttcaagtcagccaggtccccaaatgaaacaatggcattatgccgatcaaaaggcgtgacaatggttcgggttcgaccaagcccccaagtgattctgtggccttaggccgatcaagaggcgtgactatggttcagacgtgaccacaagtccccaagtgatgcattggcattacgccgatcaagaggtgtagcaatggttcgggttcgaccanagcccccaagtgatgctgtggcactaagccgatcaagaagtgtgactatggttcagacgtgaccacaagtccccaagtgatgttgtggctttccg

SEQ ID NO: 36947 - DNA, 253 bp, Triticum aestivum
  Clone ID: PAT_TA_36947
gggtcgacggggtgactaaataaatcattctcacacacctcactacaagaattgtatgccatctaaactatgagaaccgattgtcgtgtcatctatttcatgtgacgcgcctgccactgcacagtggcgcggtccctcatctggggcaggaataacatgcttcatcatgtcaatgatccgcgtatccatctcgtaacttgtgtaggcgtccttggacgcacacttgacatgttgtttatccagtctctcatgc

SEQ ID NO: 36948 - DNA, 412 bp, Triticum aestivum
  Clone ID: PAT_TA_36948
atacacgaatctagaaatcgtcgcagtaatagtaaaaaacaagcacaatggctcccaaacgtaataatatgattccaaatggccatttccacaaggattggcaacgattcgtcaagacttggtttaaccagcctgcccgtaaaattcgcagaaggaataatcgtattaagaaggctcgtgctattgcccctaggcctgctgctggacctttaaggcctgtcgtaaggtgtccatcaatcaggtaccatactaaagtacgcgctggacgtggatttaccctccaggaattaaaagctgcaggtcttaaccccagatttgcaaggactgttggtattgctgtagatcacagacgaagaaacaaatcagtagaatcaatccaactgaacgctcaacgtcttaaagaatacaaatc

SEQ ID NO: 36949 - DNA, 210 bp, Triticum aestivum
  Clone ID: PAT_TA_36949
ccctcatctggggcaggacgaactcactacgttatgtcagcgatcttcgtatatatcccataacttgtataggagtccttggacgcacacttgacatgtggtttatccagtctctcatgcgatatattgtgacaagcattcttgtccttcgtgctcgtctacgctatcttcatgtctaaggggtagattatggtcgtagtcatgtccacc

SEQ ID NO: 36950 - DNA, 404 bp, Triticum aestivum
  Clone ID: PAT_TA_36950
gggtcgaccggtcagaacgatgatgaagaagcctctctgctcaccattggcgctttccgtgggaagtgatagcaatggaagcggagctgtagctcttctgaaaattgcaaggatcttttcacaaatctattcaagccttaagaccagaagcaagtttaatcttctctttggattaacatctggctgaccctacaattaaaatggaactagcaagttcctagagcaatgatctctggatgcatgtatcaaagcctccagagaagccttacatcaagcaaatctttgaggatttttcggatgtctccaaggaaatgggcatttcagtcgcacaagattaatgtgtcaaattctagaaatttgtgtgctatagttgtatctacgaatcgcagactacatgctgaaca

SEQ ID NO: 36951 - DNA, 409 bp, Triticum aestivum
  Clone ID: PAT_TA_36951
gtaggttgatgaagggatggcgaagcccctggtccagacgaggtgacggagcaggtcggtaaggagacgttgcaacttccatgtcagtcgaggtgttgaagtagttcggcgtgatggacatcggctcgaagaagcaatggtgcggccatgccgatgcaggtcacaactcgtgacgtggtcaatgccggcttgatgaagtgaccgtgcggcgatgccgatgtgcccgctccgtgtaatccgtggggcggcgaggttggtgatgatttatccttcgcgatgctaaaatcttgtttggcttgccgggatgatgatccgaagaagttgagctcggctcaacaaagcgacgatgtgtctagcgcaggtcggcagccgtggagcaacgttgtcgagctggtttgacaccggcgcg

SEQ ID NO: 36952 - DNA, 423 bp, Triticum aestivum
  Clone ID: PAT_TA_36952
gtcgacgggccctagggcggctgccctggccgaactctccccttccatatttgtgtaggcctgtttgcaaatttttagaatcctcaaattctgaaaggaaaaaaagatatactaaatttccagttttttgacttttcattaaatcaggtcaaactgtctttaaactacttattcaagaaatattagcgttaatagataattattttagttcttttggcttttggttaaactgtggtcaaactatgttcaaatctggtcaaactgtggtcaaactatgttcaaactacttattcaagaaatattagtgttaataactaattatttaagtttttttgacttttggtcaaactgtggtcaaactatggtcaaatctggtcaaactatggtcaaactgtgctcaaactatggtcaaactacttattc

SEQ ID NO: 36953 - DNA, 348 bp, Triticum aestivum
  Clone ID: PAT_TA_36953
tcgcgggtcgatacacgcgtctagatcactccataccatatcccacttttgctacgaacgaagctatacatatgacggaaatctatgagtatgcttgtggactgaatgattcggcattcgttcttcctcatttccaggtgtataaatatctcatagcgactaagctggttgatcgaggacttgtggaaaaatctttagcgtatttggaaaacattgcttctgttattgttgcgaatccttccctggttgaaatatcattcgtggataatgtatataacctagccgatcgactgaaatactacgatcttgtcggcgaagttgaagatgagtcccaatttggtggaatgt

SEQ ID NO: 36954 - DNA, 432 bp, Triticum aestivum
  Clone ID: PAT_TA_36954
cgggtcgacggggaattctcacaacacaatcggcatacaattcaagattttggggccgtcaaaccacacaccggcagcacagttcacatggaagtcccgagcggcgctgagatgcagattctttgcatggcttgccctacgtaacagatgctggacatctgacagattagcacggcatggactagaccaccaagaagcctgcccgttctgcgaccaagcggaggagaccatagatcatatcctcgcccaatgtgtctttgcaagggaggtatggtatggacctggacctgcacggcaatgaacaaacaagagtggataccaactggggatacacggcttatagagtggtgcccaaataagggtggaaacaatggagacggaaaagatgtccgtgccctcgtcctacttgttaagtgggaattatggaaacat

SEQ ID NO: 36955 - DNA, 426 bp, Triticum aestivum
  Clone ID: PAT_TA_36955
ggtcgagggcataaggtgcgataagtcgttgtcatgcactcaactatgcggttagagttgatgggctcatttacctttgaagcttccgcagtagtttagtttagatggccttcagccatattatttttgtgtaatcgtgttctttatcaggactcgatgtaataagtgtgtgattgaactcttctataattcctcgagtactgtgtgtgtcagcattatcgatccagggatgacacttaagcacagagacttcggttcattgggatcgtggtcgctacaagatggtatcagagcttacgctgactgtaggacacgaccactagaataagccgcatgaattttcttctttgctcatttctaattctcctctaattctactctatagatggcggaccccagaaacaagttcactcaaccggatgacga

SEQ ID NO: 36956 - DNA, 360 bp, Triticum aestivum
  Clone ID: PAT_TA_36956
ttgttgctcaagagatgttacacaaggataaagaggaacttcgcaacaaatcaagtggtgcttacaaagcctcatgtgaagcccccacatcatcgagtgagaaacaaaccttcaatgaagaattgatcttaatggtgaagaactttaacaagttctacaagagtagaagcaaagagagaagctccaagtcaaaggcctacaatgacagaagatcttctactccacagtgaaactgctacaattgtggaaggcccggacactaatccaatgactgtaccgacccctagaagataatagaagaatctcccatgagatgaattatcatagatgaatcaccatctatagaaagaaagagtacag

SEQ ID NO: 36957 - DNA, 301 bp, Triticum aestivum
  Clone ID: PAT_TA_36957
gatacttaacacgatggtgctccatagcctgatgatattagcactacagaacacgggaggctttgcagcacgcatgatcttgccagttcgacgcgctgagcacgactcagtccttgttacccttgggatctacggctgggcacatcaacactctcaacggtgggcatttcagtggcagactttctacacatcggtgtggtaatagccagacggtatcatgctactcgccttgaagaaggttgccctttcgccaactgtctgatcaccgacgaggggcggaccgatagcacgatcacaatga

SEQ ID NO: 36958 - DNA, 416 bp, Triticum aestivum
  Clone ID: PAT_TA_36958
aagtttgcactgcttctttcaggtgtgttagaataactatgagttagtgctgctcctcacatgagttgtaacgttgagcaattagagcttagtgctagaatatagaaggtctagagttctctctttattatccatgatcatgtgtttgtaactgctactgtaactcaacctgggtgttctgtatataaagagaagacagccggtgaggttcatcacggcttaacacagcaatacttctgtttacatggtatcagacgccatctgaccaatgtcaacctcttcctcctctctcatggcttccgtgccggcggctaccaccgtcgtcaccgtgcgtctctctcgcgacaaccatctcatgtggaaggcacagttcctcgcattcctgcgcacctacaatctccttggcatcgcatctg

SEQ ID NO: 36959 - DNA, 413 bp, Triticum aestivum
  Clone ID: PAT_TA_36959
ccagtcgtaaacatgcattaaaattaatttacaccgaatacaagcatgagtagaatataatctaccatgaacataaatatcgtaaaggctacgttgatttgatttaactacatgcgtgaacatgtgccaagtctagccactcaattcatttaaaggaggataccatcccatcataccacatcataatcattctaatagcatgttggcacgcaaggtaaaccattataactcatagctaatcaagcatggcacaagcaactataatctctaaatgtcattacaaatatgcttacttcataatagctgactcaggaacgatggatcatcatatttacaaaaacaagagaggtcgagttcataccagcttttctcatcccaataagtccatcatatatcatcattattgcctttca

SEQ ID NO: 36960 - DNA, 342 bp, Triticum aestivum
  Clone ID: PAT_TA_36960
gtagtcacaatcatgcttatccgcaatatgcaaactggtcaatcaatgggatatagatttgcaaacatcattacccatacctcaacagacacatctcttcaaaattttaacgggcatgtgaatctcacaactgatccaacccttatcatttactggacgacctaaaccaagcagtgcacatcatcatcagtcgtctctcatgacgcaactcttggtggccatttaactgcagatgttactcatcatatgataatcgagctttttgccaacatgtcactctccgtaaacggacctcatattaacagtcacacgaacacaggctgttcaaagggccatggactt

SEQ ID NO: 36961 - DNA, 369 bp, Triticum aestivum
  Clone ID: PAT_TA_36961
aaaatgttaatagagcatttgagaaatgctaaaaatgtgtatagaaaaaatgttgaccttgtactaaaaatatttaattttgtattgaaaaaatattaaacatgtattagataaatatcattgccatataaaatatatatatatagaaaaccaaaaaaaaaaaaaaaaaaaaaaaaaaaaaaaaaaaaaaaaaaaaaaaaaaaaaaaaaaaaaaaaaaaaaaaaggacaacaaaaaaaaaaaaaaaaaaaaaaaaacggggcccccaaaaggttcaaaccttacttacccttgaatggaagttaaaacccctccaaaagtttcaccaaatttcatttaacggggcgtcttttaaaaactccgtaacggg

SEQ ID NO: 36962 - DNA, 352 bp, Triticum aestivum
  Clone ID: PAT_TA_36962
cgggtcgacattagactcgaaatcgagtagtctcacattaatatgcctccaatcacaaaacccatcattcctcattgcattcgtgcatttatcagaattgaaaagattacaggaaaagaaacactctttttgcgtgttttgaaaaaacgaaccatttcctatcacgcacctctccgttgctcatctttgttgagtaatgacgatatgaaaaatgttttgaattttcattcagaggatattcagtattttcttcgtcccttttagtcgcctttttcacgaatatgtccctcgctttgttagcaagattagcccagttgcgtgagttatgaataccgacagtaaccggttagtg

SEQ ID NO: 36963 - DNA, 419 bp, Triticum aestivum
  Clone ID: PAT_TA_36963
ggtcgacggcagggggaaaggccaaagctatgcgacgttctggacgcggccattgcacgccaaagcaatggtcaccgtgtagactggcagtaagaagagccaaatggctggcaattgttttctaaggtgaagttcttctaggggaggtttcaactgcggtggtagctcggttaaagactctgtggttaaatggtaagtgagctctgaagtttactgcatcaaactgaatcattatgcagtgatcaacaaagtgaggttaagaggcaaactagatgtcaggggagtttatgttaggaagaactatagtcctgttaattttgagatgattaggaaaagtattttatacagttgctttacaactagataaactggtctagagacataaccaagaagaagcactcacatagtgtgatggatta

SEQ ID NO: 36964 - DNA, 393 bp, Triticum aestivum
  Clone ID: PAT_TA_36964
ctgatgaagaccacactacacatgaacaacttgaggtgtatatgcagacccacagtctcgttagggatgattccttgtagcagcttcatgttgctgtcataaaagccatcacagcacatgtctgccatatagtgcttcatgaccccttgggtagtaatgcagaccagcgtcttcgtgccaaatgactgagatctttacggaaaactttctatggtgttaaactcaccattggcgatggggaagggtctcacatgaagaatatagataacatcgatgacactgccggtagctcccctgattcgtcatcaaaacgggagtcatcattcactcccattcctaaccctcctcttacccagagtctatatttggacgctccccactttggcggcacct

SEQ ID NO: 36965 - DNA, 174 bp, Triticum aestivum
  Clone ID: PAT_TA_36965
aacgagcaaatctgagcatgggtgtcggtgtcaacaccagttgatctcgggtagggggtcgctaactatgcgtctatgacggatggtaacatgaggcaagggacatgaacttttacccatattcgggccctctcgatggagggtaaattcaatacaaaatatatcctaagttca

SEQ ID NO: 36966 - DNA, 435 bp, Triticum aestivum
  Clone ID: PAT_TA_36966
ccatttatctacaacaacatagacatgcaaaatactattaggtactaagttcatgataaagtaaagttcaattaatcatattacttaagaactcccacttagatagacatctctctagtcatctaaatgataatgtgatccatatcaactaaaccatgtccgatcatcacgtgatatggagtagttttcaatggtgaacatcactatgttgatcatatctactatatgattcacgctcggcctttcggtctcagtgttctgaggccatatctgcacatgctaggctcgtcaagtttaacctgagtattctgcttgtgcaaaactggcttgcacccgttgtatgtgaacgtagagcttatcacacccgatcatcacgtgttgtctcggcacgaagaactgtagcaacggtgcatactcagggagaacacttatacc

SEQ ID NO: 36967 - DNA, 384 bp, Triticum aestivum
  Clone ID: PAT_TA_36967
gcagatcaacgaacgctcctggagagctccggattcgggtaagtaatagataattttctttcacatgcctgctttgcataaagaatgccttatccgccgctattttctttatcgcctcgatctcctggagggccttctgggcttcggccttagcgtttttggtactcacaagagccaaggcgagctcggacgctcgagtcttcgagtcacgctccaaactctcgtgtttttccatcagagcctgcagctcttgccgcacctccgccatacgtgcctccggcacgtctcgcacggtgcgctccaatgccccactgttctcggacttggatacagcctccttcagggccgccaccttgggacgaggcccctgcaacatttacgttg

SEQ ID NO: 36968 - DNA, 381 bp, Triticum aestivum
  Clone ID: PAT_TA_36968
cgggtcgacgccgtgcacgaatgcaagtcgcggcacgaggtgcgaggttcagcagaagggcaacagccatggcgaggaggcctggcatgaggagttggagctgggcgtccatggcgaactgaaggaggcaacgaccctggctcctgcagatgacagacgcggtgggcatgaggttcaacgagacagagatggccggatcctgcgagcaggcgtcggagagggccggatttggtgtccggaggcgtctgggagctccggcgtcaaaggagaactacaggacgccggtgctcgctggaggcgtccattgcatgggcgtgcttcttcctacacaattaggagaccgggaggaatgagagggaccagggtggtagggagaggagg

SEQ ID NO: 36969 - DNA, 380 bp, Triticum aestivum
  Clone ID: PAT_TA_36969
aacgctcagtgaaaccatcctcttcaagtttagcttcagtacatatcattgagagccctttccatgtacgacagcaggtttcatgtgtaacgaaggcattcttggtggcaaggtttcgaagacgattgacatccaccaagaggctcttcatctgacgttttagccagtcgtgatgcctatcttgcttctggtgaagggccacaagaagctctcgatcagtgaggacacgagcacgcttcttgggtcttggagcatttgtgctgtctgtggcttcagtagatgctggtgcacgtgtagtgccagccaacggatataccctggatatggcttcaacaccttcaacattctgcgtgaagctctggtgttctgcattctgaaga

SEQ ID NO: 36970 - DNA, 432 bp, Triticum aestivum
  unsure (1)..(432): unsure at all n locations
  Clone ID: PAT_TA_36970
cgggtcgactcattacacaaaacattttgttggcatatgagagcattcatacaataaaaaataagaagaaaggcaagtgtggctattgcacggttaaactggatatgcacaaggcctatgatanggtggaatggaatattttgaggagaatgatgacacgcttgggctttcatgtagagtttgtaaatctgttgatggcatgtgtccggtcagttaaatagaaggttagattcaataatcaagaaacggattattttattcctgaaaggggactccaacagtgagaccccctatctccatatatgtttttgatttgtgcagaagggctttctagtcttatggctcatagagaggaggttcctggcattgaaggtgtcacggtttgcagaaatgcaccaacaatttcacactttttttttgctgatgaactgc

SEQ ID NO: 36971 - DNA, 414 bp, Triticum aestivum
  Clone ID: PAT_TA_36971
ttttgggcatgatgttgagacatatcgtgatgagagaggaagggttagagtaagtagggtcagaggaatgggaattcgtatgactcgtgatattcaaaggaatttggattttatcaaagagcatgagcagtcaaaaagcatgggacaggccaacattggcaaaggatcaactagcaatgaagaacctccagattttccggaacatctttttgaaaatgatgggctgcaaagctctgttgatctcagtgaagattttgctgaaactatcggtgacaaccatcacacgtcgtcacttgtaggaggatctgatgatatttctgagggttcctgccatggaagcaaagagacaatagagatatcctttgtggatgatcaaattggagtgaaggacaatgatgacaagctgtttttgca

SEQ ID NO: 36972 - DNA, 409 bp, Triticum aestivum
  Clone ID: PAT_TA_36972
acatgttacgaacgaatcctttgatgatcccattcatcctctcaaacggcatcatgttgtgcaggaatgacggccccaggtctattatgtcatccacaatatggacacacagatgcaccatcacgtcaaagaacgcgggcgggaagtacatctcaagctcattcagtatcacaacgatctcttcctgtagccttcggagctgcttcacactgatcgactttcgagagatgacgtcgaaaaagttgcagagaccaataagcgtgtcacagacgtgcttgtccattatccctctaagggcaacaggtaatatctgcgtcatcatcacatgacagtcatgagacttcatcccgctgaaccttttcttgtccgtgtctagatatctacttatcttgccacagtaatcgggact

SEQ ID NO: 36973 - DNA, 405 bp, Triticum aestivum
  Clone ID: PAT_TA_36973
tccctggaccggtgctggacggccgagcgccgcgcacgccagggcctcacgcacaacaccgtttgcatcctatgccatcaggagatggaatccatcgaccacctcttagctggatgcgttttcgctcgggatacctggcacgaaatcctggcctggtgccggctcatctccccgcccatggatagcacgacgaccttcttcgcttggtgggtgctcgcggccgacacctcgccgagcggcctgcgcaaagggctcaactccgtcatcactctgaccgcttgggccatctggaagcatcgcaacatcgtcatcttcgacggccttcacccctccacctatggtcttgtgctttccctccaggatgacgctcgcctatgggctaatgccagcgccaagggactagcc

SEQ ID NO: 36974 - DNA, 418 bp, Triticum aestivum
  Clone ID: PAT_TA_36974
cgaaaagacactacaacatcaaggagggagcagaggccgctacgaagctgtcgtgtagaagctgagaagatgggttcaacatcctgcccttctactaaatcaggacacaaagctggcaactcgaatgaagccggcatagaagctcctatgcccaacaagtcctacatagtgcctaaatctggacgctcagctcgagcttttgggctcggctcgcgctcgttgcaactcggcccgagctaggctcggcccgtcaagtaaaaaggccgagccgagctgtacttttaggcttgtttcgacctcggaccgagccaggctcggctggcccaactagcgagctaaaagctcgcagcccagcgaaggcccaatgaacaccacacaccacaatttagcccatctagcccagcaaaatgactacaga

SEQ ID NO: 36975 - DNA, 404 bp, Triticum aestivum
  Clone ID: PAT_TA_36975
aatacgaaaaaaggggcaaatccgggttaggcctccagtaaggaagctagtcctcctcctgaagcagcagtggacaacgctactggattctatcaaagcgacttgatagaacaccatctgccagacagcccctatgcatctctcagacacataacagacgctgcagcaggatcatcttcagcacagccacacctcactaggttgatcatgaacactctcagcatcccacatctggtgccctcgacattgttccctcctaccccatctgcccatgagcttgctccttacaatacatgcgatcgtccaagtgcacaattatcccacctgaccatagatccatcaagcatataaatatttcgcataaaatacgagtcaccttttctcctacacagaggatatccatg

SEQ ID NO: 36976 - DNA, 401 bp, Triticum aestivum
  Clone ID: PAT_TA_36976
aaagcctaatctggcctccggcggctagcggctctacttagcatgcatcgctgcgaagtgctaccccaccgccggccaggccacacttccacacctcttgttattctccaccgactacagccccacgccacaccagaaccacttataacccttgtactcctctcaatctgcgactccactgccgcatcttcccatctccgggtcgttcctgtccggggcctcgccgacgtccacggcctcgccgcgctcgacgtggcgtggtcaacaaacaaggtcatcggaagaggactatacgtggagagcctgatggctgggacccacaaggtccatggttgcacgcaaggaaagttcctccttattaaccctagaagatgtttcctccccctgacagttgggaccca

SEQ ID NO: 36977 - DNA, 334 bp, Triticum aestivum
  Clone ID: PAT_TA_36977
caaccaagagggatttaataaaaacttccatatagagtgcattgaatactaagagaagtttgatacttgatgattgttttgagatatggagatagtgatattaaagttatgatagttgagtagatgtgaaagttaaaaatacttgtgttgaagtttgcaagtcccgtagcatgcacatatggtaaaagttgtgttacagatttgacatatgaggtgttatttgatctgtcctccttatcactggcggtcggtgacgagcggtggtctttttcctacaactctagccccctacgagaatgcgcgtaatacctggcatctgactacatgtagattt

SEQ ID NO: 36978 - DNA, 269 bp, Triticum aestivum
  Clone ID: PAT_TA_36978
cggatctccttccggagatcacggaaagctacacgccccctacctctgtcacgcctagcaaggcggcctacaccgaggtgtcgtcacacaggacatcgcccaatctgccacaagcacaaggtggtcacatgacccctccgggttctccataccccgccttcgaacagggccatgtggacgagtccggcgccgactggtgttcggccggaggagtctgacgttttggcatgccgaccctctatctcagaagagcatcacgtgttaatgca

SEQ ID NO: 36979 - DNA, 384 bp, Triticum aestivum
  Clone ID: PAT_TA_36979
taggcaacacaaaagaaacggtcatccagatcaaggtgtgtgcgatatacgacatgcggttcactcggatgaactatttgcattgatacaagagaacagaaacggttcaatataacaaataccataaatattgcaaggttcaaattcaaagattacaatgcccaaatttctgtaaaggggtcagctgttgacaagtcatgtatgggtttgccacaatgacttccaattactctgtcatatgctcttccaatacgaagtttagcttttttggagcctcttccattctacagtacctgccagctctgatcaacataccattcatctttcctaattaaatgtgtgttcaacctcagtaccctcaacaccctttctctggcaagaaag

SEQ ID NO: 36980 - DNA, 401 bp, Triticum aestivum
  Clone ID: PAT_TA_36980
cggcgttttgccccgcttaggagcccttacctcccaattctcggaggcggcccttttcttaccatgggaagaagggatgtcagcttctccttcccttttgtcttcggaagagggagccctagtctccccggacacagtgtgtgatttgcctccaggatggaggccgccttcggctccaccgctcttctcattctcctcctccaccggcacctggtatggcgccgggaccagcatccatgctagtatgggactagctgagtcctcaacaagaggagccgaacacctgatttgctcagccttctttatccagccctggaaaaagatggttttctcagcatcttatcatgagatgtgtatctaacttgtgtttgagaattgagtgcttaccgaggtatccggat

SEQ ID NO: 36981 - DNA, 370 bp, Triticum aestivum
  Clone ID: PAT_TA_36981
aagtatagcaaggcccgtttcgaagaaagttatacctgatggtcgccgagatgtcgctaggtgggcgacgggaggccggatctgcccacactacgacagcgaggaataagaggtcggaggccctccctcgccagcggtgcttgggaaagaacgacaaggaaggctgatcgggacgcgcccagcagtgggtaagagccgtcgccgaggacgaccgcatgaacgttgcaccttctcaccttccctggcagagaggatccggatggatctgtgacaagcggtgagaagagagagagagagtgtgtggccaccgctgtcgtgtttagatctggagaggccgagacaggtgtgaagagagcaacactagcaacca

SEQ ID NO: 36982 - DNA, 429 bp, Triticum aestivum
  Clone ID: PAT_TA_36982
ctgcaggacggtcgaaattacgggtcgacggggccatcatacagcttgggagcttcacacccaaggggccaaagagagatctgttgctactagcacgactcaaacataggcacccattgagcacagctcacaaagttacttgggggctctttgtgtaaagtaacaaagagtttgaaaggacccttgtaaccgggtatcaacccatggcttggaagcctggtgtattcacctaaaaccccgggttaacctgccttcatcaagtaagccactcctatccaggtaatcctggcatgacccgccgaacgtttgacagttactctcattgagaccctgaacttgtcaaagttaaaacgatgattggttagttcgaggcccatcttaaaaggctttgtcaaatggtttaactcagcgggctggcagcacacgaaa

SEQ ID NO: 36983 - DNA, 407 bp, Triticum aestivum
  Clone ID: PAT_TA_36983
gggtcgacggcgaccaaaaagcactccagttcttcaccagccccctcgcaccttccggtgaatcaccgcacctctcaccggcgaagcagcagcgtctgatggcccccaatgcggataagaagccggctgccgcggtagaatactccggcggtcgataagacaccgcgggcaagaagcccaaggccgagatgcggccgtccaagtctaacgagggcggcgccgacaagatgaataagaaggccaagaagatcgtggagacgtacaagatctacatcttcaaggtgctgatgcaagtgcacccggacatcggtatctcctccatggccatgtccatcatgaactccttcatcaacgacatcttcgagaagctcgccggcgagtccgccaagctcgcgcgctacaacaag

SEQ ID NO: 36984 - DNA, 401 bp, Triticum aestivum
  Clone ID: PAT_TA_36984
gataggccatcctggcacacaggttggggcaaaatgagctcgtgtgcgatcttgcgaggcatcaaaacccaatcattttcgttcgtatgtacatcccacatggtgaatcccagaaaaacatttatgtttgtatgtatatcaaacacagttttttgtgttgaaacgtttatgcaaggtggcctaatgcaaacagttatctgccagaagttgtgtgtgattgttatttgatcgaacacgactactttctagaaaccatgtcggttgtttgagttcatcgctcatggtgctatctgagtaaccgtatgcaatagcaaaccccaataagtagggtaattagcttattattgataatccatgtagtaatcaaattgacatttcttatataacacaccagatatttc

SEQ ID NO: 36985 - DNA, 389 bp, Triticum aestivum
  Clone ID: PAT_TA_36985
ttcttttgagttttgtgtgctgaagttttcaagttttgagtgagatcgtgatggatgaaggaataaggagtggaaaaacctaaacttgaggatgcccgaggcaccccaaggtaatattcaaggagacccaagtgccccggatggcatccccctctttcttctaccaaccatcggtaaattacttggagttatatttttattcatcacatgatatgagttttgcttggagcatcatgtattatatgattctttgctttaattgatttttagtttgccaaaatcatatttgttggacacacctttttgagtgggacacacattattcatgatttgttaaaatactccttatgctacacctatatcttttgagctaggcagttgctctagta

SEQ ID NO: 36986 - DNA, 344 bp, Triticum aestivum
  Clone ID: PAT_TA_36986
cctggttggggatgcgtcctccgtttggcgctgctcggccatggagcttcttagcctaccatgaacgatgaatgactatgatttaccctacggcacgaaggaatgtaggaaggaggaaaacgccaccggcgatggataaatcccccataatcggcagctcctccacgtcccaagggatggatgacgtccatcattatctaattgataaatgagccccttggtggggtactaagatcacacttacctcaatgacgatcaggaattacgatggcaagaacgccgaggcggcccaagagttcaggaactgccgtgcgttcacatgcgagagaccatctgtgtttatc

SEQ ID NO: 36987 - DNA, 385 bp, Triticum aestivum
  Clone ID: PAT_TA_36987
aagctgatggggtggtggcgtaatcatgccttctgaagcacagcctgaagaggaacttatcatctctgcaccaaatcaacctgaagacaatgctcagaccgaagacaatcctcccaatgatgacaatgatcagcaagagcaaagtcttcatcctgttcatcctcgtgttgcaaatgaagtacaaatcgagaagataattgacagcatcaatgcgtctggtccgcttactcgctcaagagcaacacagctagcaaacttctatgggcacttttcatttgtgtcaatatcagaacccaagaaagttgctgaagcttttatggaacctgaatggattcaagccatgcaagaagaacttcaacagttcaagctgaacaatgttccggaa

SEQ ID NO: 36988 - DNA, 412 bp, Triticum aestivum
  Clone ID: PAT_TA_36988
catacaaagctaggaaaaaaattagggccatttcaaggatgttgagaactaatgtgctctcagacggagccttctgaacttcccaaacacccttcattcaacatggtctatttttaaaatccttgaaatttgcaagtaggtgggcatgcccatggtaggcctccatgtcagatttgaacgatttctacaccgtgtgcaagttgcgacacgtccaaccatttatctgctttttttatcaagaaaactctagaaaatacaaaaattaccaaaaatagaaacaaggcatgatgccttaaattgatcatacaaggccatggggagaaatggggccattttaaagatgtcaaagaacaacgaactctaggacagagccttctcgccttttgacaccatttgcaagttgcgacacatt

SEQ ID NO: 36989 - DNA, 403 bp, Triticum aestivum
  Clone ID: PAT_TA_36989
cgggccgactcgagtggcaccgtcttgaatatgatgacgaggtagaggagcggttgaccatcatagctcagatgtcctccttgagagatgccatggatgtgtcgaagtagtcttttgtacgttgctcggattgtcacaagtcggaagcaagtaggtccatgtggttgcccaatgcttcattgccttgatgtaaagctctttgcgggccaagaggtggttcttagtgacgtagttgttcgggtcctcatcttgctcgatgaagagtgggttggtagaagtacttggcctatccatcattccaagtaaagtgtgagtgggagaaagagaagaactatacaaaatgtaccttgaccgatgtttagtatggatcaaagatcactcaatgatgttgcaagggaattac

SEQ ID NO: 36990 - DNA, 399 bp, Triticum aestivum
  Clone ID: PAT_TA_36990
gggccgacgggactacggagaaaaagacgtatcgagtgtgtatgagcgaggcacaaagacacaatgtttgagagataaaccaattgacagattaatattagatcgagttgtcacccttctgttgtcattgttagggttggggggtggagggagagaaagacatatcgagagtgtgcgcggtaggcacagacgcacaactagcgagtgtgtgtatgtgggtgtgtttgaaagaggagtagatagattacgatcaagatcgaggtgccatccctacgccatcggtgtcaggtactgtgtgtgtgtgtgtgcatgtgtgttagagagaatcgactcgatagaggactatcaggatcgaggtgtcacccgactcgttcggtgtccggaagtgtgtgttcggtg

SEQ ID NO: 36991 - DNA, 412 bp, Triticum aestivum
  Clone ID: PAT_TA_36991
attcacccacacgaaatcaccgaacgcgctttcctacttggggtcacgagtggcgctgatggtgaaggtatgaccaatgccatccaccttggaggacaccttcttggccacaggtggagctgccattgcattcttacacttgccggtggagctcgatggtgcatccgctacagtagcgcagcactccgaataggtgcgcttgccagagtgggcatcaaagctcttgccggacatggtcttcttcgacccgggagcttcaccagcaagtatcttgctctctgcagctgctgctgcttcccggtagaccttgtcggcacacataatagcatccttcttgttgccactgacagagatgacacttattgggcctgacattttcaatacgtgctacgcatagtgagaggctgccatg

SEQ ID NO: 36992 - DNA, 398 bp, Triticum aestivum
  Clone ID: PAT_TA_36992
gccatggaggccgccgcgaagccgatgaggagggaagacaaaggttgttgcaaggagagaattaagctgctgctgctgctgagctgctgtcagtggcgttgttggcgtctagaagcttctaggtgaggcggcaccgccttctagggtcatggctgccgtgccgcgctgcgccgcccgtcggaattcatttcagtcgatccatcaaatccgttccgttccttcgggtgacattttctatttcctgtgttcgtttgtagtagtagtggtgataataaaatgacggtcctcctcactgtggtgcaagagagtggagagccctccctagccaggcaggctcctcttcttctgtgtacaaaggcttgaacttgaagttggtactaaataaataaaacccaagc

SEQ ID NO: 36993 - DNA, 375 bp, Triticum aestivum
  Clone ID: PAT_TA_36993
gtggagggtcatgagcaccagcaggcgcgtcgaggggcaccatggtcactgtgggagcacgccaaaccgaaggccatcaccagccactggataggtgagcaaatccattctcctatcagattcagatatctttgggtagtcaaggtaaatcctttatgcttgagggtaccataaataggctattgattgaatgaaacttgtggttggctgctattgtgttgtttgatgtttggttcagaggaaaaattgcatttatttatatagaaggtacttagtaaaattcagtctgatttaatcatcacttcagggttatgtatctctgtacgtatagatttccatgtttagagaaaaaactgtatgttaaaacaagatgct

SEQ ID NO: 36994 - DNA, 420 bp, Triticum aestivum
  Clone ID: PAT_TA_36994
tatcaagaacatgatacaccagcttagtgtattcacgggaataagttcatctccaacaatgatcatcagaacggacaccttcaactgtccacgggcatctggccagatgccggtcatccaatgctaacgttcaggatttctcctgttgaacctattagctagtaggtttttcgaatgggcgattgcctaactttatcatatagatagaagagaggtacagtctggttatcagtctaagcgtactagatctgattactgtctaaagcagccatttacagccttacaataggaattatacatgtacttccggtgctctcacactatgctccgagctctacatgtcaaccggccgcactccaaatagcaatatcttcacagacgaaatccagcaccctgtcggagctgcttgccatctgatca

SEQ ID NO: 36995 - DNA, 390 bp, Triticum aestivum
  Clone ID: PAT_TA_36995
gagtttaagcaaaagtcaaccataccaagtacccatcacaatccctatctctcgcattacattatttgcctcttgttttcctctcccccacttcacccttgccgttttattcgccctctctttcccaatctcatcctctctttctcttttgcctttttctcgtttgtctttttgttgcttgtgtgttggattacttgttaccatggccgaatcaaaaggaactaagggatttctcccgagttctagtgccttggataacctttctatcctttctaagctcataaacaatgatgctacagagagacccaccgggatcaccaataagaatttagatgattttgatgatgatgactccggaatctttcgctatttacttgatgaatccttaaa

SEQ ID NO: 36996 - DNA, 256 bp, Triticum aestivum
  Clone ID: PAT_TA_36996
gaagagtaccgtcagcacgacggcgtggtgacgatcttgatgttctaccgtcgcagggcttcgcttaagcaccgctacaatattatcgaggagtatggtggaagggggcaccgcacacggctaagaaaacgatcacaaggatcaacttgtgtgtctaggggtgcccctgcccccgtatatagaggagcaaggggaggaggccggccggctctattggcatgccaaggaggagtcctcctcctagtaggagtaggcc

SEQ ID NO: 36997 - DNA, 302 bp, Triticum aestivum
  Clone ID: PAT_TA_36997
cccaatagtgacgtcgtattagggcgccggcgaccaatgacgccggaggcgaggggaacacgaggggcaggaagaatggcatcaaggccaataagggcgtgtagacgtagaagatctacatcttcaaggtgctcatgcacgtgcacccggacatctgcatctcctccaatgccatgtccatcatgaactccatcatcaacgacatcttcgagaagctcgccagggattccgccaatctcacccgtaacgccaggaaacccatcatcacgtcccgggagattcagacctcagtccgtctcgtc

SEQ ID NO: 36998 - DNA, 380 bp, Triticum aestivum
  Clone ID: PAT_TA_36998
aatggtgtgggcgacaccgacaatggtgatggtgatgctggcgatgatgatggtgatgccagagatggtgacgacgacaccagcgacacgtgtgagggcgacccggaggacacggtgagcgatatgtccgattgagctcgtgcttccttgtcgttgaccctacatgtgaaagctcgggcacggccctgaaagttgtaagagcattttgggagggggagcccctcatgtaaatagattactgcctctattccttaagccaagctggagatttatttttatgatcccgcgagtctcgctgcgagcttactactgcaatttaccttattcagggccagttcccgactggctcatgacgtcgtgagctttttaggggcctgctg

SEQ ID NO: 36999 - DNA, 270 bp, Triticum aestivum
  Clone ID: PAT_TA_36999
gacaagcacatctccaatatcgccgacacgaatatcaacgccgccggcagcgctgtcatgcactttgcctacggttctgttctcgactgtgccttgagatctaacagatcgttactaatacttgtttctcgtaacaccacattgtgttgaacaacacatcgatagtttgttatccttgttcctgtgtggtacaccaccatcttatgataattttgcgatatgttatgccattttataacaaaaaacattaaaacccataattgtaaaaac

SEQ ID NO: 37000 - DNA, 361 bp, Triticum aestivum
  Clone ID: PAT_TA_37000
caatcaagggaccgctcgagaccccaagatcatattatgcattgtctggtggagctggaaaagccgtgtcaacaggaagcaagattgcgctggagagtccaaggacggcggagaagccatcggcaggcgacatcgtgtcgatggtgatgaagaggaggcgtgcgatgccaaggagcgaccagccctctgaagctgggcgcgtaaaagcttctggtgggatttttggatacgtgcgagaatccagtggtaaacaagagaaggagaaggagggcctggcatcatctggggagggggagaaaacacagagcaaaggtgtggtggtggctgcttcaaggggtgctgcagatgcgccggtttctgc

SEQ ID NO: 37001 - DNA, 401 bp, Triticum aestivum
  Clone ID: PAT_TA_37001
gggattgctgatctgcggcagaatgtccttgttgtccatgacagatgggcctttgtaattctgtctgggaagttccgcaggagtctgccagcaatcatggcctccttcctggacttcttacagcgccttcctgtctttattggtgatgacgacgaatgccagccgtccgtcagaacatggatctcaatctaggcgcttagtcgcttctggagggatttatgtggacttccaatcatccagtggttgacattacagagatctcgtgggacttgcatcatcgttggatctggagactgcacatatccagtgtgtactgctgacagcttcacgtggtgctgcagatgcgccggtttctgcagaccaggcaaaagcgggtggtgctgctgttgttgtggaaaccg

SEQ ID NO: 37002 - DNA, 398 bp, Triticum aestivum
  Clone ID: PAT_TA_37002
aatcaaagtagcgcacgagatccaacgattacattacgcatggtctggcgtttcagttttagccgtgtcaacaggaaataatattgctctgagagagtcctaggatagagtgagtttccacctgtatgatatatcgagtctattgggaataaatatgaggcttcgaatttaattgagcgatcactccgctaattctgggctcgtcatagcttctggagagaatttcggataagtgctataatccactggaaaacactagaaggagaaggaagatctgacatcaactatcgagagggagaaaatagagagcatttgtgtcgtgctagttgcttaacagtttccaggagattcactagtttcagcagagcatgcgttcacagtttgttctgcaaatattt

SEQ ID NO: 37003 - DNA, 428 bp, Triticum aestivum
  unsure (1)..(428): unsure at all n locations
  Clone ID: PAT_TA_37003
caataactctaaaagattataatgactcatatcaatgacataatcaactagcgagcaataataagatgtctcaaacggcaacacattgtcaaaacaaccatgatataatatgacaataatggtatctcgctagccctttctgagacggcaaaacataaatgtagaggacctccaaagttcaagtagcgactaaacattgtaattcattgtagaaaagatccagtcatgatgcacccaacattagctacacacaatgcataaatcatgaccgctgtgctctactcagtttctggcgcttgttttagaatgtgatgacacaacataaaactaaatagatagtcccttcgctagagggaagcagtgatttgcagaggtgctagagatcaatttttanaacagagataaatgtaattttaagacatgcacct

SEQ ID NO: 37004 - DNA, 367 bp, Triticum aestivum
  Clone ID: PAT_TA_37004
ggatagctatcgtcaaggagggggatcaaagatctactagtcctcatgcaatactcatatactttttcagtatggaacataagacaatgtcatcgatttcttaaactattcagcacattctaaaaggtgcccatgtatatcaatcttcatgacatctgctgtatgttgtcagtgtccattgcaacattaccctactcctgacgcactatgcaatcgtgcaccagtagcatttttggcaaatattcaatggaatataccagtgggtcacttttgcaagcagcaccattatcagcttagactagtcatagctcactaataggtagtccaccattaatagttttgcggagttgatctacaagaagagtta

SEQ ID NO: 37005 - DNA, 377 bp, Triticum aestivum
  Clone ID: PAT_TA_37005
ttcgcgggccgacggggaacactaagctctgttaagcggggccccaatcttcacagttccgtttaattctctccagtagttcccatgtgagatcaatagacctcagcatagaggtactaccacaggtggtatcaagcatgttgcgattaccatcagatggccgttcatcgtaattgcgactaagcaattctgtgagagagctcatgattggggcatgattcagcacattgagttaagcctgatccacgcttgggcatgcattctcctgcgcgatgccaatacttatatatgtaattacgatcacgatgaacaggatgcataagctagatcttcagttgagattctaacttcaatagcttagcattctaagatctcgt

SEQ ID NO: 37006 - DNA, 433 bp, Triticum aestivum
  Clone ID: PAT_TA_37006
ccaacacatgcatatttctgcctagagggattttttttttattcggaagaatggaagcattagttctgacgttgtaggctgtacctaagatgctcatctcttcacatgtagacaattagacaaacactgtagctctagcatttgcttgtttgtttagggcttagctgccttcataattatttgattgatgtttttattggatattcatattttattttggagaagctgcatatggtgcttgatcaaactccatgaattagataaactttccaatttgatagagtaaatccatccagtttattacagcccttcccattcaattactcctgtatgctaagtggtaattgatcacaatatagcgtcttgcgcgtgtacatcgaaatggcgtcttcagtgttgctgctgctttggctcctacacaaataattgggtt

SEQ ID NO: 37007 - DNA, 437 bp, Triticum aestivum
  unsure (1)..(437): unsure at all n locations
  Clone ID: PAT_TA_37007
tcccgggccgacggggtgggggtcgcttctcctttgttctctttgtgctagacctttgttatgcactagggaaagaaggagttgcgaccatcatcgatggttgaaaaatgggtgagggagtgtccaccatatatgagagaagaagaatgccgactgttgttgtgggggtcgcttctccttcttttccttgtgctagatatttgtaacgcactagggaaaggaggagtagcgaccatcaccgacggtcgcaatatcagagagggagtgccaccatatacgtgagatgagagtttaggaaggaagactcgacagacctaaagtcaacccgttgcttattgagtaatagtgatctgtgtgttgagtttcttgcttgttgcctttgattgattttcaattaatgtttcaactatgaacatangaaatgcctgacgatgaaa

SEQ ID NO: 37008 - DNA, 351 bp, Triticum aestivum
  unsure (1)..(351): unsure at all n locations
  Clone ID: PAT_TA_37008
gaagtccaccgccaaagaaggccgcgacaagaaaggcaagaagaaagccaagaagagcgtggagacgttcaagatctacatcttcaaagtgctgaagcaagttaccccgacatcnggatctcctccaaaggcatgtccatcatgaactccttcatcaacgacatcttccaaaaactcccccgcgaagccgccaaactggcgcggtacaacaagaaacccaccatcaccttcccggggatttaaaactccgttcgcctcgtcctccccggcgaactctccaagcacgccgtctccgacggcaccaaagccgtcaccaagttcaactcctcgtagagtgctcctgctcctgtg

SEQ ID NO: 37009 - DNA, 377 bp, Triticum aestivum
  Clone ID: PAT_TA_37009
gagcgccacgacgtcgagtggagcctcgtggagccaagcggagtcgtcggcgatgaagacaagcgcgccgagacggatctcgcggccttcagccaatcctccaccggaaactatgatgatgggaatcggaagaatcacaacttctgcaataaactgctaagacacctgccccaaggtgggcgccaactgtcgtggttctaagactgacagtagaatggggggtaggtatgaagaggcaagatcctagctatggagtagttgtacacacgagttttacgagttcaggcccttctcagaagaagcaacaaccctacgtctcggtgccctgaggcggccgattggattatatgtgtgtgtgagtttacaaaagatgcgaa

SEQ ID NO: 37010 - DNA, 396 bp, Triticum aestivum
  Clone ID: PAT_TA_37010
cgttcaggcaaaagtataaacatagcctttataatttaataagcattgttcttacaattgagatacatgtcactagaacatgatatgcttcgagcactgagcctctattacatgagcgccttctaagacttcctcaaaatagtgctcggccgatacccggcctaccgccgaactctgggatgcaatagtggtggcttccatctctgcccagtatgtcttgacacgggcaagagccatccgtgcaccctctatgcacgccgacctcttcacagcgtcgatatgcggcacaacaccaatgaattgttgcactatgccaaaataactattcggcattggtccctccggccaaaggtgatccccgatgaacctcatatcaagtccggacaacctatggag

SEQ ID NO: 37011 - DNA, 175 bp, Triticum aestivum
  Clone ID: PAT_TA_37011
gcattcttctccagagacggcaggcggcggagctcatcggagttgatgattccggcgcgaatccgacgaaccaacggcaccgtcgtgctcaggagatcaacacgaacatgcctgagggagtgggcaaaggcggggagcatcagagcaggagatcgaccatgggggatccatggcc

SEQ ID NO: 37012 - DNA, 396 bp, Triticum aestivum
  Clone ID: PAT_TA_37012
aagatcaaatccatctagaacgtcaaggtcatctacgcccgcgccaagcagtactccgaggagtacgatgcccaggacaaggagttggttcagcttatgcgtaaggcccggttcaatggtgggttctatgtcattcatgaggcaaacccgctgtatgctgtcataatcaggcgtatcaatgccatgcacccaaagcacacgaagattttgcaactgttgcgtttgcgacacatattcaatggagtgttcctgaatgttaccacagccaccatcaacatgctccacatggtcgatccatatgttgcataagggtacccgaatctaagtaatgtgatggagttgatctacagaataggttatggcaagctcatcaagcacaggattccattgaccaac

SEQ ID NO: 37013 - DNA, 391 bp, Triticum aestivum
  Clone ID: PAT_TA_37013
tttacaacatacatccaaatcacaaaccgttttcgctgttgggtttatcacttcaagatctttgaaactggatcccatattaataggtttgactgagctttttttcacgaagaaaccaaaaaagatccagaaaacaaaaaaaacaaaaactaaaaaaaggaaaccgaaaacacggaaacttgtgcatatttgtgcttttcactctttttcggaagcacacttgtgctttttcacttttagagaagtacatatgtgcgtcaccatgaagcacatatgtgcttttcacttttcggaaagcacagttgttgaaagcataactatgtttttttgactaacgggaagcacaattgctcttcacgcagaagcttttcacacgtgcttcacgtgagaa

SEQ ID NO: 37014 - DNA, 412 bp, Triticum aestivum
  Clone ID: PAT_TA_37014
tgtgataatgatgtgtacgtgtgattccacccaagtcttaccaaaatggatcccctcttgatagtacgatgactcctacgaagctagtccaccaacaatgaaaggaaggagctacaccgtcttgaattacaacaccgaggggaggaaatcgtctcgtgccaatggatgaatctctgaaagaactaacgcacacgattagtctgcacaagcattgtcatcaatcaccaaaacatattgggaataaatatgcccttacaacgtgaatgtatttgactttttgagccttggaataattgagtgcgagagagaaaatttctcgactctagtggggaagaacataatggtcgggctccggtgagatttggatttaggaaggaggagcttgcatccccaagtccttccatctgccccg

SEQ ID NO: 37015 - DNA, 423 bp, Triticum aestivum
  Clone ID: PAT_TA_37015
atcatcaacatcaccatcactccgatcagcaggtacagggaagaactcggggaactcagtggcagaaggaaaatcgacctccagaagaggaagtcgagcgggaataggctcatcaggctcaacaggactgccaggacgcgcacgaagatgagccctaagggcatttgcctcagagatgcggcgaacctcctcggtagcaatgtgagtagcagtgtagcggcaggtgtcaaagatggctttatgggacttcccaataaagcgagcaaggcggtcaaatggcttgacgaaaggtttggtgtggcaagaagagctctcaccacacgacggagcaggagccttgcccctagaagtgtcatcacgcggagtccacatggattgaatgttgttcttgttgatggggcaagtgaagatagaatcaatgac

SEQ ID NO: 37016 - DNA, 327 bp, Triticum aestivum
  Clone ID: PAT_TA_37016
ggtcgacggcatggaaaaggagcatgcggcgttcgcatctgggtgaggatgaaatgaagatgcaagtagctgaagggtctgttttgcactcatgcccatatgtttgcgagttaaggatggtgatcttagagtcatgctagcgggtacttgtggattgtagaagtacttgtgttgaagttcgtcattcccgtctcatgcacgtccggtgcagcgtcacgttacgaagtcggtacaatagttaattattgattgtcctgctcatcagagccctgtatctactatttgaggacgaatctttgcgtgacacaccccaaaaaccatacacgt

SEQ ID NO: 37017 - DNA, 345 bp, Triticum aestivum
  Clone ID: PAT_TA_37017
cggtgataattgataatgatcttgctgaaaaacagaaactttttcactcaggaaaataattctcacttgtagcggatgcataataagacattgactcctctttgagaaagatcaatggttaaatttcctaggtcgtgcgaatgtttcggatgataccggagtgagtcaagtataccgactagcaagattgctacagacggttcggtctttgatatattcaggtttctaagtgttgtctgcttaatttgacaaatctatgggtagtatcggggggtatgaaccatgcaggagttgaaatacaatagagatcacacatattaaaaggaagaatgagttcacaacagt

SEQ ID NO: 37018 - DNA, 390 bp, Triticum aestivum
  Clone ID: PAT_TA_37018
ctaacacaaaaccctactttgtttgcatgtgcagctagaaccctagcagcactgtgtgcaagtcatgcatgaaaaaacctactgtccgcgaggctctggtatatagtgcgtgcgtgcaaacagtagtacatacaaggtgacaatggaatgtccaagaaacagaatgcttccaagcatgcatcatgtggacgtggtaagagtaatactagtactactatacataccgctacaggttggcatgcatgcatatggttttaatatatttgcaaagcttgattggcatcgaactaaaccatatgcatagtataccatataaacacacgagcggcgatcccatgttcctcacctctgcggttcatctcccctcgctgccgcctccaaggaaaatat

SEQ ID NO: 37019 - DNA, 396 bp, Triticum aestivum
  Clone ID: PAT_TA_37019
tcggatcatgtgggtaaagtgtgcaacctctgcagagtgtcaaactattcgaataggcgtgtccacggtcaaggacagttggataaccgctcttgggatacgcccattgtttacaagagctggtgcgtgtgtttgtgtgggtgaaagctacttgagtcgagtttaatgacttgaatgttgattaagctggagttgatccaaactctgtttatgttgatacctataacctattcacatggagatctaaatacttatgatgcatgctttacaaagttgttaggacatgtcattgcactcaaaactagctttatgcaaaattatctacttagtgctatatcatgcattgttgtaccttgtttcaaaacatgggttgcttgtgagtacattaaaattact

SEQ ID NO: 37020 - DNA, 407 bp, Triticum aestivum
  Clone ID: PAT_TA_37020
gtgcttaatggtatgctccaaataccctcaattgctttcccacttccacacatatgtcctaaacctaaagtcaaactcggccccactaattctttctatctggcgccaccgagtttggatgtcttagccactgccacaaaccctaggcaaatcagtctcaccgatagggatctcggtctcaccgagatgggattgtaatctctctgtgtatgtccattatcaaaatcggtctcaccaagtttgagcaatcggtactaccgtgattacaatgcaaactctctggttaacttattatcaaaatcggtcccaccgagtttgataatcggtccaaccgagtttgcctgaccgacactctggttagctaattaccaaaatcggtcctaccgagtttgtgtaatcggtctcac

SEQ ID NO: 37021 - DNA, 373 bp, Triticum aestivum
  unsure (1)..(373): unsure at all n locations
  Clone ID: PAT_TA_37021
ggccgaggcgggtccaattcgatccccaaatcgcaagacgaaaccctagactcgccccacagtttcttctaggtcgcaccaaattggagcagatagatccctaggtatcgaagatggcggatccagctgctctgccaatcgtgccttgtccggattgcggcaggaacgtggtgacctacgttgctaggcgcgggcagaacgccggtcggtgtttctacaagtgccggaatcacaacccttcatcgggcggatgcaatttctacaggtggcaggaaggctatgcagcgcgtctggccaatcttgaaggaggagaagctgctgtgggtcaaatcggtccgggtcagatgcanggtgggcaagctgtcgaagctca

SEQ ID NO: 37022 - DNA, 408 bp, Triticum aestivum
  Clone ID: PAT_TA_37022
ggccgagggggtcacgaagaactagagccgttgcgccatgggccccaagacgcacgccacgaccagggacacggagcagctcatcgcaacagacgctgcgcacaggttaagctaaacctagcctgagatgtgagagcatatgggatgtagtttcgctttcagtgtgtcatggttttgaagatgaacgcgagaccttttagcaccagtgtggcatcctattgtggctttcagagtcgctgtccacattcgcgatacgtaagcatttatgagatcatgtttacccatgtctggattcgcacagcagtaatatcggttgtacaatgaaaggatccccgttaggatgcatgcccaagaaactgttgctgttatgtcagagttcatccaaactggaggcataataccatttgg

SEQ ID NO: 37023 - DNA, 286 bp, Triticum aestivum
  Clone ID: PAT_TA_37023
tcggggaaagcccccgcgatacgtaaatcgatctggacagacctgctcgactgaacatctcctgtcgcacgtcgaatgtaagtcaccgagctagtttcattttgccttaaggatgaggtaatgcataactggagttcagacatgaattgacacattgactcagacacatcatggtctatcatgacgactacatactgagggaacatgatcgaacagaccaaaataaacaatctgtgtgagaaagtataaactgtgtctctagaggatcgaacattaagatatatca

SEQ ID NO: 37024 - DNA, 313 bp, Triticum aestivum
  Clone ID: PAT_TA_37024
ggtcttgcagctgatggagaatgcatagatgcttacgatttcgctagcttctaattccgcaagttgtattgtacgctgatggagaatattcagttgtagtggatgatattttgtaccaggcataaatggaatcttgatccataaattcagctggacggctctgtatggtatctgttccatttctgagcttctttcggatgtgaaacggagggaagttatgttatctgtaatcccgcagtgctgttgccgaggaatacgtgctgtgggctttcttattggaccctgataaatcctgaacgtttggattttaggc

SEQ ID NO: 37025 - DNA, 431 bp, Triticum aestivum
  Clone ID: PAT_TA_37025
ccacccaacgtgatccccaggacttccctccgaccactatctttaaccgacgagcgtccaaagtccaaatctgggggaaggacgataacacacaaactgcaactggcctctttcgagaaggtgcctagccaacagagaaccagagcaccacacctccaatcatcggctcctcgccgatcatgcaggccgaaagagtcgattgaaacactgacaacaagccccatcaaaaggacgttcctgtcgtcgccacctggggccgccacctcgactttcgagcccccccccccccacatgagtttccctggccgaatccacatgtgaagccaccatgagtgtcgctgtctctaggacggtcagatttgagtcaacaaactttcccacccccggagctgggtgtgccatccacttcctaacaaaccgcaatgggaaaa

SEQ ID NO: 37026 - DNA, 289 bp, Triticum aestivum
  Clone ID: PAT_TA_37026
ctctccacggtgaagatgaatccacatgcccctggatggaacaagaggtaagcctgatgcttgttagttcattccaccgtaggacataggaggcgaattcagtatggcaggcaggtggaatgatttagcgtagtaatggatgtgcaaaaagaatttaggtatggccaggtaggtgttgaaaaaccatcatgtggaatggaaaggaagtttgtgtgggctgtagtatggtgaagcacatgccagtttctgggctgaaaaaattgtacagatttagatgcaaaataaaaga

SEQ ID NO: 37027 - DNA, 350 bp, Triticum aestivum
  Clone ID: PAT_TA_37027
tcagtacaagctcatttcatctgcacaatgatccatgtaagaatatgggtcataattaggatggttcttcaatgtattcaaagggatgcattggagattttcgatgttgctagaaagacattttcacgagaaatgtcaccgatatattatggaatagtctaggaagaacggaagtgtgctaacttagggtggattcatgacgagtggtcacagtctttgagtatctgccaaacaagccactgaatcatgtatgaggaagagaaaacatgtgtgattatagaaagacgagtcagcgatgaagcatattacagcacgcgtcatatcaagtagaacgtgcagaatcacctcac

SEQ ID NO: 37028 - DNA, 153 bp, Triticum aestivum
  Clone ID: PAT_TA_37028
gagagacacacaactttgcttcttggaagaccaacacattaaagagcaaccaagaaattggcaccctccggaagtggacttcctatccactttgtctcccgcccaatcggaatccataaatccttcaagcttgaaatttgctcctcttggggc

SEQ ID NO: 37029 - DNA, 424 bp, Triticum aestivum
  Clone ID: PAT_TA_37029
attgaagcaaccatgtattccattcatttttttcacgatattttactttctcaagatccaatccatacctagttcaatcttgttactggccatatctctttacatgttctataatacaatatccgcataaccaaacacatttatcacatggttgcaagctacttaggatgttgtattaccgagagggcccagagatatctcttcgtcacatgaagtgaaaaatcccaatctttatccatgcaacccaactaataccttctgagatgcttgaagagtaccattatgatcacacagttatgaaattttggttgatacccacaaagcattcttccggttttagagagtgtcatgatctcatagtctaaggaatatatacttgacattaagaatatgtagcacataaactaagtgatacgatcatatg

SEQ ID NO: 37030 - DNA, 423 bp, Triticum aestivum
  Clone ID: PAT_TA_37030
gacggggagttccagacggacggactcatccgcatcaaggtcgggctcagcgggatcctgatggtgaagggcacgccctactcccacatgaaccaggtccggcgaaacgaggagatgcacgggaccctcctctctgagaacgtcatcggcgtcatccacgaccattacgtcaccttccgccttgacatggacgttgatggcgccgacaactccttcgtccgcgtcgatatggcccgccaggacaccgcgcccggcgagtccccccggaggagctacctcaaggccacacgccacgtcgcgagcacggagaaggacgcccgggtccggctgaagctctacgagccggccgagttccacgtcatcaacccgacgaagaagacgcgggtcgggaacccggtgggctacaaggttgtccccgccggc

SEQ ID NO: 37031 - DNA, 377 bp, Triticum aestivum
  unsure (1)..(377): unsure at all n locations
  Clone ID: PAT_TA_37031
gtcgaacaggtcaggatatgctcattcctgtgaaaagcccgacccagttaaaattagcaggccagcccatataaggcctacttgtgtcaggtccatttaagcccacggcccatacgagatgagccaattcggcccgtcaacggcccgttaaagatttgacaccattgcagcccatcgtcagttcgaccccgttaacagcctgctatatatttgggctcaatatcggcccgatgagatttcggcctgttaacggcccgtttaatggatgggccaattttcaagatgtacatctttcggccttttagcgacccatttaaatgtanggctagtttccggcccggtgtgtctttcatcctgttgacgacccataaatctga

SEQ ID NO: 37032 - DNA, 360 bp, Triticum aestivum
  Clone ID: PAT_TA_37032
cttatatctttttagagccggcggtggttttactttgaagaaattgatgaactgtcatgcttcaattatattattttgagagtcttataaataatatgccaattttcttgggttatgaatttagtcctcatgtgataaggtattcaagagggatataataaaaaattcatgaagtattgaatatatgagaagtttgattccttacatttgttttgagatataaagatggtgatattagagtcatgccagtgagtaattgtggtttagtaagaatatttgtgttaaggtttatgattcccgaagcatgcacgtatggtctctcgttatgcgatgaagttggagcatgatttaattttgaat

SEQ ID NO: 37033 - DNA, 387 bp, Triticum aestivum
  Clone ID: PAT_TA_37033
ttttgaaattgaagtcatcacaagcgcctcactatcgacgagaacgtcattttcaattgaaaatattgttccttaatgagacaccaaagtgtcagacgtcgggtttaatccctgtttgcattggggtaccactgccctattaatcatccaatcagatgttggttgtcatgattaaggcgaaactaccgattgaagtaaccttccttatttattcagtagccacgcatccatgccctgtagtaatggacaataaaggatgatttgtgtttcttctattcctcggcatgcgcttccctaccccatcgtgctgcactgatggatgttttggcagacatctcaattttctcttttgttgcaacgcacagccatatgtgccatctatcccta

SEQ ID NO: 37034 - DNA, 225 bp, Triticum aestivum
  Clone ID: PAT_TA_37034
ccgggtcgaccggtacagctacgaaaagactacagaagtcgacggagaatacgcgacactggatgcccatgctaacaggagtgcgagggttgactggctccgctgcaatgtgaggctgtcatcgactcaggatcacaagggttgtgcgtgcttagagggattgtctgcctaaaagttggactagggtcaggccatcaaacaagaactaattccatgacgtcaaat

SEQ ID NO: 37035 - DNA, 368 bp, Triticum aestivum
  Clone ID: PAT_TA_37035
cccgggccgaccggtttggtgttgtgcacagactccattggacggcgggtaacttgtcgagccaactgccgggtgagcggacgagtggctcgatgagtcgcggcttgatgccggacaggatgagtctgttggcccgctcgacctgcccgttggactgcggatgtgccacggaggccaggtcgaggcggatgccggagacggagcagtattgctcgagcgcgcccttggcaaagttggtgccgttgtctgtgctgatgttgttcggcatgtcgtagcgcacctctatgtccttgatgaatcggacgactgttggcccatccaatttcttgattggtcttgactcaatccatttggtgaacatgtccaat

SEQ ID NO: 37036 - DNA, 380 bp, Triticum aestivum
  Clone ID: PAT_TA_37036
cgtcagtccgggttagttccattcaaatcatacaagttagagtccaaaacaagggtaaaagcatttggaaaagtagatacgacggagacgtatcaactcccccaagcttaaacctttgctttccttcaagcaatttagttgataaactgaaagtgataaagaaaaattttacaaactctgtttgctcttgttgttgtaaatatgtaaagccaacattcaggttttcagcaaagattatgaactaaccatattcacaataacatttaggtctcatgtttactcatatcaatggcataatcagcaagcgagcaataataacaaatctcggatgacaacactttctcaaaacaatcataatatgatataacatgaagggaact

SEQ ID NO: 37037 - DNA, 374 bp, Triticum aestivum
  Clone ID: PAT_TA_37037
acgggcatttaaatttctaatatgtgaaagcacatggccattgatagcagaagagagattaagcatgttgcgaaaattcatatctaaactagccttcatctctttaatttttttcattttgataaaagtacataagagtagttgattcaacattttctcccttggggtgcccaaatatggtcttcatcttctcataagtctcaacggcatccccttcaagaaaaccattttcaaaaatagagtctgaaacttgcttgaaggaagaaggtaaaccaagataaaaacttttcaggtatatctctagttgatattggggcacatagctagctcgaattctcaacaacctatccgaagcatctttcaaagattcatca

SEQ ID NO: 37038 - DNA, 390 bp, Triticum aestivum
  Clone ID: PAT_TA_37038
gtgcatgagcccccaatgactagtgtcgaggctctccttcagcagctccaccaagccgtcaatgaactcctcctgcttattgagctgatcgggcatgttgttgagggataacgactccagcgccgccagctcggcatgtttacctccgcggctagggcgctcctgggagccctcgccttcccgtgagagatctttcgaggtctctgccaggcggtgagccctctcatttttttccgcatccttggttgctgctcccttgttacgagtagttctcgacctagagctctgcacaccgtccatggctagttcccctttttataacctagtactagcaccagtactaaaacctgcatagtgggaacacattcagatttgatacgtactaggtgt

SEQ ID NO: 37039 - DNA, 297 bp, Triticum aestivum
  Clone ID: PAT_TA_37039
aaaagttctgtcagcacgacagcgtggtgacgatcctgatgtactattgtcgcaggggttcccctaagcaacgccaaaatattaaccaaggaataatgtgcaaggggggcaacgcacaccgctaaaaacatgattacattgattaaccttgtgtctccaatgggtgccccctgcccccgtttatcaatgaataatagacgggatgggccggccctccccaaagccccccctatgggagtcccactcccaaccggaataaggatccccccttccaaattcaagataagagtccttcca

SEQ ID NO: 37040 - DNA, 331 bp, Triticum aestivum
  Clone ID: PAT_TA_37040
gttgttccatggctacttccttccccgtagaaaacaaagattagtgacaaagagaagaaggagaaggaaaaagcctagagagagaaggacaaaggggcggcgacagctgctgggatggcctgctcgtggcatagctagagctcctctccaagcgcggtcggaggcaggaaggccgggctgctggagtgggaagaaggggggatttgcgtggttttgctgtaaaagtaggtttattatcagaataaatagtatctcctcgctcatttgtaatcaataggatcaatttatatacaccagctgcttgaggcatctacaagcagaggaagggaat

SEQ ID NO: 37041 - DNA, 325 bp, Triticum aestivum
  Clone ID: PAT_TA_37041
gactgtacttttacaattagataactcgttcacccattatcttcatctctcgagcagggccgtatctgagaatttgggggccagtgcaaaatcaaagttcaggtccagatcttacgaaatcgttatggaaagaagtttttttaagttaccatatgcgcaacatactttttccaagagctatatggtgcaaataaagatgaattaataaccatgaatcggtattttagcttgaaggaacaatcatttccaggaagttttaccacaacgtcttaccgtgaatacaacacagactcactggttaacttattatcaaaatcggtcttag

SEQ ID NO: 37042 - DNA, 392 bp, Triticum aestivum
  Clone ID: PAT_TA_37042
tcgactcccacgtctgtgttggctactccgctctccagctcataattgctcaattcactgaccgtatcacgaacctactatacacgcctattggctatgaggtgcactgctccatgtgctacatcctccatggctcagtgtgcccttgcttcaagttcgacgctggagggataagcaattcttcctgcgtcagctgacacgggtctgccatcaacaacttcagcgtcacccctgtgatctggtccactatcctgtgtaacctcttttctggattatggctcaattctgcagcattctgctatctgtgagttatgtaggatctatttgtcaccatggtggatattccgttactgttctagctctccaaagctatccagatggaagctgcctcc

SEQ ID NO: 37043 - DNA, 397 bp, Triticum aestivum
  Clone ID: PAT_TA_37043
gggtcgacggggatggatgcgtgtgatcgagttgatcaacacccacacgtgtgggcgttaacatttccgaaaattaattagttacgctaatagactgaaggagtttaatgtgacgttcagagaagcatttaaaatggtatgaaaatgcaattgtcaaacagaggtactaactatctgtgttatcattcttctgaagtcttgaggaagatgtccaaattatgttttccccttgaccatcagatgaagcttggtctccggctttggtcatatgtttgagaggaagcttctcatggaagggtggggagagtttcggttcggaaggtggtgggtgggagcggaggaaggaaaggggagaaagatgtgctttcctcgctgcaacgcacgggcaaattactag

SEQ ID NO: 37044 - DNA, 386 bp, Triticum aestivum
  Clone ID: PAT_TA_37044
actgggtatcttagtgatggctgctctgatgatgatgagtttcttgatgctcaccgtactatggaggatgatgtcacagcagaagtttttcactatctgaactatcacagaacgcactgcttaatgcttctcaactgatcttttatcaggccatttgcacacacatggatcgtgtgcatctgtaaaggatgagaccttaaaaggcaagacacaaattactgactatagcagagaacacatacccttacttcgtgataatacaagttccaagaagaaaaacatacaggtaactccggtaagctgcaacatggatgaaagtttgatggtggaacggtatggaaggacaaaaaaaaaaaaaaaaaaaaaaaaaaaaaagcggccgctct

SEQ ID NO: 37045 - DNA, 356 bp, Triticum aestivum
  Clone ID: PAT_TA_37045
cgcggcgaggtggtaggtattggccatcctccgcaatgggtgcgcaacctccctcattccctagatcgaccatatcctctaaggttgtgaaaccatatactagagcacgaggctctgataccaattgaaaggatcgatacagtcgaatagagggggtgaatatgagactacaaattttaatctttcttgtcaattttaagatttagcggataaataggattcactagatatgcaacttggtgaacacaacctacatgacaagcaagcttaaagcaaagtatgctgggtaacaatctaattagcgagccaacaagcacacaaggcaaagtaaagtgcgggaaaggattaaccacaag

SEQ ID NO: 37046 - DNA, 439 bp, Triticum aestivum
  Clone ID: PAT_TA_37046
ctattgactaattcaatcgattcaagttgtgtgtattgtacaaattgcagctaatatgtgagcaaaggttgtcaccaatcaaagtccgtgtccttatgtaaacagatccttgtaaatgtgtgaacaaactgatgagaggtaaaaaggaacggtgtcttaaaaaattggaaaccaagttcttagccccattcccctttatctggtttttaccttgcttctgctaataaaaagattgttttcacgtaaacaattcaaatgcacactctgatcttttcctaaaccatctcgtaatggcaaaagaattgcattcagagaaatcgcatttacctcagcacagcaccctgctcaaatagtcatctccatcaatgtagaccaaccatcgtgcaaggcacctataatttacctttttttttttgaaaactttacggggggggaaaaa

SEQ ID NO: 37047 - DNA, 388 bp, Triticum aestivum
  Clone ID: PAT_TA_37047
ggccgacggcgtgggcgatggcttataccggtggctcctcgcgggcgatatagaatgatacattttgcctgggtctttgacgggtggggacacatggtggatgcgggaaaaactagtgaattggagggaaaagagtacctgggtggaggggaaatagttttttttgcgaggagatggtttattttcagcaattaatttccacttagtatcaggtaattcacttacttcgacataagtagcaaattattacttataaactaaatcttacatgaaaattatgatatgtggtattttcactgttttctgtggaaaattgtaaataagtatgtcgaaagttgtacaaaagggtcctacgtatgtgatctggactgcgtctctccacccttca

SEQ ID NO: 37048 - DNA, 390 bp, Triticum aestivum
  Clone ID: PAT_TA_37048
gacttacaactgggacaaaaaaaaggtcgagacactgccgcgagtcaagggtggacttgcaactggggcaaaaaaatcgcgccccagatgcaaatcaagggtggacttgcaacgaggacacaaactgttgggctcagttgcgagtcgagggtggacttgcaactgggaaaaaaaagggcggggccaagctgcgagtaaagggtggacttgcaactggacaaaaaaagatcacaccccagttgcgagtcgagggtgaacttacaactaataaaaacatgttaggctcagttgcgagtcgagggtggacatgcaactaggacacaaaatgttaggcacaattgcgagtcgaggatgggcttgcaactgggacaaaataaaagggcggggccc

SEQ ID NO: 37049 - DNA, 391 bp, Triticum aestivum
  Clone ID: PAT_TA_37049
gggtcggccggcttttatttctcagcgtgctttttctttttatttctcgccccacggacaaatgggcccggcgtgctttttctttttatttctcagcccacagacaaatgggcccgtcagctatagaaatacgagatacatatgcaacatgtagagccaggactactgtttcaacctcagagaccgtattgagcacatatttccttgtaccgggaccgtattgaagcaatacgcaagttccaggaccaaattggacgtcgccagcgactacgaggactatagatgcaattatctcatgtctgagaaagagagaaagagctaccgagaaagatttgtgatgtgtgcatgcatgtgaaagaaaatgagagagaaatgcatgcatgacagagaa

SEQ ID NO: 37050 - DNA, 396 bp, Triticum aestivum
  Clone ID: PAT_TA_37050
aaacggaacactacgtttcttttaggtagtagagattttacctgagagggagcagtaagagtgattagctagtgttagtggtaatgactctgatgatttttattagctactgttgctggtgattagatagctacaacagctagtgttggtggtgattagctagctagaatgagtttgaagatgatgatgtgctacactatgactatgatgattaaataactactgttgatgttatgactatgatgatgattaaatagcttgtgctggcggattagattcaagtggaggcaacatgtggtgcacattgaaagtactactaatccaaacaagatcaagtttggtttagtagtatacttttgacatgcaccacatattgcctccatttgaacctaatcc

SEQ ID NO: 37051 - DNA, 419 bp, Triticum aestivum
  Clone ID: PAT_TA_37051
agataggtgtaatgcgtctgaaaaaaagactagtctatagctcaccacgtggctattcctgtcgaacgccccaataaccgtaagatatgtatccgacagtgccacttattgcacgtacacattagtagaaaaagaactaccatggcatatgctacaccacggccgagaacacgtgcccacattacgccatctgagaatagtgtcgcacttcgaaaatagaactgtcaataaattttgagcttgtgtgtcgtcacattccaaattacactactaccacgctatatttaattgcaaacctgttcacaccaatcacaacataaacggtttccaacttaggagcatattagtactcggttataagtactactatgccaagatgactgcacattcctcctcaactcctcatccacaaaaacaaa

SEQ ID NO: 37052 - DNA, 424 bp, Triticum aestivum
  unsure (1)..(424): unsure at all n locations
  Clone ID: PAT_TA_37052
gtgcgcggtatgttcaatttcaccctaaattggttggcatggcctactttcctgaagatattctaaatatttctacatttggataaaaggtgctacatgcaccatatacgtcaaaggagatttttccccctcttctttctatattaggcaaattaatgatgtattgttcttttgattactctcatatttccatgacatcatgtttaccctatctatttaattatagattttagtccttcaatttcaattgttgtacagttctttcaatttgagcccatatttgcatgttacagtatttcctttaacaatccttccattttctgctgcgcatcncttgctatgcaacaaattatgtagtgcacaattttttcctttacatagatgaaggctgcacggatgtcatactgcacacaaaccatggatt

SEQ ID NO: 37053 - DNA, 384 bp, Triticum aestivum
  Clone ID: PAT_TA_37053
gtcgacggcatacacgaaggttaaactgattaggtgctggtgcacatattaaaaaacagtataacacagttagctatgactcttcacagtgttttcagcctctcagccatcggatcaccttaacgtgcgatatagatcagctctggatcgtctccaggtcatttcgcgggctgctgctccgcagaacgagcgtccatttctgtacgtaatcgggccgccaaaggcccaggtccagtcgaaatacttccacgggcatgggccacaagtcgtccagcggcattctccgactgctcattttccgttccgtcctctgtgccactgcccttccgtcgtccgcgatgtgccgccaggattcgctgcgctgtcgcaagcttctgttgtgtg

SEQ ID NO: 37054 - DNA, 249 bp, Triticum aestivum
  Clone ID: PAT_TA_37054
attcacgggtcgacagccttttttattttttttttttttttttttttttcttcagaagctccctaaccggtcggtaagcagctgtcacacaaagattcttaagatcactgccgctgtaaccttcggtcatagtcgcaagctcctcctgtcgtcgagaagtttgtcccatggagtaagcatttttcaagaaactggccttggtgggaaagacacgggtaagctcgaagcgaacgaggatggtctgaaagg

SEQ ID NO: 37055 - DNA, 419 bp, Triticum aestivum
  Clone ID: PAT_TA_37055
gtggttttggtagttgtgcccggaactaaaaatgcaaccgcacgctaacatatttatgcatggctactatttgcaatagaggcacacgagaaggctgtgattatttatggcgatgcaagattacacaattacagggcgtggacatactgaggctcggtaacactcgagtgacttactctacctcgtttatatctaagcgggcgtgccttgtggacgtcgaggcttctccacgggtttcaccgtcgaggttagctggatggggttgaggagctgcagggtcggggtagcgatgatgaccatcgcgggggttgttgaccacaatcccgttggagcgtgttcccaaaaggcgacaaagcacttctggggacaccaaagtattttggttgatggctggggtagacctcaaggactcgattggt

SEQ ID NO: 37056 - DNA, 408 bp, Triticum aestivum
  Clone ID: PAT_TA_37056
tgccccatcaaatattatatgcttgatcaaatggttgatgttggacaaggaaggcaatgtaataggttatgttttcttatattcacatagaagttatattgtcatggatcctctaacatgtggtgctaataatctttagctagccaaaaatcgtactgagttgagatactacttgtgtatccaaaacccttgaacccaatttcttgccctgagagtccacagtatctacctatggattgaatgagatcctcgaagtaatttgtcatcggtgcaaaaagcaatacaaatttctcctaaatatatatgatcttttattataaggaaaaataagctttgtacaaacttgtgatggtaaagaaataaaagcgaactttctaacattactttgttcaatgctagcccgcaaag

SEQ ID NO: 37057 - DNA, 395 bp, Triticum aestivum
  Clone ID: PAT_TA_37057
ctcataggtcgatgggcgaccatagtgtgagtcgtatcagcagcaagaagtctccgaccacccacgtccacgttagcagccggcgcggcgaccaaccggaaactaccgacaacggacggactgactgatttcacccaggaaactccataaaaccttccaattacaaccaccaaatggttgtataacttccttcgccggacaaacggaccaatgtctctgtgctacggcacgctctcttgcatcaacaaccttccttttatatatttcccctttacagggtatctctagtgtaaatttcacgcacatttgtctcagtgtatatgtaaaatgttgtagtggcaggagcagcagcatcatgtgtttctgacccgagcatcgtggcacatccactgttt

SEQ ID NO: 37058 - DNA, 193 bp, Triticum aestivum
  Clone ID: PAT_TA_37058
cgggtcgacggcgaacatgaaagcaaatctggataggccccccaaggtcctcattgtgctctacatgacttaggcggacttatcccatgtgtgtaggtacaagtgcggccacactgggtctttcgatcaattcagcgtccgtcctacatcagtatccgtatcgggataacgtttaattcagtaatcttctaca

SEQ ID NO: 37059 - DNA, 250 bp, Triticum aestivum
  Clone ID: PAT_TA_37059
cactgctctgaccgtgcgccaggcttcccaatgcacgcccagggacatcgaccagcgcgcggaaatctcccattcatgctgcgcgaacagggccaggcgcctcacggtggccccatactcctcctcggacagcacgggtggcacgcccggcgccagcaggcgttcgcggcgaaattccgtgcgccgccggttttccgcatcccagccctccaccagcgtgtcagcctggcccacggtcgtgctgtacgtg

SEQ ID NO: 37060 - DNA, 421 bp, Triticum aestivum
  Clone ID: PAT_TA_37060
ctcgtaggtcgatgttcaaatctaaacatgaatcggataaacaacatacatctggtcaaaatatcgaacgaatgccacattcacatgactactaatagcaagacttctcccttgtcctcaggaacaaacgtaactactcacaaagcatattcatgttcataattagaggggtaataatgtgcataaaggatctgaacatatgatcttccaccaaataaaccaactagcatcaactacaaggagtaatcaacactactagcaacctactagcaccaatcccggacttggagacaagaattggatacaagagatgaactagggtttggagatgagatggtgctggtgttgatggagattgtcctctcccgatgagaggagcgttggtgatgacgatggtgatgatttccccctcccggaggga

SEQ ID NO: 37061 - DNA, 412 bp, Triticum aestivum
  Clone ID: PAT_TA_37061
tatccatctgtactattttcatgcatgatcaaacaagttaaattgatgttttaagcagaataaggaaaagcacttaaagaggccatgtttgagtttgaaatttgaatctttgattcaaatttgttcaaacccttctggttttagttgcattagcccaacacactcatattgccatgtttcatgcatgcatcatattgttgcacattgtttggtgatgcttgtgtatcgatgtcctttgcgacaggttctgtctccgaggagtaccgtgattaccctaacgaagaatcatatccgagcatcgaaccatcaggcaagcaaccaaccatttgatcatatcgatacaatcccatgttctcgctcctgctctcttttactgcattaagacaacgcgattcaaactgctgtgtgctac

SEQ ID NO: 37062 - DNA, 419 bp, Triticum aestivum
  Clone ID: PAT_TA_37062
agaattctctaatattgagcactcttctattaagcgcgccgttactatctttttggctcatgaatttatatttatcacaagagaagccaaagaaatctttgcacactatagggtggacgccggtcgtccacccatagaagcaatcctctatgatcaagaggaaattagacgttttcaatctttggactatgtcgctttcaatgaaaaccttagaaaaaaggtccctatcaatgtcttggttgattgcatcaatgagcttaataatgattttttccttagaaataatgagctaggatactctctcgagtataagctcacaagattttgtcaaaagaatgctttcagtgatgaaatagttgtgcactatgaagggccaagggaggaacccgttccttccgtgattgatcttggggattttt

SEQ ID NO: 37063 - DNA, 420 bp, Triticum aestivum
  Clone ID: PAT_TA_37063
gggtcgacggggaatctgaatccaaaaccggccatgaagcctggccggtagatatagtccggcgggcgctctttttcctgaggagagcataagcgttagcgcgactcgagggcataaaccctaaacgttaaaattgcgcgccataccgttgtgccggagtctcgatctggtccgcacttctttttatcccgcctggcttcgatggcccatgttggctacccaccgcgggctcggccctccgccgcaaggatttcccctgcaaaacgaaacacaattggtttttgacaaacaaaatgagcatggatggatcctctgaagagtactgggacttcgatctcggtcacctttgaggctggaagtagtccgggataatcggtcgtaatggccactaaggtgttatccttccttaactgaagaaac

SEQ ID NO: 37064 - DNA, 405 bp, Triticum aestivum
  Clone ID: PAT_TA_37064
aggagtacaagacacggcttgggtttttgctgcttcgcgcgatccatcgatacaaacccggactaaaaaaaggcgagggcgggtcttttcccgcgcggtaggcaggggagtttggcatagtctgttcgaggcaaggaggcaggaagggaaagaagcaaataaaggttgagcgacttagttttgggaaaatctgattttacggaatatgtacccactagggtttatagggctcatctaaaaaacattcgtttttccattttataagtctcagttctactactagtagtagtaccatcacatgttggatttcgaggtgcgttagatcacccgatgcaagcatgtcaagagaaaactcaccaatgcatgtagaagttcatggaaatttagtggtcattcatgcattcg

SEQ ID NO: 37065 - DNA, 378 bp, Triticum aestivum
  Clone ID: PAT_TA_37065
gggtcgacggcattttataagagggagaggcaggagctacatactttctctacttggatcatatgcacttatgattggacccctagcaagcattcgcaactactaaagatcattaaggtcgtgaaactcaaccatagcattaagtatcaagtcctctccaggggcattcgcagatctgccacgcagcgtatctgatgctgcggagttctaccatgccgaggaggggagctcaacggagaaactgctctggtcccagtatgctggagccgaacacttgatgcctctgagtgaccaactgaagcagttggttgaactccacagggtgggcgaagtgggcaggcatagatttcatagtccggatgtggcctggtgagcccc

SEQ ID NO: 37066 - DNA, 424 bp, Triticum aestivum
  Clone ID: PAT_TA_37066
caaaagaggcaaatagagagggaggatagagagagagagagggcgaataaaacggcaagggtgaagtgggggagaggaaaacgagaggcaaatggcaaataatgtaatgcgagagatagggattgtgatgggtacttggtatgttgactttttgcatagactccccggcaatggcgccagaaatccttcctgctacgtcttgagcttgcgttggttttccacgaagaggaagggatgatgcagcagagtagcgtaagtatttccctcagtttttgagaataaaggtatcaatccagtaggaggccacgctcaagtccctcgtacctgcacaaaacgatagctactcacaaccaacgcgattaggggtttttaatcccttcatggtcacttacgagagtgagatctaatagatatactatttttg

SEQ ID NO: 37067 - DNA, 298 bp, Triticum aestivum
  Clone ID: PAT_TA_37067
ctcgtgggtcgatggggtccgcgtatgttaactcggtgtaggagttatgcttgaacgtaagtagtttcaggatcacttcttgattacttctagttcacgaccgtgctttgccttctcttctcgctctcatttgcgtaagttagccaccatatatgctagtgcttgctgcagctccaccttatacttttaccctactcataagcttaaatagtcttgatcgcgagggtgtgagattgctgagtccccgtgactcacagattgcttccaaacctagtttgcaagtgccgatgagaccgcc

SEQ ID NO: 37068 - DNA, 417 bp, Triticum aestivum
  Clone ID: PAT_TA_37068
cggggtgggagctaaaaacaacatttgaatgtagatagtaatagacttaatatcgatgttttaatttagtgtacattgtaatatttgaactaaggaccatgcatatgggtaatttatttcgaattcgtgccatactagatttggaaaagttggcattgactcgattgttgtgttattgtgtaggtcatatgtttgaatccatccaaagttttctcactaccatggtgttcatcatgtacatatgaatttgtattgagaaagtagcgtggatactgtgaaatgcgaaatccacgttagaattggagatcactatgtgacacacactctaattcaaataactcctcattaattaatttatagtatctcctttccaatgactaattatttgcaaggcatacacaggcatggtaatacata

SEQ ID NO: 37069 - DNA, 414 bp, Triticum aestivum
  Clone ID: PAT_TA_37069
atctggttcaatttggatagaaacctagtccaaaatttcctggctgactctccaggttgttggactatgtggcttcagtcatcggcgtctggtggtcggacatatgtaccttggaagttgttaaggaaggcttcttccaagtcctcccatctgccgatagagttttcaggaaggttgtttaactagtgccgagctggccctttgagctttagtgggaggtatttgatagcgtgtaggtcatctccgcgggacatgtggatatagagaataaaatcctcgatccataccgcggggtcggttgttctgtcgtatgattcaatattaatgggtttgaacccttcggggaattcgtgatccattacttcatcggtgaagcaaagagggtgtgcggcacctctatatcgggccgcatcg

SEQ ID NO: 37070 - DNA, 394 bp, Triticum aestivum
  unsure (1)..(394): unsure at all n locations
  Clone ID: PAT_TA_37070
aggcgaattatcctatctgggactctattccagaataactttggacaacttcatgccgtcatgccccggttactttcggctaatgatgaagccattgatttcttcattactttgacgctangaaacctctcgacccctccgagatcctcgaccctcgaccgctcagcgatccacgaccctctaccctagttcccgacccttgacccccatgtcacatttgtctagtgtcaaaggattcaacaccatgtcttcatcattagacgaaagtacactagtgaagaaccgggcaatagcaccggttggtaagggcctttagtgccggttcggtaactggcactaaattgtgggcactaaagcccccccctttagtactggttcatcacgaaccggtgct

SEQ ID NO: 37071 - DNA, 282 bp, Triticum aestivum
  Clone ID: PAT_TA_37071
atttgattcttttttctttctctcctttttcttttgggctctcaacttctccccatccagcccttaaaaaaaacttctccccttcccacccgagatgagctgcagcggcggcggcaacaacttgtcgtgagcggaggcagcggcacagtctggtcggcagcggcggctgcaagttcttctcgggagcggcggcggcaagatcttctcacggtagcagcagcatcctctcgcggctacgtcgtcctgcagttcgactcgagcctagcagggcgtcggtgatgt

SEQ ID NO: 37072 - DNA, 391 bp, Triticum aestivum
  Clone ID: PAT_TA_37072
cacaggcaaaataacattgggggttgtcctcggctcgctcgacaacttccaacgtgacgacttgatcttcgatatcgtaaccttccgaagtggctatcacgcattgctcggagggaacgcttttgctcgattcaacacagccccgcactatgcgtactgaaagctctagatgtttgatccacgcggcatcatcacaatcaacggtcacacggaacgctccctttgcatctatgagcacattgcaactcttgcagccgatgtgcagcgcggcccctcaagtcgacacatctcatcagccatcaagctgtcggactttgtgaaaagagtccagtcagtctcgcatcctgatggctctgtatttccggaactagactaacaatttcgcctctgt

SEQ ID NO: 37073 - DNA, 390 bp, Triticum aestivum
  unsure (1)..(390): unsure at all n locations
  Clone ID: PAT_TA_37073
gggtccatgatccaccctaaactaatgtcgtaatagaaggttattactgttggtgaaccctgtggttgcggaggtgggtgcatgacaggactcatctcccttcgtagcggatcgttgcaacaggggctaaaccagataccacctatatataggctgcgtccatggggacctctttcnccttaataaccgattggtaaccggagtggggaagaacggtggtggtgtatgtgatacgaagctgctgagcgtatgcacatatctgtaccggctttgctcacaaatagaaacatgtaaagtggcttaggaatccgaagtagtattgtgtttatgcaccgctatagatgcacactataatggatttcggactcgctgggacgcttagtcccattt

SEQ ID NO: 37074 - DNA, 413 bp, Triticum aestivum
  Clone ID: PAT_TA_37074
gtccacggcgccgcggaaactcaggcgacagatcatgcgctgcgcctcggtgcacttgtaggccgcagacgatggaccagcgtccgcgatgacgacggacgttcgccatgacgacggacgtccgccggcgagcccagcgaagccttctggccacatgctacatcaacaatcaaccccagcatccttctttgttaacgacatgtataattaatcttctcactttttctctcttttcatctcccgtttcagtgaggagcgacgatggagagcgcgccccggggaagggagaggaccaagaggagatgctactggcggcgacataatcggcaccgggtcggagcaacatgaaagaagaatgcatccgcgacgacggcggcggcaggagtacgttgccaacgacgggcaggcggccg

SEQ ID NO: 37075 - DNA, 415 bp, Triticum aestivum
  Clone ID: PAT_TA_37075
ggtcgacggcactcttgaaaggtgatggaggaaccttcagtacatgccattagggaaaattgtggcagagcaagcagtttcagcgctctatcagtctaacgtcggatgctgggcaacaaggaaaactcttacgagatcaacaacagcaccgctcctaatgtttcccgagggtcaccagttttaccccatcaggaacattgtggagcaacaattggaattcaaacaattcagtattccttcgcaccaggtaacattgtagggattctaggtgtgcttgggcaggcagttaggcacaaataagtgaactatactgaggaccggctactgagccataatgctacccctttccctatgttctctactatctaaaaaataagtgagggtaccaagtgcgagttcctcctccaaggttttc

SEQ ID NO: 37076 - DNA, 333 bp, Triticum aestivum
  Clone ID: PAT_TA_37076
gcccgggtcgacgggcgtgccaaaactacgacgactaagtgctgcaactacagatacgtcgagcgttttactacgacggcatcgttttgctacgagtggaggcgaggaaccggcgaggacggggatgcgatggcgaccaccaccgacgaaggcggcgtcctatggaaccgacggagtcagccggcggctggcagcaacgggcagcatcacatggccggccggcgagttggcttacgtatttagaaccacggggctgctcgggatgaactcgacaggctattttttaatagcgaaacagttgagaacatccggtctggccgggaagttttttaa

SEQ ID NO: 37077 - DNA, 440 bp, Triticum aestivum
  unsure (1)..(440): unsure at all n locations
  Clone ID: PAT_TA_37077
tcacgggtcgacggcgctcactaattcgcctctaacgggcctggtttttagcgggccacaattggtccggcctgcatctttcttaggcccgaatggccattggtgccttcacactttgcgccaagcccacaacttactttggcctatattcgacccatattttagttgggccttttgtggacccatcacttagattggcccaggtagcgttgggccattaacaggctgaatattctactggcccgttacggcccanaagaaaccatgggcctttagtaggccgaaatgcatgttgggcctcaattttcactagtcatcgacgggccttcagtaagctaaaatgtagaccgggccttttttggcccagttatatgataagccgttactaggccaaaacatatcttgggccttagttggcccactgaaatcttggcctttaa

SEQ ID NO: 37078 - DNA, 415 bp, Triticum aestivum
  Clone ID: PAT_TA_37078
ctcgcgggtcgacgaagcacactattatcagtctaaccacttggatgccacattgtcccattgctgcataaaatcctttcatctttctgtttcagcaatgacgggtcggccattccataagaatatcaatggccacgtaatctggagtccacctctcttccatcatacgacccatcgattcaaaggccttttcaggcatattctatatcacgaagtctcttcaacaataattatctgatgagaataagagactcatttgatgtagatggcttcatgtcaagaatgtgttgctgcctgttacactactatctactgaccagctgagcactgatataactgctttctgcactcctcaataatggcgctcatggatgcaaacaccagaaaaaggaactgatgagtacccaaccaacag

SEQ ID NO: 37079 - DNA, 380 bp, Triticum aestivum
  Clone ID: PAT_TA_37079
ctggctcaatgccaatcagcatactaagcattgaaatcattgctgaggactttgatttcagactggatcttcacaagatcatcagttgtcatagtgacaacgttgtacttcaggaatttttctttcctgtactgcgctttctaaatctgcctggccttctcaaatttccatttctcttcttggatgaaggcagtcaccatatgactttggccaggagtcaacttgaaatcaggcataggagtgtttgggtccttgtgccagagatcaatgtaatcgaggatcaactttggatccaaaagcagaggcacatttgtgcccttggctctagcggccctgacttgcctatctctgatgttttcagcaagttcttcatcatcagc

SEQ ID NO: 37080 - DNA, 435 bp, Triticum aestivum
  Clone ID: PAT_TA_37080
gggtcgacggcgatctatcatatctgcatttgtgcttcaaattgctgatatgcaaaattaaagcagtttgaatggttctagaacaagtaccatccataaaatattgcgtccattgtaatgagtgattgcttcgatctatttagaacttcatagtttcgacaggtcatctaaattgcttctacagtcacaacaaccagaattgctcacaaatgtatgcttgacaatagcaaacaacgacgtaggggacaagctggcaatgacatggaatttggtatttgcatcgattaaattgggactttgcttccaaagaatttggtatttgcatcctaagaaacgagaatttccttccgaagaattaggaacctccatctaaaaaaaatgaagatttgcttccaaacaacaaaaaatgatgcatatggacaggatttggcccaa

SEQ ID NO: 37081 - DNA, 407 bp, Triticum aestivum
  Clone ID: PAT_TA_37081
acaccataacgatgttcatcgcatgtaggtctctgaaaccaagcccaccctgctcctttgggagagtcaacctgtcccaaccaacccagtgatgtttatgctcgtcctcctgattatcccaccaaaatcggcatatcatgtggctaatgctctcacatagggacttagtgaggtcaaaacaggccatagcataggcggggattgcctgggctacggttttgattaaaatttcttttcccttttttgacaaaagtttgattttgtatccctgaagcagctcccaaattctgtcccggaggtactcaaagcagaggcgacgcgactttcccacataacgtggtaaacctagatacttgccctgctgttcctcattctgaagtccaagtaagttcagaaagatttgtttc

SEQ ID NO: 37082 - DNA, 396 bp, Triticum aestivum
  Clone ID: PAT_TA_37082
gataccctatatgcaatcatagtattgcttttctcttccgatcgttctgttgcatacttatatattgcttatgtattgtctgtgaattggtactaacgtttcgtttggctactgcatagcgatgccgtggtatgtcgtgtacaagggtaaggttcccggagtctacgacgactgggaggagtgtcgcagacaggttcaccgattcagcggcaacagttacaaagggtacgccactagggccgaggccgaatctagatacgcccgctatctagcgggagaggggagggagcgttggaggaaccggatgaagacgagcttcatcgtgatgactgcagctctcttctatgtgatggtagtttagatgatcgatatcgacttgtaatgtgaagacaaact

SEQ ID NO: 37083 - DNA, 402 bp, Triticum aestivum
  Clone ID: PAT_TA_37083
ctgttgaggacgaaattcggggctagatcatggaaatctatcccgtagtagaacatgaccccgcggacgaaggggtgcagcggaaaccccagtccatggacaaagtgggcgagaaacacgaccctctcgtggggtcccggagttggagtgacctgcccatagtccggtagccggtgcgctatgtctgcggccaagtatctggccgcccgaagattcgtgatgtgcttctccttcacggtggaggccacccacttgcctcctgctccggacatgtctatctgtacggagaagatttggactagggtgctggagctcggggaggtaaggatgagcgaaggaggaagagggcatgggtgaaaatgaggggtccttatcccgttatagaggccacgaagtggtgcg

SEQ ID NO: 37084 - DNA, 369 bp, Triticum aestivum
  Clone ID: PAT_TA_37084
gtcgtcactaacatgaatcttgggacagttcgagcttgtcgctgccggagaccctgtagaggtgcgcgaagagacctggttagatttgttggccaccactggtagatgctccatgtctcctcctctggttccttgtgcattattgggttgtctcaattttcagtttggaacacttagctatgaatatttttttgattaatattgatgtcgttgttacatattggtactgggaagattttatgtattattgctgagctctcatgagcaggcctaattttacagatgtttagtgcaccggttcctgttcatttacaacacagccctgtgatctaattgatgtttccctgaatttatgacaggtaaactgca

SEQ ID NO: 37085 - DNA, 353 bp, Triticum aestivum
  Clone ID: PAT_TA_37085
tacgacaccctagactgagtcataataggcgagggctgctggccgaggcaaggttcgtggcgtgatggcagcgttgatggtggaggtcgtggcgtggtggcggctttgatcatggaggttctgtttaattccccgggggtgtcatcgctgggctgtcaaatcctgaagggaggagtctgccggcagaacatttgttttgaaccgtagatctgtttgtagtacagtggatgtaacatggaccgttggatgcaaccatgtgggtttgatcagaccttgtgggttatcctgtgtgcactttcttgggtgcacgtatgggaagtcacgtttggtcatttaagagtagtatatataca

SEQ ID NO: 37086 - DNA, 429 bp, Triticum aestivum
  Clone ID: PAT_TA_37086
tcacgggtcgacgggacacactaaagtgagtcgtatgaatagagccttgcctctaaggtaggccccacatggtttgcctcttttttaacataacgcgtcaagtcgcaatttgtttgttcacccgtggtagacgatcctccctccaccaagtggacaaccagtacacggtcaaattaccacgtgggctgccttttcgtacagaaatgagctccaccatgtgcccgcgcgggtgtggttcggaaagagacgggagtacgtgcgctgtgcgtgcacctcttctcttcgtgcatgtcccccacctaagtgggtgtgtgtgagacatacaaacctagacaaatggcttgtgtggaataactactcttcgtaagccattgtaagagtggacaaaatggtgaaggagacgataggggagccggcgaggtgtgcccc

SEQ ID NO: 37087 - DNA, 356 bp, Triticum aestivum
  Clone ID: PAT_TA_37087
catgctcttagagataacagtaaagatgttatcgggagcatgctcaacctctctaaaccatgacatcaaactccatcataatttgtgggagaaaaggataacagatgatacatccaccgaattttgcgtttgcaaaactatagccaccaatacacatgcaaccttggtgaatatggaacagtgttacatttattataaacataaagttcctggggtcaaaagcagttgtgtctcgaactctcgattcatggttggaaaagagtatacgtgcaaacagtacaataacaaatggattgacctgtttaactcgatccttttatttatacaacagtagaaattaaatactactatgctga

SEQ ID NO: 37088 - DNA, 427 bp, Triticum aestivum
  Clone ID: PAT_TA_37088
ggtccaggccaactgaaaaatcaatcctgatagaccaagtcagtaagttgactgggaagaaaaatgatctggaggccttcctgagtggtcttgccaagaagctgtttcttatgcttgaaggtaaacctctatgctcggcaaacatttccaattgtggtttttccattcgaccatccccttgacttagtgatcatccttgcagaattttgtcaaaactttgaagaagaaactagccggctggagccaaacctcgaccccgtcaattctccggtgaacgacgaagttgccatggatgttttctgactggagtctcgtgttgcagctgtcgtggactatctcgcaaggctgaaggccgccacatctcgcatcgactcgacgctctggcctgaggagacacttcataatgaccttgagtcgtttaagggcg

SEQ ID NO: 37089 - DNA, 340 bp, Triticum aestivum
  Clone ID: PAT_TA_37089
caatgtatacgaatagcatggaatgcccatgatatctgtgctctccaactggtgctttttaacaatacgaggatgactcaacatatttctaaatatatacgctcttctcaaagggaagcacggatttgatacttgtgccaaagctcgtttttgaaatcataagtgaataacattttgaacagtataatttcattgtcacaattacaatcaacatatcgcaatatcttccatgctacacacactagatgcggttcccaaacataatggctaaatttgtactcgcccatccagcaacaatcatcaatccattgattgctccaatcaacgagtgcctcctact

SEQ ID NO: 37090 - DNA, 416 bp, Triticum aestivum
  Clone ID: PAT_TA_37090
ggttctagggtcgacggacagtgatttatcaaaaatttagatatctacaacccttctcttcctaaacgaaactgacattgcaaaagtagaagtataaggcactagctgaatttattctagcattctaaaaaaaatgaatttagtctagcgcgccctccagctcgcacattcataacaaaattccatgcaaaacatagaattagttgaaccatatattaagcaaaaaacaaatactacatgcagaaacatattttaaaaaataaagaactactaaattgtttttttactttacatgttagtttttccctttttgcaaaaaatgatccaaatatattataaaaggtgcagcagtagtataaagcatctcaaacatcaataaaattacattaagggacctggaccatcgaacaacaact

SEQ ID NO: 37091 - DNA, 406 bp, Triticum aestivum
  Clone ID: PAT_TA_37091
ggtcgacggcttgccccaaactaaggcgcaccataattgcaaacaaagacatagatggatagagcactacaagattaacaaaacatccttactgatcatcctcaaaagaggcacggatcactaggaaacaacatgaacataaggccatatgagacaaacagctcaaggacttagtggaaatgctaagtccctgaaaacagaattaacaagtgcaccactttgcaagcttgcactagtcaccacacacatcacaaaaatacatgggttgcacctctggaaagatgacaaaacccttaacaaaacacatgtagagcatcagggcatatcatgcacacaataatcatggcaaaaatgacaaaaacctaaatggagcagcagatctgacaattatctcaagtaacctccg

SEQ ID NO: 37092 - DNA, 365 bp, Triticum aestivum
  Clone ID: PAT_TA_37092
gtgacacaggggatgtgcggcgaagtgtggtggctgcaagttctcggcagaggcaagtcctccagcttgaccacatcttcatggtgctccctgccgccatgcattggtatggacatggaactgggcccctttggacatgaacggtggctctcctctagacattccacaagtgcaagcacgtcgtgggcatcctatttgcgagtgtgagcatcgtccacctacagtaatgtgcaaccacattgcatcattccaacgttcggcacactactgattcgtcacaggcctgagaatctcatttgcctcacaacatggagatatcagaacagataagtatgatgcattagctagcttttcaggggtttaag

SEQ ID NO: 37093 - DNA, 419 bp, Triticum aestivum
  Clone ID: PAT_TA_37093
gtcgacgggcgaggtgatgtgatagctgctctgctccccggacaagattgaagccatgatcggagctatgccggcaacaaccaggaaagcagtcaaggctctcgcgatgctttccctgtgggagatctggcaggagaggaaccgttgcatttttagggcaaaagaggccagtgtggctgatgtgctacttgcaatcaggagaagcctaaacctctggcagcaaggcggcgtcaagttctttcagagccccttcggggaccccccgggagagtaggctagtggattgtgccaggggcactttgctttcttcttcattcttcttccttctctccttgatctgcggatcctcgccttgtcacttttgtcatctgctccctgcttaataacaatgaaacaccagcctttgctggtccttaaaa

SEQ ID NO: 37094 - DNA, 408 bp, Triticum aestivum
  Clone ID: PAT_TA_37094
tacactaaattgagtcgtattatttaaaaactgttggcagcattaaaaaaatgttcacatgtttcaaaaaatatatccctgaaagaatgtttatgtaataaaaaattattcgtgtagttttataaaaatgtctcaacgtgtattcgaaaaatgtttaacaggtattttagaaaatgctcaacaacatgtgtttaagaaaaaaatgtgtaaaaaatgtttaaggtgtatacaaaaaagatacaatatttcagcaaaaatagacatcaaaacatatatttgaaaaatataaatcccgtatttgcaaaatgtaaaacatgtataacataatgttccataaatatacaaaaattgtataatatgtaagaaaaaaatttagacgtgaaaacatatatttgaaaaaatgttaat

SEQ ID NO: 37095 - DNA, 404 bp, Triticum aestivum
  Clone ID: PAT_TA_37095
ccggcaagatcgtcagtatccggattcctgattgatttataatttctcttttgtgccacatagtgtccttctaatgccgcacactacctgtagtccggccgaggatgatcttcccgcttcatcaagcgggtccttggctccgtcggatgtagattccattccgaccgcctccacccctcgtgatgctgaggatgccgaggtgggatcccaggaggggacccgccaagagggggaggctccggaggtgccatagggcaacctcccgggcttcgtgccgaactccgcaccggaacccgcagtggttccggagtccggcaggcggccccttcgtaagaagggaaagaccgtgacactggcagcctccgttcaaccggaggcgccggacaaacttgttggaggcgctc

SEQ ID NO: 37096 - DNA, 420 bp, Triticum aestivum
  Clone ID: PAT_TA_37096
tcgacgggtagtgtcaacgaacacataccagtatctatagataggtttttctttttcgtagaggttgtcgcttaggtccttggacccttccttcatgaagcttgaggaagcactcacttttctatccacggcattcttggttctgcacttagtcttgaacctgtgttggtttgggacgtcaatctcattcgtcagcggtgtgtgccgcgtactatgattgctttcttcttgctgtcaaatcccagtctatctttcactgagcttccttcgcttggaattcagagtccaaaagtaagaaagaaagcgtactgtgaggtatgaatgatcaaatgtctacaggtgtcattgaatatcatggggtacgaacttctaaggtcatggtgtatggtattggataggctggtccgctggtcgaagtca

SEQ ID NO: 37097 - DNA, 441 bp, Triticum aestivum
  Clone ID: PAT_TA_37097
cgggtcgaggacatagccgcacgttatcttgcaggacacggtgtatgcggtgacggatgctgagtacgaggagccgatggagcagatactttggcgctcacttctccacgacgttggtccggcggcgccaccgaagacgctcctccgcgccgtcaagtcagacctgttgtcgcctcctcgctgtcgggtgaaggccgaaccgccttcccttccctgctctccaccgcgctatcatggcattcaaatcggatgccacgtcaaggtggagcggttgtcgccatctcctcgtcgcgtcatggaggagcggctgtcgccacctccctgccatgtcaaggaggagcgaccgtcaccacaacctagttgcaccggtggaggcatgcctcacgcgatcaccgtgaaggcacgccggggcatcatgcgctacctcggtggccgccaaaa

SEQ ID NO: 37098 - DNA, 353 bp, Triticum aestivum
  Clone ID: PAT_TA_37098
acttgaggcgatcatttgtttcaccagatcatatgtgtgtctcttggatcgtcctgtgcgtatctgagtccttgcattttactataccgacagtcattccttgctgtacacatctgtttgggagattactacagatggaatcaactatttatgatgagtcactctaacgtccttcatcgtatgatcttttaagtcaagatactctggccctatatgcttcactaacgtgcgtcgtaaaataccggtggtgatgccatgttatatatgcacatgatgacccaagcgtgtgttagattgatatgctaggcatgtataggatcaggctatctagctgtggatctgaagtaacccct

SEQ ID NO: 37099 - DNA, 396 bp, Triticum aestivum
  Clone ID: PAT_TA_37099
cacctcaaacggatccgacgatgacctgtaccgatccgttgactggggtgtcgtcctgtgcgtttggaggaagcaatggccatccgcattgcactccgccgctccctaggaggataacgcccgaccgacggcatgatctgtctggcgcgagtccattgcgtggcgcattgggcgctcgaatcctcctgtgctggataattgcggtcctcttgggagccttccaatctccatttccccatcaccagtccgctggagtatgagtcctaccgggaccggtgtgcccgtcgtgggaaggagaggatgagggcggcggatgcccgcctcgcagccgacatggccgtggcagaggcggttgatgtggcgcgcgggcagccgcagagaaggaagccatccagg

SEQ ID NO: 37100 - DNA, 264 bp, Triticum aestivum
  Clone ID: PAT_TA_37100
gggtcgacggcgtgctccaattcaagatgaacaaactggtagatgtgcttggactggaggggaacattggacacttgcctgagagatacaagaagtgccttgttaggaacaaggaggatgcgtgatgattattgctctagcaaactatctgcgcttgtttggtcgagaatcgaagctgcagtttgaacttttatatgtatgggacgtcctaatctgcaagctttatgcttttgggcagtcaagaaaactgaatttagcggaccg

SEQ ID NO: 37101 - DNA, 420 bp, Triticum aestivum
  Clone ID: PAT_TA_37101
gccgctagcaaggatgatccgctaaaagtgcagaccgtcgaatcacaagatcttcaccatagtcctgaaaaagattcctagtctacaaagaataaaaccaacaaaaacaacaagacacacagatataaactcttcaaatctgaacaattaaatcagggaggacacatacatacctccatgccgccaccaaaaagggcagagtaatttttttcgcaagaaacatcatgatcaccactagacaccgataaaaaaataatctattgatgatccgaggtccctcactctcggtgaagatgacagctgaaggagaggggattaaatatatctccgatggccgatacttcctcaaaccctagccaactgttgatctctagccagcccgcctggaccaactcaaggtcagagtgcgacactgctttc

SEQ ID NO: 37102 - DNA, 389 bp, Triticum aestivum
  Clone ID: PAT_TA_37102
ctcacgggtcgacattcgaccccaagatgactctcagcacgcgttcctatttggggtcaatcgtggcactgatggcgaatgtaccaccagtgccatcctccttggcggactccttctgagtctcaggtgaagctgccaatgccatcatacacttgccggtgtatctcgatggtgcatcctccacagtggcgcagcactccgaagaggtgcgcttgccggaataggcatcatagctcttgccggacttggtcgtcttcttccccccgggagcttcaacagcaagtgtgctatgatcaattgcagctgctgcttcacggtacatcttgtctgcgcagatatcggcatccttcctgtcgccggggacagagatgacccgtaacgggcctggc

SEQ ID NO: 37103 - DNA, 449 bp, Triticum aestivum
  Clone ID: PAT_TA_37103
actcgcgggtcgacgactgaaaccattcaggttatatgcatatatacataaacggccgcaaaggaggcatcctaatactttcaggcaaaagtataaacatagcctttataactcaaatagcattgttattacaatcgagatacatgtcactcgaacatgacactcttcgagcactgagcctctattaaacgagctccttccaggacttcttcaaagtagtgctcggctgaaacctggcctacggccggattctggcttggaatcgcggtggcctccatctccgcccagtatgtcttgacacgggcaagagccatccgcgcaccctctatgcacgccgacctcttttcagcgtcgatatgtggcacagcaccaaggaatcattgcacaagaccaaaataactattcgggcttggtccttccgggcagagacgatccacgacagacctcat

SEQ ID NO: 37104 - DNA, 418 bp, Triticum aestivum
  Clone ID: PAT_TA_37104
gttcttcttcacagaacaatagggccagagagcttgcttgtgagtggaggaggtattgcggtaaggacggaaaccaactggagtctcaagcccgtgatcttccaccccaagtaactccatgaaggccttccacttgacagaaagcaacttgccattagtcatccaagtcagagtccattcggcatcagtcccaagatggacagtggcatagaattgggccaccaaatttgcatcaaagtccttgttgaattgcatgatactgaggatgttcagccgagtgcacatctaaagggcttcgccaaagtactcagggtccttctccatagaatccgtatcgatggagcgcacatcaacatatagattcttcttggccttgatcacatcaaagtagatggcaaattgaaaatgattctagaat

SEQ ID NO: 37105 - DNA, 412 bp, Triticum aestivum
  Clone ID: PAT_TA_37105
gtcgacggcgatatacaaatagaaaaactctcagctcagtcgttcccctccagcatccttatccatccgcacacaccactttttccattagccggctgattaagatctcgctgcttgccatcaccaaattgattctcaaaccatcacggctgattcattccttcccatttctcttcgtgtacgtactggcacagtttaccgttgagcagagtgcgcggacgcgtccgtcgcattctcaaggatgtggattctcgacgacctcgtggagtccggcggagcgttctcaagggtttcggccaagatgatgacctcttcttggcgtacggctagaggtccatggcagaggtgttgtagtttggcccagtggaggatgctgcgagggaaatccacgagtcatgtactgagtgagtta

SEQ ID NO: 37106 - DNA, 380 bp, Triticum aestivum
  Clone ID: PAT_TA_37106
atgatgaagatggccaccggtgatggatccccctccggcagggtgtcggaacagggtcccgattggtttttggtggctacagaggcttgtggcggtggaactcctgatctattctgctcctcgatgtttctagagtatatggacatatataggagaaacaagtcggtcaggggaaccatgaggggcccacgagggtggggggcgcgcctccctgccttgtggcttcctcgttgcatccctgacatactctccaagtctcctggattgcttcagttccaaaattaactctcccgaaggtttcattccgtttggactccgtttgatattccttttctttgaaacaccgaaataggcaagaaaacagcaatttgggttgggct

SEQ ID NO: 37107 - DNA, 394 bp, Triticum aestivum
  Clone ID: PAT_TA_37107
acattttatcatgcatgttgcaacggcaccttggtggctattattgtcgatcatcccggactgcttcctgcgttgcatgtaagcaaagatgaagccttaacctctgaagaggattccttccttataccatgccttatgcacaaatatcatatttttatagaggcgaccatcagaatgcagcgccgagcccctggggactcgtcagcaaaaggtatccgggccaggaaggctcaagaggaaggcggttagggtcgaaacaccatcgcagaggtatagtttaattctgctctgtgattatcatgctagaaatgtaacagtttccatcgtgtcctggcacaaagagtagtcgccagactatgtccggagatcctgccggtcacgcctccaccagccg

SEQ ID NO: 37108 - DNA, 291 bp, Triticum aestivum
  Clone ID: PAT_TA_37108
ctcgcgggtcgacggggggcacgggagccgttcataatggttccaagggcccgaacattggcagtggcggcaggaagcgctgacagtcgattacatcagagacataatattgtgctgcctaaccatgttccccagcgtaccatcataaacctgtgtcgtctgattaccccgcgatcttgaagttgcaccgtatctgtgacgctgaatggtgttaacgttttggattgtctcgataactttatattagaattgaatgcaagctaaatgaccctgaaattgaaaaacagctga

SEQ ID NO: 37109 - DNA, 398 bp, Triticum aestivum
  Clone ID: PAT_TA_37109
ctgtcttcaacaccgccatcaaagtggtccttcagccgccgaggaggagggaggtgatggcggccaggaagaaaactaggcgaagctctggatgctccatcatgcacttgatgtgtggcagcacgtgtgctgcctgaattagcaccctggactgactctggagacgaagcatggtgtagtggcaagtcgatttgctgacatagcgcgggcgtctttctaatgcttcggttctgtttagctactacgatatgttgcgtgtttcggtttctacttcccaatcctggagctgtctacgatcgactattcggattgtaggtgtaatgttatgtaagcgaggttgtgtaacaactagatacaggcaagctataagtttatggttagcatctcgtagggatttg

SEQ ID NO: 37110 - DNA, 385 bp, Triticum aestivum
  unsure (1)..(385): unsure at all n locations
  Clone ID: PAT_TA_37110
cacgggtcgacggcgagaagtattgggccttattgggccatacgggaatagaggagagaggccaaaaggaatgaggcgcgcaccccccctctggtcncaattggacaaggggtgcagcccccttttccttctccctctccccctctttccttctctcctactccaacaaggaaaggaggagtcctactcccggtgggagtangactccccccttggcgcaccctcctccttggccggccgcctccccccttgctcctttatatacgggggcagggggcaccccatagacacaacaattgatctcttgatctcttagccatatgcggtgcccccctccaccataatccacctcgattatatcgtagcggtgcttaggcgaaaccct

SEQ ID NO: 37111 - DNA, 418 bp, Triticum aestivum
  unsure (1)..(418): unsure at all n locations
  Clone ID: PAT_TA_37111
tcccacttctccaatgcataacctttcattcacttctcgcattcaatgaagttgtagtgttgaaatgttatctggcaagacaccagaagagtatgacttgtgaaaactctcgggttcacatggattanggaaggcataggttcaacccatangggcatcttaggaacatataccacaaacctcaggagtaatataacacaagctcgaaggcagaggatacaatttaccaaaggcattatgtatccgaggaaaggctcaaaaggttattaaatatgaaggacgttgtcggataaaatccaacaaaggatctggcggtccacataggatctgatgtgagtatcggtactcaaccagaagaagaaagaatgcaaaggcatcagattgtagatatatctggataacttcaaagcttgaatac

SEQ ID NO: 37112 - DNA, 410 bp, Triticum aestivum
  Clone ID: PAT_TA_37112
gggtcgacgtgtgtctataaagggactacccggaggcgattcagggacaagaaacaacaactcgagagccaggtaaagcggattcgctccctgatcatcgagaccccatcaattccaccacaacgggatcgtaggcttttaccttcaccgcaaggggccgaaccagtataaactccccgtgtcctttgtccggtttaaccccttttaagctaatctcgttgcgatggctccacgactaagtcctcacactaggacatctgacgtgataattccacgacaccatgggtgagagtcaagccatcatgtgtgtcaagcgcttcgcaatcggaattgtgtaagtgtttggtccggagtatttgagagctcccaatgttgaagatgccgcaaagcttttggagatgaacaaagct

SEQ ID NO: 37113 - DNA, 425 bp, Triticum aestivum
  Clone ID: PAT_TA_37113
tggtgttttaccgtggtgaaaaccaaaagattccccgctccctccgccttcctgtagattgcattgcctttcagccgtttcgccccctttgcttcctctccccattgcttctacctggtgccatggtggcgcagctgatcacgaagtacgaggtgaggctcctgacacaggagctccatgccaaggatgcggagctcagggccaaggacgtggagctccatgagctcaaggaggagaggagtgccatgctcctccgttatgtgcgggagttcacggagcttcaaaagcggcagccgtccaccacaaagatgctcgaggcgttggcggcgttgctgcagaaagagggagatacgataggccgtcaggggagccggttggagcgcgagcgggccgatcgtgacgaggtccaggatcgcctcagccac

SEQ ID NO: 37114 - DNA, 416 bp, Triticum aestivum
  Clone ID: PAT_TA_37114
gtacttcatccgactgaaaatcgcactgcatcagaagaaaaaccgcactgcatcagacgggtaagagaactgcttggtttcttttattcaaacataattttttcaaggacgagaaagtagagtgcacttcacatcgagtgtaaatgaagcacaacactatcaagaagtgaaccgcactacttttttgcttctgtaagaattttttgcacttacggatgaacaacatcatacaacggaccgcactgcatcggacaggcaagtgaaccccataagttttctcttttttcaaacttttctacgcttatttgtgaacctcatggtcaaagttagtgaaccgcgtggcctagactagagaacaacatttttttgttggtgaaagtaaatcgcagggcagaaactattggacttcattaaaa

SEQ ID NO: 37115 - DNA, 407 bp, Triticum aestivum
  Clone ID: PAT_TA_37115
aaagatgaatccccaagcactggggtggatcaaaaggcttagcattggtgttgccgcacctagcagaacaccattatttgcggctggatggagttattgtagggctcgtttcctctctggagctcctggaagtttcaattgtgaaatagaggagcttgtagaggcgaagtcgggcgtaggagacgacgccattgttggatgtgttgtccccggttttgcctgatactgtatcccgttgcgagaaatactgtaacaaatccgtccgtggtgtacctagttaaattatcgagaagtgacattagaaatggtctgtggagagctttggtaataagcggtgcttctgtgcctggtagaatcaaaaaggagaaatcaaaccaagtgtccgagcagttaaaaaggaaaaaggg

SEQ ID NO: 37116 - DNA, 449 bp, Triticum aestivum
  Clone ID: PAT_TA_37116
atctgcgggaggtgatgcagcatcctcaagctattcagatgcgcaatgtggtgttgcatatccgcgatgtgcaaggcctgaagggaactggatccatggaggccaggcttgaagctatggaacaggaagtcttccgctgcaaggggatggtggaacatggactcaatgccaatcacctcatgatcgcggactacacccgtgatctcaaggtggatggcaattccatgaaggacatcatcttctccttcaaagagcaaatcaacttcctccagagccagatctacgacctccaaaaccaagtctttgaatatgaggcaaggtttaaaggtatgagtttggctgccggttgcaggaatcgagagactcactcttcctcttacgacggtgagcctctaccatggaaacctgaggacaagattgcttctacttctacactaccaactccttct

SEQ ID NO: 37117 - DNA, 283 bp, Triticum aestivum
  Clone ID: PAT_TA_37117
atgagcaaacgcgacatcgcacgctgcacatgttggaaaaaacggtacacatcacggcgccaatttgacatactcgtatacccaagttcgggcggctcagtagtctaagtacctacgcgagcttctgctggaatgtatgcgatgagaaggaaagcagttggaatttggggatgcacggacggtcgaaaggatacagccggaggtgctcataccagcaacatcgcaactctactcactgtcacgaacactaactgtagcgtgaggcatcatactgaatcataac

SEQ ID NO: 37118 - DNA, 449 bp, Triticum aestivum
  Clone ID: PAT_TA_37118
tccgggtcgacaagtaggcctcaacctgctgctcacttcatgggcatgcatcaaagccttggtattcagcttgcacagcttgggaaggatgcttctgcagcaggagctgcacgcagaggtagtactcagcggaagacagttgaggtcgagtctgttgcagctgcagggaagcaacaagctcgagaagtagtgaagaaatctttccgtgccgagttcatcgagaagctgcacaaagatttggatgacgatatcgatgtgagagccttggaaaatggatttatatctgtcactcctctgaatgtgcacggccatgtcgagcctgaactcgaagctccagcgtcagactggctgtcagcagctgtggctgtatccgaagaaaaagaagctccagcgacctaacagaaacgcagaaatgtacactgtaggtggcttagtccttgccctggtgt

SEQ ID NO: 37119 - DNA, 425 bp, Triticum aestivum
  Clone ID: PAT_TA_37119
ggtcgatgggcaacactaaagtgtagtcatattataaaaaataaataactataagctactggatagacaaaacaataaacaaacagtagcaaaaagaatcaatcaaaaatatttcataaacctcgagatacggccaaaaaagagatatgaataaatttcatcaaattcaattttaatctactcaaatatgaaatccaattacactaaagaaacttcaagaaattataaaactaatgcaaaaaagaatcagtaaatttggatctaaaacatagaagttataagcaaactaaaattagaactattctgaaatctaaaacagagaaagaaaaaagcatgcatgcggctgaaagaaaaaccgaagaggccggttcgatctaaaccagaaaataaaccgtaccgaaccgatcaaatctaataaaacctac

SEQ ID NO: 37120 - DNA, 333 bp, Triticum aestivum
  Clone ID: PAT_TA_37120
gtctacaacgtatacgtctcggagtgcgcgtttgcgctccctctttgggatgtgggtgacgtaaatcatgttcactgttttgaccttcagttgaaattttttctgtccccagtgttcggttggcgagattcgtcctcatcttcacttggcggctccttccctttgtgtttggtgcttagcttgccagcctacttgaagacccaacattctttgttggtgtgattcgcaggtttctcggtggtgccgttaatctgacaggacttgtctagacttttatttaagctggacggaccatctccgcaggcttcaaatggctttttccgttgaccgggt

SEQ ID NO: 37121 - DNA, 381 bp, Triticum aestivum
  Clone ID: PAT_TA_37121
gtcgacgggtgcctgtgacgctgccaatggccggcctaattagtaggtttgattagtttaggccaaattaggtgttaattagtctaaggcttttgcaagtggaccccggctagttaatataattaactagaatagtttagttgatgtccatgacatgtggccccaccttgactagttgaccagtcaaagtgctgactgtatatcacctagccaatgacagatggccccctgcactgttcattgttgactcagtcaacatctgactggacctttgactttgaccctgaccccactgtcatactctatggctggaatagcgctaggtaacaaaagtttaatctggctttatttttcgaatttaagatacatccagtaatttgg

SEQ ID NO: 37122 - DNA, 274 bp, Triticum aestivum
  Clone ID: PAT_TA_37122
acttgatatatatatgtattgcaattgaatactcgtggtgacaatggggtatcgtattgattcacttgatatatgttttggcactcaactcgcagattcccgaggtgacattggggtaatctatgcataggggttgatgcatgttcttgtctttgtttctctggtagaaatcttggggcattatttgaagttctatgtgctggattgatgtattatgaatctgaatttgctttggtgttatctagtacagtctcttggttagatctatcagatt

SEQ ID NO: 37123 - DNA, 264 bp, Triticum aestivum
  Clone ID: PAT_TA_37123
attccgaggtcgacgggggcgaacatgtgtaatactgagctgcacaaaggcaggttggaggtgcctagacttataaaagatttcattgatgaggtttcaactcaattgaaaatggtgtgtgaatctgatacggatgagttgcttttggaagagaagcttgcctttgttcaggaaagcagacatgcctttggaacgactgcgctactcttaagtggggggtgcttcactgggttcattccatgtgggtgtactgaaaaccttggt

SEQ ID NO: 37124 - DNA, 253 bp, Triticum aestivum
  Clone ID: PAT_TA_37124
ctcaagtaaagagatgtctgctctgctttccttgtgttccaaagcttctgcttcatcttttcggaaaatttccctggcttggacacacaaactatatatatgaagatgtttacgttgcaatgcatagtagtactagctatatatgagttggacttcagaaagagggatataaaaaaaaaataaaaacgttctttaacaacaaaaaaaaacatcacagaaaggcagaagaagcaacaaatcaaataagataaaa

SEQ ID NO: 37125 - DNA, 412 bp, Triticum aestivum
  Clone ID: PAT_TA_37125
tccacgggaccgtctaaactcactaatcatatatcgcctcgcaccaatgtcaactctgagacttgaactccagtaggcaggggatatcactgtcctccaaaccattcaacgacatggtttccttgacgtgtaatactcatggggcaaaataattctgttttgctagaacttattataatttggtctcattcacattcaaaggctataaaaggtgaatgagatcaaattatatctcatctagatgagttctatatactcccaaataattaccaaatgcaacccatattatattcacaagaaatcgaaattgtgcagaccattcataacagtacatcttcagacattggaaaactgcactccgcacttggttggcgtgaacccatctcagctcgcactccaaaactcgaaaaat

SEQ ID NO: 37126 - DNA, 261 bp, Triticum aestivum
  Clone ID: PAT_TA_37126
ctcgcgggtcgacgggactgacaaaacaccagtaatggcagccagaggaagcgacactagttcagacctgacaatagtcctctgaaattttgtcatgttctcagtcgaaagcagggatttcgataccactagaaactgaaccagttgtgcaccataggagcagaggtgaaatttgcttggaagcaacagcagttcagtgcatctgtgtacgccgacagctacttgggtccttgagacgattgccacatgtttatcctcctg

SEQ ID NO: 37127 - DNA, 291 bp, Triticum aestivum
  Clone ID: PAT_TA_37127
ccacccttctgggctccggatcacgcgcatcgctgccgaggccgtgcggcttgtgggaggcgggggcgcgcggtgggtggtgctcgtggacgacgacaccgtgctgtccccggacaacctggtggtgtgctcgggaagtacgactggagggagatggtgtacgtcggggcctcgtcggagagccactcggccaacagctatttcagccacggcccctcgccgctgtgctcgcgcggacactcgaacgtgttgctcgagaggttacccaggctgtagggaagccacgaccgc

SEQ ID NO: 37128 - DNA, 415 bp, Triticum aestivum
  Clone ID: PAT_TA_37128
gtcttctgacatgcagcagcaaagttgttgttgttgttgttgtttttgtcgttgttgttgtgagcatggaacttgcttctaacttatttattcattgctttgatggtagagatattggagcagatgagatgagagaataaccttgaagttcagtggtttgtaataggaagcatgctcgacggtgcaatcagggtcaatcagctccgtgagccgtgctatgtccttgtcattgagggaggaatacaactcctgaatcacatctgtcaggggggaagatggtaaggcattacctccatctccctggtaagctttgttgagaccactggttgcttttggccctggtattgatcgtatgggctttggtgagcattgttgtctcttctcccacttggcgcttatctgctgtcgtcgggac

SEQ ID NO: 37129 - DNA, 404 bp, Triticum aestivum
  Clone ID: PAT_TA_37129
ggggacggggaaaaaaagacgggcaggagggggacgggaaaaaaaaggaaccagcgacttcgtcagccacccccggcgccggcgggacgacggcggctccaacgcaccatcgttcctgatctccacggtctctgcacctctacaagagagtttgtcatcatgcacagccccagtaagcggttgattacctctgtgtccaaacgccttgccgtgtccaatctccaaggctgggcagacctcccagatgacctgctgcactcaattgttgctctcttgggctcctccattgaccttcttgcctttgctgccacctgccgcccttggcgtgccgctttcttctcacacccatccaaatctaccttgtgcttctcatgcccccctgttctcacccgaaaaaaccccat

SEQ ID NO: 37130 - DNA, 140 bp, Triticum aestivum
  Clone ID: PAT_TA_37130
tcgacggggccaccttacacagatatatgactgctatattctctgacttttgtgaaaagattgttgaggttttcatggatgacttttctgtttatgggaagtcttttgatgattgtctaagcagtcttgatcgagttctg

SEQ ID NO: 37131 - DNA, 397 bp, Triticum aestivum
  unsure (1)..(397): unsure at all n locations
  Clone ID: PAT_TA_37131
gaggacgaggatgaggacgaagaagacgactcggacgacgaagaagacgaggattcggaggacgaaggggacgaagacgaagactccgacgagganggggaggacgaaggccaagactctgacgacgacgacgaagacgaggacgaggactcggatgaggaggaggacgacgaagacgaggaggaggaggaggaggaggacgacgagtagcatgggatggaagtggagcctgtggcgttcgcatctgggtgaggatgaaatgaagatgcaagtagctgaagggtcggtttgcactgatgcttaactgtatgtaagggatggcactcggtaaccgaatgttgcggatgaagaatattgactgcggcatgactaaatattgtcctcagggttgatggct

SEQ ID NO: 37132 - DNA, 390 bp, Triticum aestivum
  Clone ID: PAT_TA_37132
gctgtcacaggggtgaagaaccatccggatgagggcatccttaacagaaaaaccaacttcatcaaattccacagttacagagttatcacgagaaagcttacgaacacagactaaattctgaatcagtttagagacacaagaacattattaagataaagtggtctagaggtggagcgaaaactagtggaaccaatgtgagtgataggaagaccaacaccattaccgacaatgatacgagaagaagtgtggataggagacacggaagagaggttacccgggtaagcggccatatgcgaagatgcaccgatgtccataaaccagtcgccaccgtcggaataagccccggtcgggggctattggtcaggtgcaacgagtagtgtcgggtcataa

SEQ ID NO: 37133 - DNA, 374 bp, Triticum aestivum
  unsure (1)..(374): unsure at all n locations
  Clone ID: PAT_TA_37133
gacgttgtactggtctcagtatactgggaccgaacacccgatgcctatgagcgaccagctgaagcaactggtcgagctgcacaaggcggctgagcaggccatgaggggccttataatccggatgtggcctggcgactcccttcccaatagctacttcggcctggtgaggcggcttgtagatgcctgcccatggctggaggtcataaagcggtccgtctgcatcgaaggtgcacgccgggcctttgcccatgcgaagctgcactgggccaagatggacgccgagaagctggtgaaggangggccgccgcggggcaaggagcatcgccaccccaaaatgtattatgagggtgttctgaacggtgcctgtcttgtgg

SEQ ID NO: 37134 - DNA, 166 bp, Triticum aestivum
  Clone ID: PAT_TA_37134
atacaactcgctaaactgagtcgtaataatggcagccttaagagaacagcggagttcatcaaggtccacagtcagagagttatcacgagaaagcttacgaccagagagttagttctgaatcagtgtagacacacgggaacagtagtagtatagggtggtcgagagg

SEQ ID NO: 37135 - DNA, 365 bp, Triticum aestivum
  Clone ID: PAT_TA_37135
gtggcggacggaggctggtgtgggaatggggtgttctagcgcggatggtgtatgaatgggaaaatggagggagaggtacggggaaccatgtttttgggacgctcctgtctgaaatatgggaaagttacggacgtatcccccatttcaaatttggacgtctcgtcggttggggataggacggtaatctcgcatctcccaagtatttgccggtaactatttcgggcgaggagagggtgttttgctgcccacggttggcgcccatggtgtatgaacggggctgatacgtacggcggttgtgtcacgtctgatggaagttacacatctgcccctatttaaaatattagcctacatctacttcggacgag

SEQ ID NO: 37136 - DNA, 390 bp, Triticum aestivum
  Clone ID: PAT_TA_37136
acaggatgtcggcgcgacgaggtgacaaaatccggattcgcagggttgcccgagttacggacataacacacgtaggacaatggtggcatatgggatcaccctggaacgacgtccgcagtgtagaccggagtgcaaagcctgtagcaccaagaatcgctgaccaatagaaaatactgtttgatatattattaatatgcacatcgcgaataacttacaacgattgcacctggtatttatctgacgacgtccatactgatggcagacgagatgattatggatgagggacatcctggccagagtgcctcaagactgcatcgggccgaccaacatacggaacggccgatctgatgcataggtcggctggccgaggtgatgtcaggatattgttac

SEQ ID NO: 37137 - DNA, 353 bp, Triticum aestivum
  Clone ID: PAT_TA_37137
ttcctaggtcacgggggctgtcgaaactacgaggtttcattatcacgattctcaggcataccagagttactcatatccttcacgctatgtgctagcctctatagtagatctgcactgcactatctcaccattagagttggtgcatacttcgccggtggatccaaactccgtgatcagatgagctcaatgtctgatataccaccataaagcatcccccgaatagcttccatagcttgctactgtggtattcccaacgacattcagacagatagcaccctgcatcattctagcgtgcggattaccattctagcgtgcatcattactgtctcagggccttgcataatcatgtcgtt

SEQ ID NO: 37138 - DNA, 412 bp, Triticum aestivum
  Clone ID: PAT_TA_37138
gaagtttgatgacgataatgatgccggtgatggggatgacaccatggaagaggagcatggcaaggaggatgctgaagatggtggtgatgaggggatggagcaggaggaagggagtgacggcgatgaagacgatttcccgcatgccttcttctttgtgaggtatctgtgtgatcgggaggactgctatggcatgcttgcgccgttgccacccttaccgaacggtgagctgtcccatgtatttgagtgcaatgcctgtgggcaactgaagaaggaagaagacgaggttgaggctgatgctgatgctggtgattgcagcatggaccagtaggatgtttgctgctgtttttttggagcacttggtgatgaaatggatgcactggttggcgttctccgtactttgggggctgtttgc

SEQ ID NO: 37139 - DNA, 423 bp, Triticum aestivum
  Clone ID: PAT_TA_37139
gatcaccgggatgcgcagtcccatgcttatgcaaatcaaatcaaaataattgcaaacaaaactcccccgggactgttgttagttggaggcactcgttgtttcgagcaagccatggattgatgcttgttggtgcagggggagtataaactttatcattctgtttgggaaccgcctataatgtgtgtagcacggaagatatcgccatctcttggttgttatgttgacaatgaaattatgccgctcaaaatattatttatctctatttcaaaatcgagcgctggcacctctacaaatccctacttccctctgcgaatggcctatctatttacttttatgttgagtcatcaccatcttattaaaaagcaccagttggagagcaccgctgtcatttgcatccattgctattaatttatattgggtatg

SEQ ID NO: 37140 - DNA, 296 bp, Triticum aestivum
  Clone ID: PAT_TA_37140
ttatgctagttgtatcgctcaccaaggcatgacatgacagttgacgtgtcgctgctgctagtctgtatccaacgccaatttgtgacatgtctgtaaaattctgcatcatacttaatcggatttgtgagagacgggataggcgaatgcttgttcaaattactgtgggagacatcgcactttgtgtcttcattgcagtacattatttgtcacagattgcactcttgattcagtgcctatcccggtcaagctccggtggctctctaatacagtcataatctgtgtgtaggtattgagtt

SEQ ID NO: 37141 - DNA, 374 bp, Triticum aestivum
  Clone ID: PAT_TA_37141
gagttctatatgactaatgttgagtccatggattatgcacactctcacccttccatcattgctagcctcttcagtatcgtgcattgccctttctcaccttgagagttggtgcaaacttcactggtgcatccaaaccccatgatacaatacgctctatcacacataaacctccttatatcttcctcaaagcagccaccatacctacctacgatggcatttccatagccattccgagatatattgccatgcaactttccaccgttctgttcatcatcatgacacacatcgtcattgtcatattgccttgcatgatcgtgtagttgacatcgtatctgtggcaaatccaccatgcataaattttcatacatgtcact

SEQ ID NO: 37142 - DNA, 406 bp, Triticum aestivum
  unsure (1)..(406): unsure at all n locations
  Clone ID: PAT_TA_37142
atgacgaaaatgaccaccggtgatggcttcccctctggcaaggtgccggaacgggctctcgattggttttacatggctacagaggcttgcggctgtggaactcccgatctaggcttatttctgggggtttctggatttataggaatttttggcatcggtttcaagtcaggggggtccatgagtcagtgacaaggcagggggcgcgccctccacccttgtcgttgattcgggactcttctggcccaactcttgtgcttcgggggcttcttctggtccataaaaaataatcgtaaattttcagctcatttggactccgtttgatattccttttctgcaaaactcaaaaacaaggaaaaacagaaactggcactgggctctaagttagtangttagtcccataaataat

SEQ ID NO: 37143 - DNA, 392 bp, Triticum aestivum
  Clone ID: PAT_TA_37143
gtcaatactacaccctataatgggtcttaataatgacgccacggcggtttacaagaacaaggtgaaaatgtaaaggaatttttctaagtattgaagattgacatgaacaaattcaaaccaatctagggcctaatgttggggatattactattggacgtaaaccggccaggagtagccgggttaactttatgaagattggaagcccatgaagacttgaagatgatgacgctttacgaagtcccaaggcccagaagtgagttaaggcctatagatgtaaaccgacttaatcatgtaacttgctgtgtaagataggaagtgtggagatcgaaccggacacgtttataatccggcttcaggactctgtaaaccggcgggcgtcaacctatgtatat

SEQ ID NO: 37144 - DNA, 384 bp, Triticum aestivum
  Clone ID: PAT_TA_37144
aaagagagagaataagccatctagctaataactatggacccgaaggtctgaaataaactactcacacatcaccggagaggccatggagttgatgtagaggccctccgtgatcaatgccccctccggcggagctccggaaaaagccccaagatgggatctcttaggtaaaaaaggttgcggccgtggaattaggttttcgtggttctcctggatgtttgggggtacgtggatatatataggaggaagtacatcggtggagcaacgaggggcccacgagggtggacagcacgcccaggggggtaggcgcaccccctgccttgtggcctcctcgattgtttcttgacgcccactccaagtctcctggatcacatttgttgtgaaaat

SEQ ID NO: 37145 - DNA, 392 bp, Triticum aestivum
  Clone ID: PAT_TA_37145
cgggcagtgcacgacgtggccgccgtggacgcggcggcgtaccagagctgcgtggtgcccaagggcaagagggcgatgcgcagcgggcacgacaaggtgaggctggtcaaggggatgcactacttcgtctgcaccgtgcgcgggcactgcaaggccaacatgaagatcgccgtcagggtcatctagagtgtttatagctacctgttttgccaactgcattcagatcaggtcgatccaaagcttccgactacagctttttagtttgcttaatgcttgaaccaactgctagtttgcttcccagtttttatccgtgcactcttgttctaggtgcggcaatcgcgagttgtaattcctgttaatttgaatatgggtctgaaggcttactaagaaaa

SEQ ID NO: 37146 - DNA, 357 bp, Triticum aestivum
  Clone ID: PAT_TA_37146
gtcgacgggacagttgatggtgtttcatcacaacaattgtgtgggatgtcataggcatttggatgctggacgaacattgctgcaagaacttgtacaaactattggatggaacaagccccggttttgtgcttacactggacagttattttgtgcctcttgtcacacaaacgatactgcggttctgccagcaagagttttacaccactgggatttttctttatatccagtttcccagctagcaaaagcatttttggactccatctatgaccagcctatgctctgtgtaagtgctgtcaaccctttcctttttgctaaagtgcctgctctgcttaacatcatgagtatccggaagaaaat

SEQ ID NO: 37147 - DNA, 243 bp, Triticum aestivum
  unsure (1)..(243): unsure at all n locations
  Clone ID: PAT_TA_37147
gggtcgatgggacacactacaggtagtcctgctaacctgtctgttcctgtgtcctggaaagcctgcctgtccggtgattgcgctatgagtttcttggttcggcgtgcaggcttgacgcgtctttgccatgaagcctgtttcctgtctgctgccggagtactgacttggttgtttctgtgtaccgcaaaccttgtgtgtccagtgagattgtgctttcgaacctgttttacatacaanananaa

SEQ ID NO: 37148 - DNA, 401 bp, Triticum aestivum
  Clone ID: PAT_TA_37148
gggtcgacgagtcacactaatcaggatgataggggatgtgtgaacatttacctcatcaccctcttttctccgtccagttgcctgattacgctgtggtggatccatgaaatcatcatcatcattttgatgatcgccacgagccattctgctgagataggaacagaccaaattgtcatggtggaaatgtaaatgcaagaggtaagcagttgccacctaacagaaaatgtcaactagtgaatgcagaaaaaataacatgaacacacacgcacccctcctatgattgtcggaaacataaacgcggcaagtaagcacgttgttgcattatcaagtaaaaaaagtgtacatatggtaaatgcacttttgaaacaaaaatgttgaagttgccattgttaccccaagat

SEQ ID NO: 37149 - DNA, 371 bp, Triticum aestivum
  Clone ID: PAT_TA_37149
ctctcatcaataacacaggtgtgaaccattgttgcccgaactggccgccatcgtctctctcatcaggtgtgtcttcttgattttctctcaccaactgcagctggcgctcaagcttgttaattagaggcgacagaacacgcttcgcgtgtctagtttctgtaaatctgtttagccatcacttttgtcttcactagtgtatttggcctcagtttagtgtataatttggtttagccgtcactctgttttcactagcgaacgccaagtcttggattggttgcatccaaactctccacgtcctacaaacgctcatgaacttcacttgtcaatgtataatatagactggtgtaaacaaacttttcatttacgcttag

SEQ ID NO: 37150 - DNA, 421 bp, Triticum aestivum
  Clone ID: PAT_TA_37150
tcgcgggtcgacggggtgcccgaagccaactcgggatacaatcttggccccaccaaaccccccctcgcccgctcgcgcttcccggtgtcagttgttcgcattcatgtctttgtagagcgtccgatccgcgttgacgctggcgcagaacgaggcgacctctcactaccggctgcacgcccgactaaacacgcctccttgtcgcattcatccagcttcagattgccccgcgtatctccattgaacccgcgcgtgggctaagaaacctactcctgacacacgtccgcccgtgagccgtccaacattaaacaaaatgccggttggctcctcgcatccctagctatttaaatgaggtcagacaccgggcaagacctgcaccacatctccgctcctcatctcctatttgcaccatattttgcacaat

SEQ ID NO: 37151 - DNA, 413 bp, Triticum aestivum
  Clone ID: PAT_TA_37151
ctcgcgggtcgacgggagaagataccttcatgttgtagggcacggccgcagtgaaacggatcatgttgccggtgaaagggttgagtacgcgtgcagcgtgaggatgctccctgtccgcgaggacgaacaaggcgccgtcggtggtgacggcgacaacatagtacttgcggagcacaggcatgtccttgtggaggacgcggccgctggcggtgttcaccatgaggcatgagttgggctcgaaggccttgtcgatgatgatccagttgcgaggacagaagcgggggtcggaggagttggaggggtcgtcggtggcggagcgccagctgcggcagacggcgcggaagtccatgtagcagtcaaggtcgttggtgtcgaggaggcactcggcgatgcaacggacgagatccgatggg

SEQ ID NO: 37152 - DNA, 423 bp, Triticum aestivum
  Clone ID: PAT_TA_37152
tcgcgggtcgatgggggactctaaaatgaggcgtggtaagagcctaagcttggggatgcccctggcaccccaagacaatctaaggacacctaaaagcaaaagcttggagatgccccggaaggcatcgcctctttcgtctacttctatcggtaactttagttggagctatatttttatttaccacatgatatgtgttttgcttggagcgtcttgtattatttgagtctttatttgttagttttccacaatcatccttgctgcacacacctttttgagagagacactgatgatttggaaattgttagaatactctatgtgcttcacttatatcttttgagttatatagtttttgctctagtgcttcacttatatcttttagggcaagatggtggatttgttttatagaaacttttgttctctcat

SEQ ID NO: 37153 - DNA, 333 bp, Triticum aestivum
  Clone ID: PAT_TA_37153
gacggggaatcatagcccgacccggctcatttgtccttttgttcgcagaagggagatcctgtgcgctagctatatctgttatggatggagccctcactcaaccgacctgctacctggaaatccccaatgcaccaatgtaccaaaggcactgtactttgaataggaaacacttccctacttcacttcctaattaataaagtaggaggtattcgagtacggaggtactagaccgtgattctggtcctgatgcggacacacctgtcgacaacagagaagggattcaattgagagcggatagcaagatcgaatgaatggatactctgagatagaacg

SEQ ID NO: 37154 - DNA, 357 bp, Triticum aestivum
  Clone ID: PAT_TA_37154
gggtcgacgccgaacacgaacatgactcataatcgggcgccggcgaccaaagatgccggcagcgacgggaagacgaggggcatgaagaagggcagcacggccaacaagggcgtggagacgtacaagatctacatcttcaaggtgctcaagcacgtgcacccggacatcagcatctcctccaaggccatgtccatcatgaactccttcatcaacgacatcttcgagaagctcgccggggagtccgccaagctcgcccgctacaacaagaagcccaccatcacatcccgggagatccagacctccgatcgcctcgtcctccccggcgagctctccaagcacgccgtctctgaaggcacc

SEQ ID NO: 37155 - DNA, 422 bp, Triticum aestivum
  Clone ID: PAT_TA_37155
gggtcgacgggggagacgatcatgcatccgttgaatgctgtcggattcctcggtgaggagaagatcgccgccaaagtggcctacttgaagaagacgttcaggtggtcagacgctgaggtgagcattgctctgcgtaaggctccgtctgtgctgaggaagtcaaaggaattactgcagcgcaggtctgatttcctcatctctgaggtggggttggaaccgtcctacattgctgaacggtcagtaattatcaattacaagctggagggccggatgaaaccccggtactacgttgtaaagttcctcatggaaaatggattgctcaagtgcaacccaggctactaccagaccgctttcaaggtgagagagaacgtattcatggagaagttcatttgccctcacaatgaagttgcgccgcacctctc

SEQ ID NO: 37156 - DNA, 323 bp, Triticum aestivum
  Clone ID: PAT_TA_37156
gagatgactattcatttatattcgagaataatggttgttctagttatatgagtaacatattttatggtcatggacccaatgtgaatggtttattcttgttgaatctcgacagtagtgatacacatgttcataagactaatggcaaaagatgcaaagtgaataatgatagtaccacatacttgtggtactaccccttaggtcatattgggcaaagtgatgaaaaaactcaaacggagggtttttggaatcacttgacttggaatcattttggaacatggtgagccatacctcatgggcaaaataccaccagactgttttctcgc

SEQ ID NO: 37157 - DNA, 420 bp, Triticum aestivum
  Clone ID: PAT_TA_37157
ccacgctaacatcagtcgcggcaggacttcaattgatggattgaccacttcttcgacatgcacgaacactcgatacaggtacatccctaacgtggtccgcggcggccttggtggcgacaaatagtacaaccccggttcctggaccggtatctcaacaccaatcaccttcggtatggttgacggcttcttcatccatgccataaccgtcagagcccagctgtctggaggaacaaacatacttacgagctcacatccaaggtccttgataagctcattcatggactcgttgttccaagcatgtcgaggcatgctgtggaaggtaagctttgttaaaaactcaagctcagagggcaccgagccccatcctgggtgctcactagcgagccatcgtagaacaaacgccgggaagattcgaacaca

SEQ ID NO: 37158 - DNA, 376 bp, Triticum aestivum
  unsure (1)..(376): unsure at all n locations
  Clone ID: PAT_TA_37158
atccggatacttgtttattacgagatgaatattcatttaaattcgagaataatggttgttctatttatacgagtaacatattttatggtcatggacccaatgtcaatgggttaccattgtgtgtgtgctgttgtctaggagcacctgtgaagagccatgtaggcagggaaggaagaggtggtcatcgtgtggcttcacacgtctggcatgagcgccttacgtacacacgtgaggaggatcgtgacagagggcctgcagtggtgggctctgccagctttgtgtggtctgcacatgttngtggccatgtaagtgacccatgtaagcgttctctctctcttttctaaactcgctcagttttctaatttctgtaattgtg

SEQ ID NO: 37159 - DNA, 420 bp, Triticum aestivum
  Clone ID: PAT_TA_37159
cacaaccacacccgggccgaaaaccgcatacggccttcaccggaacaacttggtgacttcacccgataaaaaggcgcggaaaacccctaagccttaacggacaaggtaatggaccacaatttccaaaaagggttaaaaaccgtgacaattgaatcatacaatggaacgacagatcccacaatatggatcaaaaattcccttctccacatcaacatggctcagggcgatgatctccatgcaatcaagtacctccccctaaaactcaagggaccagcacggcactggttaaacagcctcccagaaaactctattggtagttgggaagatttgggagatgcctttggagacaacttccaaggtacctatgttcggcctccagacgccgatgaccttagtcacatagtccaaaaacccgaagag

SEQ ID NO: 37160 - DNA, 415 bp, Triticum aestivum
  Clone ID: PAT_TA_37160
gacggggatctggaacggtggatgtattgagctcgagctgaagatcagccactccatccacgaccaatgcttcttttccttattttcatggagatgatttcagtactctttatccgtgtcatgttagagccaagatgcatgtgccactcgttccatcaagtgtctaatgaactttcagttttgttcctggtttatcttggcttcttgctgcttaatatgcctatgattcaataacaatacctactataaaaaaagaaaatggaaggggtgcttcctacctggcaccgcccaacttgctctctttgttcaatattgtgtcgagtccccaagggaacatggtgctgtataaacaatagtggaaagcacagggctcttgagaattaggatttgttggtttcagtcgtttcaagtttta

SEQ ID NO: 37161 - DNA, 411 bp, Triticum aestivum
  unsure (1)..(411): unsure at all n locations
  Clone ID: PAT_TA_37161
agttccagagagaggtgcgcgccatcaggcggacgagccaccgcaacctggtccgcctcctcggcttctgtcacganggcgcgcaccgcctcctggtgtacgagttcatgagcaacggctcggtggccgacctgctcttcaggggtgcctcaacgccttcgtggtccgactgccttggcatcgcactcgacgtggcccggggccggcactacctccacgacgagcttagcagccgcgtgacccactgtgacgtcaagccgcagaacatcctcatagacgcagccggcacggccaagatcgccgacttcaggcttgccaaactgctccaacctaatcagacacgcacttttcacggtgtccgccgcacgcgtgggtacctgggccccgagtggtacaggggcacgggccctg

SEQ ID NO: 37162 - DNA, 389 bp, Triticum aestivum
  Clone ID: PAT_TA_37162
ggagagacggaggcgggcggcttttataggagggcaagaggggttcgggggtaaaaagcacagagccgtgcctggcccgtttaacccaggccgtgccgtgccgtgccgggccgggccggcccatttgaccaggtttgattgtgtatccgcctcgcattttctgatttttaccaatttattaatagtagcaaaaatgcccgtgcgtggaagtattggacatatagtttattgcatggttacttatatttgtatcatgatatttatttatttaactaacacatcatgtttttcaatttgtcttcaaatcacccgtgagatttacatatgtatccactaatgcatcatgtgtttcatcagtttatcttgtctgcatgacaccctcattcaac

SEQ ID NO: 37163 - DNA, 408 bp, Triticum aestivum
  unsure (1)..(408): unsure at all n locations
  Clone ID: PAT_TA_37163
taacatgacccatccagttggaaccatacccaagggatacctgatcaaaaattgaatctctttcggtaaaagtaatctattaggcaccggaaaccctgttgttggtttgcccgtcaacaagcactgtggaaggctcgaaggcaaaggtcacaccaatggtcatagggatgtgaatgtgttacgctcgggccaacaaaacgaccttgatanggcaaacttagtagtgctacaacacctagatgtgctagaagatttcatgacactgcacaaagagaccatcgcaaagaagtaccgtgaccgtggggtgcacaggacggacgcttaagttattagagagcacaactccactttcttgttttggttcaaagagcgagttctggctaatcccccggaagaaggttgtccaaa

SEQ ID NO: 37164 - DNA, 423 bp, Triticum aestivum
  Clone ID: PAT_TA_37164
gacgggatgttggaatactaaatttggaggatttaattgcaacggaggtggtaccccctcaacaatggttgaattggcaaattcccgtagggttaactcaaagttttaataagatccataaataggtctcggaagaaaatgctcttgcttgtcataaataatttactccagaactattctggtgtagttgttctgcgaagaagacagtatgtttgtgggaagagcatgctcttgcttgtcataaataatttactccagaactattctggtgtggttgttctgcgaagaagacagtatgtttgtgggaagagaatgctcttgcttgtcataaataatttactccagaaatagtctggcgtttctgcatatcctggcctgtgaagaagacatagtaatgattgtactataatttagcttcaaaaa

SEQ ID NO: 37165 - DNA, 161 bp, Triticum aestivum
  Clone ID: PAT_TA_37165
tctcttcaattcaggtgttgatagtttgctttagttatatgtttataatcagggtgtatgttgtgatatatagtttcgagttttgtttgaagatttacttagagcatttttagagtcgaggatgacaggatggtaattttcaaaaagttgtggctctagag

SEQ ID NO: 37166 - DNA, 120 bp, Triticum aestivum
  Clone ID: PAT_TA_37166
agtgaggaggccggcgggaggttcacgtacgggagagaagcgacggagttaggagttgtaaatatgcattgttgtatcgcgacctgaatgaatggaataaacgaaataacgctgttattc

SEQ ID NO: 37167 - DNA, 395 bp, Triticum aestivum
  Clone ID: PAT_TA_37167
ctatagcagttgatataacagccaattgcaaagataattcaataagtgtcaacttaatcaaatcaagtccacgatataaagaaagagggataacactaacaacgggtccaagattacataaagcaattttaacaaaatttcctttaatggagcaagggaaaatgggtaatcctcgaaaaccaagtttccttgggaatccaaccctaaaagttaaatagcagcatggggaaaccaactcgggaacttctttaatatacaataccttcaaaaactaggcataaggatttattttgagcatatcaagttaaccgcatacgcaaaaagataggtcaaatcatttaagcaaagcgctcaaaatcctcatcatcctttttcttggatggtttgggggggaa

SEQ ID NO: 37168 - DNA, 404 bp, Triticum aestivum
  Clone ID: PAT_TA_37168
atttcagaagggtggaatacacaaaaccccgatggataattcatgtccaatcaagaatttccatgcaagagacaaagagttcacctatcgcccaggcgttacctattatgcttgtggagaagaagggcactatgccaagcagtgccccaagccaaggaactcaaccccgaagcccaataatggtggaaataattcagcgccaaagcgaagcaatttcaaccccaataacaaccatcggaaaggtcacctgaaccatgtgacccatgaggaagcacagaacgccctagatatcgtgctcggtacgtaccccgtcaacacaatacctgccatggttttgtttgattctggagcttctcactcattcatttcgaagagttttgctttgcaaaataatttttcgatgc

SEQ ID NO: 37169 - DNA, 400 bp, Triticum aestivum
  Clone ID: PAT_TA_37169
cacctctggaaaggaaccctttggccatggagcatcagcaattttacttattagagcacctccgcacgctgcgtactgcccctcgaccatcttcggcttcacatcgaaggtcttgagccacaggccgaagtgaggggtaatgcggaggaaggcctcacaaacgacaataaatgacgagatgtgaagaagggaatccggggccagatcgtgaaaatccagcctgtaatagaacataagacccctaacaaagggatccagagcgaggcctagtcctcggaggaagtgggagacgaacacaatgctctcgttgggttcaggagtagggacgacctcccctcgggcgggcagcctatgcgaaatttcggcggtcagatatctggcctccctcaacttcttgatg

SEQ ID NO: 37170 - DNA, 415 bp, Triticum aestivum
  Clone ID: PAT_TA_37170
ccgcttttaccaagctaccgcttcttctccgagcagccacctcgccggagccgtcgcttgcttcccggtgatgccgcctcctcgccctgccactgaagtgcgagggcgccaccggattcaatggggtgtgccgacggccgtcagacaactacggcgtcgagtttgaacacaccggtattggctcgacacatactcgtcagcctacctcatgacatcgctgtgtggaggctcagcctcccccgcccgaaactcaattccctgcaaattgagtctggtgaatgcggagctcgtcagcccgccggtgacaattgaatctagcccaatttgggcagctcctcacattgttgtcgatgagtgggaaaacattcgagagagcgataaggatgccatggcagcgttcactaaggcacatcgg

SEQ ID NO: 37171 - DNA, 410 bp, Triticum aestivum
  Clone ID: PAT_TA_37171
gcacataaatctgttcaagcacagaagtaatcttctttagtcatgaaaagaattgttattaggagggaacacaacagatgaaatagagctagtggcagatgcttgcatacatcagatccaatgcttttactacataaaacaatcccttgaattaatagtggcaaaatgcaatggataaaaacaatgggtaagccctttctcttttgttagtattggttctactcctccttgctactttgaagtactgataattctcctccttgggcatgtcatttcccagagggttaaaatgggcactcttaatttctctttcggaggaagcggagaagctgtagatgacgctaaggcacagaggaagagcaagaactgcaacacctgtggatgttgtcaacgtttctcattgtaattga

SEQ ID NO: 37172 - DNA, 403 bp, Triticum aestivum
  unsure (1)..(403): unsure at all n locations
  Clone ID: PAT_TA_37172
ctacggcaccaggggctcacagcccatggaggagagcatccttggagcagatggcgccgtggtggagggcaggtaccaccacaacctggacctcttcacgatgtccaaggacgtcgccgccacaaagatgccgtgcgcgtgacacggcctaacccgaccaacccctgggggaagaaagacaccactgccacggttcactgtcagccttcagccgcggtgctcttgggcacattctccggtggtgcttangagtctgcaccggttactgtacccatatgagcttatgttggtggttgtgactgttagaggatctcatgcttggctatatataggaatcctggtttgtcgaaactcgaataatgaaaagttgaaattgcattctgaatttgcgcaagaatataat

SEQ ID NO: 37173 - DNA, 140 bp, Triticum aestivum
  Clone ID: PAT_TA_37173
aactggtgtttccagtgtctaacgggtgactaacacgtacaagtctgcccttggaaggggaacatcaactggaaccagttgcggataccccgtatgctggggatgttcaaaacatgaccaatagctttgatgtccggact

SEQ ID NO: 37174 - DNA, 328 bp, Triticum aestivum
  Clone ID: PAT_TA_37174
aggttgcatcggtgaaaatttccagtttttcctagattagatttattttcttacctattgtccaagaaaaagccacaaaacaaaagttagatttaatcaacctttggcctaaccagactgaacctttggaattttcctttcaatggttggaataatgaattaacggttgcatcaacgtgtccaattgctgggcctaatgtccaattcctttaaagtttcgagttctgttcacaataatcacgcaaccgctggatcaatatcccaaccgctgtgtaacatcccatacaacaatttccaccaagtgctaagcactgtttaatgtcacaat

SEQ ID NO: 37175 - DNA, 413 bp, Triticum aestivum
  Clone ID: PAT_TA_37175
tcggtaactgatttataggatgaaggtctgacgagaactgtttgggggccgattgatacgaatagaattttggaggttcctatggcaccatcaagaattgaagattttgttgcatggaaccacactaagagcgggatgtttagtgttcgctcagcttatcatgcggaatggagctatcgatttggtaggcacgaaagaaacttacttggcgtcgaggggtcacatatcatcccgggtgtggaagaagcggtggagcttatttgggtggtgagcactatatggaatattgccgaggggtgtcggtgtaccaaacattatttgtaccgaaattaatcttaactgttgcatggtacatttggtgggagagacggcaaacggcaaaccgttcacaatggaccagtatagacgcctca

SEQ ID NO: 37176 - DNA, 415 bp, Triticum aestivum
  Clone ID: PAT_TA_37176
tgccctcattgaagattgaggtgttgtgcatgctggggtgcagagaagcacaagtgagagtggtcgccatataaccttggatggggatgaattatgtgctcaggggaggtggtgtgtgttgtgtgtgtgtgtcagatattgagagaaaacaaacctaaggagagaaatgtgtgtgtatgtgacggaaagctacatgctaaacagggtattcacgaagagattgtgcgtgcgagatagagagcgatgtgcgggccttgaggtgggcaggggccaggtgagggtgtcaaaatgtgcatgttgatgcatgtgttacatgcgatcgtgcgagggacagacaaatcgagagagatggttgttgtgttacggatgctcctctctctctcacacacacacacacaagtaaaatagaagaccg

SEQ ID NO: 37177 - DNA, 413 bp, Triticum aestivum
  Clone ID: PAT_TA_37177
caactagtatgcatcacaccctgatgatctcttatgtatatcttatcatgttacttctgtaatcaaacatctaagatgcgctgttgagcgcattatcagctaataaagggcatctgccatcattgtataaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccccccaaaagttttaaactttaatttccggtaaaagaaaattaaaaccccttcaaaagggcccccaaatttaatttaaaggggccttttttaaaaaccttttagggggaaaa

SEQ ID NO: 37178 - DNA, 399 bp, Triticum aestivum
  Clone ID: PAT_TA_37178
ctccgccatctgttccaaaatgtagtgcgtatagccttactgaaaattcaaacctaactaactttaactaattttccttaaacaaaattgcaaatataaattacccaatatatatatcatttcattcatcttcgagaggcaactataaatatggggaaagagtgtacaaagaaagaccgtcgtatgacctgcaacaatttcaaccatcctttggtgtggaggaatatcataggaactctacatgatatgatttttataggatttttttttctttagagcgaattggttcgtaggaatagattcatatactccatatttcaaaggaaaataaacatgatacatttttatagctttagagcccattagaaaataaacatgaatggattcccatactcccac

SEQ ID NO: 37179 - DNA, 418 bp, Triticum aestivum
  Clone ID: PAT_TA_37179
ctaccaatctatccacctaggagcatgcgcataataccttgcttgatttttgcaataagtatatgtgttctttatgactaatgttgagtccatggattatacgcactctcacccttccacctttgctagcctctctaataccgcgcagctttcgccggtatcatacacccaccatataccttccccaaaacagccaccatacctacctattatggcatttccatagccattctgagatatattgccatgcaactttccaccgttccatttattatgacacactccatcattgtcatattgcttagcatgatcatgtagttgacatcgtatttgtggcaaagccaccactcataattctttcatacatgccactcatgagtcattgcttatcccggtacaccgccggaggcactcatat

SEQ ID NO: 37180 - DNA, 392 bp, Triticum aestivum
  unsure (1)..(392): unsure at all n locations
  Clone ID: PAT_TA_37180
gcctcaaatgtgcagtggtcggtgtcccaaagaccatcgataatgatattgcggtgattgatanatcctttggatttgacactgctgtggaggaggctcagagagctatcaacgctgctcatgttaaacctgaaagtgcaaaaaatggcattgggttgtgaagcaaaggggccgcaacagtgggttcatcgcaatgtatgctactctagctagtcgtgacgtggattgttgcttaatcccagagtctccattctaccttgaagggaaaggaggcctccttgagttcgtcgagagacggctcaaggacagtggtcatatggtcattgtggtggccgagggtgctggccaagatctcatcgcccaaagcatgaactttgtggacactcaagatg

SEQ ID NO: 37181 - DNA, 396 bp, Triticum aestivum
  Clone ID: PAT_TA_37181
ctagtggattcttgggagcattgtacctccacacgctccaaacggagattagcacccgcaaggatgtgaacttcgggatacatcgttcctccgcgtgcctcggttatctcttacccgacccctttacttatgcactttactttatgatagccatagtgtttcatgttgtatatcttgcttagtataagttgttggtgcacataggtgaggctagttgttttaggttttctgcttgagaaattaaacgctaattctattccgcatttgttcaaccctaaaccataattattttaaagcgcctattcacccccctctaggcgacatccacgatctttcacccagctttctccaaactcccttgccctattgaagaggaataacatatgtttcatacct

SEQ ID NO: 37182 - DNA, 385 bp, Triticum aestivum
  unsure (1)..(385): unsure at all n locations
  Clone ID: PAT_TA_37182
gaagccagcagcagccttcttacaggctttgaggtaagaagtttaaaatatgtaatgtagtaccgcatggatagtagcccctaatgcccagttcggtgttcggaaagaaaaagccggactgaggatctaaaaagatatacgcaggagttctaaaaatatgtcaatatcggattgcaggctgcgctgctgacctctgccgcattgactgcgaaggtcggtgctttgaagcaagacctcgagcggaccgagaacgagctcggccttgccaagaagcagctcgaggacaaagaaggtgggtaacaccgtaataaatttgtaccttacagaaaaggattttggttgcaatagaaataacaagcataacttgggcactgcanggggcacg

SEQ ID NO: 37183 - DNA, 275 bp, Triticum aestivum
  Clone ID: PAT_TA_37183
agataaaacggtggagctgtcagtccgtcaacgctccttccaaaattggggtccggtaaaataaccaaacttgaaggttgtaataactgttgccaacaatttccgccttactttaaatggaaaaaaacaaaattcatttccattgcctatgatggatttcgatttgcttttcacatgaagcatcaacataaatcgttgaccaaaaaaaaaaaaaaaaaaaaaaaaaaaaaaaaaaaaaaaaaaaaaaaaaaaaaagggagctcaaaagggatcaa

SEQ ID NO: 37184 - DNA, 421 bp, Triticum aestivum
  Clone ID: PAT_TA_37184
tccggagcgacgaacggcgcgatggcgacacaaattccaagaaggaccacctccttcaggcaatgaccgccaacttcaaaaacctccaaccgctcaaccgtgcccgccagaacaaggtgaagtccaagacggcggcggtggacaaggtggaggcggattttgaggagcgcgtcgcccagacgtagatctggttcggcgaggcccgggaagagttgaggactgcctaaggtgagctggatgtgcgcaagcgagagctcatcctgaagcaggccgacattgagaaggtccaagaggcggcgaaggaacaggccaccaaggatgaagctgcccggcagcagcagcaagctctactggacaaccaagaagaacaccttgttgcgcgtgagcaagcgcttgccgccacgcttggcagcaaggacgg

SEQ ID NO: 37185 - DNA, 399 bp, Triticum aestivum
  unsure (1)..(399): unsure at all n locations
  Clone ID: PAT_TA_37185
ttcttcatcttcttcttcttccttgacctcctccctagatgggagaagggtttcccctctggtccttggctcccatggcgcgggaggggagagagcccctccgagattggatctatctctatttctgcgttctcagatccttccccttcaccgtttcttttatatccggagatccataactccgattggggtgaatctttcgcccagattattctcgtaaaattagctttcttgcggcaaaagaagagcgtcaaccgccttacgggtggcccaagagagtgccangcgcgccccctatctcctggccacctcgggcaccgtttctacaagttggagcatganggtgtttttttgatgtcttccttatgagtggcggtcgggggacgagcgatggtcttt

SEQ ID NO: 37186 - DNA, 284 bp, Triticum aestivum
  Clone ID: PAT_TA_37186
gaggaggaagaggggacgggacgagggcgcggctgctgatggaaggggcggagcgacggaggaagacgcctcccgatggatcaaatcgggggtagtattgtaatttcacactatttcacctggtcggaaagatgcccccagcgacaattatttcggaacggagggagtaattttttacataacctagaatgttcttctgaactataattttgaatgagccattatctgagatttaaatctagccaaaaatgatcatggctgatataatgcattctcagaatgct

SEQ ID NO: 37187 - DNA, 412 bp, Triticum aestivum
  unsure (1)..(412): unsure at all n locations
  Clone ID: PAT_TA_37187
taggtgcatgtggattctggtcacttggccttggattggagtgagcagcgttgcgcagagacttgggagtagatggattggagtggtggggcgcctttattatatgagagtccaaactctgttgcgttcacatcatgctggctctattctgcttctccaattaattccctctgcatgtaattgaggatgcatcattgaccgttcaacgtctcgagaaccgctacccactccctccttggcattcaagcacctatggacccgtcgatgacgagggtgctatggtgacttcgtaaatttcaagatgatagtgccgtgcatatgtgcattcatangggtgagtgtatgcgcgtgcatataagcgcttgcgtctgtactgtgtanaaaaacgtaaatgcatgtcaaaaagagacta

SEQ ID NO: 37188 - DNA, 219 bp, Triticum aestivum
  Clone ID: PAT_TA_37188
attcgcggatcgatggggaggtccaccatggagctagggttgtcgggatgaagaagaccctcgtccttcaacccgggcccccccccaaaggggaacgcaacaaccgggtcaatccacaatatcccctttaaggccaatgggcaacccggattccaaaaggttcatttgttatgttcccaatcctccaaaaaggttggccttgtcctcaaaaacgggcac

SEQ ID NO: 37189 - DNA, 425 bp, Triticum aestivum
  unsure (1)..(425): unsure at all n locations
  Clone ID: PAT_TA_37189
atgttcatcaagattgagggatgtaggctgaagtggatcagggaccaccagagagagatacgtgccgatctataccaaggccttgtggatagcatcgcggttggggagatgcgagcgagcgctgttgggaagaggatcgtgctgccagggacgcatcaaggaagcaaccgagacatgaagcggaggcagatggacgccatggcactggtgcagacatatgggaagcctgacatctttttgactatgacatgcaatcctagctgggaggagatactgaatgagctacttcctgncaagacaccccaggaccgaccagatcttgtcgcacgcgtgttcagggccaagctggagaccatgaaagagatgttgttcaaaaagcacatccttggtgttgtggtagcacatgtgtatgtcgtcgagttcca

SEQ ID NO: 37190 - DNA, 392 bp, Triticum aestivum
  Clone ID: PAT_TA_37190
ggagagctttataagaaaagcactaccggagtccttcaaaggtgcatctccgaagaggaggggcggaacctcctggctgaaattcatgccggacttagcggtcatcacgctgcagcccggtcccttgtaagcaaagccttccctacaggcttttattggccgacggcccgggcaggcgcttaggacttagtccaactatgcaccggttgccagctctttgcaaaccaaagccatatgccacccaccgccctctaaactatccccattacttggcccttcacggtctgggggcttgacatggttggaccccttaaaggcggaacctacaaccaaaaatacatactggtcatgggggataagttcaccagatggatagaagccaagcctgttaa

SEQ ID NO: 37191 - DNA, 301 bp, Triticum aestivum
  Clone ID: PAT_TA_37191
agggacagactagatgataaattgcttctgcaaaggactgccccgcatcattttgctcaactgtggatcgcaaggctgtatcaagctgccgattgaagttgtgggttcatacccctttttttgcctttataaaaatgaattttgtggatccaatagtgagctgccctatcttaaagagttgcaactcttcctgcatgtaaagttttcagtgttggtttggaccatcagatagacatgctggagttgtttctcagatgctaccatgcaacttcaggaaaaaaaaagacagaaagcatgacat

SEQ ID NO: 37192 - DNA, 431 bp, Triticum aestivum
  Clone ID: PAT_TA_37192
acgcagtaccacactatgattatctcaagctcaagatgcccggtccacgcggcgtcataacagtcaatggaaatacggaacgctcccttcgtacagaagagcacacagctgccttagcagcggaagtagagagcggccttctcaagcaaaaccttaatttggctgccgagccacggacatcgttaagagggtccgaactactctacagcaggagagctcggctcgccaggagctcgactagcaatctggcctccgtcttagtcccgatcaagtggtggcattcgtgtcgcgcgtacataactacgcactcaaaatcccatgggcaacgacggagggataactagcttgtggtccaaagtacgggtcaaccgacatcggatacacacatactttcacttttacttgtttccttttcaggtctcaatcccaca

SEQ ID NO: 37193 - DNA, 438 bp, Triticum aestivum
  unsure (1)..(438): unsure at all n locations
  Clone ID: PAT_TA_37193
gggtcgacggagggagaaaagctcgatcgttccccatctctctcgtctcgtcggcgacgcactccacggcggcggggaagcaccggtgctcctccccggcggcgcacggcatggggaatttcgcgtcgagtgacgcttcttcttcagtcaaagaggcacaaagggtatcaacaaccagcttcacgcccaaggactcaaggaggaagcactgggactctgggagcattcaggattggttggagacggcggaattggttgggccgcggctttacagctgccgccattgccggaaccacgtctgcctccacgacgatatcatctccaaggacttccagngaaggaatggccgcgcgtttctctcctaccacgccatgaacgtcaccacaaggggcaaaggaggacaggcagctcatgacagggctccacacgatcgccgac

SEQ ID NO: 37194 - DNA, 423 bp, Triticum aestivum
  Clone ID: PAT_TA_37194
gtactactagcgagactgaagtctctctgcaaaaacataaattaagcaacgtgagtacaaatgtacccagcaagacttacatcagatctaactacatatgcatcattatcaacaaaggggatggtggggtttaactgcagcaagccagctttgactcggtggcttcctgaactacgactgcaatgtaactctttgaggtggcgcacacgagtccacatattcaccatatcaatacaccactatgcatccgctcctgtctccctacgagaacgccatccatagaactcacgcttatcttgcgtatttaagagtatccactttcacttgtctatgtactgtacaggcaacccagaagtcctttaccgcggacacggctattcgagtagattatattaaccctgcaggggtgtacttcttcacaca

SEQ ID NO: 37195 - DNA, 432 bp, Triticum aestivum
  unsure (1)..(432): unsure at all n locations
  Clone ID: PAT_TA_37195
gtcgacgggccattcataacattggacaaattgtttacggcttgacctcaactgtcgccgaacactaccgggggctattaactggcctcccaaactaaatcctcaatattttgctcttacattggagatgaggtttcatgatcatgcttagcatgacaacccatagaaaggaaccgatagcgggactattttctttggaagacatttcttctgttaaacagtaatataacatgtctctccgcgtacctttgtttataaaaccgtatggccagattgccttgtttgttgtaaatctttgccctcataaaggctttataaagtaggacaaacactcctcgactattggccgangaggtggaagccgatggtcggtcaacaaagttttgtacaatgcagatccgagcattaatgacttaaagtacttggatacat

SEQ ID NO: 37196 - DNA, 407 bp, Triticum aestivum
  Clone ID: PAT_TA_37196
gatgatcttatcgggaggaaaaacacttgaaaagaaaagcatctttacacttattcaaggaatcaatacaatttttaggcaaagaagaaaaccaagttttagcacgattcccatagggagaacggaaatagcttcaatttaacaatatcattatccacatcttttttcttttgcatatcacacaactcaaggaaagtatttagatgggatgcaacatcttcattaggactaccagaaaattgttctttcataacaggattcaacaaagcggcattaatttcataagattccgtactagtggagagagcaatcggagtactaataaaatcattattattagtgttggaaaaatcacacaacttggtattctcttgagacatcatgacaaagcaagaaatctagcacac

SEQ ID NO: 37197 - DNA, 211 bp, Triticum aestivum
  Clone ID: PAT_TA_37197
aatctcgattgttaccatccggtaggcggcagcagggccttgggtgatccggggacttggaggacaggctcgacaaaccaaaccggtggataatcacacagcactgtaatgtaaacccgatctagaccggttctcggtgatctcggtcaacatcgtttttccattttgctgtaaacatagtgagatttctcacgacggcattatagaagtg

SEQ ID NO: 37198 - DNA, 407 bp, Triticum aestivum
  Clone ID: PAT_TA_37198
aagtttgtgaaggaccacggaggagatgagattcaagccggccccaccgtcaactagtatctttgtgaccttgaggttgcggatagttggtgagaccaacatcggcaagcacccgaccgcagttacgcgatcagggtgatcctcaatgttgaagatgataggcgtgctggaccatttcaggggcttgcgtgactctatggatggctctgctgcattcacttcccgcatccactatttgagctggcggtgcgaagtatgcagagaggcgccaccgtcaacgcacaggacctctgtggctttctgaaattcttgctcatcggtctcatcatcatccacgtcttcgtcatcgtcgtcatcttcatccttgtcacggccgtggggaggcctgtctccttgccgctgcttgg

SEQ ID NO: 37199 - DNA, 429 bp, Triticum aestivum
  Clone ID: PAT_TA_37199
ctggtattctgccctttcactgtttcttatatatccggagatccgtaactccgattggattgaaaccttcactccgattttttttctcccgaaaattagctttcttgcggccgaagaagatcattaacctccttatgaggggcccaccagggtcaggggcgcgccccctgcctcgtggctccctcgggcaccgtctcgcgttgattttcttcccatattttacatatattccaaaaataatctccgtccgtttttatcccatttggactccgtttgatatggattttttgcaaaactaaaaacatgcaacaaacatgaactggcactaagcactggatcaatatgttagtcccaaaaatagtataaaaagttgccaagtatatgaaagttgtagaatattggcatggaacaatcaaaacttatagatac

SEQ ID NO: 37200 - DNA, 422 bp, Triticum aestivum
  Clone ID: PAT_TA_37200
caaacataagttcccgcttcaaaaaccggtatactacgtatccactgtcctcacaccatgcaagtcacggtacccacattatcaaaagatagcatacgcggtcttgatggcatctcggaaactatgacattactttcaagagtgtcactactttcaagagtgttcaatcacggtggcctccgaagtaccactcaatgatataataaataaccgtgatgccaaggggccaaatttgctaagtgggccatcgagctctcccgttcgacatcatatataaaccagggtgagccattaagtcgcaagtactggctgacttcgtcgccgaatggacagaagcatactccaattggatcatgcactttgacgactctaagatgttggccggtctgggagcgggtgttgtcctgaaatcccccaccgga

SEQ ID NO: 37201 - DNA, 392 bp, Triticum aestivum
  Clone ID: PAT_TA_37201
aatgttactgtctacaaagctcgacttgtcgcaaaaggttttcaacaagttcaaggaattgactacgatgagaccttctcactcgtagcgatgcttaagtctgtccgaatcatgttagcaactgccgcattttatgattatgaaatttggcagatggatgtcaaaactgcattcctgaatggatttctggaagaagagttgtatatgatgcagccggaaggttttgtcgatccaaaaggagctaacaaagtgtgcaagctccaacgatccatttatggactggtgcaagcatctcggagttggaataaacgctttgatagtgtgatcaaagaatttggttttgtacagacttttggagaggcctgtatttacaagaaagtgaagtgggagct

SEQ ID NO: 37202 - DNA, 423 bp, Triticum aestivum
  Clone ID: PAT_TA_37202
tttgagccacagccaagcgcgccgcactatcctgaggggcatgatatagctctgcctccaaaaagtgccttggaggccgcacacgctccggcaccgatcctcgactcggagattgctgcgtcctttgaggatgaacggttggacgtcaccttgggggctgcgatcttaaaggcgatcgagccgaacgcaagccccgcactccgcatggcccatgactcctaggagccggattcttctctgaactccgggccttccgtgcccccgccgatcgaatctgattgggcgcctgtaatggagttcaccgctgcggacatctttcagtgctcacctttcggtgatatcctgaattctctcaagtctctctctttgtcaggagagcccaggccgaactatggtctgcgaggttgggatttggacgacgaa

SEQ ID NO: 37203 - DNA, 429 bp, Triticum aestivum
  Clone ID: PAT_TA_37203
cataatcttatcacccaatatgaatctagggttggagttactttgaaaaatcttaaagagaaagaacctatagttaatgaaaaaatagatcttgattccgctagaattggtaaacttgaggatataattaccaacttaggttcggcgttttctcccatgaaaaacactccaaaaccctctacaaaaatcaccaagtttatctatgttcctaaaaataaaggtcaaacttctagtaagggagacgcggacctcaaatccataagtgttcatcccaattgtctttctatcattaaggaaccttttgctacaaatgaatttcttgaattttttcccaaaggtttattcattgctaaaaagggagaaacccctaaagattattagtgctctacttatgaatcaagtgccaaagatggcactccttagatctat

SEQ ID NO: 37204 - DNA, 423 bp, Triticum aestivum
  Clone ID: PAT_TA_37204
ttaccgcgttgggcacctggacccaaagcacaatcttcctgagaaacttaccactgccgaatgggcaaagcttggtcctaccattgcaaaggttaaagctctactaagaaacgggttaactggcattgatttggtcaggtgctgggtttcttggtggatcatacccttgagtcgtcgcaccgtcttaatgtgcacttacactggtggtgtaaaggatccactgcaccacagctctgcaccattaactaacgaggaaattaacaaaatggttaagtcccttttaaatgaagatccagaagattgcattaaagtgggcctggaaaccttctgcaaacttaacccgccaccggatgtgattccccgaatttaattacctttaactcattactcaaatacttgttaacccaacctttgatgaccttt

SEQ ID NO: 37205 - DNA, 400 bp, Triticum aestivum
  Clone ID: PAT_TA_37205
gaatcccactgtgttggctcgtcatactgcgaaacaagtgcattatgatatttcacattatgaccatctgaatgcgaatgatatattatccggctatctcagccatgtgcactcaagccgtgacttggagattgaaatggtcaagaagttgcagctgaagtatgaggtacgttcttccaacttatattctgccagtccccaagtcttcagattatgagaaaaccggaatgatctgtagactttatgatataggcttagactttacctttagatttttctggagttcaataaaatagaacaaagcttcacctgtagtccccaagggccggttcatttgaccgtaaatgagccggttctttgaattttcataaccgtctcgtaccgaactcaacaaatattg

SEQ ID NO: 37206 - DNA, 283 bp, Triticum aestivum
  Clone ID: PAT_TA_37206
aggtccagaccagaagccatggccgctggggaaaggcccgttggggcgatggagagagggcgttcgcgctgttgggagcgatgcttagtgttcgggctggggctcctctcgtcccgaactaattcgttcgatcgatgcccagattcctccggaacgaatcgttcggtgtggggaggtcccagaccgaacgttcggccgttatcggcgtcctatatatttttgaaaggaaaccgagcaatatctcatcaaataaagtcaaatgaacctttcaatatcggagaag

SEQ ID NO: 37207 - DNA, 423 bp, Triticum aestivum
  Clone ID: PAT_TA_37207
aaaatatatgtccatgcattggaagatttacaggctcaagcagaagttgctctatgcttctgctgtgtcaagcattagctgtaagcaacttgtccttttccccacgtgttccggagttggaactcgatgcaccattcagcttgcactgttaacaccatttttgaagatggatgtaactgacaaacacccctccagtagttgcagccttgctggaaggatggattcaggtgtgcatcctgacagtcactatcacttttgaagattgatgatgtacctgcaaacggcttcgttaattttaggaaggatggagtcgtgcatggactggatcctaaccgactgacatgaaaacttgaggctattacacggattcagcgttgaaacacggctttgaagtccgacgtgtgccttatgattttttgtggg

SEQ ID NO: 37208 - DNA, 335 bp, Triticum aestivum
  Clone ID: PAT_TA_37208
attcccgggccaaagatgttgccgatcaagacgagtacgatgaatttgatgagttgccagccaagggatcgcgcacaagtgcaacagagaagcataaaatcatcaaaaaacccaagttcattccgggtcaacttaatgatcccagttcccccatgtacatgggaatgaagccgtaagactagtctttatgcctaccccgcaacttaattcgtttaatttagaactgtcgcgtgtactgaatttgtgagttatgcctggttttctgttgatgtaagaactgttaatatgttgaccttgatatgctgtcagctcaagcaatgaatatgaactatttt

SEQ ID NO: 37209 - DNA, 404 bp, Triticum aestivum
  Clone ID: PAT_TA_37209
tcccggaccaaccatggacgcagacaagcaggttgtaaggaagacatggaaaaagggttagatgaaaggcgtcccgccgggggtccaaaatttcaacgggaaaaatgaatttcctaaagtcctacaggcacctggttgggctaagaggtgtgtttccctaaatcaatcaaattagtatgcattgctgaatatttgttgttgagcgattaggagtgatgctgtcatacgtgtattgacgtccccttggggttcagaacattcagacaggtagttgatgctgttcttaagcagtgtacggttatgaatggatgatgatctatccagcttggagcatgttgttactaatttgaaggttgctgtacaattggttatgagttatgaattaaggggagtgaattgtagtt

SEQ ID NO: 37210 - DNA, 430 bp, Triticum aestivum
  unsure (1)..(430): unsure at all n locations
  Clone ID: PAT_TA_37210
ggtccagnaatccgggtcgaccggggaagcaacaacactagcagcaggggcaacattctcaagtggctttttaatgccaacatcagaatcttcttgccgactggtgggaatagcatcatgggatccttgagctacagaaggatctacactgtcaacggcaaccaatacagaagcatcaacactaccacggccatcaacaacacaactgccctgattcagatcaacatgaagttccacgctatgttctccaacctgtggaaagtttaaaatacacagagtcaacctgtggaaagtttaaaatacacagagtaacacaaaaatgagcgtggggataactaacacaacaacacacaacacacttatgtcaaaagactgctgacaacatacacataacaactacagtccccatatgcaaaacaacaccaacaca

SEQ ID NO: 37211 - DNA, 433 bp, Triticum aestivum
  Clone ID: PAT_TA_37211
ggtcgggtgggtattataaggttcaggctggcgaagcccgcccttgacgtgtcaaaaagaaaatttctcattattactgatgaagattaaaaagaagggaacatagtgtttcttgccgatgagttgcgtcctgcttcagccacccaatcgttgctgtcaacggtttagtcaaccctggagacttttctactttgcaaagagtatatgcgaaactttgcttttccagaacactttaggactagtttaacagaggccacctgatttgtctatacactaatgattcaaaggtatctatcctgtaagttgcatcatgctattttccttttatttatttttgataaagggtggcttttattgcctcaaaatggagtatcaagaggatacataacacaatgagcacacacccggtctctgtataaataggatgcacaca

SEQ ID NO: 37212 - DNA, 398 bp, Triticum aestivum
  Clone ID: PAT_TA_37212
gtggtcgaacatgtttagcccactgggcggcttggacgcgcatgcacgaaggtacgcatcacgcacccgccacacgtgcatggcatgatgggccatcaagtggatgaggtgatcctgcacctcgtcacgatcgacgcactcgtgctctaaccagctcgcctgaccgcccatgtctctcacgcttcgacagaaacactatcgacacctcgaacatcattgtggaggacactataccgcttatgaagctccgtggactcacgctcatacacgccgagcattgtactccgctcatcctttagctcacggatctccacatcgttggcctcgagcttcatatccatgcgcagggattcctgtgtcaggcgcctcaactcagggaccgtggtctaatgggccaa

SEQ ID NO: 37213 - DNA, 393 bp, Triticum aestivum
  Clone ID: PAT_TA_37213
agggtgaacatttatttacagcaaaataaaaagttttattttattttcttattagttttgttttaggtataacaggagttctataatagatattggtttgattctttttgcacctagtttgtatgttgttttcctttatgttagttagtaaaaccattgttttggatctgtaaagaaaagtgttagtaggttaaaactacttctttgttgttgcttgatgtgatggaaaccttgattttgttttcctcgagttttctttgattttggtttgagtgcttgtgtgttttccttcagtttgctgatatgtcattagtgaaatacttatttgtgctattgtttgacttgatagaatttccggagtgcgaagcttgctatctcgagtcactagcgttt

SEQ ID NO: 37214 - DNA, 385 bp, Triticum aestivum
  Clone ID: PAT_TA_37214
catttccatagccatttcgagatatattgccatgcaactttccatcgttctgtttattatgacacgctccatcattgtcatattgctttgcatgatcatgtagttgacatcgtatttgtggcaaagccaccgttcattattttcatacatgtcactcatgagtcattgcacatcctggtacaccgccggaggcagtcatatagagtcatatcttgttctaagtatcgagttgtaattcatgagttgtaagtaaataaaagtgtgatgatcatcattattagagcattttaccagtgaggaaaggatgatggagactatgattcccccacaagtcgggatgagactccggatgaaaaattaaaagaaaaaggaaaaaagaggacat

SEQ ID NO: 37215 - DNA, 416 bp, Triticum aestivum
  Clone ID: PAT_TA_37215
ggcggggttcaagacccgtgaagtgaacgtgcggtctccggcgaggaaaagtagaacatgggagacgggccggccagttggcacaccatgccctgccgcctcccatgccctactcatcctcggaggagtccccgacctcggcggtgccggacgttggacggcggcaagtaggacgcgtggttgacggtgctcccgtcgccggctaccagcgtggccactgcttgtgtggcgacttgagcgagggcggcgacctcgagctccatccccgaagacaagctctcccatagagcgtttgtgcttgcggtcatggcagatgtggttccaggtaggaggacgatgcgctatggtgtggaggttagctgggtgttgccgctttaagtagcgcattccggtgaggccaagcgtcctggtgcatc

SEQ ID NO: 37216 - DNA, 462 bp, Triticum aestivum
  Clone ID: PAT_TA_37216
cggtcaagagaagccgaagtccatggcagccctcacggcactcatgacccccttttgcatgggcgaagacaacttgctagcctgtagcagtaatactacaagcgatcctggcacttctgaagctaagaataacaacggcaggccctgacgcaacaaacacaagcgccgcatcaataatgacaataccgaagacatggcggtcaacgccagatttagcggcactaggaccggtcagcggaagaagccattcaaaagaaatagagagggctcatccagcctggaccgaatactcgatcgaccctgccagattcatggcccctccgctaacctgtctatcatactaaccgaagttgttgggtctttaaacaggccgataagttaaatactgagcataacgagaaagggtcgccgagcgaggacgacgacgaggagcctcgtcaaccacacactgggggacagaag

SEQ ID NO: 37217 - DNA, 474 bp, Triticum aestivum
  Clone ID: PAT_TA_37217
tggcgatggacacgtgcaggaggacgacgttggcgtcgcggtggtgtcgatggcagagaggcctggcaacgtgcgcatgtggtgcccattgaaagtgcgccagaccggtgtgtaacccagttcaagtattgtggcttggatggggcatccggcattagttgtgaggtgttggtgcaatgtctgtttggtattaggcttggacattcgtcaccccttcatcacgggtctaggagtagcaacatgtattgtcaagatggtggcttcaggcttactgatgtattaccttataacgactttatgaataattaataaaatggctgcatgcatcgcccagatgcagatgcagaggcaggggccagggggtatatcctccttttcaaaaataaaataaaattaaaacctttggtcaactcatttgcttagttatgtttgtctcatgggagggaaccgcgcgtgcaactggcggttcactcg

SEQ ID NO: 37218 - DNA, 410 bp, Triticum aestivum
  Clone ID: PAT_TA_37218
aaggccgcgcatggagagagccgagacaagatggccaagatggccatagaattaaaagccgccgctgatcattgccgggttcttgaaaaggaaaaccaagtgaaggcatcagaccttgagaaggctgctacgacgagaaaggacctccgctctgctatgagggcaaaggaggagctgcgggaagccggggatattgtagctgggaaatcctttatgttgtggaggatgttcggagatccacggtatgcccctctagatcgactatggagttcgtaggatgtatatatggatttggcggtgagcgctgccgatgcggccaagtatttccagggtcagacggaccgtgaagtagaccatctgttttggagacaatatcattcgcccgagcgtccgctttcattgactgacca

SEQ ID NO: 37219 - DNA, 444 bp, Triticum aestivum
  Clone ID: PAT_TA_37219
ggtccagatatccgggtcgaccggtagtccagaattccagttgccggcatttttcctcttcatgcaaaccttgtaaaataagtgagaaaaggcataagtattgtaccataatgtgtaataacaacccataatgcaataaatatcaatataaaagcatgatacaaaatggacatatcagttctcaagatgagagggcatcttattataatttccataagaattcttgtaggagttaccataattattagaggaattacaaggaaatggcccagggttgaaattacctctatatgcgttattaccaaaattgttcgtaccaacaaaattcacaaccatagattcattattattctcaatcaaacgagaggcaaatggcaaataatgtaatgcaacatatgagagtttatgatgggtacttggtaggattgatgtagatctccccgg

SEQ ID NO: 37220 - DNA, 424 bp, Triticum aestivum
  Clone ID: PAT_TA_37220
aatgttactgtctacaaagctcgacttgtcgcaaagggttttcgacaagttcaagggattgactatgatgagaccttctcacccgtagcgatgcttaagtctgtccaaatcatgttagcaattgccgcattttatgattatgaaatttggcaaatggatgttaaaactgcattcctgaatgggtttctggaagaagagttgtatatgatgcaaccagaaggttttatcgatccaaagggagctaacaaagtatgcaagctccagcgatccatttatggactggtgcaagcatctcggagttggaataaacgttttgatagtgtgatcaaagcatttgggtttatacagacttttggagaagcctgtatttacaagaaagtgagtgggagctctgtagcatttctgagattatatgtggatgaca

SEQ ID NO: 37221 - DNA, 479 bp, Triticum aestivum
  Clone ID: PAT_TA_37221
gaggaggtggcggctgcgaggagatgaggaaggaggagtgcgatgggaggagttagggtttggttggtcgggctgcgggtgggggtgggggttaccctttttcttttcttttttcttttttctgaagatagatggatggatggacgtgggatggagagatggatggatggatggggccatgtcatcgatccgtgtgacagctaattccaccaatgagaatagagcacgtgtaaatatgtttttcctttagtttttttctaatttttcatatgaaaaattcaaaaaatgatctcatattatacacaggggtgcattttgtaatggcaaacagtgttgcctaaggaagtttttattttctatccacgaaaaattcatttcccatttttcgagtgcccaaagtgagtttttttgtgaaggggactacatacatttgttgcaaatttgtaccaaatctattttccaatatactaggacatatt

SEQ ID NO: 37222 - DNA, 509 bp, Triticum aestivum
  Clone ID: PAT_TA_37222
gcctgggcgtacggtccggtagtccgggtcgacggggggttaagacgcatttaaagttcgggtgaacaaagatatgatattagtacttcggtacatacaatcattatacataaaattcttttacccaagtcacttgggggctcctaaatttatatgagccattttataataagtgttcttcttcttagtcgttgcaaagtttttattactattattatttatcactccttttttcgacatgagcgtgtggtcactagccggggagcctaatttctctctcaaagccgctagagtttagtttggtaaactggcctaatgagaagtactccggcctcgggataggaggttgaagccgtaggctgacccgcttgaagtcttgagataggatgtgtcatgttaaagcacgatagaagcacttctttttctaaggccaattttcggattggcaccgaacacttgatcctgttcggacgtcaagtttttactgacgttttttggttttccaagct

SEQ ID NO: 37223 - DNA, 421 bp, Triticum aestivum
  Clone ID: PAT_TA_37223
gggtcgagcggtagcattccttgatatgctaattatgctaaattatattgttgctaaatttataccacctagcttcacataccagcaaaagaaaaaaaattctatgacttgcgacattacttttgggatgacccacatctttataaagaaggagtagatggtttcattagatgttgtgtacctgagcatgaacaggaacagatcctacgcaagtgtcactctgaagcttatggaggacaccatgctggaaatagaactgcacataaggtattgcaatccggtttttattggcctaccctcttcaaagatgcccataagtttgtgttgtcttgcgatgaatgtcaaagaattggtaatattagtagacgtcaagaaatgcctatgaactattcgcttgttattgagccatttgatgtttggg

SEQ ID NO: 37224 - DNA, 348 bp, Triticum aestivum
  Clone ID: PAT_TA_37224
aggattcaaagctgagccacgaaatcggtttggagttgagcaagatgagtgcttccgccggattaagaccaattggagcagtggtctttatgcaacgtggactgctgaagatttgcttgaggactacagacaatacaaccaacacagcagagatcgccaaggcatatggcggaggtggaaaggcgagctcaagttctttcgcactaaggatggacgagttcaacgcctggattagggagaacacatgaaccggcctggaatgctggatggcaatctggtgtatcatatcgtaacatgcgtgcatgcctagttgcgaggaagatgtgaaaaatgagcagctgatgttgg

SEQ ID NO: 37225 - DNA, 444 bp, Triticum aestivum
  Clone ID: PAT_TA_37225
gcttgatagagggtcagtgctcgaagaatattatgttcgagtaaagtgtatcataattgtaacaacaatattatgatatgtttaaggctatgtttttatacttctccccgaaaagtttcggtcgtcggcttcagccccctcgcgtataacacgggggtgtttggaaaagcacttgatcacacttgacccaacgtcttggtccgttaaggaggtgttagtgcggcaaactaggcaatcgaactatagagctttaacactttcacttagccatatgagtttgacagtggggctactatatagcccctggtatgtccgtggttattcaaatacggtgcgtatacatacgtgaccagaaggacggtccttcgcttaacacgaagggaatcgcgaagattctgatgagtcatcgagtggttgactagctctcaccgcatcatgacagtc

SEQ ID NO: 37226 - DNA, 426 bp, Triticum aestivum
  Clone ID: PAT_TA_37226
tacatggcacttcaccttattagggcctaagggaatgcattgtggagtagttattagatgattgattgcgagagtgacagaagcttaaaccctagtttatgggctacttcgtaagggattgatttggatccaaaagtttaatgctatggttagattttatcttaatacttttgtcgtagttgaagatgcttgtgagggggttaatcataagtaggaggtttcttcaagtaagaacaacacctaagcatcggtccacccacctatcatattattaaagtagcaaacccgaatcaaaccaacatgatgaaagtgactagatgaaattcccgtgtaccctcaagaacgttttccttatcataagagaccgttttggcctgtcctttgcctcaaaaggattgggccaccttgctacacttttgttaccgt

SEQ ID NO: 37227 - DNA, 432 bp, Triticum aestivum
  Clone ID: PAT_TA_37227
cgggtcgggcggggaaggggggagagaccacgcccatccagtcccgatgggtcgctcgattggatcgaccggaagtgcgggaagcatcgatgcgcgcgttgggatcgaccagaggatctgggtccagctgatgcgctccagcgcgcgattggatgcgaggtgcgcaaggggatcaacggaggcggacaatgcgggtgaagaaaggtggggacgagggcgaggcggtggcacgagcatggaatcatctgctgtcgattcgagttcgtttgtcggcgattccgtaattaaatcgcagtttctacatgccattactggtaatggttgcaggtttttaagctcgttggaacttgcttacggtgggtttgctctttgctggttctgcttgattgcaagcatcatggactatccaaatgcaaacatgcgcaactttcc

SEQ ID NO: 37228 - DNA, 494 bp, Triticum aestivum
  Clone ID: PAT_TA_37228
acggtccggtagtccgggtcgacggctaaatcgagcaaaggcgaccagcgatggcgatgacgtttgctttgctccgctgccggctgcgatcgcaatacgtacggtttttcaggcagattggcaatacacattttttttgaggggtaattggcaatacacatatgtaactctcatttcccagccgaacaggcctggcccaattcatcctgcttcttcttttccttttctctaatttcttaccaggctgacatcccgtgtcgcgtgttaggcgctccctatggattttttttctgtacgcgtctttgggctctagatgttttttttggtttattcggctttttggtttttgcccagtccccctaagcttcggaccaaaaaatttcaaaaaaaaaatttgcttgaagaaacatgtttttttcttccgcggtagacatgggtttgctttccatggaggcacaagtttgattccatgagaggcaaagacacctgtgcct

SEQ ID NO: 37229 - DNA, 365 bp, Triticum aestivum
  Clone ID: PAT_TA_37229
gggtcgggcggagacggatgccaagaaacagctgtgagactgagcaagccaagcgccgcgctgagggggacaggaagagggaaagcgaacggttcaaaatttccctgtttggtcacgccatattcagatattctccccccttttcactggagaacgcaatgcgatgcaagagaaaaatagcctttcctcttccgttattcgatgtttgcagtagcaagtagtggcactcctagatgtattctcttgagttggttttcttttctctatcctctactatggtaagaagaaagagatgtttgaagactcagaaataagtgaattaagtaaaataggatttgtaacaatggtgcatgtgaagcttaagg

SEQ ID NO: 37230 - DNA, 433 bp, Triticum aestivum
  Clone ID: PAT_TA_37230
ggaatgggtaaagaagctcttaatgttcgagcagctgcagaactatttgataaggcaaatgatatacttggctatgacttgctgaatctttgcatcgatggaccaaaagaaaagctgaactcaacagtgatcagtcagccagctatatatgttaccagccttgcagctgtagaagtgttacgcgcacgtgaagaaggccaatctgtaattaactccgtagatgtcacatgtggtctcagcttgggagaatataccgcgcttgcatttgccggtgcctttagctttgaggatggtctcaagcttgtcaagcttagaggagaagccatgcaggatgcctcagatgctgtcaatagtgcgatggttagtgtgattggtctagattcagaaaaggtgcaacaattatgcgacgctgcaaatgaggatgtggatgaaa

SEQ ID NO: 37231 - DNA, 413 bp, Triticum aestivum
  Clone ID: PAT_TA_37231
ccaccacggaaggccgggtggccgactggatctatgccatctccatgggcctcgccacgggcatctttgtctacgtctccatcaaccacctcctcgccaaggggtacatgctacagaggcccgtcgccgccgacacgcccgtcggccggtggctctccgtcgtgcttggcgtcggtgtcatcgcagtcgtcatgatatggaacgcctgatcctgaattcgtgattcatgagaactagaagcatttagctatggatgtaagcctattgtgctgctataagtttctgctagttggacaccagatttgcagtaccagctgatcaaatgaagcagctaatgacagataaacataagcactaaatccctggttgtttcaatacgcatttagtgtgtgtgtatatatatatatatcaac

SEQ ID NO: 37232 - DNA, 253 bp, Triticum aestivum
  Clone ID: PAT_TA_37232
ttggatagcatgcaaccactgacatcgcataagtttggcgaacgctttaaaaatatatttaaatacgctgtagtgcaaaactgccaactgaaccagatttgaaaatcaggtgtaaaactcaaaatatgcattgaatgaaatatgttttgcataacagtgatttagaaacctcacatgacatctccagattttggttgaaatttgtagataaatttatcaaatgctggtacttcataaagagctccaaaactaa

SEQ ID NO: 37233 - DNA, 284 bp, Triticum aestivum
  Clone ID: PAT_TA_37233
agactcatctatgacgccacatgcactacacgataccggggattgtccgctcaagagggtagaatcgttgatcaacgaccatggaccattgtcactctccattgtggcagcatcagataagatcaactacattcgtttaggggaaaatgcaatgcaagacttgctgggtaagacggtttgatcaccttgcaggaaatcatcaatattttggcggatttcaccgcgttggggggggaacttgtcccggatcctgcgaggttcccatcgaaaatgctcatcgagaa

SEQ ID NO: 37234 - DNA, 419 bp, Triticum aestivum
  Clone ID: PAT_TA_37234
cggggagaaagatgtgcttctccttggagacgacccttgggagtcatttgtcaatagtgtatggtacatcaagatactttcaccagaggatgtgcacaagttgggcaagcaaggaaatgatccacgttacctttcctaagtgcaagatcattgtgctgtttctgtggacttccatggagaaaattcagatttttatggcatctctgatccagcgaggattcgacagcacatggtagcacccttgctcacggcggcacaacatccccggaacctcccatcgtctcatcttcgtacctgtctcttgtgtgtgctccgtgcacgtctcgagagctccccgtccgttacctatctccgtccggtgcaagccaccgacaccatgaactgatatctctgtaggttcctcttgggaatctgtatcg

SEQ ID NO: 37235 - DNA, 428 bp, Triticum aestivum
  Clone ID: PAT_TA_37235
gacggggaaagaaaagcagaagaatcctgcagattctgctggtattgatggtgcaatagaaggtcaaagtccggcggaaaattgtaccgacagggtatctcgtgctaaacgagctgcagaacaagccaaacagaaacaaatagctgccaccaaacaagcagagacaaccctagttcttgcaacaccttccacagtaccaccagctgcacgatttactcgttggtcaactcagctagcagcacattcccaagctcccttgccacctgacactacttctgaagcactcttgacacaagatgagttggcaagatcagatgaactttgtgagcttcaagtgcaagaaggttgttgctggagtcaatttacagttgcatgcttctttatatgtagtctcacagtttgatgtacactaacacttcctatgtttc

SEQ ID NO: 37236 - DNA, 395 bp, Triticum aestivum
  Clone ID: PAT_TA_37236
acgaccagggactgtgttcatgtggatttcagttgcttgtttgacaagggtttgcagcttgagaagcctgaggtggtgccattcaggcttacacaaaacatgatcgatgggttgggcatcgctgggtacgaaggcgtctttctgaaggtctgcgagatcactctgtcggtcctcaggggccacaaggaggcgctcatgacggtcctcgagaccttcatccacgacccactagtggagtggaccaaagcccacaagtccagcggaggggaggtccgaaatccgcaagcgcagagagccatcgccaacatcacggcgaggctccagggcgtcgtggtgggcgtcaacgccgctccctccctgccgctctccgttgaaaggcatgcgcggcggctgat

SEQ ID NO: 37237 - DNA, 138 bp, Triticum aestivum
  Clone ID: PAT_TA_37237
acggggaagaataactggctgctgctttcttgcagggccaccgttcatcgttctctcatacttgtcactcttgattcattgcataacccggctcaccgccggctgcatacatatagatttatatctacttctaagtat

SEQ ID NO: 37238 - DNA, 420 bp, Triticum aestivum
  unsure (1)..(420): unsure at all n locations
  Clone ID: PAT_TA_37238
atacaggcggggaaggtaccggtgccgatgccgctactgaaaagaagaagcagaagaagtagaggatacgaaaacctaactaactcggcattggacgactggtgatcacaaagatgacacctggcaagtttgagccatttgagccggaacaacctcgcaagtgctatgggaaccaagtaggatgcatcctacaggaatgcacgagcatcaacgatgatgacttaaggagtcaagaacatttgaggcagttgctcctgacgaagttgtacaagagattcaagttccccgacagggatgataacatagaacaaccatgggatgatccgaagatgaaaaagattaacaatcacgccatgggcatgttcagcaatgatttggcctcctggaaagagagggtanacaagctattgaggccgaaga

SEQ ID NO: 37239 - DNA, 431 bp, Triticum aestivum
  Clone ID: PAT_TA_37239
gacgggttttgaagtacgcaaaatgatgtaccttctgacagttccgcatataaaatgcgccctgtgtagatagtagcccctgaggctcggtgtgttgtcaaaaatgacagcgcgccgaggatcataatcccaagtataatgtgtcgcccttcctatgtaggtggcgaagggtccggtggctagccagactgataaatttgctgaactaaagcggcaacttgacgtggcggatgccgacatcgcgcttgtcaagaagcgacttgacgagtcacaaggtatgcaatttctccgcagacacctggtaagggagcttgatgcccgtgccttacaacatgtatgcttgatgcagatggtgcagctgccatggagaaccttcgggcggagctcgcccgagccaaggagcagaccagatagagtgatgcggctgcctt

SEQ ID NO: 37240 - DNA, 403 bp, Triticum aestivum
  Clone ID: PAT_TA_37240
ggtgcacacactggttaaggagtctccaccagagaagcaagccaccacagctgaatccatcaacaactctgtcagaccttcacctcaaatgcatcccggtgtaagtaatggtgaaggctccggtgcgagcacgcagctgaaccgacacgaccaagccgcagtcattggagcgctgctcgagcagatgcagcttgacgagcagatcggtagtctagcaacatagacgaacaaccaaccgagcccggtggctggtgcgagaagaagttaccatttgttagctaaagaagaattgcaagtatttttttgattttctgttcattgaggtggtcagtcaacaagccaaaaggatggatgaatagctgaaggcggtgattcagggattggttttcgttaaatttttggg

SEQ ID NO: 37241 - DNA, 422 bp, Triticum aestivum
  Clone ID: PAT_TA_37241
tagctccttgagaaagatgccgaaactcatgtatagatcaacactccaatcatcaatgctccaagcatcataccggagattgactagtaggatcacaaaagtgatgcatctgtacatgaatttgactacatttcctgaaaaaatacccagaagaggttgagttaacaatatgtgagtttgaaaatgttgttcatattttactagtactatttgggtagggtatagactagacaagcataagtggaggtgaattagatgtctgaataaaaattgtcgataacatgtagatgaactgcacagacatcaaaaatcttattgctcccatcaatatccggcagattagactatagttattaagctataaatttgtattttctactccagctgccatagaaaacccaagttgaatcaacattgcaatt

SEQ ID NO: 37242 - DNA, 416 bp, Triticum aestivum
  Clone ID: PAT_TA_37242
gaggaggagcatgattggtgatgtcgtggagtattgctaccaccgtcatgtttaggtgtcctctctactcttttggtgtcccgatgccaaaggaggagagagtgtacggatttgcggtgtgttgtgagttgagtgtgtttctctttttgcagttgctttcctcgctcgaactcgtttgctttggtttgtgtttgagaccatatggggtgagacatatgagctaagctatccatttctatctatgtcaagtactttatgttaagtaatcgtttgtgagatatatcttgtgtatgctctcattcatatgctcacatagtttctcttgcatgctttcatcttactatctatgcaagtacggtttggtctataaaatatagggggggtggatcctatatgtgtgcattttgcattccaaa

SEQ ID NO: 37243 - DNA, 416 bp, Triticum aestivum
  Clone ID: PAT_TA_37243
tagatttcatgctctttccaaccctattggattcaccttcaaattcgtccggagcgttgagttacggacgaaacaatctgacgttgcagcagaatccgagtcaaactacaagcccaaaggtgttgcatcacctccacttgggcccatgagacttgtacgacctagggttagttttaggctgccttgggtcttcctcccacctccttggccaccaccccttgctcctatataagtagatccatctagtagcttttccttgggatttgtttagttaaaagttagccattgcaacttcgtgtacttcgtttgtgtccaacgaccagaccaagaccgcttccggatccccaccattatcaatacttcatatatatttgcaatattcagattgctttatcatattcttgctcgttcttcga

SEQ ID NO: 37244 - DNA, 245 bp, Triticum aestivum
  Clone ID: PAT_TA_37244
ctgaagaagcaggtcctaaagctgacggaagagagggacgtggccaaaggtgccttggctgacgcacaggccacagtcctcggcaaggttgagctgctctctgaggccaatgactccatcagggatctgaagctgaagctggagggccccagggaacgctttcggaggtcaggccccgggaggagaccctgaccaaagatctggaggccgagaggcagctacgcaggaatgatgccgccaacccc

SEQ ID NO: 37245 - DNA, 397 bp, Triticum aestivum
  Clone ID: PAT_TA_37245
gcaacggcgtctttctggttctgctcatggccaggtggatgacaactttgccaagccttccccgcccttttcgcaagatcaaccaggaagaaccgttcggtcaaggacgcactgcacgctgacagatggatcctggacttgaggcgaggtgaccccgatgccattgcactgcaggtggtgcagcttgcgagggaaatcaggcaggcagccctcgccatcatcccaggaaccgaagattctattacctggaagctcagcgcctcgggatgctacacaacaagttcagcgtacaatgcccaattcagcaatagacagattacctccttcaaatccatcatctggaaagtctgggcgccgggcaagatcaagatgttcctttggttgctgcaccttgaca

SEQ ID NO: 37246 - DNA, 398 bp, Triticum aestivum
  Clone ID: PAT_TA_37246
cgattgaagagattaatgttttgagtggaaagatggacgagcttatgaaattgtttgctagcaagagtgcttctatttatcctaatgatattcctttgttcactttgattgataataataatgaatctatggatgtgaattttgttggtatgaacaattttggtaataacgcgtatagaggtcattttaatcctaggccgtttcctagtaattcctctaataattatggtaattcctacaacaaatcttatgtaaattataacaagatgcccactgattttcaaaatagtgttaaagaatttatgagttcgcaaaagaatttcaatgctttggttgtagaaaattgcttaagattgatgatttggctaagaacgtggatagaatttctcttgacgttg

SEQ ID NO: 37247 - DNA, 411 bp, Triticum aestivum
  Clone ID: PAT_TA_37247
tacacgccggagacgacgggagggagctctgaaccttgtcgaaattctgaccgtgaaggaagtggaagtagaggagggagacgacgtggccaatggcgtgaaggcgatatggtgttcgatccgtgacgtagaggaagcaggggaagaagaccgcgacggggcgctggacttggcgatccggctcgtggaggtcgctccaaaggaagaagaaggccaccacgacatggacgacaccgggctcgagctcggcttggctcgaccggccatggcgacggcgacggcagggaggcgcgttagggaggctcccgcccaactaactggggggatcggtcgaggagggtgacggggtgcaggacgacacgtcgaagacgagcttgaggccctccggccgcgagaacgacgacgggcatc

SEQ ID NO: 37248 - DNA, 434 bp, Triticum aestivum
  Clone ID: PAT_TA_37248
acggtggcatgaagcagttgagtaggtgtgcgtggatacacactattcatcgcatttgtcatcgagcgattgcaccactatcttcagaagctcatcaccctgaggaaatcagtcaacacctcccagagaggagcttgaaattttccaaatggagttcaaacgtgaatttgagaaaatgattccttggctaagttccaaaaatgtcattctatgaagttcggctattcagccatggactagtcaatggtggagttgcaattttgtttcttttgtacatacatgaattgaatgtaatcaacggaaagaaacatatgttgattctccaagttagagttcatttttattttctacaagtagcaaaacttcctgtgtagattaatacatgttctgtgcgatcttgtgttacaaatcttgtagtactgtttttacaggga

SEQ ID NO: 37249 - DNA, 395 bp, Triticum aestivum
  Clone ID: PAT_TA_37249
aggatagtacctctctgcaccaggacggctaaggctctacaatccaattacgaagactttcactgatttcgagatgagaaattccacatttgttggtacttacactggaagtctgttgtctacagagagcactttcacttctgaggctgaacgttgcactatctgcggctgctatggcacccttgaagccatcgaaccttatgcactctgtgaagactgtatgtcgcatcaagccttgcttttattgcagcgtctggaaggctgcgctgaactgggcacgctttcaagaattaccaattgccaatagacaatttcaaccatggtccagcaaaaatagttttcaaatgtcagcctagttattttttagagaatattgctgctaacctgttcctttt

SEQ ID NO: 37250 - DNA, 406 bp, Triticum aestivum
  Clone ID: PAT_TA_37250
tgtgtttccgttgactataataactccgcgaggtcctggcatcttgagcttgaggtatgcataatgtggcaccgcattgaatctagcgaatgcggttcgtccgagcagcgtgtggtaaccactgcggaacgggactatatcgaagattaactcttcgcttcggaagttatccggggatccgaagaccacttccagtgtaattgagcatgtgcagtgggcctctacgcctggaatgacgcctttaaaggtcgtctttgtgggtttgatccttgaggggtctatacccattttgcgcattgtgtcctgataaagcaggttcaggctgctgccaccgtccataaggactcgagtgaggtgaaatccgtcgatgattgggtctaagactagtgcggcgaatccgtcgtga

SEQ ID NO: 37251 - DNA, 384 bp, Triticum aestivum
  unsure (1)..(384): unsure at all n locations
  Clone ID: PAT_TA_37251
ttatagtgaaaatcttaggaagagagttccctattctgaaatatctcaatctttgtacgttgaggattttgaggagtttgattggattactagaggaatttatgtaggattcagcagggattggttgagtaaaatgatgaaggaacccgctaggaatgagctacgcattttatatgatgatatatacggtgatgatcccgactatgggtttatgaatgttaaaattacaaatcaaagccctttccatgatttaagttcttcttctaaaagggaaataagggaaaggatagattttctaagacgagttttggaggatttgataaggaaagaattgcatgccgaagatggcaatacctagatctattcgtgtntttatgcctggct

SEQ ID NO: 37252 - DNA, 347 bp, Triticum aestivum
  Clone ID: PAT_TA_37252
ctcggcatctcgtcgatgaaaaggaagagccctcctgtgccttggtagagcatgagtaacagtgtctccaattttctaatatggatgcattgccacgagaagcgagaacttgttaatttgaatggttccatttttgcgggaaatgcagtaccttgcaatcactttggcgttattagtaggtgtcgtggttctaagtctgacagtagaatgaggggtaggtatgaggaggcaagatcctagctacgatgaggttgtgcacgcaagatttatttacgagttcaggcccttcacggaggaagtaatagccctacgtctcagtgcccggggcctcggtcgattggattatg

SEQ ID NO: 37253 - DNA, 282 bp, Triticum aestivum
  Clone ID: PAT_TA_37253
ggtgttggtgctgacgcagttcatgtataccactgtcttgtgtttcatctctttcactgtcgtgttgacttgtcagaacgtgctggtctctgtggttctgctgtgtgccataatgtcctcctggctaatctatgcgacttttcgccttgatcgactaaacaccatccactctggggatcaatctcgtcaactcgcttcacaacatagacaggcgcatgcgtcatcttcaatcaggcattaatgaacacttttaaccctcgagaagcgtgtgttttcaaattc

SEQ ID NO: 37254 - DNA, 363 bp, Triticum aestivum
  Clone ID: PAT_TA_37254
gatgaggatggtgacttcgcggagggcgaagaggaaatctcggaaggagaggagtatgacaaccccaaggccagtgacgccaagaagaaacaaataggcgagggtgaggagaatggcgaggatgatgaggaagaacaagaggagcaggacggtggaggaggtgacgacgatgatgatgatgacgacgatgatgacaatgaggacgacgacgatgatgacgacgatgtcgctgctgaagacgatgaggatggagtagaagaggaggatgacgaccaggacaacgacgatgatgaggaggacgatgacgaggactcgctccagcccccgaagaagaagaagaagtgaagcccttcgacgcggctg

SEQ ID NO: 37255 - DNA, 417 bp, Triticum aestivum
  unsure (1)..(417): unsure at all n locations
  Clone ID: PAT_TA_37255
gtaacggtcagcaggtcgagggcggaacacgggacatcgggtcattcccctcaatcctcggtccaatccgccttccctcccgacctccataaattaagggaccttgcaacctacccgttgccggaagcttcttcaacttccttctccccttctccttcggctcccaactccctctctccgatccagcgatctctcgggtctcgcggccgatggcggggccgatccgcgtcaccatggaggtcggcgccgacggcgtcgcgctcatcaccatctgcaacccgccggtcaatgctctgcaccccatcatcatccangggctcaaggagaagtacgccgaggcccttgatcgcgacgacgtcaaggccatcgtcctcaccggcgcggcgggcaagttttgtggaggcttcgatattaatg

SEQ ID NO: 37256 - DNA, 414 bp, Triticum aestivum
  unsure (1)..(414): unsure at all n locations
  Clone ID: PAT_TA_37256
ctccctgtcccatataggctccgccactctgtaaccgccgggaccgagtttgtgttcccctaagttcaactcccgcatttctttcccccactgacttgattcggaggttgcgctgctctcgcatttgatcttgaactccttgtagtcatcttcgctgatcgaaggatttttcgccttgatcttctcataactatcacctttgtcaatcattctcttcaccgcgcttctccaagtagacagggccgtgctcatcgtcgtgagggcgtcactgttcactttattccctgagaggcgtgtgttttcaaattcagccgcgaacttgtatcattcgtgcagctttgtgaagaggagtgtcggtgtcaaaaccggcggatctcgggtanggggtcncgaactgtgcgtctaagcggatgg

SEQ ID NO: 37257 - DNA, 247 bp, Triticum aestivum
  Clone ID: PAT_TA_37257
atcgacgacgtagttcattgctctcaaagctgacctgatggctaggggtgtacgtatggatctgctcggaatggcacccgagtttggccgcaagtgcaagcctccgaataagaatattcggccgggggagtagcattccccttggttaacaaccttggaagagatctccagagtctggcaaccattttgggacaggttaacggaaggccggattgaaaccacaatttccaagtcaaaactggtcgat

SEQ ID NO: 37258 - DNA, 392 bp, Triticum aestivum
  Clone ID: PAT_TA_37258
gctacccactgacatgccttgcttgcatgatcacgccagatgtcaccgctctttctacttttaacacatggtgggcccataacccacagttccacaggatcgagacctgactctcctgtacaccctgttgccaaagttattcctagagcttgacttcgtatgtagttcacgggccacctgcctagtgatctattctggtatcagacgcaatacatattcccattgctctgaacccctttcacatttcgtatcaggcaacgaacgattgcctatgcgcttgaaacttctactttgcacattcttactttgctctcgataatttcttaagtttcaattcaagagttatttttcgccaccttccctaatgttatctaccggataagcacccatgc

SEQ ID NO: 37259 - DNA, 325 bp, Triticum aestivum
  Clone ID: PAT_TA_37259
gatgagagcatctacatgcgcggcatccacggcatcctcgagcgtgatggtggctagtcgctcgatgtggacgcacacgaggtcttccaccacgatcgcgacctacacagcaagatggtacgctacccgcgcgaagtgcttgccagtcttcgacatcgtccttatggccctggaggcgcgtacggggccgctgtttgcgaagcatattcagagcaagatcgacaacatcacgtcatccatttgctggacgaatctgaatccgtgagctactgagaggatggtgtcaatcagaggtatgataattcgatgcagctcagtcatacca

SEQ ID NO: 37260 - DNA, 328 bp, Triticum aestivum
  unsure (1)..(328): unsure at all n locations
  Clone ID: PAT_TA_37260
gggtcgaccggtgcagtttttgcaagtgtgagaacaagtaatacagtacttcagcgctagttggggacacctgatttcccatgcatccgtctatcatcatgtatcactgcttgaatataatcaagcatggctgaagaacattttggtcctcggcgtcgtcgacctggtgctcatggccattatttgcatgctgaagctctgaatctcagccccatccccatatgtatccagcgtgatggaatcgatgtagttcacatatgtatcccgggcgatgtatctgctttagcaccgtatggttttacctatctggttttcagagcaaaanana

SEQ ID NO: 37261 - DNA, 351 bp, Triticum aestivum
  Clone ID: PAT_TA_37261
cccgggccgccggggaccaaaagtatccaaccccccgatctagggtttcttttccccaccgcgcgggcacaacacagagagcggcggcggcggggaggagccggcgtggaagacgatcgatctcgggggcggcgcgctggagacgcagatgggtggcggggttaaagccaaggaggagtaccgctttggctcgtccaaggtttctcccttgcctacggtgaatgccgaagaagtggccgctgccaaggggaagaaatccagggcgaagaaggctgcgtcgcggatagacttggacaaggctgaatcccttgcgtataaagccaggattaaggcgacggagtctgccagggt

SEQ ID NO: 37262 - DNA, 411 bp, Triticum aestivum
  Clone ID: PAT_TA_37262
gaagacgataacgataatgaggatgcccgggctcttgtgaccggagccaggttctcatgtaatgatctcgaatgcagtttgtcaatatcacctgaaacggaccgtctgacatctcctaagctgaagatggcctttggtcttagcggcaacctgcaaagtataatgctttgaagaatcaggggatgaattagatagcggtagtacatcataccacctgatggagaaaaggagcctagagaaaagcattctgcttgagctggaacgcgatcatcatctcaaaattcaagaggaagttagaagtaagttatcttcgttggaggtatgccaccaaaatgaaatccagagaacaatctctgcatttgctcgacttcagaaatatgcagaatcacgaaaagagatagatagaaggct

SEQ ID NO: 37263 - DNA, 410 bp, Triticum aestivum
  unsure (1)..(410): unsure at all n locations
  Clone ID: PAT_TA_37263
cgggtcgaccgggatttattggaaagaattaaacgcaactctgaagattggggttccgacgatggtaaggagtcaggtatgacacctaagtttgattgtgttatatcttttatggataccgatgcttttcgtggatttagtgctaaatatggacttgactctgagatagtagcttctttttgtgaatctttcgctgctcatgttgatctccctaaggagaagtggtttaaatataatcctcccactgaagtaaaagtagttgcacctattacagttgaagaaaagactattacttataacgatcctattgttcctactacttatgttgagaanacaccttatcctgttaggataaaggatcatgctagagcttcaactatggttcgtaagagtaatactagaacatatac

SEQ ID NO: 37264 - DNA, 405 bp, Triticum aestivum
  Clone ID: PAT_TA_37264
cccgggccgacggggtcagcaataactctgacccccaaattctggaaataatagcaattagagaggctcttgctcttgcagaggatctttacataaacaaaatgtccattgcatcagattgcaagatggccattgatgcgatcaaagaagggagttccgctgcctttggagcaataattaaggagattatagctagaacgagcatttttcttcatgtatttttagtcatgagtataggacctcgaatgtacaggcccataatctcgcaaagtatgctttatccttaggttttggccgtcatgtttggttacgccagatcgaagatctcgtatttatccttaccaacattgcgaagcagtaataaagttttgcgagatactcagaaaagaaagataatgttggcat

SEQ ID NO: 37265 - DNA, 391 bp, Triticum aestivum
  unsure (1)..(391): unsure at all n locations
  Clone ID: PAT_TA_37265
ttgaagaccatgtaggcagcataggttgtgtcttgggagaggatcttgctatttatcttcccgcggatctctaaccagcaaacatccctgagttgagcaccttcggagaacctgtcgtagacatanggtcagaacttgcaaaagaaagaaaaaaccaatcaacagcgtaagttgttaaaggaataatgcccaaaaggcattattaaattggtaatttaanattccctaanaccatgataaaggttaataatccatgctagaattgtattaaccggaaacatgatacatgtgtggatacattgacaaaacaccatgtccctagtaaccctctactacactagctatttactcaaatatggtaaagtttccaacccatacacatgtgttgaca

SEQ ID NO: 37266 - DNA, 266 bp, Triticum aestivum
  Clone ID: PAT_TA_37266
aaccccaccatcacctccagggatatccagacctccgtcggcttcatcccccccggggatctcgccaagcacgccgtctccgagggcaccaaggccgtcactaagttcacatcctcctagactgaccgattgcatttggtttccgcatctgcatctgtactcttgacactgcgtatctatcgatcagcaggtaaaggtcgccgtactagtacctgtgctgggtgattgccaacgctttgttggcccgtaggttgtcacaactgaaa

SEQ ID NO: 37267 - DNA, 402 bp, Triticum aestivum
  Clone ID: PAT_TA_37267
cccgggccgacggggaggataatgaactggggatccaggtgcaacgcattgacttggtaatgcgagagcacggcgttgaagaaatcggagaaggggggattaggccagcctagagggcgtgaagatgaatggggatctcggtggctgtcctatcaatcgcggagcgggaagtaggtcaagccaccgtcaccttgcactcattgaaatctgaggcgagcatggggcaaaccttgtccattgcttcctggttgagcaccaccgaccgctcgatggcgggctcgaggaccggcggtgtctggattgaggtgtgggtcttcttcttccccttcttcttctgtttcggggcgcagcagagaggattggagccggttcaagccatggcaggaggcagctgtttctggg

SEQ ID NO: 37268 - DNA, 120 bp, Triticum aestivum
  Clone ID: PAT_TA_37268
cgggtcgacggcttttaacataagctcattcaggcacattggccaccccgccaaattcggcttcaacgatgacttacaggccttagtggcaggccatgcagcaggctccgcggcagaaaa

SEQ ID NO: 37269 - DNA, 384 bp, Triticum aestivum
  Clone ID: PAT_TA_37269
gagcacacagcaacaacacacacagatggggttagtgtccctctagagatctcgttcaagacgtccaagtgtgtcgagatctagagatctctgttggtttttttcatcaaaaatgccaaagcggaagaaagcctggtttcgtgatgcagatagttttgaaactcgcattacacttgaggcagaccgaggattccttaacctcttggaccggacgcaagacagtctcaggaatgcacgaaacaatgcgccaaacatgacgacgaaagtcttgggtgggtttgttagaaccttctactttgatgaagaatctaatgctgatgtcattgatggcgaaatgcaaattgagtatgatctagaacagatcaaagtataccctatcacagt

SEQ ID NO: 37270 - DNA, 371 bp, Triticum aestivum
  Clone ID: PAT_TA_37270
aggagatcaaccgcgctcgccctctctggtttgctactgctggtgctcatcggactccccgacgccgccgtcgccgccaacatgaccgatgtctgcgtcaaggccgccgtcggccaccccgacacgctcggcgactgtcccttctcccagagggtgctgctcacgctggaggagaagaatgtgccctaccagatgaagctcatcgacgtcagcaacatgcccgactggttcctgaagatcaatccggagggcaaagtgcctgtgtataacggtggtgatggcaaatggattgctgattctgatgtgatcactcaagtcattgacgacaagtacccatctccatcacttgtcacccctcctgagtatgcatc

SEQ ID NO: 37271 - DNA, 413 bp, Triticum aestivum
  unsure (1)..(413): unsure at all n locations
  Clone ID: PAT_TA_37271
cgggtcgacgggactctagctaattgctcccactttcaatatgtatccagattgagactaagagtcatctgatttggtgtcaaagctttcgttgacgtaaccctttatgacgaactctttattacctccataattgagaaatatctccttagtcctcttaggtaactaaggataattttgtccattatccagtgatctactcctggatcactattgtcctcccttgccaaactcatggcaaggtacacagcaggtttggtacacagcatggcatactttatagaacctatggttgaggcatanggaatgactttcattctctctctatcttctaccgtggtcgggttttgagtcttactcaacttcacaccttgcaacacaagcaagaaccctttcttttactgttcattttg

SEQ ID NO: 37272 - DNA, 359 bp, Triticum aestivum
  Clone ID: PAT_TA_37272
cccgggccgacggaaggggcaattgaaagttggaaggaggaataaactaattatagtatttattgtgactaaaagttgctgattagcaactaaatcatactgcatattgaaacaagcacttcaggccatctatgtgttaagagtttaggggcatagcttccatcatccaactaaactacacaacttatactaacccatataagttttaacacttcactgatattcttcataacccatataattgtccactagtcagtaccatgttttgaccttgttgatcttcaccaaataactgggaacattaaaacacctaatacaacagtataaactaggctgtcttcaccagtataacacgaaac

SEQ ID NO: 37273 - DNA, 258 bp, Triticum aestivum
  Clone ID: PAT_TA_37273
ggggatgccaattgatgaatttgtgggcaatggcgcctccaatgttgatgaacaaccacctacagattatgattaaggttgtggtgctgccaagggttcaaaccccgaagaattcaaccgcaacctttaagaagctgcccaaattcttaagaaagccaaggaattcaagattggcaaggaccaccaagaaggcccaaaaacctttccgtacaaggccgcaaaggctccgttcaaccgccttggaattaaggccaaaaa

SEQ ID NO: 37274 - DNA, 358 bp, Triticum aestivum
  Clone ID: PAT_TA_37274
aggacacgtaaacatcttttcggcagcgcctccacaaatctcgtcgttccaccacctgttggaacagatgatagtccatacatggaaactgctacaacctcagcgattgacatactgatcgtggggggaacgggaacattcatcgggcattttacagactgcgtcttcgcccattcctagtttaatatcactgaaatgtacattgtgttttggttactgtaccaactcgatatcaggtcatacagcatcatcacccggccgaaatcggccggcaatgtggttggtttttgttgcctagattgctatgtccgcatatgagtggatccgcctgtccatgtctcagcaacaacttcccgtc

SEQ ID NO: 37275 - DNA, 381 bp, Triticum aestivum
  Clone ID: PAT_TA_37275
cgggctcgacacaagacaggtacagacgcgcactgttggaccctgaggaggttccggaggaacacaacatacgtgcgtcactcggcacctctgagtttgcgcaagaagtttctggaacattcagtctttatggaatggacagtcagaacatactaacatcacttcctctttgtcaccatcgttcacacatacgggccctcctgacaatcgaagggaaccacttccaccagaccagtgcattgtaataatagcatcatgggcttcttcagactcagttggatataacccaatgcacttggtgtctacgtgcatcctctctaagcaacgatctatcggccaacgcactcattctccgtgtatatgtctcagtcaagttgacta

SEQ ID NO: 37276 - DNA, 403 bp, Triticum aestivum
  Clone ID: PAT_TA_37276
cgggtcgaccggcggggcaacgatgcaggtagatgaagtcgagcacgggaaagctactagacaagggtttgcatcgagacgaggagggaaacaacaggaaacggggcgacaacatgccaaagcacagttttggctgatgcatcccatggtcgccgcgtgagctggcatgcgcggcgcgtcctggcaaaactgaccatgcccagtgcatttatattagtaccctgagtccaaacggagcaacaagtcggctcaggggcaaagaagagaaaagcaggaggggcccaaacatatcagcagcaacctgtttgtgttgtctagtggagacacaaacttggcaacgaaggaactgatttgtctggggcttatcatacactaagttgacttttatcaccaaaactcagct

SEQ ID NO: 37277 - DNA, 207 bp, Triticum aestivum
  Clone ID: PAT_TA_37277
cgtataatggatgcaatttggtagagttgcttccatgccttgcatttttcggtcgtcttgtgtgttcgatcatcctaacatcttgataaaagagctattgagaaagtacatcatgggtgagacccaagagttgaatgtcgtcttgtaaaaattattgttgaatgatgactatgtgatataagcagaagggatgagcgtgtgaccatc

SEQ ID NO: 37278 - DNA, 408 bp, Triticum aestivum
  unsure (1)..(408): unsure at all n locations
  Clone ID: PAT_TA_37278
gggtcgaccggtggcagggactaccgagcatgctgcgatgtgacattgagcggcccatttaatgcgccctgtcagcctgtagagttaggtatgatagcactgtttgctatctaatcagtgcataatgattgatttgccacatggtgaccccttgacctataaaaggaggctcatggcaaccatagaaaggattcggaccctcacacgtccttgggcgcgtagccgttctctcncgaggcaaaccctgccgggaaaacgtgctgcgctcaccaccatttttccgcctcacggtggcccgagcctgggtaaaactgcccgcgtgatctctgtcatgctgctcaacgctcccctgctctttgtgcaatgtgtcatccccccgtcgaaccagcaagggactcctggtcccat

SEQ ID NO: 37279 - DNA, 253 bp, Triticum aestivum
  Clone ID: PAT_TA_37279
gctatgatattagcaggaaaatatgacccgcattgccatcttatgcaggctaacaccggtaaccatccatcgcacacttggcgagcaattattattgggcgaactgtcctaaacatgggtctcatcaaaagggtgggaacgggcacagagatcaatatttgggaagataaatggatcccgtctaatccgtcactacgccccttgtggaaacctaataatactcaccttactctagtgtgtgacctcattcgca

SEQ ID NO: 37280 - DNA, 338 bp, Triticum aestivum
  unsure (1)..(338): unsure at all n locations
  Clone ID: PAT_TA_37280
aanaagaaaggcaagaagaacgtggagaacttcaagatttacatcttcaaaggtgctaagcaggtgacccgacatcgaatccctccaagcatgtcatcatgaactccttcatcaacgacatcttcgagaagctcgccggcgaggcggccaagcttgcccgctacaacaagaagccaccatcacgtcacgggagatccagacctccgtccgcctcgtcctccccggcgagctcgccaagcacgccgtctccgagggcaccaaggccgtcnacaagttcacctcctcttaggctctttgtcaaatctcttctggcgtgtgatggattcatgtttgactgt

SEQ ID NO: 37281 - DNA, 355 bp, Triticum aestivum
  Clone ID: PAT_TA_37281
gcagcggctgaagctagcccggacatccggaccgccgtccggatcatccagacccagccagatcatccgggtccccctccggatcatctggataaccgcgctgaggatacccgaaggtttctcctgaagccagatcatccgggccacctcccggatcatccggacgacggccggatcatccggacccccatccggatcatccgggctttgcctgcgtgcaacgcttcgggccaaggcccatgtacccattcgccccctcacttaccccttcgcccactagactataaatagacctcctccacctcctttctagggttagcaaatatgatagctcattcttaggtgagctttgctc

SEQ ID NO: 37282 - DNA, 253 bp, Triticum aestivum
  Clone ID: PAT_TA_37282
cggtcaagaaatcccgggccgacgggattgcgtagtctagaatgagtgtagttgaaatgctcattttttacctctcgggatgggtgcttgcctggaaccctgggaaagggtacttttgtccccctatatggtgcaagataatctgccctgtttggggaaccccgagtcaacaagataaaattttcctattgatggcaatgcatttcagtcaaagtcaatgtcaatgtataacaattcaatcatgtactaaatg

SEQ ID NO: 37283 - DNA, 332 bp, Triticum aestivum
  Clone ID: PAT_TA_37283
gacgggaacttcaaccaaaaattctccccctaattttccaaggccaaattgacttatatccagaataggggacggaggtggcgggctagcaaaccacaggcatgcctggtgtcttttgctcaccaggtggccccccacctgtagttatttgctccagtatttttgatatattccataaaaattcctggtaaagtttcagctcatttgtagttgtgcaaaataggtggcctggcgtagctttttcaggtcccgatttccagctgccggaattctccctctttgtgtgaaccttgcatattatgagataaaatgcattagagttactccaaaaa

SEQ ID NO: 37284 - DNA, 124 bp, Triticum aestivum
  Clone ID: PAT_TA_37284
gataggatgccttaccagaacgtacacgcacacgaggcgacaccaccccactacgatcgagcatccctcccaaaaaaagccccatgatcgagcgcactaggcacaggcacgcaacgctgttggt

SEQ ID NO: 37285 - DNA, 343 bp, Triticum aestivum
  Clone ID: PAT_TA_37285
agctgaatgaagaccctcttctgccagttatttttgttaattcagacagattcgattgagatggcccaagatagataaattccgagcggaatttgtactagataatatcgactcattttcccatgtggaattttgagtgtttgtgctggccgatcgcttgtttgttgaatccagatagatttaagcatttcccagctgacaaaaaaaaaagaaaaaaaaaaaaaaaaaaaagaaagaaaaaaaaaaaaaaacataacagagaaaaaaactaaaataaaaaaaaataaacaaaaaaaaaaaaggggcccctcaaagggttcaagcctaacttccccgtgaatgg

SEQ ID NO: 37286 - DNA, 337 bp, Triticum aestivum
  Clone ID: PAT_TA_37286
tgcttatccatattgcttcatccatcgtaagataacccagaacttgaaaccttcaatcacacagaactcaaacaaaacctacgtgagatctgttagtataagaaaccaacccactactataagtactatagaaaacctattattattttgtttttgcattatatctactgtattctgacttttatatggcaaaaactcatcaaataaaaccatagaatcatcaaaacaagcacacaatgcaaagaaaatagaatctgtcaaaaacagaatagtctgtaaaaatctgaaaatttcgaatacttctgtaactccaaaaattattaaataaactttttga

SEQ ID NO: 37287 - DNA, 302 bp, Triticum aestivum
  Clone ID: PAT_TA_37287
gactgctacccccagataaaaaaactacagtaacacacccaatccacgacatgcttcccacatgataccatatattacggtgggtgaacaaattactgccgagcaattgatagaaaagtgcatagttatgatagtatctatgcatgaccatgaacatatgcatcacgtccgtgtcaagtataccgaaacgattctgcatctactactattactccacacatcgaccgctatccagcatgcatctagagttctaagttcataagaacagagtaatgcattaggcaagatgatatgatgtagac

SEQ ID NO: 37288 - DNA, 177 bp, Triticum aestivum
  Clone ID: PAT_TA_37288
ggtcgaggcgatgtagcattgtattacattggacgcctcgtgacgtgtgatggacatgcctgtagtatgaactgctaagtgttatgtagttcctttccggttgaaatggtaatccctgtcgatgacgagatgaaaatttggttgccctcagaaaaaaaaaaccaaaataactataat

SEQ ID NO: 37289 - DNA, 374 bp, Triticum aestivum
  Clone ID: PAT_TA_37289
gggtcgacggggctgcatctggcagagctgcagctgccgccccaaagggcaaccttcatcaaacacaaccccataacagggcctcaaggttatgtgccccatcgcccctctttctaaattactgaaacgaaaatggctaagcctgatgtgcctcttgtatctgttgctggatttgttatgatttgattcaccaagagtgattcttctacagtcttgtagtatggttaaatggaacaacgaaggatatttctaatttggttattgctagaataattcatggacttgatatatgctgggatgttttgcctgtccttactgaagaagatgagaatggaatttaattggatggtccctttcatcgtgcttaataatgt

SEQ ID NO: 37290 - DNA, 348 bp, Triticum aestivum
  Clone ID: PAT_TA_37290
gcggtggtttcaggggctgaggcagatggcggctcttgagcagaggcctccggttcagtcaggaccggctcttcgaccggtttagtcttctttgccctcttactgagctttgcttgagcactgataggacaaaaggttagtacaaaagcatgagtaaagataagcacaacataagatgatcatcattacccgggtgcggtcttgaaagccggcaggttcgattgcatagaatcaccagtggaaggtgaagtgtcctgataatttgaatcagaagaattgagcggttgacgagtaacgcccgccaaaggatgaaaagggtataagttggagataacctcggtccggcgc

SEQ ID NO: 37291 - DNA, 314 bp, Triticum aestivum
  Clone ID: PAT_TA_37291
gggtcgacgggacacccaaaagtgagtcgtattagaagaagatttccttcttttcttggtaagagcgtatctttttgcctcaagtcgaagacagtcagtactcctcggtcaagcttaatatctagctgaataaagtggaatctgcgcatgcatgcagaacacatcaattacattactataccttcgattaagggaaaccgaatatgtacagcacagtaacatgcacgtgcagttgtaaagatacagtagtttcgactcgttgtgattcacgagcaacgattgtaacacgttgtcgtcggtatctgtgatccaat

SEQ ID NO: 37292 - DNA, 131 bp, Triticum aestivum
  Clone ID: PAT_TA_37292
ctgccccatgtgctgtatactctatgacgatgattggctaggttaacgctctcgtcactcaatctgcctggcatgtgggcaatgattctgaactctatgcaggtgtgccttggaggggttatcatgggata

SEQ ID NO: 37293 - DNA, 234 bp, Triticum aestivum
  Clone ID: PAT_TA_37293
ggataagactccggactttaggaaacagtgtacaggccatataacctcaagtcaagattggaggccacgggatcccttaaaggatcctgcatttattttcctgcatcttggctgctcgattgggtctctgcttcattttcatcacatgatacttaagtctttcttaacatgtgccggcccatccattaagtgtgcgtccatgtaagactttatggatgtaacatccctgttctt

SEQ ID NO: 37294 - DNA, 153 bp, Triticum aestivum
  Clone ID: PAT_TA_37294
ctctcggaggtactactctggttttttcagatttatttttccttcaagtactttgttttttcatggcattggggtttttctggaaaattacatgaccaccaattcaaaatggccttccaatttaaaaggtataaccaaaaatttcctgcaacc

SEQ ID NO: 37295 - DNA, 382 bp, Triticum aestivum
  Clone ID: PAT_TA_37295
cactccgatgtcaaatccagggtttttcaaagggaattttcgtacattcactcggtttcatcagggcagtgaagtttctcatgtataatatattcgcatcagttgcatataagtcatgctacttgcacagattaaccaaatattatcatgccacatgaatggtagattatatctccgaatcatttacatcaggaagggatgaggaactccaacacatgtactggcccagccataatgtttgcgtacatgtaggattgtaaggatctagcataaattttcttgttggatggtggttttagaatctgattcattttctgattccaattgacagaagacgtaacccaatagtatagctaaatcagagattcgttaactgaatcca

SEQ ID NO: 37296 - DNA, 176 bp, Triticum aestivum
  unsure (1)..(176): unsure at all n locations
  Clone ID: PAT_TA_37296
agaagggtctagggtacctanggtttatgatgtctcgttgtttttgcatgctagcaagtgactccgggatgccagttttaagatttcgcttgtgttgaaagatattattattattactgcttgtagcctacctgggataccgtcatattttgctgattatggaaccccttttatcc

SEQ ID NO: 37297 - DNA, 403 bp, Triticum aestivum
  Clone ID: PAT_TA_37297
cgggccgacggggaactggacctaagagtactacctagggatactagggattgagtgtgtgagatgaaccggagaaggtaaatgcagagagatgaaatgcacaaaagacggagggatgtgatggttgcttgtccgtttattttaccagaccacttattactgcgagtggttgggttttgtgatatgaccgctttactgccgcgccacgagcggggtgagactcgcgtgcagcaccgccctctacactagtactacatcggtcgtggtttattagtcccccattgaatttaactaaagatttaactgacacaatgttattgcatgtcaacaaaaactatatcgttcgattcgtatttgaacatagttttcaatgataaaattttaggtgacatgcatcagcatt

SEQ ID NO: 37298 - DNA, 274 bp, Triticum aestivum
  Clone ID: PAT_TA_37298
tggggaggcgaaagcgggctccgcgggctgcctcgggtacttcggccggtttgggcggcggagggcctgctccgcgagcgtggtcgagcccgcggtcgggatccgggagatcagcccgtacatgctcggtctcgtctcggcgagtttcgtcggcgctttcaacgctttgatagagtcggtggtgccgtgagatagccacgggaatcgtgtgcgagttcacagcttcattgtcgcagaggttgatggctgttcatctttgcagaacagaggccct

SEQ ID NO: 37299 - DNA, 418 bp, Triticum aestivum
  Clone ID: PAT_TA_37299
ggtcaagaattaacgggtcgaccactcaatgacttagaggaacctttaggattcctccgcattaacgaaggaccatttcccggtcatgtacatacgtgcaccatattcggacgagcgcggaggtaccaggggctatatagtagccccactgtcaaactcctatggctaagtgaaagtgttaaaccaatatagtgtgattgcctcgttcgctgcgctaccacctccttaatggaccaacacgttggatcaagtgtgaatacgcgttttttgcaaacacccccgcattatatgcgtgggggctgaagccgacgactgcaaactttcaggttatatacatatatacataaatggccacacaggaggcatcataatactttcaggcaaaagtataaacacagcctttataactcaataaaac

SEQ ID NO: 37300 - DNA, 316 bp, Triticum aestivum
  Clone ID: PAT_TA_37300
gagtgagtaggattcctccgctttaatgatagaggaattccctgtcatgtacataggtgcaccatgttcttgtcagcgcggctgtaccagaggttatacgatggccccactagtaaactctcatggcaacttgtatgtgtttagccattatgctgtcattgcctcgcgtgtcgtgctagaatctccttagtcgtccaacacttagttgtatgtgtgaatacttgtcttttgcatgtacccctgcattatattccttcgggctgaagccgtcgactgctaagtttcatgttatatgcatcattacatcgttgggcac

SEQ ID NO: 37301 - DNA, 338 bp, Triticum aestivum
  Clone ID: PAT_TA_37301
aagaacccctgcgtcgccacctgcgataagcgctgccccaacgagtgcatcgttatgtgcccaggttgcaagacctactgctgtaagcatatatacatacatcatgcgtatcacctatacatatattcacacatactagctatgtccatacaaattaagaagtcgagatgcctaaattaattacttaacatttttgtacgagtgtgcgacttctaccccggcatgtcgtgcggggacccacgcttcactggtgccgacggcaacaacttctacttccacggcaagaaggatcaggacttctgtgtcctctccgatgccgacctccacatcaacgctca

SEQ ID NO: 37302 - DNA, 365 bp, Triticum aestivum
  Clone ID: PAT_TA_37302
gagcggcatactttcattgtcaacataacaaccaagagatggcgatatcttccatgctacacacattataagcggttccgaaacagactggtatagtttagactccccctccaccaacaagcatcaatccatgacttgctcgaaacaatgagtgcctccaactaacaatagtcctgtgggagttttgttagcaattaatttgatttggattgcataatgcatgtgactgggcatcacggtgaccagccattttctcatgagtgaggagccgagtccaatcgtcttgagaataacgcgcctagcatggacgatacagacaaccctaattagtacatgcactatacgagcatgcacaacataatttc

SEQ ID NO: 37303 - DNA, 377 bp, Triticum aestivum
  Clone ID: PAT_TA_37303
cggctcatcgcatcatgcatgcttttcccatcccctttctctcgggctagctggctcagggtgttgccttgtgaagacaagattgtagttagtatgcatacatgagtatgacagaccatagttggagcacaacaatggcttccatatcgatgctggccacaagaacgagcacagagcataggccatggtgctggcctgctgggagccttgcgagggccaggcacgatgccacaccacacgcccaagctgcagcggtagtgacacaggtgcacagtgaggcgaaggcgatgccgaccggcatggtgatgccgagcacaggcaaagaaaccctatgtttcaacacaaggcatacatcatgtaaatgtttcgctcgaaca

SEQ ID NO: 37304 - DNA, 315 bp, Triticum aestivum
  Clone ID: PAT_TA_37304
aaggccgagtaggccagtaggagaggacagatctacgctcccgagactggtaataataaaggcggtggattttgcctccactcggtgatgtattcttccttgctactgatagtgatttagtgcactgatatgttcttcaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaggggccgcccaaaaggttcaaacctaacttacccttgaatgcaacttaaaacctcttcaaaagggtcaccaaaatta

SEQ ID NO: 37305 - DNA, 374 bp, Triticum aestivum
  Clone ID: PAT_TA_37305
agagtaaaaggatcggccggacaagccttgttcaaatctgtgtattcaacacacatgtgccaagtgccgtttttcttaagaacgagcaccagattagccaaccactcagggtgaaatacttcgacgataaacccagcagccaacagtcgggctacctcctccccaatggccttgcgtctttctttgttaaagcgacggagaaactgcttgaccggtttaaacttgggatcaatattgagagtgtgctcagcaagttccctcggtacacctggcatgtcagaaggcttccatgcaaaaatgtcctggttctcacggatgaactcgatgagcgcgctttcctattttggatccaaattggtgttgatgctaaactg

SEQ ID NO: 37306 - DNA, 175 bp, Triticum aestivum
  Clone ID: PAT_TA_37306
tggcagaacttttatgcctccttcgcattcaggtacaggacactgatgaaggatatgaccaagatccagcatctacagggaactggaaagctacctcagcatacgatgtatacatagtggacacatcctataggaatgtcaacgaggatcgacagggtgcacagagggatccttc

SEQ ID NO: 37307 - DNA, 350 bp, Triticum aestivum
  Clone ID: PAT_TA_37307
ggtcagaataaccggtcgacggttctatctgatattgctcgactttgactccgaggacattgatggtatggacgcctgatgagagatatgaccaagaatcagcatctatagggaactggatagccacctcatcattgtatgtaaagatggtggagacatccataatgtatttcatcgatgatcgaaagggcccatatagggatcgtacccttgaaaaattatcaaagctgcgatacatgcgtcatgtacatcctcaactccacgtagacccaagcagtcagcacggcgatactgctgacgcataattcactattgagcaatcgtccatcaaagctatcaccggaaaatat

SEQ ID NO: 37308 - DNA, 374 bp, Triticum aestivum
  Clone ID: PAT_TA_37308
gatcttgtactactgctcaacagggaggagattggtgacaatggagttgtctgggaggttgaggtaaagtaggacttacatcctggggagtttgagggtaaaaggatcaagatttactacagttgcttcacaactgcatacttggtccagaaatgaagatcaggatgatgcactctcatgaagcatcaacttgagctcaaattgggcagggcttagtcattaggtcatatgatgatgctgtaaaaagatcatgctaaatggaaaaaccaaaatagcacttgcttcacaaacatcatttctgtccagaaacttggaataattatggtggtcaaatggatcaatgaaatgatgccaaaatgggtggagagatgttt

SEQ ID NO: 37309 - DNA, 370 bp, Triticum aestivum
  Clone ID: PAT_TA_37309
cgggtcgacgggtccattaattaagcactatatgcctagcttaatggctttaaagaaagcactgccagggagagaacccggaagtttgagagagtcatttatttcttttatatgctttcataaagtttaaaaaccaaaaaataaagaggggaacccaaaacttttcaaaaaggaaagtgaaagtgagagagacaagcattgttgaagtgggagagctccttgaactttgttcacgctcacagaaactttgtgaatcttaattacagaaactttttcaacaaaaataattaccccctgtacaattccattgtattataaaaataatgttccaaggttgcctttaagatgtttacaatgcttgttggtttgt

SEQ ID NO: 37310 - DNA, 380 bp, Triticum aestivum
  unsure (1)..(380): unsure at all n locations
  Clone ID: PAT_TA_37310
tcatcaatatgggcgtgggtaacccaaccgcttctaagactcttagatcataggcaagtccaaacggacacggataggacgttcgatatccaccctctttataaagggacgaggccttttatttttccctcccgtgctcaatcgaatccttcccccacctcaagctcaaatgcccaaagttcaggtcaggtgctccgaaccttcagtcatgtccggatctagccttcaaggccgatgggtgccttcttccgtcacggaagaagtcgtcaaaacgttgagggaggccagatatctgaccgccgagattctgcatcgactgcctccccgggggcatgccatcncctcctccgaacccaacgagagcgtcgtgttcgtctccc

SEQ ID NO: 37311 - DNA, 450 bp, Triticum aestivum
  Clone ID: PAT_TA_37311
cgggtcgacggggggacggacgaatcgagagagatggttgttgtgttacggatgctcctctctctgtctctctctcacacacacacacacgcgcgcgcgcgcgcgcaagtaaactagaagaccgttctctcatgtacacacaacgtatcggcatctgtctatgtctcactcatgcatgatcatttgcacattcacacctctctatgtatgtatcacacacacaccgtctccacactgcccttccgccacaacacacatatggacacatacacacgttctctctcagtcacacacacaaaatcagtattaaaaaactagggcgcacctaaaacgtccaaatccaaataaacacgaactgcagctaaattcaaatatatggaaatattgcagcgtcaagaactttcacaggaaaaaagttgagtaatactcgaggattgtttcacacacaaa

SEQ ID NO: 37312 - DNA, 357 bp, Triticum aestivum
  Clone ID: PAT_TA_37312
aggaggaccccgactcggatgacggctgctgaaagatcacgcacttcttcggcccacagagcggctccgcttatggcttatccaaggttggagcttcaccggcgccatggttgtgctcggaggaggactgccgatgctcgccgctgctgtcgtccacatgctcctcctcacgaccacgggtggacgttggctgaggtctagcctcccatccacgcgcagattatgcaagaatctgcttggtctgcatattagtaccgactagcgagcacaggaaggacgacttggacctgacgacttggacgttggctgaggtctagcctcccatatgcatatttgaccagtactacgcgcggcccg

SEQ ID NO: 37313 - DNA, 356 bp, Triticum aestivum
  Clone ID: PAT_TA_37313
cgatagaggaaaagctgaggaggtttaggttgacggagatcagtcagcagctgcgtaggatggacctgatgaaggagacggtgaggatggtgctcgatgcccttgagagtgctgactgaataatggctgatcgatagtgattggtaaactgttggaagggggaaatcagtctttttgtttctagatagactatatgtggttaattacttacttccctggacaaggttgcagttgcctccatcaaaattaggcatagaacatggagtgatggtcttctccttgttattgttcatggatcattgtattttgggattcttaggtgctaacttgtggtttatatgctatttggttgtgtc

SEQ ID NO: 37314 - DNA, 368 bp, Triticum aestivum
  Clone ID: PAT_TA_37314
gggtcgacgggtcacatggtcgttccattccccgagccctcattctctccctcgcggcaggtgatgagtcgtgcagatgaatcccctggccctggtccttaaattgatatcctcccaaacactcaactctctctaataggattggatttggtagaaagatgatttgagtggaaagcaactcggggaaggctagagatcaagatttatgtggtaggaatggaatatcttaacctcaacacaagtgtaggtggttccctctcagaaaatgtatgttggaagtgtaggcatgttctgatggctctctccatgaataaagagtgggtggaggggtatatatagcctccacacaaaatctaaccgttacacac

SEQ ID NO: 37315 - DNA, 361 bp, Triticum aestivum
  Clone ID: PAT_TA_37315
gggtcgaggggattattaatcttgcatgatgaaaaatgatgatattgttagaaatgattctggattaagtgaggtttgatcttaaccagagaagtatcttgagttgatgatggctcagtgggagcatggttgatttagttatttttatggttatgtgatgcatgggtagtgtgcatagcatggcattgtgacaccggttgttttcattttaagttgaacctgataaataactcaactggaatatgttgttgaccgggtcatggtgccgctgaaatgagtctttcccagtgcaaccacatttgccggtatgggacggccttaatgcgtttcatggtcgtgccattggtcggtgcctccattt

SEQ ID NO: 37316 - DNA, 270 bp, Triticum aestivum
  Clone ID: PAT_TA_37316
cgggtcgacatgaatcttcacccaattaacgaacatcattatcaaacctaaaataaatccaaaaaatgcaaacaccattgtcaagtcaatgacttgaactttgatgggttggtttcatcacaagggacgccgtaaaaaagaagttccatctccttcggcttgcttggctgaatttgctacggatctttttttcaaagggcaactccaacgcggttcgttataacagacacaaaatgtttgagggcacgtctggaccagtgatagggcgga

SEQ ID NO: 37317 - DNA, 371 bp, Triticum aestivum
  Clone ID: PAT_TA_37317
ccgggccgacgggaggtgaaagctagcaaaagactgggaagcggccaactgagagagcgacaacagtcgtaatcatgcattaaaattaattcacaccaagtacaagcatgagtaggatataatccaccatcaacataaatatcgtgaaggctgcattgatttgattcaactacatgcgtgaacatgtgccaagtcgagtcactcaattcatttaaaggaggataccatcccatcatatcacatcataatcattctaatagcatgttggcacgcaaggtaaaccattataactcatagctaataaagcatgacacaagtaactataatctctaaatgtcattgcaaatatgtttacttcataatagctgact

SEQ ID NO: 37318 - DNA, 387 bp, Triticum aestivum
  Clone ID: PAT_TA_37318
gggtccacgggatcgagtcaaagtgccaccaaatcgagctttctccagtgcagccacatttgcctttatgggaggccctagctaggtctattgtcatgcctctcgccggtgcctccaactagggaaggttatgggcgcgcgctaccctgatcaggtaggcggacataagccttgtgagcccgagtttggttatgtgcacatgtccctttttgggaccgtttttgccacgatggtggtcgtaggtgactttggtaggcacggggccacccatgacttagcccaaaggggagttggtcggagtggccgggagagtgtcatggcagtaggtcagttttgtcggaacgccgttggtccaaccgaatgggagtgcaaggccatggggttcgt

SEQ ID NO: 37319 - DNA, 292 bp, Triticum aestivum
  Clone ID: PAT_TA_37319
ttctaaatgcatcatcatctccgccatgcgtcgttgacttatggccatgacaataagggaatgctgtgtgggtattaaggagtatgttgggtatttgtttgttcactgtaaagaggaacacttcctttaatatccattgttatgtggtaagtggtttagtggtgcaaccataggatgcatgtgttctcatgtggaagggacagtgctaatggaaatgagctggtgtttagttaaaacagacgatctagacaatcaaaacttacgtacccatgcaaacaagtctcaaaccgca

SEQ ID NO: 37320 - DNA, 354 bp, Triticum aestivum
  Clone ID: PAT_TA_37320
attatggttgtagaaatttttatcttattaaattacctctcgtcatgttgagattgctatcgtctctttcttcttccttgcatatgcttgtttttgcttgccttgcaaatttgtttgattataatatgcctatgcataggaagtatgttagaattagatgtgtttgtcctgtgtttcatgatgctctctttgtgcttcaatttttgtccttcatgtgagcatcattaaaattatcaatgcctagctaggggcgttaaacgatagcgcttgttgggacgcaacccaatattttcccttgctgttatttaataaatcttgcgtctaccttatgtttaaatgtttttttatctttta

SEQ ID NO: 37321 - DNA, 274 bp, Triticum aestivum
  Clone ID: PAT_TA_37321
cactacccttcggtccactcgatctctgctgggttgcgtttgatgtaaggagcagtctccgcaatgtatcattccatacggatgccgtttgaaataccttttccgccactgacatcagataagcattctcacagcagtttgcactgcgcctttgtgtagtaggttagtccgataagtaatagagaactgtaggagaacacccattacgcatccagcacagataatattatattaatgtagaatctcgtgttatagatactgtcgtgtcattgtc

SEQ ID NO: 37322 - DNA, 405 bp, Triticum aestivum
  Clone ID: PAT_TA_37322
gtccacgggtttaaatcaggcatccccacacggctcacctcctggaaagagagcggccggacatggggtgattcggaggagctgaccggactccaagcctacatccaaaagctagtggacaagaagctcaagcttgtcaacatagtccaggtcatgctcatccgccggattctcccgtgccaacaacagggcttgaacatgtgggagttcgatccggcgcagcaccagactttgagcaggctcttcgacactacgtatgaagatgtctggaaggtgttgtttaagggcgccaaggctcccgcatccgctaccgaagatcacggattcagctcgcagcgtccggctgttgaggtgagtgattttgtcctttacgggacgcttgttttccatagtttgactctatgc

SEQ ID NO: 37323 - DNA, 341 bp, Triticum aestivum
  Clone ID: PAT_TA_37323
acgggtgtatgataacttgattagggatgttgcaaccattaattgctccaaattctcctggccaagtgtgttacaggcgagacctcgctgacttttggaaacctgtatgtctgacaagtgtctatacttgctttgttacatgtgtagaatgcattctttgcactctcaataactcgacgatttgatctgatcaagtgaccatgattgtagtgctcaacccatgattctatcttgtaggtatcattaccacacaacttcatgtccataaaacttatagaacttctcaacagcctgtaatccttcaaatatcatgcctaaattaggcttcaaattctcttcac

SEQ ID NO: 37324 - DNA, 380 bp, Triticum aestivum
  Clone ID: PAT_TA_37324
gtctatccacccgtccatggatggtgcaattggctctgaattgagggtcggagcggttgtcggtgcggtctcctggacactgtccgatggtagagctaaatcatgctcatcgtgaccgtgcggcgcactcggcaggggctcgaatccgtcgaagatgaagtctccgcggatgtccgacgtgtagtttaagcttccaaacctaacctggtggccaggggcgtaactctcgatctgctccagatggccaagcgagttggcccgcagtgcgaagccgccgaatacaaagatctgtccagggagaaaagtctcaccctggactgcatcgctatcgatgatcaaaggagccatcaagcctaatggtgacgacacagaggaactct

SEQ ID NO: 37325 - DNA, 395 bp, Triticum aestivum
  Clone ID: PAT_TA_37325
cgggtcgacggggaagatgaatccagcgagcaagggttccagaaggctacgggggccatgtgcgtcgatggtggcgtgtcgctgcatacttctcaacgccagctcaagcagtgggcgcgtgagattagaggagcggcgccatcgttcgacgcttagaagccgctaaagtggtccagcacgcccctcatctttgatgccgaggaccaccctcaccgcacagccgcggtcgggtgtttgcggttggtggtcccgccaacgatacgcaacctcaaggtgaacaagatgttggttgacggcggggccagccttaacttgatctcgcccgtcgtgatcagaagactgcaaattcttggtggagaccttgatgaaacgggcacgtttcgaagggtcaatcc

SEQ ID NO: 37326 - DNA, 428 bp, Triticum aestivum
  Clone ID: PAT_TA_37326
cgggccaaatcaaagaaggtgcaaacataataaccatctaactgaagttttagctgacgtgtcttagacatacatatgctgagttccggaatacctcttgtacatccgccactgagcattgcagtgatcgtagaaaatcttttggtttacatacaccatccgtgaaaccttgtaaatagagaagtggatggtagagtgagtgttcatattatctataatgtcacttatctgatcaaggcaaaactgcggaagttgaaatgtcagaactggaatcgtcgttggtttaactgaagacttagaccacaactgtcgttgacctctttaatccatgtggctgccgtatgctaagaattattacaccgtccaagtgcagaagtgcattccccgagggtaggaagttgtatgggtccaaaacacgtctgagtgga

SEQ ID NO: 37327 - DNA, 406 bp, Triticum aestivum
  unsure (1)..(406): unsure at all n locations
  Clone ID: PAT_TA_37327
ccgggccgacgggtaaggaactaaccagatctaacgccgaagcaccgctgcaactccttgagcagatccgggcaaggcacgaagaccggattgccgcagggctaccttctgatgcggttgatccggaggaggacttggaggaggaggaggagcatgaggagaacgtgggggacactggggccgtggatctgtaggctgagcaataggcgatcctcgattccctctggtgggaatcagcgacgaaggccaagcgttgtcttctgcacgaggtggaggcggagcacgccacagacgttgacaagatgctcgctgatatggatgagaaggaggatccggagccctccaacgtgcccaactacncggcaccggcatggacgtcgtggacatctccgctgaaagaacttag

SEQ ID NO: 37328 - DNA, 352 bp, Triticum aestivum
  Clone ID: PAT_TA_37328
gggtagggtgtgcgtgcgtgcgttcatagggatgagtgtatgcgcgtgtatatgagcgcttgtgtctgtactgatgcttaaaaaaatcatttgcctggccagtcgttgatttcaaacaccacaatctgattagagccgcatgatcgcgtcctaacatgttcagagtccccctcacccaaaaaaaaaacatgttcagagtcccccgtagcaattccaaccagcaggaatgcttgccaacttgcaccagccatgcagcacctcgtcgctggtcagctcagattaaaaatccgacgagcacgccacacatcggccacggctgcagggccgaagagctcagagtttcaacaccggg

SEQ ID NO: 37329 - DNA, 399 bp, Triticum aestivum
  Clone ID: PAT_TA_37329
ccgctaactgtccggcttgacggatttcctcgcgtgctgtgcaggattcggaccgtgcctccttggcgtcttgaagggccttggcgagttcggtccctttcgccttatgttcttcttctaaggactcacacttgcgggtggtgtccttgagcttctgctccacctcggtcacccgttcctcaaaacggcgccgagcggcctgttcggccgttatgtccgcagccgctttatcagtgacggccttgcttaccctcgcttgctccttggcttgtgtaagctcacccctgagggtctcaaccacggcggcaccatctgtacaaacacacatattgcggctcttgaaatttcgcagcacacggacataaacatgcattaaataagatgtgtcttgtaccttgc

SEQ ID NO: 37330 - DNA, 450 bp, Triticum aestivum
  Clone ID: PAT_TA_37330
gggtccacgggtcggctcgatcgacttcaatgctggtaggtggctagccgctgcgacggtgttaatgtggcgggggtgctagagctggcaaaggtttgattgtcacatgcgatgtggcggacctccgaactcccgaagaccggccttcggtttaagccgaccgggggaatttcgaacatgacaccgatccagcccaaaatgagagtccgcgttggtggcctaaaaatgttaggatcatcatgtctgcacttgttgagccgggttggagatgccttagtcaaccgagatcatcatgtccctttttacttcacaatgcaaaattaatattatttgattcttcatgaacttaattttatattgtattactttattgtttttgatgttaatttattttacataaatatatagttaaactttacgaagtttaacttgagacacaaatcttatata

SEQ ID NO: 37331 - DNA, 418 bp, Triticum aestivum
  unsure (1)..(418): unsure at all n locations
  Clone ID: PAT_TA_37331
ggtccacgggtacactatatgttcatcaccgggagcatgtaaaatgtttgcatcaaatccttcattagcagtctgttcattagacacttcaggctcaagaacaacatgagcttgtatgtgttgcaccggaaacttgattagatacatcagattcagtcagttcagtattgattgggggagttataaaataagcagaaattggtttcattttctcatagattccctacatacaaccagaaattgaacaattgaattagatagaatcggcgatgtgatgtacctgctcgttgcgcatgctactcttgcaagctgcgactgtccgtttgtgcaagctcgatgccatgctcgtgctgccgccgctgcctcccatgcaggttacacctanggttggatcntcatcttcntgtccttccgttca

SEQ ID NO: 37332 - DNA, 382 bp, Triticum aestivum
  Clone ID: PAT_TA_37332
gggccgacgggacatcgccacaggcctcgggcaccccactacagggcctcgacgtgcgcgcggatccggtttgccgaggcggatggttgcccttcccaggtgcattaatcgcgcgctataaatgcgcggaatacatggggtcgtgtgggggcatgggtgtagttaaccccacgccccaacgatcgtcgtttcggtttcgccgccgccgccacgggtataagtagggggacggtgcacggctagaacgcctcgtgtcgctccccgctctccatcttcttcttcctttgtctcccctgctccctcgctaccgccgtgctgccacgccgtctaagcgccgctgcagctccccgtcgcgcaatttctctgcatcaccatggccttg

SEQ ID NO: 37333 - DNA, 383 bp, Triticum aestivum
  Clone ID: PAT_TA_37333
ggccgccaggtaatagggacgacggagcggttcactagccaaatgccgtgggctagaagtaatttccccccgaagatcgatcaaatccggagcagaaatagcagttcggcttccgttgcccatctcatatactcgttaaaactataccacacatatataactacgcacttaagataccatgggcattggcggaagcgtaatacggacaagtctgcaagcactccggtaacatttttttctactttcctttttctttcttcattacctcttaaaaacaggtggcgcaaaggagaaacatctaaaaccgactctatcggagttcagatctgtacactcacctacggggctacttccttcaatgattccccttgccgaaggacggc

SEQ ID NO: 37334 - DNA, 329 bp, Triticum aestivum
  Clone ID: PAT_TA_37334
cggggtgagtgtagtgaggtaggctgctgcctgcctgcctgctggggctgccagcgtttaggtgcgtgtgtgtgtgttgtagtagatgagatgatatgagatgagatgagacgagacgggacgggaagccattgcattgctgtagtgactgatttgtctgtaaaaaaagaaaataaaattaaaaaatggaatacacacaaaaaaaactaacataaaaagggtaaacaattaactgttgggcaaatgattaaacttcagattatcatgataatatccacgcaaaagatcattacacaggaaccacgtcgaagattaaaataaacgccccc

SEQ ID NO: 37335 - DNA, 325 bp, Triticum aestivum
  Clone ID: PAT_TA_37335
gatggaagacagcaaacatatggagcatgcggtaatggttatcactaaggccgtgattctggtgcactacaaatctgcgtccggatacctgatcatctaatttgtgagttcagaatgctcatggagaagttcctcgatgtgtactactcgtactgcctcacgcatacaactcgcatcctcgtaacgcctctaaatgccctggtgctccataagtagcatcctctgtggggcctcaccatctgactggacgtgttcgtcgtcctaaagaacacactggacgacgggttggcaatgtcaccgtgcacggagctggtcaacgacaccg

SEQ ID NO: 37336 - DNA, 391 bp, Triticum aestivum
  Clone ID: PAT_TA_37336
aaatattttttgggttttctttttaattattactacagcaagaaaagtaaactaactaaaagctacactaattttttttggttttcttaaggtttattaaacacagaagaagaaagcaagaaaaagaaactaaactagcatggatattacagtgaaagagtatgagcaccgacatctaacaatgagtgtgtgaacataaatgtaatgtcggtgggaaatacgtactcccccaagcttaggcttgaggcctaaggatgtttattgccacggatggcctggcggatatccatagttgtagttggggtcgtactgagatgcagtggtcattgcatcgtgtgctgcagcttggaggcgagctctctcagccctcctcctatactctgcctcctct

SEQ ID NO: 37337 - DNA, 391 bp, Triticum aestivum
  Clone ID: PAT_TA_37337
ccgggccgacgggtatggcaaatctggagacaggagaaggtgagatcgagagagagctagggttttccccgaatcgggctgaattggggattttgaccagggaggggatgcacaatttgcaaaaaaaaccttcacaattatcctgacagtgggccatacgctgagtcagcaagccacgtcggccccgtaacggctcgcaacagggaagtgacacattcgctcataaagcaaaccaaattgaccaattctccacattttgagacttgtgtgaccaacgtgctcatcttgcgagagttcagtgacaaacggtgcgtttatgtctttcataaaacacattacaatcgggaaattgaaatattatatttcacttgtttcaaaaaactgattacac

SEQ ID NO: 37338 - DNA, 372 bp, Triticum aestivum
  Clone ID: PAT_TA_37338
agaacaccaaaactgccacaacttttgcaaacggactccgaatttgatgaaaccaagtttgttggaaagctagcgacaagggctaacaaaatattgaaagaaatatcaataagaagcaaaatataaaagtcccataagaaaaaggtgagaacccttcctcggaaaagaccggtaaaacctgcaacaccgaaaacatcatagaagacgcatgcgaactccgttttcgatgaactcaagcttgtcatcaagatgaccataagctctaagactcacaaagataaccaaacaagaaccaagaaacatgatgcaaggatgcaatggtttgagctctctactaccgacacgatcgagctaacaaacttagagcccccc

SEQ ID NO: 37339 - DNA, 408 bp, Triticum aestivum
  Clone ID: PAT_TA_37339
ccgggccgacgggtatcccatggagtaccgttttccggtacgccacacccctcctgatgaacaggacccctgtttcgaccgaagcgctccaacacaagtccatttcctccgttttgcggtacaccacacccctcccgatcaataggaccccatttcgaccgtaggaggtccaagggaagttcgtttcctctgttttgtggtacgccagacccctcctaatgaacatgatcccgtttcgattatggtcggtcgaacacaaggccttttcctctgttctgcggtacgccaggcctcatttcgatcggttgttccatccaagccagttggttcccgatgaacacgacgtattctgttgcctcccgatgaacatgacgcattctgttgcctcccgatgaacacgacgacaat

SEQ ID NO: 37340 - DNA, 382 bp, Triticum aestivum
  Clone ID: PAT_TA_37340
ggtccatcaaatatctttcatgggtatgatggaaaggaaaattgtggcaaagtgttagaagaagaattacatagaattcttggcataaaatatttgaatgatgagcatgattgcaatgttgttagtatgaattccttgaatatccatgatgctaatgatatgcaaagccacaagcttggggaagctatgtttgatgaagatgatattttttctcccccaagttttgatgagaatatttattatgatgaaagcatgtctcctatttatgatgattattgtgagtaaagaataatgataaccatgaaacttgttatcttgatcttaattttcaatcacatgatagttattttgttgagtttgctcccactactaatgatgagaa

SEQ ID NO: 37341 - DNA, 275 bp, Triticum aestivum
  Clone ID: PAT_TA_37341
tggcagggtcatatcgactccctggccggcgccgcagctaggccgggtggccctgtcagttgatggctcattcctgaaggaggatggctctgcagctgtcggtatggtgcttataaacgacaaaggagatgttcaaatggaagcctaccgcttcatcttctactgcaatgacccgctggaagcagaattacatgcgatcatgcagtgtttggccctatcaatacaacactctgatttacgggtggtggttcaatcggactcggctgaagctttgt

SEQ ID NO: 37342 - DNA, 388 bp, Triticum aestivum
  Clone ID: PAT_TA_37342
accgatacagggatgacactgaagcacagagacttgaccgtttgaggtcgggtcgctacaagatggtatcagagcacacactgagtgtaggacacgaccactaagctacaaccatcgatcactattctcttctcatttttgactcctctccattttctactctttaggaaggtggatgcaaggaacaagtttacacaaccggaggaagaatcaccttttggacgacacctgaaagaagtcactaggtacctgaacattggaatgccaagcttcaccgggacttacaatgccacattaccaaaagaggagcgatggatgattcaagttcaagttccaggaaggaccttcacggcagtcactaaacccatagagttttccttcgatgcac

SEQ ID NO: 37343 - DNA, 378 bp, Triticum aestivum
  Clone ID: PAT_TA_37343
gactgctaccccagataaaaaaactacagtaacacacccaagcggagacatgctcgagacctatgccagctagccctgttcggtgcatgtacgggcaggagcaatttaaccaaaaactgaaaagaaaagggtcgcgctaactgccacacatgtggcagaaagggagacgcaccacacgtctctaatgtaaacagattgccacgtcatcgcatgcatacatgtaggaatatttttggattttcagtttttaaattgttttatctcttaaacgaaaaatccgactgaaaatccgttttcaccattaaatccctcacgatgagatcttcgaaactagatcccatgttgatatgttttgatgaaatttttttttggattaaa

SEQ ID NO: 37344 - DNA, 378 bp, Triticum aestivum
  Clone ID: PAT_TA_37344
tgatggcgatgacgccgataaggtaaaggagaagatgggggaaggggaaggaaggcctcccctcctctggctctggcctgtgggaggaactctccgcccgcgggctgctgctgcggccgcgtgtctaccgcctgatcggaactggatggctggataccggtcttcatatgctaccatgatacggacgtctgaaccgttggatctcagatccgacggcatataaggagttgttgtacctgcacgcaatttcaagattcttcgatgatttttttgtaaaatgtttaatagctcataggagccgtttgatctgatatccaacgttaccaagagcccgtatcacggtatcacctaaacgttggtagcacatgatatttcccc

SEQ ID NO: 37345 - DNA, 395 bp, Triticum aestivum
  Clone ID: PAT_TA_37345
acttctagcgcattcattcataagcaaaacatggtgaactggaatctagaactcatcgacatagggagacttgatccacatccaacaaatagacacgagctagatttgagaaagtcagtcaaacgaatctgtaaaattaagaattcatgcttgctggatttgtaagcaattagttgatccaccaaacgagaaagagcattgacagcattaaattgcagaagaaaaactaacagcaacccaaaatcacccaaatcactggttgattagcaacaaacaagacgcgcgtgtgtggtaattcaaagaagaaacggccctgcagacgacggcgccgcccatgacaaggagctgcccgaggagccgtacatccccttccttcacaaaaccacatcagacct

SEQ ID NO: 37346 - DNA, 223 bp, Triticum aestivum
  Clone ID: PAT_TA_37346
aattcgcgggccgacgggcgaggtaaccgttgaccatatctagacgcgttcacaagttatggcaccggtttcacgtactagcagcaccagtaagtgtgtacgtgcaatgcacgttaatttggaactatattaagtgcatgcggatattaagtaggatattaattgcgtgtcattatgtgattaacactattccaaagacatgaaatcaacaacaaatgaataa

SEQ ID NO: 37347 - DNA, 150 bp, Triticum aestivum
  Clone ID: PAT_TA_37347
gggccgacggctgtacaaacagacagtcggaccacacgcccagccggattaccattgtacccccggggggtaggcctatataaacccccccagggcacccatgcaaagggttgatccaagctagttctagacaccacatagagagggggc

SEQ ID NO: 37348 - DNA, 393 bp, Triticum aestivum
  Clone ID: PAT_TA_37348
gggccgacgggagctgcaagcatcaggagggtgctgctggatcgacgacgagatgtggagggtgtgcgacaacagcaacggcgagctgcggagagaggtggcgacctgcaacccatggcgatggcagctgccgcagggtgcgcaagctttgtgcggcaaggccgcggggttggggcggttggctgagcgcggtgactcgttgtgggcagaggcatgatgtgcggaaggacagagaggaaatcatgcagctacttttgcctaaatccaacggctgctaggcgaccggccgaaagttgggccggtgcgccggcgcctagcagtggccttgttgttttattggatgcttgcctcttcaccctgctggatgaactcgcctacatttttttgacctgg

SEQ ID NO: 37349 - DNA, 418 bp, Triticum aestivum
  Clone ID: PAT_TA_37349
cggcgaattatcaacaagatcttcgtcactatcacagtcgccgggtcagaaccagaacttttcaagaaggagatttggtgcttcggctcatccaagatcagacggatatgcacaagttatccctaccttgggagggacctttcgtggtcagcaagaatctgcacaatgggtcgtactatctgattgatattcaagagcataaagactcacgcacatcagaggaggagaccaacaggccgtggaatatagctcatcttcggccttactacacttgagccatcggctctatctatgtacatactatggtagtgtatatattatcattgatataataaaaccggagcctcagctaaagcggggtctctgttctttcatatcatgtgtggttacatggagtggttccgttttaaagcgggct

SEQ ID NO: 37350 - DNA, 121 bp, Triticum aestivum
  Clone ID: PAT_TA_37350
aattcgcgggccgacgggggaaggaactccatgatgtgtgttctggtcgtcgacctccaggacaatgtcacggatcactcgtgcgtgcatcattcatcaaagagttgtccacatatcttca

SEQ ID NO: 37351 - DNA, 183 bp, Triticum aestivum
  Clone ID: PAT_TA_37351
aaagtcatggcgaactggtttcccatggctctcaaggagggcgcccgctcctggctcctgaacctgcctccaggctcaatttcctcctgggatgaaatgcgcatccacttcatcgccaacttccagggcactcccggccgcccccagtcgtaggcgacctgcgctgcatcaagtaacaaccag

SEQ ID NO: 37352 - DNA, 382 bp, Triticum aestivum
  Clone ID: PAT_TA_37352
ggccgacggggcaactacataggttgcacagcaataggatcagaaaaagcgccctggcaactggccgagctggctcctcctccctccatgtaagacgtggcaggtccgaatcgctgaaagccaaatcccagcttctcttagacagaacaacgggtgacaaaggttgtagcatcactggcctgggtaccgagaatgctacaggagcttgcaagaggttctcaaaagacctcctccaaatcatctccgggggcaaaggaggcccaaaagggatcacaggcagagcaatctcctttgtgacagtaagaggatgatacaccacaattgcccaattgttcgctgtatcttcattgaccacaggctgcataattgtttcagatatatc

SEQ ID NO: 37353 - DNA, 370 bp, Triticum aestivum
  Clone ID: PAT_TA_37353
attcgcgggccgacggggggagcaaggaagggggagacaaatctttcaggtacaatggtatgacaaccatgttctgaactatcaatgagatttggtgctaagtcagcatcgtgttttatccaatctatcaaacaccataagtttcatgtcgaaaaaaaaaaatcacagaaaaaaaaaaaaaataagtaaaaataaaaaaaaaaaaaaaagagtcaataaaacaataacaaaacaaataaaaaactagtaaatgttataataaatggataataaaaaaacatcgtccacagagaattacatccgttaatggttcctttccctgggaggcaatcccctaaagtgcatgtcaagactgctaaaaggggagtgt

SEQ ID NO: 37354 - DNA, 409 bp, Triticum aestivum
  Clone ID: PAT_TA_37354
ttcacgggccgacgacgcggctgatccagagatttacgctccccacatagtccttatgagcggcggtgtcatcactctgcaggtccttctcggtctctatggccttgttcagggtctcctcccgggctgtaacctctgaaagcgtgccctccaagccgtctagtttcagcttcaggtctttgatggagtcgctggcctcggatagcatgttggccttgtcagagatagcaacctgcgagcccgccagagtgcggttggctgcgttcttctcctccgtcagctccaataccctcttcttaatcttcttcctcatcttcagttgggtttctcatcatagaggatcttactctggccatggacttgttgaccttttcctttctcttcttgcactcaccagtctcctttgggt

SEQ ID NO: 37355 - DNA, 424 bp, Triticum aestivum
  Clone ID: PAT_TA_37355
tccgggccgacggagtggagagatggcttggccaacggtggagtagcgcttcacagcgaagcatgctaagcagagctgctagcagcaggaggcaggagcaggtggtcccggcggcgctggaggaagaagacgagagattgaagatggatgtcggtcgttggatgtaaatccaacggctaacgatgttagaatcatttgttgactaagttgacaacgacttgcattggcttcgaactattggcccacattttagcctccaaaaatgtggcacgtattcaacccattttttcagaatttacagtcttttttgcggggtagaatttacagtcaatttgatctttttttttgaattacactccattagttgggctgggtgaacaaataatgtagcgtccatgcgggccaattaagtttttccaaaaat

SEQ ID NO: 37356 - DNA, 393 bp, Triticum aestivum
  Clone ID: PAT_TA_37356
cccttcatcatttacttgaccatagtatgtggtagttgatttgctttatttgttgatttcggactttgttattttaggcccacctgtgtcatcgacgaggacaacgtggtggcgtcctcaacgttgaggattgcggctattgaagcccctaagtttggtctactagggcggggttggcagatagagtacactgccggaggttgccgctttggagatcgttaggtacaacatctttaggtccttgttcattgagtccttagggattttcgccaccgtatagtgtgaatcttttcattcttatggtttgcaagtgtcatgcctccggttagcaatcttgaggccacgaaggcaataaaccctaagccgcaagttccggatcggtctgctgttggc

SEQ ID NO: 37357 - DNA, 427 bp, Triticum aestivum
  unsure (1)..(427): unsure at all n locations
  Clone ID: PAT_TA_37357
attcacgggccgacacctcgacgcaacgagtggcaaataggaaatagccatgaactattctaataaaaatgtgaacaacgactcgaactcgcgtcactatattgcacagatggttcagctaatcactacgccaactgaacgacaacgattgcttccaacgcgaacaatataagaaccatcgtagccgtgctatttactacgcagcatcaccttgattttttttaatgaaaaaagctcgtcaaatttttgaaaaaagttcacgaattgagaaggttcaacggttctgaaaagagtttatcaaatttgaaagaaaagtttactgtttcgaaataaattccatcaattttgaaaaaagttcacccaattttgaaaaaaaaatcatccatttgaaaaaagttaatagattttaacanaaaatcatcagttt

SEQ ID NO: 37358 - DNA, 407 bp, Triticum aestivum
  Clone ID: PAT_TA_37358
ccttggaactgggaaactcacttgcccagcttctcagcaacgccagaatcctgattcactcactatcaccaacttgcgtaatgcactgaattttctgtccatagttgaagagcttcagagtttgttcgtacgatatggtgagctataacctgcagtcgaggacagttggatgcatgggctgcgtgacaaggtagagctaatggtgcctagcaattattcatcacgagcatatttgtaccaaatcatgtcagtcttgaacaagttttgtttttgcagtgctattcctgtgattttccaatcctatgaaccaaagaaggcctaaacttgctacaaaatctgtactttccctttgcgagcgaaggaatacgaactcctgttttgcaccctatctgcgttgttagcccaaa

SEQ ID NO: 37359 - DNA, 296 bp, Triticum aestivum
  Clone ID: PAT_TA_37359
cagccagagcaaggtgtggagcttgagctacaacgagaatgacaacttgggtgttagctgcaaaaaccaacagttcaagtgttcaaacagttcaacttgggctgatagagtttgctattaaatttctttcttggaaaataatttgctgctattacttcaaatgttacaatgtttggttatcttttgagaccttcatgtttcctatttcatgttggcattgtcaatgtttacagtaatgtgcaagcagaaattactcgtgttgagtgaaaaaaaaaaaaaaaaaaaaaaaaaagaaa

SEQ ID NO: 37360 - DNA, 426 bp, Triticum aestivum
  Clone ID: PAT_TA_37360
gacgggtcaagaataaggagcggagtccactccccttgagaataacccgcttaacatggaagatacagacaaccctagttgatacatgagctattcgggcatacaaaacaggatatttatttgaaggtttagattttggcacatacacatttacttggaacggcaggtagataccgtatataggttggtatagtggactcatgtggaataactttaaagggattggatgcacaagcagtattcccgcttagtacaagtgaaggctagcaaaagactgggaagcgaccagctagagtgcgacaacagtcatgaacatgcattaaaattaatcaacaccaaatgcaagcatgagtaggatataatccaccatgaacataaatatcgtgaaggatatgttgatttgtttcacctacatgcgtgaacatg

SEQ ID NO: 37361 - DNA, 430 bp, Triticum aestivum
  Clone ID: PAT_TA_37361
gacgggtcacatggtcgttccattccccgacccctcattctctccctcgcggcaggtgaacacgcgtgccgctgcctccgccatctctgcctcccatcctcatcccgatccttgtgtaccaaggagatccggcttccctccccgagctcgcctcccggcgactattccatgcgcggccgcggcaccagccgcctcccggtcgtcggtgccacgaaccatgaacgccatccggctatgagaatttccgcgacacccatctgccagttcgtcagcctgaccctgcccatcttctcgctcgttcgccagttctgaaaaaactaatcactttgtagattgtaccaacttttcgtttttggtctgtttgcacttctgcagtctcaaatgttacctctcagttcgtgcgatctccggatattctctacagcttttt

SEQ ID NO: 37362 - DNA, 356 bp, Triticum aestivum
  Clone ID: PAT_TA_37362
ctaaagagcgacaacagtcatgaacatgcattaaaattaatgaacattgagtgcaagcatgagtaggatataatccaccatggacataaatatcgtgaaggctatgttgattttgtttcaactacatgtgtgaacatgtgccaagttcagtgacttgaatcattcaaaggaggataccaccctatcataccacatcacaaccattttaatagcatgttggcacgcaagataaaccattataaactcctagctaattaagcatggcataagcaactataatctctaattgtcattgcgaacaggtttattcataataggctgaatcgggaatgataaactaatcatatttacaaaaa

SEQ ID NO: 37363 - DNA, 224 bp, Triticum aestivum
  Clone ID: PAT_TA_37363
tgctagcaggatatctctaactggtaaatagttacgcattcaaacctagttctgacggcagtcccctgtacaaatcatatatcatgaatagcaactgcatgacttagccggcttgagtcatatcctgtctcatgtctaatgttcgagtatgtatgtcatatgtagactgtgatgtcagctttctgacctcaagaacacgcatgctgatgaaagtgacgcatttg

SEQ ID NO: 37364 - DNA, 402 bp, Triticum aestivum
  Clone ID: PAT_TA_37364
gctgctaaaccggattctcactactgcgccccctacttggcgcaccaaagatgtcggtggaaacgacacctatgggatcacaagaatccctactacggttgcggggcgcggggtcatgagaagagcaggatcaacagtcaacacaagcactcgggtcgtttacccaggttcaggccgagaggatgcgtaacaccctagtcctgctttggtatgtatatctgtgttcttggagttcttgagctagctacaatgagtgtaacttgtccaagggtctgaatccttctcttggatgccttgggcctccttttgtagtcaaggggatcgccacagtggcacacatgaggtggcatcggtgtacggtggctaagcttatcgtttggcattacgggacaagacacattt

SEQ ID NO: 37365 - DNA, 434 bp, Triticum aestivum
  Clone ID: PAT_TA_37365
gggcactcatgaatcggaaattgttagaatactcaatgtgcatcacttataaatttttagttacatagtttttgctctagtgcttcacttacatcatttagaacgggttggtaaatttggtttaaaggaacccatggtccccccaggatccacttagataatttggaaagctcaacaaaccatcatggaaattggcgttaattatgttaggcattcaagattaatatgtaaaattttcttatgagtgtgttgaatactatgagaagtttgaaacttgagaattgttttgagatatggacatggtgatattagagtcgtgcgagttgagtagttgtgcattggagaaatgcatgtgttaacatttgtgattctcgtagcatgcacgtatgagtgaaccgttatgttaagaactcagagcatgatgtagttattga

SEQ ID NO: 37366 - DNA, 457 bp, Triticum aestivum
  Clone ID: PAT_TA_37366
taccgagtcgtaaattcccgggtccacattggcgtcgaaacccttgacgagtatttccggacggagggagtacctaggaacacaatgagcacgatggagtttgtaacagaagccaagaccagaaggatgcatttcgggatgcaattgacaaatgtggactgctggacattggatacagagggaaagactggacttttgagcggaaagttgcaggctgaccattcacgagggtgcgtctagataagatgccttgcaacgccggagtgatgcaacattttccctagtgcagcactagtacaccacacggcagcctcttctcatcacgagccgatcccgctagccttcgatgccgacgtgcatgtgcatgcatgcaagggatggcccaggtcatttaaatatgaattgatgagggaacgccaccccgaactggtggaattcgtgggcactggccactggg

SEQ ID NO: 37367 - DNA, 436 bp, Triticum aestivum
  unsure (1)..(436): unsure at all n locations
  Clone ID: PAT_TA_37367
cgggtcttaattatgcaacttgaaacactctgagatgtcatgctcgtctctcttgcaatacctgcaatacttcttgtctttggattgcgaccggcccctgtagccgtttttacttttgcctctgtttccattattggagttcttctcctttgtcctgccacgaacagataatccctcggcttgggatgaacttgaaccatcatgaggcaccattaatttcatcttctccttagagttcaaagcttcataaacttcattaagtgtgagagtatcacgactgtatataatatggtgtctctaacattggtataagaacttggcagtgaacacagtaacattaaagcagtatcttcctcttcatacttaacctccattgcagctagatcagatatgatctctttagattttgaaatatgattcanaacattacctccct

SEQ ID NO: 37368 - DNA, 424 bp, Triticum aestivum
  Clone ID: PAT_TA_37368
aaggcgtgagtgagagaggagaatccctatctctttataaaggcggtagaaattgtgcgcctccccactcgcctgttaaaatcgcttattccccaagagccatgattgatggcgcggttgggttacccatgcccgtattgatgagaatcccgcgataaggggacacgatctctgcttcgacaagacgtgtcaaggaaaccgcctcgcactacgtgcagtagctggttgtgagaaacgtttcgaataatgaccagaccgtggcgtgatgtcatgctataaaaagctgctagcatattagatttgtggaatattttgctctctacggtggtatgcggaatttgtttttgcagagccagacacgattcctgtgttcaaaatcttctatgaagtattcggagaaggaacctgccttgcaatcccgaag

SEQ ID NO: 37369 - DNA, 410 bp, Triticum aestivum
  Clone ID: PAT_TA_37369
attatcttcccttgcatgttatagttcatcaagaaactctagtagcttcgtgatagcgactggagaacttttgtcaatcactctcttatctggaagattaactcccacttgattaaagtgattgaagtacccagacattctgagcacatgctcactggctgagctattcttctccatcttgaggcaaaggtcttgtcagaggtctcaacctctcaacacgggcatgagcctgaaataccaatttcatctcttcgaacatctcatatgttctatggcgttcaaaacgcttttggagccccgactctaagccgtaaagcatggcgcactaaactatcatgtagtcatcagaacgtatcttccagatggtcacaacatccacagacaacgccagaggggttggcacactgagc

SEQ ID NO: 37370 - DNA, 427 bp, Triticum aestivum
  Clone ID: PAT_TA_37370
aatacaaatcactcaatcgagcaaaattggacgtgtgacattattaggttgatctacacgaaccactcgtaggggaaaactgtattgtggagtacaccataaggtcacagtggcacaatctgaagtagatcatcctgtatacatagaagtgcaatagaaccgattagatgccattaagcgtgcatgcaacaacagccaccagaaagcagcaccgaccttaactatatagtaatgtgcgcaatatagtatcagtcctcatgcggtcgaactgatcataatttacattgcaaatattatagcatcatcactcgttagccacatggctttatttaggcagaggcattacgtcatatgtcaagcggcatcaggaccaggtatttgcctataaggacattttggtgtaaggactaaaaaaactccgtgtcac

SEQ ID NO: 37371 - DNA, 445 bp, Triticum aestivum
  Clone ID: PAT_TA_37371
ttcgcgcggtcacggggattagactatcaatcaaggtccctctactcctcgtgccctcgcgaagctgaacccaatcttgttgggcccttctacaacctagatggtctcatctctcatattatggttcaagggacaaccatggatgaacctgcagacgacgctgattctgacgaagcgcctgcaccaccgaagccaaggaagctgaagaaacctaaagcttcgaagccttcccctacaccaaaggtttcacgggcgaagcctctggccactgcacctcctaaagactgtgcagtctgaagatctttcacgcatctccaagcccgccaaagtgaagatgcccatgcaacccactagccaagcactgacccctgctgttgttctgcgcaatgagaatgacgccattgatctgtccagcgatgacgatcttggcaatgacgctcttgag

SEQ ID NO: 37372 - DNA, 360 bp, Triticum aestivum
  Clone ID: PAT_TA_37372
attcgccggtcgacgggttccgtttatgatgacacgctccatcattatcatattgctttgcgtgatcatgtagttgacattgtattcatggcaaaaccaccgttcataattctttcatacatgccactcttgattcattgcatatcccggcacaccgctggaggctttcacatagagtcatattttgttctaagtattgagttgtaattgttaagttgtaagtaaataaaaaagtgtgatcatcatcatttttagagcattgtcccaagtgaggaaaggatgatggaggctatgatttccccacaagtcaggatgagactccggactaaataaaaaaagaggccataaatagagagagag

SEQ ID NO: 37373 - DNA, 426 bp, Triticum aestivum
  Clone ID: PAT_TA_37373
ctatatataatgttagttcaatttttggtcgtactaatctatagtagtaaggtgcccgtgcgttgcaccgaagagtgaaatgcattgatcggggagttgtttattttgacaaaggatgtgggggtcatctcatgtgtaacgggtatcgataggtttcttgggatattatctcatctctagagctcacaaacatccgggtgaaatagataaaaaggtatcttttgcaaacaaaaccgttcaactgttcaacctgcatccaaaacttgtgaagaaataacacttattgtgctttgcaagaaatgatctttaagaattagtttttgagtatcgattgttatacatgttggctacagatgacatggcactttcttatagtcaacaattggctatactattaagtaatattaaccaatgccttatacacct

SEQ ID NO: 37374 - DNA, 420 bp, Triticum aestivum
  Clone ID: PAT_TA_37374
gataggagtagactgagagatgggatagaactccatggcatccgagggttccagcggcgtcggcgtcggcggccggaaaccatcggtgtcacacatacctagacatcgcggagtggtgaaattcctcaccggcttgccagcgcgaggaaacctctcgtcatgttccaactcttccaatctgggaagcctcatggtttaagtcagcgagcacgacatacatcctccagagggatcagtgatcgacatggatacgacaaagatcgtaatcatacatctgcaactaaataacacagacagtgaggccaaagacacacgttctatgactccacaggaaactcgcgagggtataagatgtaccgcagaattttgggtgtgcataaatcatcccaaaagcccaacttgggcagtttcttcggattg

SEQ ID NO: 37375 - DNA, 417 bp, Triticum aestivum
  Clone ID: PAT_TA_37375
cgggtccacggggatgactaagcggaggatgggggccaggcggacgcaccagaacgcggagcaaacggccatcctcatcccaagcgcgcctctaacaacgagccgcgtgcgaacgaatcgactgctgccggaggtgatcacaccgatactagccagacggcttctccgatgaccgactctggcgcctcatccgacacgcctaatccgtctgctgcgccataaactgccgctgtatctcttaagttagctgcttcactaatctgctgaaaacttgttaattcacaacattctacccacgggatgtactttgaggctccactcgataattctgccaaaggcctatattatgtagaggttaatatatatctaacctttactgcgcaatgttcctatggcctttttcctttgccgccttca

SEQ ID NO: 37376 - DNA, 446 bp, Triticum aestivum
  Clone ID: PAT_TA_37376
gagaagacggaggaggaggaatccatggggaacatcctgaagtgcttcaggggagacgacgaagaacaagaagaccactacccctactaccgtccaggctccaggccccactacccccagcagcagcagcaagctgatggccatggcgtcgcctccctggcgcacgacctcctcaactttgagagcgcgtccatggttcctgaagggctcaggcagcatgttacggcgtccaagaaagcacagattaaatggtaccagaatatgttggaggcatataagaatgcgagaaccccaccgagaacaccggaagaggctgcacaactagttgtatcagccctaaactggatccagagtgctgatttggagggtatcctcgaattctacaacttccccatcccatcactacctgcagcatcctcaaaccaccgtccatcctcgctgccaga

SEQ ID NO: 37377 - DNA, 107 bp, Triticum aestivum
  Clone ID: PAT_TA_37377
gccaccttaatcccagtacctcgctcacgatcgtgcatatcaacatcattaccgttaactgcatcatcaaacaagtctgtgtcctcaaactcaatctctagcgggcg

SEQ ID NO: 37378 - DNA, 298 bp, Triticum aestivum
  Clone ID: PAT_TA_37378
gtacgtttttaccaaattaaaaggctgcaatgacaatggcaattgccggacggcaaaggattcaattgtaaggtaatggaaattcagcaccatcaattttaacccccccattcttgaatttaaccttgcggcaaattgtaacgttaaccttattcttcccctccggtttgctccttcccgggttaatcccttaaatatgtccgctctcttctatccctctcacagatatcgggtgtctcgagaaccccgcaggagatatcgtgtaaatttgggcccccctgtcatctcatatcataga

SEQ ID NO: 37379 - DNA, 118 bp, Triticum aestivum
  Clone ID: PAT_TA_37379
attcgccggtccacgggagtgaaataaccatcattattagaacattgtcccatgatcaaaatataagtggccaaataagccccctcccccccaaaagatataggccaaagaagcctac

SEQ ID NO: 37380 - DNA, 418 bp, Triticum aestivum
  Clone ID: PAT_TA_37380
ggtccacggcgctagagttattttaacttctcctcgaggggacaagttttgttatgtgttgcgattgatgtttccttgtactaacaacgccgcagaatatgaagccttgatctatggtctttgaatggatgaatagataagcctgagtcaggtctggcaccttggggattcatatttggttgctcaacaggtgtgtcgcaagtgggattccaaggatactctcattgcggcttacaatcgcgatagtcgaccctgtatcagggcattttaacggttatcaagtggaacacattgatcgcataaacaacgaatcggtcgacgcctcaagccggtttggatctcagcgtacgccggtaccatctaaaaccttttcggatgttttacataatgcgtctattaagttgcctacagaggaaaa

SEQ ID NO: 37381 - DNA, 375 bp, Triticum aestivum
  Clone ID: PAT_TA_37381
attcgccggtccacggggccaaaaaaggcatgttccataagggctaaacttaatgatgacgccgcggtaggatgacttacataggagacgcacgtcattattgcggggtttggttttttaaactgtgggtgtgaataccaatcaccaacatgttggatccaacgactgttaactgtattggcaacgcggaaaatccaaggttgcctgaagttaaagttaaatgagaaccaaccatttactggcacctaaaaaaaaagaacatccaagaactcaacctttccgtcagattctgtggaagtggtgctccaactgctgctacagctgccccagctgccagtggtgcataaaaaaaatggggaccctcaagaagttaaa

SEQ ID NO: 37382 - DNA, 182 bp, Triticum aestivum
  Clone ID: PAT_TA_37382
cggggaggatgcagatggaaagtaagggaggctaggacagactgaaagaaaagtggaccactagggtgatttgagtgtgcatcggtatcgatgtcattcatgacgacggtctacatgcccgccacaccatcgacaattggcggatactcagcagatcacataagtctggactagtctgcgga

SEQ ID NO: 37383 - DNA, 393 bp, Triticum aestivum
  Clone ID: PAT_TA_37383
tacattcaaaaaccatgcggcgaaattttgcatgtggagactgactggaaaaaattatccagagactgttgtagcctaggttaatgaaacatttcatcagggggagaaaataggttgcggctttgaacaattattatttttactaaatttgacattaagctaatgcaaatattaattaacatgctaatgaactaaatccttctactacttgaggggatctcacagctcatgaatattcctcaattacgattgcgcgtacacaatttgtgatgttctaatccttttgttctagatacaacgacaaataatctaattatggaaaatatgcaaggatgaagaaacaagaaaagcatagcccttattgctggcctcattgccgatcatcctagtcgt

SEQ ID NO: 37384 - DNA, 214 bp, Triticum aestivum
  Clone ID: PAT_TA_37384
tagatagcatggtgaataagtggcgttagattcctccatgtacactccctgtttgccttgtcgcttcccttgtcatttgcccactagaaccatgacacatccttaattttcgtcctctgttgtaaagagtccaaccctaccagcacagttacatgagtacctgtgactattacagatctgaacgaaaaaaaaaaaataaaaaaaaaaaataaaa

SEQ ID NO: 37385 - DNA, 409 bp, Triticum aestivum
  Clone ID: PAT_TA_37385
acgggggatatggaagatgtacatacttagcaagaagatttactagcataaaaaaaggaatccaacaacaaaaatgaactgtacaaaaacacacaagaaaattaaagccatctcgcgaagtaagagccggatgaacggtgtcaccacgtgtgggattatgcacgtgttacgtctcatcgtaaaagggggcgcccaaagggttccagctttaagttcccttacaggccactttcaaccccctctaagggtgcccccaatttccattcccgggccgtcctttttacacttccgtacggggaaaaccccgggctttcccaattttaacccccttggggaaaatccccctttcccaaggtgggttattcccaaaaaggcccccccgttttccccttcccaaaattttgccccc

SEQ ID NO: 37386 - DNA, 444 bp, Triticum aestivum
  Clone ID: PAT_TA_37386
gggtcgacggcacatctgaaagcaagtctttgcacgaatcaatcagggagaggcacgtctctcacccaacaccgaatccaacagcatacaacgaagctgatcactgtgggtggtcaacagaggaagagatacaagccgatctgaaaaaactggacgccatggaacaggatcaacaagttacttctctccctcaacctggagccatgcatgtggaactcgataactcgatccgcacaaattcggtcaaagctcacagtgccaaattaagctcttacaataacttgaaaaacagtgttccttcgtcgacgatatccaagatgcatccgtgggtggacaatgctttaagcatcacatggaagctatgcaaggagattatggatcacaagcagcatattaataagctcgaacaagataatcgcaatctgagagacatcattgccaaaa

SEQ ID NO: 37387 - DNA, 441 bp, Triticum aestivum
  Clone ID: PAT_TA_37387
cactgaattgcaaaaaaccaccacatttgaagttcagttctggaattgccaccacattctttgggcgtcccaaaaacccacaattttctttgctaattttctcaataaacacttatgaccaatttaggcagaattaatctaatctctgacatgtcaacacgttggtcagatccacgtgacactgcaaatcaacttgtggttgagttggttaggtgaatagtggtatccccaacccaccagggttcaaatcctggtgcttgcattattcctgggtttatttcagaatttccaagatgatatgccggctcagtctctcggaggtgctcatagggatatggtgttcgtgtgtgcgttcataggggtgagtgtatgcgcgtgtatatgagcgcttgtgtctgtactgatgctcaaaaaaaaaagatccatgtgacactaattcac

SEQ ID NO: 37388 - DNA, 433 bp, Triticum aestivum
  Clone ID: PAT_TA_37388
aagttcccaaaggcaacataacgtaggaatgcaattttgaagtgtgaaactgcatgtaagtttggtatgcattcatcttgtgtaccatttaccgtacaagatttcatgtggttcgtgtatgttcttttggtattcatttaataattgtgaaaataaattgcaataaagaggtaagaaatgttttttagggaaagaggtaagaaatgttatttgtacatgttgttagttatggagcaatatgtttgatgaaacacgttaatccacatacccctagtcagatttcaatctccactcattacctttggtaaatctgtattgatggagtgaccatgatttcatctaaacatttccaggaaaagattaacgactttcttcacaaaaatgatggatgattgcaagtttttcacatgagaagaggaaagaacagagaggt

SEQ ID NO: 37389 - DNA, 290 bp, Triticum aestivum
  Clone ID: PAT_TA_37389
gggtcgagcggggccagcaccatacccagcaaccacttcattgcgccgttggctgtgtccttcctcacgctgacataacatttgagaccacatgaattagtcaacatcagatacgggcggagcctggattcataaatcgctgaggcgacattacatctatgttcccctagttatgaggctcgataatactgttttttttgtatcccctgtgatttgtggcgatgaggtaattaacacattacaacatttgcaccgccagaatgataccaaggtacctacacgtgcgccta

SEQ ID NO: 37390 - DNA, 352 bp, Triticum aestivum
  Clone ID: PAT_TA_37390
ggatacacaagcagttggtgtattttaattgagtttacttcaagtcctctacaaccggatattaaccaattcccatatgccacataaccgcaagcacggctctcaaaagtttaaaccctacaggggtatcccaacttagcccatgacaaactcacgatccacgaagacaatcctccatcgcgggaccctccgatcagactcggaatcccggtgcacaagacatttcgacaatggaaaaacaagtccagcaagacctctcgacgtgctaacagcctgatagtacctgcgcgtatctcgtctcaggccactacagatgagctatgcatccaggtgccaaaataccccaattaag

SEQ ID NO: 37391 - DNA, 370 bp, Triticum aestivum
  Clone ID: PAT_TA_37391
ggcgacaaacaccaaagccgagaagcggccgccggcgtccaaggacggcggctagaagacagggaagacgagatcgaacaagagcgtggagacgtacagaatctacatcctcatggtgctcaaccacgtgcatctcgacatcggcatctcctccaaggccatgtccatcatgaacgccttcatcagcgacatcgtcgataagctcgccagcgagtctgccaagctcgcctgctatcacgagatgcccaccaacacctcacgggggatgcagagcaccgtcggccacatcatcgtcggcgagctcgccgcgcacaccgtctgagaaggcagcacagccgtcaccaagttcaacggcgcttagaaaatctgt

SEQ ID NO: 37392 - DNA, 363 bp, Triticum aestivum
  Clone ID: PAT_TA_37392
aaactgaacctgcaacacttcccgagcatctacaccatcgctgttcaggctgccggtggaatatacgagaaggtgatctgcaattacttccttttggccctcacacccaacgataaggtttggctcatgcatttaccggaggactcgatttcgtcacgcgaagacctgtgccacgaattcatcggtgccatcaccggtgggcaccacgaactcggcaagcccatcgacctacaacttctccagcataaagaaggacaaaccctccgtaaatacttacaacgatttaatacacttcaaacgaatattccaaatatctatccagcagctgttataacagccttctaatctaatgtgcgcacatgt

SEQ ID NO: 37393 - DNA, 406 bp, Triticum aestivum
  Clone ID: PAT_TA_37393
gaggacagcagtggcgtgcccgtgttcgcggagtacaccctcgacgagctacacgcctccaccgatggcttcgcaacggaccacatcatcttcgagcactgcgagaaggagcctaatgccgtctaccacggaccctcttcagctctggcaccaccgtcgccatcaagcgcttcgaccgctccgcctggcctgacgcacgccagttcgtggaggaggctagggcagttgggctgttgcagagcggtcgcttgtccaacctcatgggatgatgctacgagggtggcgagcggctgctcgttgctgagttcatgacgcatgataccttggcagctgtgattcgtagtgtggttagggtttgttaagtttactagctccttcattgatgatgggtggcccgtggtgcttt

SEQ ID NO: 37394 - DNA, 368 bp, Triticum aestivum
  Clone ID: PAT_TA_37394
aacagggatcggtgcagattctgccagaaggttagcaatggcggaataagcaggttcaagtttcatctgtcgcaaattccgagcaaaggcgtcaacccttgcgtcagggtgacggatgatgtcagggaaaaggtgatcgctctcatagaagccatggaatcacacagggagctcgagcttctcaagagaaaacgtgttgctgaactgtcggtgcttccgaaaagaacacgggaacttccatctcagccttcctccccagggttgcctacttcgcctgctattaatcctgcattcgatccgagtcagctccttggcctggaagtgcctgctccggtacttagactatctggtgctgccaccaagccccg

SEQ ID NO: 37395 - DNA, 177 bp, Triticum aestivum
  Clone ID: PAT_TA_37395
gaaggagactaggtcgcccaagaagagcgccaagtcccacaagaaggccgacaagactgcgtagagacagacgagcgtcgatgagcttgctagaagcaatggtttcgatggtagaatctgtggtgccagccggaggtgaaaagggcgctgttcatagcggccgcgccatacgatatc

SEQ ID NO: 37396 - DNA, 389 bp, Triticum aestivum
  Clone ID: PAT_TA_37396
gtacttcaaggccggcgatgccgatgaggcacgggcgatgtttgacagggtcccggtgcggaacctggtgagctggaacgcgctcattgccgggtacgcgcaaatcgggcgctccgaggaggcgttgcatgcctttcactcgatgttggaggacagggtcaagccggacgagttcaccatggccagcgtgctgtctgcctgcgcgcagctcgggtcgctaaaggaagggaggaaggttcatgacttcatggaccggatgcgtatacggaagaaccacttcgttctgaatggcctggttgatatgtacgccaagtgcggcgacctcgagcacgcccgcaaggtgttcgacagcatccaacggaggaatactgaatgctggaactcgatga

SEQ ID NO: 37397 - DNA, 396 bp, Triticum aestivum
  Clone ID: PAT_TA_37397
tacggcagcgaaaaaacaacaaaattccaggggtgaagaacacacatcgtgtcagcgctgctccggcagacatctcgagatctgctgtgcgaaaacagacctgatctgtgtgctgtggtctcatagagaccatatatatctacactaaatatatcacatgtcacatctcacatcgagatgttgttacacctttctcgtgacagtctcgcgctataacagatagcgctctctgttcgccccgccgcccgcggagatgctatagtggtagagtgtatatctcctcctccgcggtgtgcctctgcgtgtacatatatggatactctctctgtacagtgacaccggctaacattgagattataacactctgtgtaatgttataatactctgttgccctcc

SEQ ID NO: 37398 - DNA, 348 bp, Triticum aestivum
  Clone ID: PAT_TA_37398
cgcgggatgctgcgaggagggctgacgctggggcgctgccgcgctcgccggagtgcacacgcacattgacggcggcagatcgcccgtgtcagttggagtaggagggcttttttttattcgcgagatcagacggccctgggtggactaatcagacggctgcgcgtcgaccggccgatatttggcggcgcctatcatcgcccattttacaaacacctaaattcttaccaacgtcattagttcacgcacaaatttactgcgatcactccctcacacacacaacttcatttacaataaaaccatgtaaccgagtcttcgcaaattaaaaataatagtttgtgcaaggtaaaa

SEQ ID NO: 37399 - DNA, 273 bp, Triticum aestivum
  Clone ID: PAT_TA_37399
gggtcgacgggccatggtgtgggaggggcgagagcccctccgagattggatctgtctctctgtttctccgttcttagatctggcccttcaccgtttcttttataaccggagatccgtaactccgattgggcttaattttggacacgatctctatccggaaattagctttgttgcggcgaaagaatggctccaactgccttacggggtggccaccacggtcagtggcccgccagaaccctggaggtcgcccgctgctcctggccccctcaaggc

SEQ ID NO: 37400 - DNA, 393 bp, Triticum aestivum
  Clone ID: PAT_TA_37400
gaactagaaaggttaatgccggtcagtacatttctgtccatttgctctagcttcacttttatgcttcgtgcgatcttccccacttcatcgatgtctttctccatgcgtcccttgattgctggaagatgcatcatttaaacgctccgcgtatatcttaccacattaccactcagaaatgcaatcagtacatatatacaagtaaaggatggagttcaagcctttcattgcagaggccttagtggctgattttgactcctcgttggcttcctgcaggtggaaagaaagaattaattttccttgtcaatagtacaagttagagactaaggtgatggcaagatgtaactaaatattgttttaaaaagggaaagagctcatgtctgaaacgtctgaaac

SEQ ID NO: 37401 - DNA, 395 bp, Triticum aestivum
  Clone ID: PAT_TA_37401
ccaagacatacaaagttggcgaacttgttctacgcttgccggagaagaaaaaggacaaactcaagcccaaatgggagggtcccttcataatcgacgaagttcttaccggcaaagcgtaccgtctttgggatgcatcggacaatcgcctagagccgaacccctggaacgcggccagactccgagggttttatgcctaccgccgaattctttgttcgtccccttctcccctatagtttccattactttttctctcttttccacctttatttttttcgctttaaagctctcatacggctcgaccgaacaccgctgacgtagacatctttacatatgtacgtccattatacccggggacttctttacgagaagcttgttcacactattttttccgagcg

SEQ ID NO: 37402 - DNA, 410 bp, Triticum aestivum
  Clone ID: PAT_TA_37402
ggctacatctcattggacatgaccccatggtaatgacatctcagatggagaaacttgatctaacagagacataacatgcgcgaaatttggcaaggcaaacctgttagttggcagacgagcacaacatcagtaagaatgtatgcaagacatatatggtataattttgagataaacaacaaataataatactcacatcggtacggttaaacattctcggatgttgtatgagcgtcggtcgcagcgcttgtgttaataataagatcctttgagtagtagagcatgaagagggcaacgatggtcatgagctcaccaccgtcatttaggtgcttggcatggaaattctcgttgcagcggtaagccgcgtagcacaacatctccacccacacatcgcggatcatatgaagtgttgt

SEQ ID NO: 37403 - DNA, 388 bp, Triticum aestivum
  Clone ID: PAT_TA_37403
gatacgcatacggggatacgggatacggcattttccaaaaacagccattcggggatacagcggggtatataagtatttagaaaaataaatatgaaagtatatagaaaaataaatttgaattaagatctaatgagaattttttagtactggatatatattgtctcctttctattcatgaaagactgagagcagtccactcacagcccatgtagctgtccgtccacttagagcccatgtagctgtccatccacttagagcccatgtaaggcccaattccagaaaaccctagactagtagcactccagctgctccagccgaccccaacctcccattctcgtactccctttctccagccgccagtgaagaaaggaaacgacagcgccgccaa

SEQ ID NO: 37404 - DNA, 403 bp, Triticum aestivum
  Clone ID: PAT_TA_37404
gggtcgacgggcgcaggtttgggcagctggagcaacaagaccagaggttgaagacgcggcttggctgttggattaacatccaacggtcagtgcagctagaataatttattgactaagttggcaaagccctgcgtacgcgttaacttagtaggcccacaagccagcctccaaatatggtgggtcccagctagcagggggaatcaatttttttcgcgtaataaggtggcacttccttgcatgcgaagatgttttctggttttttttctttttttctttttcgagttagaataaaaagaaaacaatttaacatctttgatacaatctatattttcatgaaaaggatcataataaagctggcgggtcccagctgtcagggagaggaaactttttatttccgcataat

SEQ ID NO: 37405 - DNA, 367 bp, Triticum aestivum
  Clone ID: PAT_TA_37405
aatccggcttcgataagctcggccagctcctcccccatggcttgttgcttgggttcggaaaagtgccgcagtgtttgcttgaccggtttaaatccctttaatatattgaggctatgttcggccaacttgcgtgggatccctggcatatctgacgggtgccaggcaaatatgtccaagttttcgcagaggaatactcatagtgcggcgtcaactgttgggttcagctacgctccgatagatgttgtcttcttggggtccgttgggtggacctggaatttgactatttcttctgctggtttgaaggaggtggatttggggcgtttatcgaggattatgtcgtccctgtccaccatggagcacagtgcag

SEQ ID NO: 37406 - DNA, 411 bp, Triticum aestivum
  Clone ID: PAT_TA_37406
gaggataaagaaaacgaagaagatgaagaagaagaagaagaagaagacgacgaagaagaagaagttgaagaagaagaagacgaagaagaatgaagaagaagatgaagaagaagacgaagacgaagaagatgaagaagaagaataagaagaagaagaagaagatgaagcagaagaatctgaagatgatgaagaagatgtagtcgaatacgatgacgagttagctgacgatcaagatgaatccgttgcgcataacttgtcgacggcgatgctgaggacttcgactcaggtttgcaactggacgattacgctgaccaggaccatgacgtttgagacgaatttgatccttcgtacgccgattggcagcccgaccaatacttcgttcataacacctcctctgactcggtccggtct

SEQ ID NO: 37407 - DNA, 409 bp, Triticum aestivum
  Clone ID: PAT_TA_37407
agtgatactcaaccaaatcctatgtcttcgagcaaagacaatgagagcaaaccttatccagagctggatgagtcagctttgtttgtagcccaagccaagctgtcgcgtgtgtttgaaatctcaccgttgggcacgtatcagttccttagtgacccaaggtcatttcggacatatcatgtcgggttgcctcctggctataaatagcccactccctacaccataaatttgtggctgctcagagttagtgcacggcttttttcgtttgagaacaaccctcctccgaagcatttgagagagagagagatcattgcgaggactaatgtcacatccctagttctggtatgctcaaggctagctagtcatgtgtgcatcatgtttcaattccatttaaatttgaaatgaggatttg

SEQ ID NO: 37408 - DNA, 413 bp, Triticum aestivum
  Clone ID: PAT_TA_37408
ggggttaaatggattctatcccggctatatgaataagcttgttgctgcactacggcagtttgaagaagatctctcgcccgccgtgtctcaactgtctctattgaatctccttccattggaatggctgccaagcgtgaggccgcagcaatcatgttatccagggggctcgaaaagtgacccgatggtgtaggcacatactgtggcaggttaactgtccgtcgaggtggctccgttgctcgtggctgatccaaggcgatcctaggcgcttcggctcggtttgcggctgtcggattactcggcccggcgcctggcgtttgaaagagatttattccttcgtaaaccggtggcaggcgcgaccgatacttcgttcataacacctcctctgacgcggtccggtctagcatgagccgata

SEQ ID NO: 37409 - DNA, 367 bp, Triticum aestivum
  Clone ID: PAT_TA_37409
atagcatcattgcccagacattgtcatctgcaaagtataaaccataagttgctgttctcagtgattcaaagtgcatatagtgactcacatctccaacaaggtacattgctgatatgagactttgataatgcagtgtccggaagcgacaagcaaaatgttaattctgtgagcatcactgcaccgatgtaatgcatgtagacatgttaacatgtgcttagctatactgtagaaattggtaaccctttgcaatttggttgcatggttgcttgagagagaccatcttcatcctatgccacatactgcatgcttacatcttacgtcatccaatttcaggacacttgcaactgctctacaaacctcagcacat

SEQ ID NO: 37410 - DNA, 416 bp, Triticum aestivum
  Clone ID: PAT_TA_37410
gggtcgacggcaatacggatattgatgaggatataggcctgggggtcacccgccaggagggccgggttactccaaggatcattaccagaagcccggagttaagtttcaggataatgggccagagatgggctgagacccggatatagcttaaagcctgtagttacaatcattgttatagtagacttgtagtgtaaggcaagtattgtttagagtccaagccggacactcttatgagccggccggactctaagggctgctgggcgtcagcctccttatataaagggacgacccggcggcggtttggggacaacaatctctccgagagccgggcatagctgtttagctccctggcgatcgtaaccctaatcaataacacctcgaactggacgtaagcttttaccttcaacctaaggggg

SEQ ID NO: 37411 - DNA, 138 bp, Triticum aestivum
  Clone ID: PAT_TA_37411
aacgaacagcagggggcggtagaactccacatctggccgggtgatcagcatcatgtaatgcactgtgcctccgtgtcagatctctctcgttcgtcttcatttctgtaggattcattttatccacttattcagtcatgt

SEQ ID NO: 37412 - DNA, 390 bp, Triticum aestivum
  unsure (1)..(390): unsure at all n locations
  Clone ID: PAT_TA_37412
ggcctgagtgcaccatgtgtcttaggacgcacatggcttattatgtaagccgagtgccctctcattgtgtttgccgacacggtggggttcccaactgctaccacatgtccaatataaaatgagtctttagctaccgcactcggcttatatataaaccagcacatgtcatttagttctttggcttctataagacgagtactttttctgggccatatggcttacgattttgtaagtcgagtgcttgaaataggtgaccgagttatacgtataatataagccgagcgcattggctcagagacacagcttatataatatacgtcgagtgcttttacctgngcagcccggcttatagtgggtaagcccattactgcactcggcttatatgccaag

SEQ ID NO: 37413 - DNA, 434 bp, Triticum aestivum
  Clone ID: PAT_TA_37413
cccgggccgacgggtcaacttatcaacccagggaagtgttccatccttttttccgataattgcatgcagtcggtggcggatgaagtgaaacatattctggagattactcagcaggtttttgagcctaagtatttgggcttaccagtcccggaagggagaatgcacaaagggcagtttgagactactcaagaaagactacggaagaggcttgttgactggagcgagcagtacgtctcgtcaggcaacaaggagatcttgataaaggcagttgcgcaagcaataccaacctatgtcatgagtgttttccgcctccctgcctcggtgtgtgatgatctcacacagatgatgagacaatattggtgggggtggagaaaggcaaaaggaagatggcatggcttagttgggaaaagatgatgctaccaagagtatgggtg

SEQ ID NO: 37414 - DNA, 351 bp, Triticum aestivum
  Clone ID: PAT_TA_37414
cacgtttacagggggtcaacccgggaagaagccaacccaagggaaaggtcacactgcccgtgacttttggaagcgacctgaacttcaggacgatgtggatcgtgttcgatgttgccaggatcccctggccctacaatgggatccttggctgcccagcgctggccaagttcatggcggcgtcacactacgcctacaacaccctgaagatgccgggacctgtgacgatcatcaccatcccctccgacaagaaagatgcactgatttgtgctgaccaactaaaccagcaagcagttgcagcagccgctgccgctagggcacttgctcttgccgctgagaccccgggggaaaaaa

SEQ ID NO: 37415 - DNA, 383 bp, Triticum aestivum
  Clone ID: PAT_TA_37415
gagggctggtccaatgtttattacatatggaccgtcgattggagcagcactttctgctctcaaagctccaaaagttagttatttttacatatggaccgtctattggagatgctctgagcagtagatatataagattagtcgggtgcacaacacccctttgttatggacacacatcccttttatggcaccaggaatatgcgtctgtatggcttcccaactttttttgttcacatcaatacagacacaagtgctcatatatgcacacatacactaaccctatcaatacacacacgaacaccctacccctatgagaacctccgagatactgaaccgacatatcatcttgagattttatgaagtcaccgtacgtgcctcatatttga

SEQ ID NO: 37416 - DNA, 422 bp, Triticum aestivum
  unsure (1)..(422): unsure at all n locations
  Clone ID: PAT_TA_37416
ggtggtatgaccgaagccggtaatcataacatcatccgccttgtcatcagcagccttcactggacttgacggtttatcagcagccttaactgggcttgacggtttatcagtgtctcggaccgggcttgtcggtttatcagactggcctgttgggtcaacctccacttgttcaacaacaaaatcataatcttgcggcggtgggtcattaagcatggcatcggcatttgtatcctccagatctagagttttttccggttcaatagctacattgtcgtcagccggtttatttaaccgggccttcttgttgggtcaaggtttggcactgaagagaacaaacataaaggtcaatacatcggacaaatataatatatcaaggataaaattaanacataactcaaccaggaaccgtcttgaggggtgga

SEQ ID NO: 37417 - DNA, 390 bp, Triticum aestivum
  Clone ID: PAT_TA_37417
agtctgcaacattctgatccgtgtgtgctttacaaatctctatgtcatcttgtagatgcagctaccacgcgctactacgagctattccaaataactactctactatacgaatccggtttactactcagagtcatacggattagtgtcaaagtttgcatcgacgtaaccctttacgacgaactcttttaccacctccataatcgagaaaattccttagtccactagatactacggacaagttcgaccgctgtcatgtgatccattcccggatcactattgtaccccttgactaactcatggcaaggcacacttcaggtgcggtacacagcatagcatattgtagagcctacgtctaaagcataggggacgaccttcgtcctttctctctct

SEQ ID NO: 37418 - DNA, 383 bp, Triticum aestivum
  Clone ID: PAT_TA_37418
ggcttcaatttaaatgggtttccttccacctttgattttttaatggccccttaattttgggttttaattgggtttcccaatttgaattggtttttccgttttccattggttcctttttggttcatcacaccttaacgttttttcagtacacagtcatctgaaacatttcttgtatacccggtgaacattttgacatacataattaacgttttctgagaaatgatattttctcagtctacttcttcttatacacactgtatactttgggtatatatctaatacatgtttagcagtgtgaaatacacgattagcattttttaatacattgtcaacaatttttctagacacattgaacattttttaaatgcttgactaacattttc

SEQ ID NO: 37419 - DNA, 434 bp, Triticum aestivum
  Clone ID: PAT_TA_37419
gggtcgacggggagagccaggtgtctcatccggcaccgagatcaacgacaaacaatcatgttgacccctttgggccagcaacagaggaagagatggatgctgatttgatgaggatagatgccatggaagaggatcatgaagtcacttcccgcctccaagatggactcacaatgggagaagtgcagagctcatctattccaaactcggttatcccttccaatgttagatttctttcttatgagattatgaaaaagagtgtcactggttctcccgcggctatgcagcacccttgggtgcagggagctttggctgttacaggaaaactccgcaaggaaataatgaacctcaagcagcaagtcaacaagcttgaggaggaaaatcgtatcttgaagggcatcatcgccaagaacatcacaatcacatccccgaaaaga

SEQ ID NO: 37420 - DNA, 405 bp, Triticum aestivum
  Clone ID: PAT_TA_37420
cagataaattggcatagtctgacaaatccgtttttctcttccccttattcataaaggcaaattcatccttggcggtatgcttggataaaacaactagattgcctggggcggtatatgccgtgccagtaacaacaacgtcatcatccttggcggggcttgacgggttgatattctccttagcagggcttggcgctttggcagtagggctcggcggcttggtaccatggcttggcggatcagcagtttgatttggaggggtggcatcagttgatgtatcgacctgtatcttcggttcagcctttggcggattagcatcagcacctggattttccagagtagagtggtctgtggcagtctcaggattttcgccctcatcttcaaggctcttctccgaatcaacttcat

SEQ ID NO: 37421 - DNA, 387 bp, Triticum aestivum
  Clone ID: PAT_TA_37421
atatcacgcttgttaacacagtcgaggtcatgctcatccgccggatacgcccgtgccaacagcggacgttcaacctgtcggagtgtgctccggcacatcaccatcccttgagcaagctcctcgatcctacttacgaagacccctccaacgtgtcgttcaatggcaccaaagctctcgcaaccgcgactgacaatcccggattcagcctgcagcgtcaagccagtgaagtaagcaatttcaccctttacgagacgcatgtagctcaaagtttgaatccatgcatgatctaaactcccccaccttagccaggcctggcacatgaagtccaggtacgttaactgtccggctcccgtagcagacgacccatcagacgcccgattgacgggg

SEQ ID NO: 37422 - DNA, 213 bp, Triticum aestivum
  Clone ID: PAT_TA_37422
gatacgcagtaggtggaccctttcacagccgtccaccactaagcatctacccgcactttcgctcgtcctcttgacgaagacctctatattgtagcaggggtgtggtattaataccttcctcaactcctgaacatacaggtggtttgagacgtactcattagtgaagtgcattgctaaggcccgacaagggtgttgtatgaaaaacttccacaa

SEQ ID NO: 37423 - DNA, 385 bp, Triticum aestivum
  Clone ID: PAT_TA_37423
gtctcccatttagaaaaacccatgaccatagaaagccaaaaaacttaggctctacatcattgatgaggctgtagctgtctaactgttcagcgaaaattatacctcaaagaagatagcgcctttttcttggtccggaaactcaagcctgcaaagcatgtattctatatgaaaacatctaaattttgagtgtcaaatcttcaagcagtcaattgccttgaagcacattatagagcagaaattcatttgaaataaaataattatctatatatgcatgctcttgaataaccttttttgcatctaatcatcatggatgatatcgtacaacccaaccacccaaataccattactcttgatgcagacataagctaaatagctaacttttttt

SEQ ID NO: 37424 - DNA, 342 bp, Triticum aestivum
  Clone ID: PAT_TA_37424
gaaaatcaagctccaagcgggacgagatccgcgccgcatccgtagatgacacacggtactggcacattcacggcttacatatcaaagttttggccaccgagcaggactcagtcgagagcttatatatgagaaataatgagacacatacgaccatatgtatgcgtgttatatgataactataaacattggttttcccgaatctcaatatggtctgtttcctttgcaaagtgcttttcttcgattgtagagagataacatagaatttcacatagactgcaatcatatggaaagtaaattcaagtttagaacaaagggattcaacgtacagctgaagtacaaaag

SEQ ID NO: 37425 - DNA, 289 bp, Triticum aestivum
  Clone ID: PAT_TA_37425
aggatcatccggagatcgcgacgagtttagaatctgcttttactgtaacatttgcaaaacgtagaacaggatattgcggaattgaagtctgcaattaaggagcttgattcacaattgatgccaccatcagtgcaaacaagactattatcgcttgttccaacaattcactaggaatttacacgcttaaatactctggctgaagagatttataggcgggatagtccaaactgcatgaaaatgttgctgcagtcaattctactccatccagcattcataggaagatgctaat

SEQ ID NO: 37426 - DNA, 403 bp, Triticum aestivum
  Clone ID: PAT_TA_37426
cgggtcgagcgcgtctccttgaccgtaaccccttgtgtgtttggaaatagtaaccgacgttcatcattcaccttaatcccaaaaccccctttttgcgtaaaggaatcaatctggtttctccatgccggatcaaaacctttcatacgcaaagcttgttaaaggaaacgccatttgactttatcatatgctttttcaaaatccactttaaaaactacgccatcaagttttttggagtggatttcatggagcgtttcatgcaagacaacaaccccttccaggatgtttctatcaggcatgaaagcagattgggacggctgaacaaccccttccaggatcgaagtttgtgaagtttgattttttttaatctagacgcactatattgtggaacggaggcagtggtact

SEQ ID NO: 37427 - DNA, 426 bp, Triticum aestivum
  Clone ID: PAT_TA_37427
cgtgtagcgctgggctgcggaatcttaaaatttgagtgtgcgacgaaacgggccaccgagctggaccgagcgaaaacaggctcggctcggtcgctgaacgggcctatatttccagctcggctcgtcctttttagttgtcgggccgagcccagtcgggccgagctagaacgagcttcgagccgagctaaaatgctcgctcgtacgtccagccctagtcctagggcatgcccacctagccgggaaacggcgtggtgagagacccctagccaagacatcatcagttgctcctaatcagtcttcaagtcacggacgctcctcgattttcctgagctattcttcatacatcagtcattggttttgaaaactggtttaacaagtcatctcgtatccaatttcttgatagtctaattgtacccgaggagtttt

SEQ ID NO: 37428 - DNA, 384 bp, Triticum aestivum
  Clone ID: PAT_TA_37428
taatcccaatttcaaaccagttttggaatttcaaatttccttaaaaaatacaattgttaagatggtcctccaataaactagttattttaactaaggacaacttaacaaatcgtaattggacaggccctattaggtgtagtttctgtgatcggaatgagacgatcaaacacctttttctagattgcccgctatccaaagttttatggcagacggtccatattacatttaatattactccaccgaattctgtcatcacgttatttgggacgtggcttaacaggatacagcctgacttggcgatacatatacgtgtacgagtttgtgcactgctgttgactgtatcgacctgcatatatgatttggtttttaacaggatatcacata

SEQ ID NO: 37429 - DNA, 283 bp, Triticum aestivum
  Clone ID: PAT_TA_37429
gggtcgacgcagagatgagttgcaccctcgcgtcctccacagaaacgagtgccaagagctggctttttagcctgcttgatacattaccgcatgataagtttgtcctactggcggtgaccctatgggcaatatggacagcacgacgaaaggccattcatgaggcgattttccaaactccacatgcaatacaaatgttcatcacccggtttcttgcagacctggaagctatccgtactcctaatcctacacgggctccgttggcaaggacaggtactttgataca

SEQ ID NO: 37430 - DNA, 430 bp, Triticum aestivum
  Clone ID: PAT_TA_37430
ttcatctttttaatatctttcatgggctgctgactctgttcatacaaacgacaaacttgtgtaaaatctatttcactgtcctgttgacttgtctgaccctgagtgaaattgtggttctgcggtgtgccataattttcttctggctaagttggcacggagcgcgtccaaggacgagacatctttcactctggggatatattttgtgaactcgtaagataagaaagagagtcgcaaaggtcgataaaatcacacacaaagaacatttttttaaactccaggatatttttggaaacacacgattgcgcgcggagaaggactattacatatcttacacgtgggcataattatacattacatcactcaggatatgcgtacataatcctgacatgttatttaaactagtgcactcctccagatcctacatgatgcg

SEQ ID NO: 37431 - DNA, 391 bp, Triticum aestivum
  Clone ID: PAT_TA_37431
cgggtcgacagggatattgaacacggccaaaacacgaaatgcgccccgatgcaaatcaacttgcctgaaacctggcatgacacgcaaggtcattacattgaatgtacttgcaagctcacaacagacatacgcacgatggtagacaatatcatgataattaatcaagttaaattaatgcaagaaattactacaaatgcaaagctatgcaaagcaaccaaacagcgcatctagtcacacggactcgcttaccagacggttacctcataaccaaatggtgacctcaccggggtcagacctgaaaccaatcactcatgaacacctcgagtgttcaaggttcaccatgaaacaatgcaccacaacaattactagtttgcaagattaattataaaag

SEQ ID NO: 37432 - DNA, 225 bp, Triticum aestivum
  Clone ID: PAT_TA_37432
gatatcaaactcgagtacacgtcccaaacctcggtccgttctcaacctcgccgccgtccgtcacaactccagaattccctccccatggctctcatcaagatccgcatcaatggctaccgccgggtcggcacgctctgtggacagagttgcgctccaaaaccacgatgtcgaggacgacacggtcaacgacaccttcaacaccaccgactacatgacctacatgtc

SEQ ID NO: 37433 - DNA, 425 bp, Triticum aestivum
  Clone ID: PAT_TA_37433
gggccgaccgggcaagaaggaaaaaatgaaaaggaccccccggtcttatttataaggtgaaaggataagtgacaggcgtgaaaatcgaggagcccaaaagttggatatgtgacaaagcggtcgcctcgattatcggaggctcattaatgaaggtgaggtatattcaatttttaataacaggtgacgtcgtggcggtttattacgaacctggaagatgacgtcatggcgttttacaggatttatgtgaaggtgtggaaggaggaatttttctatgtgttgaagattgacatgaacaagttcaaatcaatctcgggcctaatgttggagatattactattaagtataaaccggccatgaagggccgggttatgctcacaatgagttagtcgagtttgaaacccatgaagacaagaagtatggcactt

SEQ ID NO: 37434 - DNA, 164 bp, Triticum aestivum
  Clone ID: PAT_TA_37434
cgggccggccgggctctcagggtgaaagtgataacgagatcctaatgttagatttagtaaaattcacttaacccgaataaaagagagatcagagtccgagagtataggcaaggagtaaaagatcctaataccacccaatggcgaagtgggcccgtaagccacac

SEQ ID NO: 37435 - DNA, 202 bp, Triticum aestivum
  Clone ID: PAT_TA_37435
attctgaatttccttccatgtatgccagcgtacatgtactacgtatgcactcattttctcttggatggcttggctaatggctatggatgaaagaatccattcaaaaatcatccactgggaacgtcctgtcgttacccaaacaaatatgtttgcaacacatctccctttcactagatgcctcatcagccaacaagtgcacacc

SEQ ID NO: 37436 - DNA, 384 bp, Triticum aestivum
  Clone ID: PAT_TA_37436
gtgacatgaaccttcaagaagaagagatcctaaagttggcttcattgggcaaccatggcaaccttgagaatgctgttgacgttctgaagagatcacttgctctccgcaacaagagctacaaagacttgatggtccaatgcaatcatctgggaagatcagaaagtcgcgctcagcagaggattgagaaggacaaagagctgataaagaagttgagggcaaaggtacttgatcttcagaaggaactggaagaaaaggaaaataatgtcatcagagacttgaggtcttcaaagaaatttaaagctgaccagaaccagacaaatccagtgaatgccaatgctaataatggtttctctagtccaagtgctggatatgggaatcaaacag

SEQ ID NO: 37437 - DNA, 380 bp, Triticum aestivum
  Clone ID: PAT_TA_37437
tgcctagccgggaaacggcccttcgttaatgcggaggaatccctaagactccaataagtcattgagtggttgatcagtctcacgctatatcatgacagtccgttttcggctttctctactgaggtgctcgtctggatgaaccagggagcggaacgtaaggcagcaaaacacaggagccgggcaaacctaacatttgaccaaagacatgatttggagctgatgcatataaggccaaactcgcgacgccgaacactccctaaggtattcggtctttatggtgtaaactgggtctaaatagtaccctttgtaataagcccctggtgtccaggtacgtgcattattctggcgtggccacatgccaagacgtcagcatccttctc

SEQ ID NO: 37438 - DNA, 332 bp, Triticum aestivum
  Clone ID: PAT_TA_37438
tcacggtctagaatatcccgggccgacgggtacctgtacatctacctcccatcgtacaatactcgatagaccattgctcatccaaccctcgaccatcgactgatcatccagcccgcaatatcacagggtcgtgtccatccacgattcgaccttctaacattcatccaaccctctaacataacactatgtcccgatcatcaagaccacttctacagcgcaccattcatcgaagtactcttcgcctgcattcctgaatattcagcctatctgacgccgtgataggatacagctagtacggatacgccggaaatcgatctatatgccttactttt

SEQ ID NO: 37439 - DNA, 368 bp, Triticum aestivum
  unsure (1)..(368): unsure at all n locations
  Clone ID: PAT_TA_37439
gggccgaccgggttgccaaatcacaaacagttcattcgagtgaaccgtatgttgtatatcgcacaaaccttcatctggctgcncgtttcttttgttcctcctcatcacaaacaattcatcccagtgaaccgtatgctgtgtatcgcacacaccttcatctggctacccgtttcttttgttcctcctcatcgcaaacagttaattgaaatgaactgtatgcccttcatcacacacgcaactaaaaccttaaccgtgtttgatgcatccgtcatcgcaaacattttatacatttttgacggttttcatacaccactgtttgtgattattgcatcgcacacagtttctcgaaaggtctctgattatagtgt

SEQ ID NO: 37440 - DNA, 363 bp, Triticum aestivum
  Clone ID: PAT_TA_37440
cattttattgatcgctgcactacatgtcaaaaagctgagtcacgactcaatcctcatggtttatatatacctttgcctgtaactaatgttccttgggaggatctatctatggactttactttccgtttacctctaataaacaaggggatggatagcagatttgatgtcttcgatagattctccaaaatggaacactttataccacgacactagagcgatgagcctgtaaaggttgctgatttgtactttcatgaaattatacgcttgcatagtgtgccaaatactagtgtttcagatcataatactaaatttcttagccactttccgagatttcgatggcctacgttggggacaaaacggctt

SEQ ID NO: 37441 - DNA, 396 bp, Triticum aestivum
  Clone ID: PAT_TA_37441
agaagagtgcacggagacgatgtggtctctcgccagctctccgtgggctctaaggcatgtcggcaactcggcatagacggacgggcaatcagtttcattagatcgggtgcaaaaagaattgtgtgagagagatgcgcttggcaagtaagcatgtcaatggcgcaggaccggtcaaaatgtgccacatcagcgaaatacattggatacggtagggcttgaccgtagagtgacacatttctgcgacctcaatgaccatattttaacacttttgaattacggtgatgaaagtgaaccctagagtcaagttcaggtactaaagatgtaatttactcgatataatttggtctcatccaacttttatagccattggatgtgatgctataagatgcatgtgtg

SEQ ID NO: 37442 - DNA, 217 bp, Triticum aestivum
  Clone ID: PAT_TA_37442
atggtggtatagtacgaaagcagctgtaattccagggacgatcaatgatcgaagaatatcaatctatcgatacaccgtggcttacaacctggtcagaattattccgtatatgaagttgaatcagatcatgtggatttacaaaatttgagcgagaatgtgttgcatgtttagaatatgatcccttaccctgcattgaatcaattcgttgcgatctatt

SEQ ID NO: 37443 - DNA, 352 bp, Triticum aestivum
  Clone ID: PAT_TA_37443
cggatgtaggaggccatctgctctcccaggggcctgttggaaatccaagggcgccgccaaggggaacaacggccggtaggccacattgaaccctaatggaactccaaatgcaaagtgttttcacagcgagctatgacttcgaccatgtcgatgttaacgtcagtcgaaagcgcaaagacgtgaagtcctcctacgtgccacgcaaaatgtcggactctatgatctgcgtgcaagaaactctccaagaactaatgtttgacctcgagggtgttttcttggcaaccaatgacctgacgacaactccgacattatcaggacgagcatactcactcacaccagacatgacggggac

SEQ ID NO: 37444 - DNA, 397 bp, Triticum aestivum
  Clone ID: PAT_TA_37444
gagacacaaagacacatagatttatactggttcgggccaccgttgtggtgtaataccctcatccagtgtggtgtggtggattgcctcgaggggctatgaatgaactagtacaaggatgaacaagcctgaggaggtgaggtgttcttgagctggtgtggtgctctgcttgttctgattccggtcctcttctatggtggtggctaagtcctatatatagtggccttggtcctcttcccaaatatgagagggaagggattccacaacggcgggatttgaaaggtcacaagtagtacagtctatcctgacaaaagtagtcttcgcctacgaaaagcctctggtcgtgacgctgcggtgggctcggtgatgacctccgtcctgtcgtcctggcggtcttggt

SEQ ID NO: 37445 - DNA, 420 bp, Triticum aestivum
  Clone ID: PAT_TA_37445
ggtcagatatccgggtcgaccggattccattgtatgccatatagagattcgtgaggaagcggaggatccgaggaaggtaggtggaggctgggatacgccagagtggaagatcgtgcagcggcgctcgtcaccggagacggtgaagaaagagcctgtgccggcgattccgggtacttttctgctgatttcttagcaaggggggattggggaccgagggagggacctcatggaaagaatggaggaggtagggacacatcacagaaagagattgatgcctggtggtcgtctttcccgagtccggtcactgcgaagctagtaatcccatacaaaccagagagcccctacctgattcgctcctccacaagtagtttttcttttagaataatacatccagaagaagtaattggggggctgacagca

SEQ ID NO: 37446 - DNA, 171 bp, Triticum aestivum
  Clone ID: PAT_TA_37446
cgggctcgacgggacggcaacgtagtcgtgaactagtcctgatagatggtacggatttggtcatgacaccgacgtcccaggacatgaatagggcaacactctacaagatgattttgtgagtcctcgattcttcggattcacagtacttcaacaatttctcctgaactcaag

SEQ ID NO: 37447 - DNA, 359 bp, Triticum aestivum
  Clone ID: PAT_TA_37447
cgggtcgacgggaattgggaccaagagccttgcacgacctagggttagtttgaagctgccttgggacgtccttccacctccttggccgccgtcccttgcgcctatataggtacatccatctactagcgttttccttgggatttctttaattaaaagttagccatcgcagcgtcatgtacttcgtttgtgtccaccgagcagagcaagaccgcatatggatgcatacaatcatcaataattcagatatatttgcgacattcagattgctttatcatagtcttgctcgttcttcgattgcttggacgaatataccatcgtggtcaggctgaccgtgcttgcggcatcgtcagtaacctcag

SEQ ID NO: 37448 - DNA, 277 bp, Triticum aestivum
  Clone ID: PAT_TA_37448
gagtaccacaagggcatctaggacgatggaatctaagccatccgcctcatcgctagcatcaggatcgcacctgacaacaagaggagtagcaggtactgttcaaggatgctactcacgcatcaccattacctaaggttgttgcgttggctaaagttaacgtggatgaattgccatcgaacctacaggtggaatcgtttcttgaatgcagcccccctagtttcggttttccttgcaaggtccccaataattcttatcaacaagttaaggtcaagggttt

SEQ ID NO: 37449 - DNA, 383 bp, Triticum aestivum
  Clone ID: PAT_TA_37449
tggcctgggacggcgagaagactcgctgatcggggcagcgtcctcggttccgtgaagcaggggaggaagacgtcgatggacttggcatctccggccttggatcgcagaggaacggggtcatggcggcgtctcgatgcgcgtgggtggagatagggtcggcgacgagcttgctacgccggaggaaagcttgagcacgagccggccatggcgtcgggcggaggtgatggggcgaggtggagctacccttacctggctggtggcgcggaggaggaagggaggaggaaggggaaaccctagggagggggcgctggttaaaaaggacgggcgtgggcgccgtggtagccacggtggccatgtgcccctgaatattactgtgagtggag

SEQ ID NO: 37450 - DNA, 355 bp, Triticum aestivum
  Clone ID: PAT_TA_37450
cggtctagaaatccgggtcgaccggtatgtggatcaaagagtaggagacagccctaccaaacacagacacacacagagagagaaagacacagagaaaggaaaaagttaggtctgtcaaaaagatcgtgacatgttatatacttgattccgtatacgtggaaagacaatacacaacatgtttgatgacacagctggagaaacatcgaccataagggaatgatctcatgggttcatggattgacacttttgtgaggtgggagagatggattggtaattttgtgcaccaaacataaggtcgcgggagatgtcaatcagccatcgtcacatcatcctgcgtcaacatgacaccgcattc

SEQ ID NO: 37451 - DNA, 410 bp, Triticum aestivum
  unsure (1)..(410): unsure at all n locations
  Clone ID: PAT_TA_37451
cgggccgacggggatacaaaattgatcggttacagaagaaagatcgggagaggttgagacaaaagaaaaaataaaataggtttttaaacagggttctatctcctatacaacaaccaattctaacangtattactcctatatttcagactttgtgttaaattcgtggtccaatgtttggtgggaaaatcagaaatactatgcactgacgatagtttgcttgctgtgtaacctgtatcatcagtgtcccacagtatatgctgcttgcaacattttgagtgcagcatcaacatgtttcagctgccttttgtgcatcctggtgtcctgattgtcatgtacatcaattatcaacaaaacattccaattgtctttaagcatacattgttatgatcagatatatgcctttgaacttc

SEQ ID NO: 37452 - DNA, 348 bp, Triticum aestivum
  Clone ID: PAT_TA_37452
tgccaggactagctctctcctaggtggtctcaacctgccctatcattccgcgacaatgtagctgttgggggccgtccttgaactcaagcccaccactacttggagcgagccacttatcctctcagccaccacatcggaatcacttgtgggtactctacgagccgaccctaccttattcaccacatgtatcatataccatgtatgtcattacgtccccgtgatcatctcccaattgatcatggtcctattccatatcatggcagacggacaataatgtatggccactgattgtgacactatcatcctatactaagcatttaagattgtaggtaaaggtaacaacatcta

SEQ ID NO: 37453 - DNA, 342 bp, Triticum aestivum
  Clone ID: PAT_TA_37453
tctgtttagccatgttccagtttttctactaagtctgaatctgttaacgaaagttactatgttcacatggttgccattgtattttctgatcccttttggcttatggtaagtaagggacttttgttgtatgctttgagtagcttcatgccatgccttgctttgccatgatatgttcatatagcatgttgttatcatgctctaaacattgcatcctgatgttaaattccgggcaagttgttattttctctaagtctgtaacctgatatcttttgcacttttgccatgcttgtttgaacctgctattatgtgagttatccgtagctcagtgttcatcttgtggca

SEQ ID NO: 37454 - DNA, 352 bp, Triticum aestivum
  Clone ID: PAT_TA_37454
ggctcccaatgtccgggaaggctctgattaccaacttgtaatgccctcgatacggctatatcgcctacgtgtcgagccatgacttacatgcataaccacattcaaagcattgtcgcaagtaaggcactcttcagaacatcccatgtttatagatactacaagggaaggtacatagttggcttacactcgccatatcacacatagtacatatatagcattacatcaaccaatcaatcatggcacgactaccgtgccaaactaagagatcaacccaacatgcgacacagtcccgatcgctccaactgggcaccactactgatcatcagggaaagacacatactaactgcgtgag

SEQ ID NO: 37455 - DNA, 249 bp, Triticum aestivum
  Clone ID: PAT_TA_37455
cgggtcgaccggaagctgatcgtaatcggcaaatcgagtctcgtcatctgaggtacggttgagatctagggaattctgtgtccagatggtcgctcctcacatagaatgggccaggaggtccgcgaggtcgttcctcgactattagaagttgctcttagacacatggatatccctctgatgggagaacctgactatggccacgaggatcatgcattgattgttaaacctgcagtcgctctagcctgtaac

SEQ ID NO: 37456 - DNA, 413 bp, Triticum aestivum
  Clone ID: PAT_TA_37456
tccacccattcgtcttcgtgcattggtaactttacttggagctatatttgtatttgctacatgagatgtgttttgcttggatcgtcgtacactatactagtcattgccttttagtttatcacaatcatccttgctgtgcacacctttttgggagaagcctacttggttcgaatttgctagaatacgtctatgtgcgtcacgttagatcttttgagcttgatagtttttgctctattgcttcacttatatctttcagagcacggtggtgtcataattttgaataaattgctaatctgtcatgcttcacttatataattgtgagagtcttttagaccaacatggtgattgctatggtcataaagttggtcctagattgatgagcatcccagttgggtataatgttggctatctta

SEQ ID NO: 37457 - DNA, 242 bp, Triticum aestivum
  Clone ID: PAT_TA_37457
gggtcgacgcgggccaggaacacatctctcctaagtggtctcaacctgccctatcactccgcgacaaagtaactgttgggggccgtctggaactcatgcccaccacaacctggatggagccacctatcatttctgcccccacatcagtatcacttgtgggtactctacaatccgaccctactttagtcagcacatgtatcacacattatgtatgtaattatctaccggtgctcaactcccta

SEQ ID NO: 37458 - DNA, 171 bp, Triticum aestivum
  Clone ID: PAT_TA_37458
gaccacaacaaggccgcggaccacaataccaaggacggcgaacacaccaaggacagctagcacactgacggcacgccggagaacatcaacgacaagatcagcggccacggccacagcgaccgcaccaacgacagcgacaaaacaaaaaaccacaaaaaacacagaaaacct

SEQ ID NO: 37459 - DNA, 126 bp, Triticum aestivum
  Clone ID: PAT_TA_37459
ttaacacctttcttcatggtgtatgaggcagaggcggtcctcccatgtgatattcgtcatgattcgccccgggatgccaattatgttgaagaggacaatgaggaagcacaccaggaggcgttggac

SEQ ID NO: 37460 - DNA, 406 bp, Triticum aestivum
  Clone ID: PAT_TA_37460
cgggccgaccgggaggaaaaagggaaaacactcaactagcaaggaatcggtcacacaagcgctagatcaaagaacacaaagagatacatgagatccaaagtcaacaaaggtaaggatacaaaggtaaccgatcttctccatgaggaggtcttgaatccacaaggggatcttcccacgaggggggatgtttcctatgaaatctagtgcaaatgaatcatatggaaaaattcctatggtttacaatcctacgaatcaaacaaccaagataggaaaaattcctaatgattagaatcctccaaaattcctttgagaatcctttgaatcaaagaagcccttaatctatttgatgattcatggaattgtgtgttgtaaagcataaagtaaaaacaaataatggcaatttaac

SEQ ID NO: 37461 - DNA, 391 bp, Triticum aestivum
  Clone ID: PAT_TA_37461
tgaagagagtgacaaccatggataagtgtcaaaacctccaaacacaggagactctgatgctgcgcaactcactgaggatgtacatgcaaagctggttgaatagctcagaccttgtgtaggtcttctactcaatattctgtactcgattgtcaccgaacctttcataatcaacatgctgaatcacaagacatattctgctcgctgattgcgatcgctgtctcatctatgatcaagtcttacacttgtgtctaactactctacgatcagtatgttcgtatattattagtgcttatattctttgcattggttcacataactgtcatactatctcagaatctactactgacgatcaatcggtaaccagttagacatatgctgcttgttatatcaa

SEQ ID NO: 37462 - DNA, 403 bp, Triticum aestivum
  Clone ID: PAT_TA_37462
gcccgggccgacggggccaattcccaatgatccaaccccggctccaaatggaaatatgcgtcctgcggtcagaaagggagagagcattcgcccaaattaagtatggactaaaccgatgtgccgacggcaaaccggcggttggagccttcccaattgcggtgccaacaaggcgcatttgcagttacacacgcatgtgctcatacgtgtacacctacctgcattgactcggatttcatttgctgcccgtttgtcagaaacgtttagtacatatttctgcagactgcaggtcgatgattattcatggttttgtgaggtgaccaactaaccgttggtggatgaggaacgtttacctgggcaagttcttccactgtgagaacatactgccccacatgtcatcgacact

SEQ ID NO: 37463 - DNA, 330 bp, Triticum aestivum
  Clone ID: PAT_TA_37463
cgggtcgacgggatgatgcacgacctcatgccgactagtgttcataaatctcggcatatgggcatactggatggaaaacgcacgctaggaggcgaacacatcatatgtatcgacggatattctctcactgaaacacactatacagttctacataaatccgccttggtagctccgtaattggatgaacacaataatttgatacactccatacacccagagcggtctgatcactgcattatacgtgaacaagccaagagtttcgccagctggttgcagacatttaccatgcatgacacctataatgaatatgacatatacttgcagtcccaa

SEQ ID NO: 37464 - DNA, 404 bp, Triticum aestivum
  Clone ID: PAT_TA_37464
accaagccaatgatgcaaggcttctgttgttgctgctgcaagtcttcatcaacttagttgttccacagggagagatataaatccttcacttgttcactttgtaatctgcagattacttcttccattaatcacctagtgctcctgttagtgagattcatctagtattttttttgcaaagcatgcaatggtctggagtagttgatcatggcctgatggaacctctagctgaacaataagataggttagttagtgtagtagaggaagaaagatgatatatttattatttgcttttgctgcttctatatacacatgtatgtatgtttagttattcgacatgcttctgaaattgattgtgcttttagatcgaaacactatgcttgttcaaagagtgtccatgttgtgtg

SEQ ID NO: 37465 - DNA, 361 bp, Triticum aestivum
  Clone ID: PAT_TA_37465
gaagggtctaggatacctagggtttatgatgtctcgttgtttttgcatgctagcaagtcactccgggataccactttgaagaattcgcttgtgttgaaagatcttattactactgctgctctgtagcctacctgtgataacgtcaaatgtcgctgattatggaatgccttttatcctgcacataaggcatacgtgtatccctaggctgcgagagcgggcgctccatatgatgcaagcttgtcgtagcctgctagcaaagtcctagcccttctacagggtcaccaaaattcaaggcattggccgtgcgttttacaacatcttgactggtaaagccctgtcattatggaacttattccccttg

SEQ ID NO: 37466 - DNA, 353 bp, Triticum aestivum
  Clone ID: PAT_TA_37466
tgtgactgaacagatcccggtcgccgcagtccacctatcaactcaaccaagtcagtactccacgacctcgcagacctcctaacacatacaccgcctctctccgagccttggtcaactcattaatgcacaacatgcaattctcgcgcaacagcgaatccacatttaacttgatacaatcggttggcccataccctttcggcgtagagaatcattccgctcaggagaaacttcattcagggtgcagacagtcaggacattgtcgtcatacgaagtcgatattataccgagtgtcacttaccaaaccattactctcctgatgctgcagtgcaagcacttctctgattactcacagg

SEQ ID NO: 37467 - DNA, 187 bp, Triticum aestivum
  Clone ID: PAT_TA_37467
acgggtaacttaccacccatgtggtgatcctgggcatggatggtcctatgtagatagacaggcattcgagataccttcgttctttctagagtctgtgctcagagctattatctagggatgtgcttgtgtgtctgtaggacttgagtatcggatcgtatggatcctagactttttgaacatgttgtag

SEQ ID NO: 37468 - DNA, 418 bp, Triticum aestivum
  Clone ID: PAT_TA_37468
atgcgccccgctggcatggacacgtgtcggagcagggtggagcggcgacggacgggacatgggttagtctccgtccccgataaagtaagggacacctaatggggtgcattaaatgcaccttatcctgtaatggctagcgataagcttagccacgatacaccgatgccacctcctgtgtgccactgtggcaatccccttgactataaaaggaggcccgaggcatccaggagaaggattcggaccctgggacaagttacattcatggtagctagctcaagaactcaaagaacactcagatatacactaaagcaggactagggtgttacgcttccttccggcccggacctgggtaaacgacccgtgtgcttgtgctgattgctggtcctgctctcctcaacaccccgcgctccgcaaccat

SEQ ID NO: 37469 - DNA, 397 bp, Triticum aestivum
  Clone ID: PAT_TA_37469
agaatgaagaaagacctaaaggtcatgcttatttataaggaaggactgacagagagggcgcgagaaacgaggaggccaggcatggatatccagctactctgacgcctcgatttttgggatggtcattaagataaagatccgttgagatatgacagaataaaatgaatttaatggaagatgacatcatggcgggttatcatgaattcagaagatgacgtcatggcgggttataactttgcacagacaaaagccagaaagtttttcttaaagtattgaagattgacatgaaccggttcaaatcaatctggggcctaatgttggggatataactactggtgtaacccgcccaggaggggctgggttacgctataacaattcattatatgaagcccaatat

SEQ ID NO: 37470 - DNA, 166 bp, Triticum aestivum
  Clone ID: PAT_TA_37470
cggggaattcagcgctcactatcatgtcgagcagagcaaggccaatcgctctgaggacaatcattttctcatttacggcggattgtctaacatcgatcatcttgcacacatcggtgcgtgcgccgctcagaactctaccgaggcatcccgatggatgcctcaaact

SEQ ID NO: 37471 - DNA, 167 bp, Triticum aestivum
  Clone ID: PAT_TA_37471
agccatgttagactcaccgatcagttcctcagcctgaatagagaacgagatgctcgctgtatcggcacagtaagtgtcacagtttttgtggttacacacaacgttatcactgcacgtttcatcgtttcaactgttgctcctcccacttgcgcctccaccgatcttac

SEQ ID NO: 37472 - DNA, 363 bp, Triticum aestivum
  Clone ID: PAT_TA_37472
gttggtggggctggctctgcctttttggaattctggggaagctcggagttcctttgcgtgatgccaaaggtccattaacgctgccacgtattctcaggtatatagatatgcgcacagtcctgatggcaaagttatagaatcgcactatcacatagggttatagcttgttgggtatgccacacaacacccatgttcaagtcactggtataaacttggattacaatcaagtacgacgtgctggacccattgagaatctacgtctcaaagtgtctggaattgaagacgaggatatcatggcaggtttcgtactttcaagtgttgctaatcctattggtgctttcactgaatttaatgcccagctgc

SEQ ID NO: 37473 - DNA, 375 bp, Triticum aestivum
  Clone ID: PAT_TA_37473
agtcagtatatctcgatagaaccaattccaatccaggtagtgtgaacagaggatgtggaagttctgtttccttgccttgtcaagcatttcatctgacactctatctgtactatagctagatcaattcctaatcattcttccacgcgactttactccaaagaattttgccttcttagcttgactcgatctcacgatattggattgattggcacaccgcgcatctggcattcgcttctcctatctatctcttccaactaagctgatcactggaaaatatgtcctcctgcatgcaatcattccagagccaactacgacgatacctgatcttccactctgttcactggaggaaagactcgaaagtgaacaattcttcaa

SEQ ID NO: 37474 - DNA, 217 bp, Triticum aestivum
  Clone ID: PAT_TA_37474
atccatatccatcggatctgggacctatgctatcatgacataaatcgtctccaatctcgcgctggcagccgtcgcaactcatgcttcttgtgcaccgattggatgtactggtggtggcagtcgttctacggcacagtgtctccctgagctctgagttgactggcggtagcatctgtagcatgtgttgaggaatctctcctgcatgaggtctccattc

SEQ ID NO: 37475 - DNA, 246 bp, Triticum aestivum
  Clone ID: PAT_TA_37475
cagcagcactggtaactcaatgatggttgcgatctctcacaatatatatagtacttttatatgtgtcaactttaaggtttatatgtttgggctgtgcttttgtgatattttgggctgtcagtgctttgactgggttttaccatcccaatgtttggcattcaggtacgttttagcattacttctgcactcgtggtaagttaccttgccatgtcgcaacagtagttttgtctggtcagtggtgtttgt

SEQ ID NO: 37476 - DNA, 339 bp, Triticum aestivum
  Clone ID: PAT_TA_37476
gaggtatgtacttttggatatgatgatattgtgctttagaaagccttggtttatatcaacgtctgggcagttcggatacatcaactcgagcatgatgtccttcgaccattggtcatcgattacgcgggcaccctctaggacatcctcaatatatcgctctggcttgcggtggtccttgccacctgagtggaccctcaattgcgacgatggcggccttcattttcgcgcagtgcatcttgacacgggcatgggccagacgcgcattttccatacatgacgaacggttgatcatgacaatttgggacagcgcgtcaacgagtcgctgcaccagaccaaaat

SEQ ID NO: 37477 - DNA, 216 bp, Triticum aestivum
  Clone ID: PAT_TA_37477
ctttcggtttcgtgtcttgttccagttcctgttggcttttgtgttgtcttcttttcatgtttcgggtttagctgttttgggctatgcgcgtttggtctggcccgagcattggcctggctttgcgcatcgcgccgcagtgcatgctcggctagtcacgagcctagtcttggggatgcgccaggcctccgttctttctcctccgttcattggttcctt

SEQ ID NO: 37478 - DNA, 110 bp, Triticum aestivum
  Clone ID: PAT_TA_37478
acggaatcctcaaggacggagaattcttcatcgccgaggattgcatcgtcttcaaagggggcatgtaattactatcctcggcttctccatctgccgctcactcatgaggg

SEQ ID NO: 37479 - DNA, 175 bp, Triticum aestivum
  Clone ID: PAT_TA_37479
acgggaaactgtagtacggtccgtttggtttctcgcttgtcttcgtctttgtcagtcggcatgtgactttgggatgcttgttttcagattctggtttctactgaggttgtaagatattcttgtctactgcttgtggccgaatagtcgatcggatcgttttttgcttatttaggtg

SEQ ID NO: 37480 - DNA, 226 bp, Triticum aestivum
  Clone ID: PAT_TA_37480
ctgcggttgctgcagcgctctcgattgcatcattgtgcaatgcggtatgtggtttccagccgtggtgttcctgtatgtcgattactaaaggcggaagtcgatgtggtatagactccatgtccatgtggtcgctttcttgatgttctacttaggtagccgagcgtagggtctgaaacttcatctgcacagttgcctacatcaagttcttcggcgatcctttcacaaa

SEQ ID NO: 37481 - DNA, 401 bp, Triticum aestivum
  Clone ID: PAT_TA_37481
gacgggcacggacaaaggagaacagagcacctctcttcttccaggtcagtgagcagcatcaggaggaggagctcaagcacgaccaccaagaggcaccaccgcagcagcagactcgaaggagaccatatgcaaggcacctcctcttcggttgtgagagtgtccaggggtcatgggtgcggctaatgcctatgtctgtggctgcacttgacactgccctctctttaagggcacatatcattttttataactctgctatattttcccaagtctttattatcttgcctagccttgtcttgatatgtattgcttgatgctaattacccaagttagtgcatgatgttaaggataacctgagaacacttgcctaagtttataagatatgacatgtcacagttcaaaaa

SEQ ID NO: 37482 - DNA, 160 bp, Triticum aestivum
  Clone ID: PAT_TA_37482
acgggaaatgcaataaaggcaatcttgacatcaatgaacttgaatctcttgagaatgtcttgagtgtatatatcatggatggtaaatgttccttctcttcattgcatgattttgaaatcgcgaaaataaaattaaataaaataaaaataaataaacagct

SEQ ID NO: 37483 - DNA, 362 bp, Triticum aestivum
  Clone ID: PAT_TA_37483
caaggaggagaagcgggcgccggcgaccaatgaggccggcggcgaggggaagacgaggggcaggaagaagggcagcaaggccaacaagggcgttgagacgtacaagatctacatcttcaaggtgctcaagcaggtgtacccggacatctgcatctcctccaaggccatgtccatcatgaactccttcatcaactacatcttctataagctcgcctgggagtccgccaatctcgctcgctacaacatgaggctcactatcacgtcccgagagatcctgacctccgtccggctcgtcctccccggtgagctcgctaagcaccccgtctctcatggcaccatcgccgtcaccattttcacctcat

SEQ ID NO: 37484 - DNA, 355 bp, Triticum aestivum
  Clone ID: PAT_TA_37484
acctgctcatccatacgacctcaaaagacttgtcaactccaacctatagctatcaaagtcatctttccacactaatatgtatcatcactgacatttctagcataaaatgttcctcagattcgtaattcagatagttgaatgatcaaccttctttttctcaagggccatctacgactgatcatggctcttctgcccgttactgtaagacactgcacatgtacaacatgtatgtttatttggcaagcagtttcagtctgttccacccatctttcagcgcacatatatatacattggaaatagttttccttccacacttaaccttatcacacgccatcaaggtagcagcgactcaaga

SEQ ID NO: 37485 - DNA, 263 bp, Triticum aestivum
  Clone ID: PAT_TA_37485
ctgctgcaaccctgaaggacctggatatacttgttaattccaccttttacatctcaaagtcagctttccacatgtcgaggtactggcactggtatttatgcgctgagacgttgcatacattcgtatttcagatcttcgaaatatgctcctcgtgttctcaagggtcatctctcactgattatagctcttatgctcgcaatcgttatatattgtacgtgtatgacacgtatgtttgtttggcaagcagttaaagtctgttccac

SEQ ID NO: 37486 - DNA, 305 bp, Triticum aestivum
  Clone ID: PAT_TA_37486
ctgcaaccctaaacgtcgggattctactggacagttcctcctctttcacctctatggaatgtttgcattgctcgttgcattatcactattctctacgtgctccgtcgttgatttgggtcgttactgtggtcttcgactctttcacatcgattttctacgggtcatcactctgtcatttcagttctcctaaaatcattcgtaataaattgctcctggacaacactggattctatacgtaaatcagatcaagctctgcggctccctgtcctaatggctcactggatccctttctagcctggatgctt

SEQ ID NO: 37487 - DNA, 315 bp, Triticum aestivum
  Clone ID: PAT_TA_37487
cgggattcgccagtaatgtcatcatcgagaatatgctatttgtggcgaaaagtttttcacaggttcagggacttgatctacgagtgagatcttctcattggtagtcgtcgcttaagtctgtcgggtacaggttaccagtagcttcatttatgagctctggcatatggatgtcaacatgagttaccatagatgtcttcgtcaggacaggttgtctgtgatcgactgattgaggttcagtcaatcctaaggttgctgaggggtatgctagatctagccatagctcgatggactggagtaagtagctatcagttggca

SEQ ID NO: 37488 - DNA, 275 bp, Triticum aestivum
  Clone ID: PAT_TA_37488
tgaatagctggctcaggattgtgcatccgtgacgagtgcaacgttccctttatatagtgttgtggctttcgcacacctggcgcttgtaactattagtagactatacggtaccatggctacagctcggctgcttgcttgcctgtcctggcatgtactggatttgtactgcgttcgtttgtatgcgtgttcattccatgctatctttctttgcgtgaattatttaatctatgtgtggtttcaatgatacaatttgttggcaatgtaaaatgttcaac

SEQ ID NO: 37489 - DNA, 267 bp, Triticum aestivum
  Clone ID: PAT_TA_37489
cctgttttcgtgtgccctcgcctgtgtggtgcgcggtgcccaggccgtagcgtcgtagcgtgtctaattgtagtttgctcgtgcggtgagtgcagccctctccaggctccaggccacacgctcgctcagatggtcggagtgacccattacattcagctcggtagatcagctcaggtgcgcagctagggctggcgccctcccatgctttgctccccagtcatcagcagcgtgcaacttatgaagaccatcatctacgtgctaggcgag

SEQ ID NO: 37490 - DNA, 205 bp, Triticum aestivum
  Clone ID: PAT_TA_37490
ggtggtgtctgggccttcttgctatggtgctgcggtgtgctgggatggcctggcccgcttttcctttttcatttcgtctcgtctcgtcttcctgtcctggtcagttcattcgggattgtcttgtatggggactttacgttatactctcatgtcaggtctttctcttatcttatcagattggattagacatgactgttagcttgat

SEQ ID NO: 37491 - DNA, 282 bp, Triticum aestivum
  unsure (1)..(282): unsure at all n locations
  Clone ID: PAT_TA_37491
ctaccatatatcacaacantatcctccagccggttaggcgtcatgttctaaggatccaagagtcattgtggatcccctgtgaacggagtctgtaaaggtttggaaatctacctttaagacttactagactgattgggcgaagactgggtgtccttacctaaccgggatataggtgaagacgtggtcttctaaattcactctcagtctccctaaccagatatgaagttgtcaaaacaactggaactggtctaccaaatccttgtcttcaccaaactactggtt

SEQ ID NO: 37492 - DNA, 346 bp, Triticum aestivum
  Clone ID: PAT_TA_37492
cgggaacttcgatcccctatgcgtgccgactgctcattggatttgctgtcgtccatgattacgtgttcatctgctgcttcaacagcttcatggtgttcactcagttgcatctggacatttggatctcctctaatgccatgtctatcacgaagtcctgcatcagctcttgcgacgagaacctcgctagagatgtcgttatgctggtgcgtcacagattgaagggtgccatcacgtcgtgtgacattcaatattccgtactcctcgagatccccgtcgagctcaacatgcacgctctcttcgaagtcaccatggctatcaccatgttcatatcctcataagctgttca

SEQ ID NO: 37493 - DNA, 405 bp, Triticum aestivum
  Clone ID: PAT_TA_37493
agtgttgattcatgtatgcctgtccccataagttagtgccactttgggttcacgactagtcatgtcggcccgggttctctgtcatatggatgctagcgacactatcatatacgtgagccaaaaggcgcaaacggtcccgggccatggtaaggcgacacccgtgggaataccgtgtgtgaggccacaaagtgatatgaggtgttaccggctagatcgatgtgacttggaattggggtcggtgacagctttggtatcagagcctgactgcctgtatgattaccaagccaaactggtcgaagttgagtctagaaatgctttagttatgtaagggaattgattatggaagggaacgtaaggctctttttaatccttatacctcatggctttctgatctgagtcaacctc

SEQ ID NO: 37494 - DNA, 392 bp, Triticum aestivum
  Clone ID: PAT_TA_37494
catctacctcgatagagaactttcctcgttgcctgatccttgatcaaaaagaaaaaaggatgaaactcgagaaaaacatgattgtcaatggcaattctatgaacggagagaagatttttgtgggcactaggaacatgcaagattcttttgagatgaattttacgactaggggtattaaaaattgaatggccaatgtgacgtatacccataccttcaccactggccgtatgaatttgatccttgccacgatatttctccttcatggtgactttctcgagctcgttggtgatgtggttggtggcgccgctgtcaacgtaccagtttgtgtcaactccataggagccatcggccgccgcggaaattttctcttcatcttgcgaggagtcaccatc

SEQ ID NO: 37495 - DNA, 388 bp, Triticum aestivum
  Clone ID: PAT_TA_37495
agtgttgagctacttttccttaatccctagattacaatggctgttcatgaacaaggaaatagcttcagatttgcgttatcatagtggtctatttctattgacgtagcaaatctaatttccctatcttcctaatataaacaatctgggtattgttccattcttttaattctatggcagatgggacctggacgaacagtccggccaccaagaaatgccccgcaatctcaaggtcaacattctgggagtacctcagcatcaaaatccaggaaggtacgtgggataaataagggaaatggcttggagcgtttgatcaaaagggcaggtcatccactaaacttgaccatcttcgaagagagaagacctattggagaaaatactgaactacttt

SEQ ID NO: 37496 - DNA, 285 bp, Triticum aestivum
  Clone ID: PAT_TA_37496
cgggggtacctgcatctagtccgaaggcggccgcacgcgctgggtaccgtcgccgatgggccatggtccgcgcgccgtcacctcgtcctccaggcaccggagtctccctttcttccgttcttcttttcctgtgattctgggcagagctctcggcacagctcgtgctgataacgtgttgaatgtacatgagaatgaatcgaacctctatctttcattgatcatcggatggtatttataccaggctttgcgtcataaaacacatagagagactctaccatgcaaaaa

SEQ ID NO: 37497 - DNA, 389 bp, Triticum aestivum
  Clone ID: PAT_TA_37497
ctacctgaaggcgtgcttgatagcctctcaccagagcaagtcctgaactgcaacacggaggaacaatgtgtggagctggtgagccatattcctgtaacacatgctgcacttctcagctgggttgtagagctcatggctgatgttgtcgaagaagaggagtcgaacaagatgaatgcccggaatatcgctatggttttcgcacccaatatgacacagatgtcagatcctcttactgctctgatgcacgctgttcaagtcatgaacttgctcaagaccctggttctcaaaacactcagagaacgtgaggatgatgaaggatcatattcgaccttttcgtcatcgccaactttatccgatggacttgatgaggtggaccgggagcacgacca

SEQ ID NO: 37498 - DNA, 372 bp, Triticum aestivum
  Clone ID: PAT_TA_37498
taagttcacctctgaatcacttgtcttcagtttcgttcatagtttatcattgaatcactcaactcattccttgtttgcttctggtttatgcatgattgcagcaactctatagagttcttgacgagcacaaggccagagccgacgtggtcttgcttgcggctgtgaagaagaaagctcatcagttgcagtacgaggtgcgctgggttgccgtctcgcagtactaccacatctacctggaacaaaagatgaccaaaactcaagcgcagaggcaacgacttaccttgaacagggagcagttcatgatggtaactattactaacttatgattgtttcaagcagtcaactatatgtttcgtgctcacatgtcatgat

SEQ ID NO: 37499 - DNA, 371 bp, Triticum aestivum
  Clone ID: PAT_TA_37499
gctcgctgcagtccccgtggacgcagagaatccaacgtgatgttcttgggagaaaatccctgaaagattcatttttctcgagagaagaggtatacttggcttcggacgatctagaggagccaatgtgagattaagcattgtctcagtggcgttgtattcgatccagactcttactggtttcccactcgcaagcctcaagcttatgttcttggcctctcggtcatcacaatgtgcagtcggtgcagaagcagtggagatcactcgatttaggtcgatgcctacgtggttatcgtcaatatcattcatctcaaccgcttgcacggtgtcagtttcaattgcaagagttcgatttcaggagtttccattgttgg

SEQ ID NO: 37500 - DNA, 393 bp, Triticum aestivum
  Clone ID: PAT_TA_37500
ccagaaagaccattgccggaggcaatcgagtattccttcgaagaaaggcggctggccgtctatttgtcaagagaagtttaagctctctttgcgtaggcgaaagttggaaacctgacggctgttacttgtgagagactggctgctgcctagtatgttggtcgacgacagtcgtccagtgctgttctgattgttcccctctgccacatttgattgtttccatactcagcaaaggaagcttgcgcttcagcagcttccgttcagtactgccattggttagatataattaatgtgtataggtttctttctcggcactgaatcatcttgaatctgtttgattaatatagatcggtattgtgttctaaagaacaggagcgcggtcggcgggacagaaaa

SEQ ID NO: 37501 - DNA, 133 bp, Triticum aestivum
  Clone ID: PAT_TA_37501
agtggtattcccagtcgcggtcaggtggctagcgcttaagaacctgcccttgggaggggaacaacacctgggaactgttgctaataccccgtacgctgaggagcaagcatgagagacgagggagagaaccaga

SEQ ID NO: 37502 - DNA, 204 bp, Triticum aestivum
  Clone ID: PAT_TA_37502
gtgggaactgatgggtacgaccagagcgtgtcggacgacacgagtaccagtgagacctctatcatcttcctctgtcacatcctgaacaggaggcaggcagtcttgagttaatgcggtgatacagctgctagcaacatattctcaggaaggaggaataagtttgccttcactgggctttcaattttcctggctaagcaggcgtaa

SEQ ID NO: 37503 - DNA, 350 bp, Triticum aestivum
  Clone ID: PAT_TA_37503
cccatcccttggtcatttgacttcgactacgcatcatagaaagagggaatttgttcgtgtacagtcacaaattgatcaaatatgtcgtgagattgctggcaccacagaggtcggtgcccacgtggctacgccacacgtcatcgcggattatttgatacctgagaggcctgatgattttccgtcccacctccaggagcttcagactagatacaccaataggttggctaaggttcctgagtatgtctccatggtacattatctatgtgccgtcttgggcatggatgttctcagtaccgtgactgaagttcaccgcactccagatgactccagttgctgattcctgcaagagc

SEQ ID NO: 37504 - DNA, 202 bp, Triticum aestivum
  Clone ID: PAT_TA_37504
gggtgggtcggtgcatctgctccattcagccacatgctaggagactttagggccatttgacccccaactacgccacgctaactcagggctcacggatacaaacatggcctatcgacaagggtcgcgtgtaccagtaaccggcgctctctcgggtgtagcccctcgtcaaagccgatcccagtgagaggtcgccgccgcgctg

SEQ ID NO: 37505 - DNA, 454 bp, Triticum aestivum
  Clone ID: PAT_TA_37505
ttacatgcacggggtcacgggacaatcaaacgacagttagctgctatcgctccaacacttgagcagttgaataagaagaagaatgagagaaagagggaatttgttagtgtacagtcacaaattgatcaaatatgtggtgagattgctggcaccacagaggtcggtgagcaggtggctacaccacaggtcaacgaggatgatttgacacttgagaggcttgaagattttcggtcccaactccaggagcttgagaaagagaagagcaataggttggagaaggttcttgagtatgtaagcatggtacatgatctatgtaccgtcttgggcatggattttctcagcaccgtgactgaagttcatcccagtctagatgactccattgctgataactgcaagagcatcagcgacgagacattatcaaaacttgacgagacagtacccacaactcatgaac

SEQ ID NO: 37506 - DNA, 182 bp, Triticum aestivum
  Clone ID: PAT_TA_37506
ctctggtatgtcccttcttctcttctcctttgtccttgccgttgggtcgtccttggcggtgtgcttggccttctccggttgcttgcctggggccttttttcccgtgcccgttcctgtttcgtgcgcttcctttggggggcttgtccggtttcttttctccttcttctgtcttggcgctttgg

SEQ ID NO: 37507 - DNA, 215 bp, Triticum aestivum
  Clone ID: PAT_TA_37507
ccggacctcaaatcagtaaaaatgaatttcagagatcctccagtaaaagtggaacctcaatagctcctgctcctaaagtgacgaatacgagagttcaaaggcccaagctaactcctgaattgttgggctcggaggatggtctcggcggtgttcctcacggtttccctaaatccgctcaagtcgcgtggccgacgcgatacacagaagtctttttt

SEQ ID NO: 37508 - DNA, 216 bp, Triticum aestivum
  Clone ID: PAT_TA_37508
gggcatgcggcagctttgttcccatggacccttctggtgttttgcatccacacgggcgttttccttcgccccgtgcccgtcgtggcgttttggctttctgtctgcgggggggccgtggttggtttcgtcggggccctggggcgccgtctgctgtgggggttcgggtcggggggcctccgtgtgtcgcggcgctgcgtgcctcgcggtctgtcgctc

SEQ ID NO: 37509 - DNA, 272 bp, Triticum aestivum
  Clone ID: PAT_TA_37509
tcaggtagctcaccgcaagcccggcctaagtggtccatggctgagaatgatttgcttgaaaaacggatcaaaccagagacaatgagatggccagaccgttgccggacttggttcttcgggtctggcggaaccttggaccctgttacagggttttgccagtggacggaccagcatctggcaataccagtcatgaaccttgtttgggaacctagttatttcaaaaatttcctacgttcacgcaagctcatggtgatggcatatccacgagggga

SEQ ID NO: 37510 - DNA, 124 bp, Triticum aestivum
  Clone ID: PAT_TA_37510
gaggagggggaagaggacgtcgatgtgggctaagcggctgggcccgacttggcccccgcttcgtttcacgactactacgtgtcttctctggccctgcaagatgcggatgtttccgatgtcgccc

SEQ ID NO: 37511 - DNA, 426 bp, Triticum aestivum
  Clone ID: PAT_TA_37511
cccggccttaaccaaaaaaaaaaaatcaattttgtggttttcttggttaagactggttcaaaccggtttacatgcatgtgttggacgtgtgaaaaaattcaacgtgccgttacgtgcgtccgttgggaaacatgcaaatgttattttggatgacacaaaaaacgttttgctccaacacatgtgagcaataccggatgcgtaaatggtgatttagtccaatacagttgaccggtatcgagccaaatgatattagctttgtccggaatgtggttgtagctacaaatattatccaaaatttacctacaactggtttatcaagtgtatatagaaaaacaatttaaaaagaaaattaataaataatagttttaaaatgttgaagatcataataattctgaataattcttattagaacaaagaaaccaaata

SEQ ID NO: 37512 - DNA, 384 bp, Triticum aestivum
  Clone ID: PAT_TA_37512
cctgtgcgataaaagaccagtggccatgaattaggattggccggctccatttaaactcgatatactcaatattttttaggctatcacgataaccgtcatacttttgcatcttaattttctagagcaacttattgtactgtccaagatgtgacgatatgcataaacatctagacttaacctatgcaaagatgcatcttaggtactattgtttttatctcggcctctttgagagttatctcatcttagtcattttagaaacatatatcgagttgttacctctaagtatcccttttatccaatccgaacttcgacgtagaaagtatgaaatcactaacatgacagctgggtaaattggcatactctagcagtcgttgcccctctcat

SEQ ID NO: 37513 - DNA, 247 bp, Triticum aestivum
  Clone ID: PAT_TA_37513
tcccgaagcctccgggtggctacaagcgtccggactcgttccagtgacgatgtgattcttcttggctgtctgcctccttcttttcctagggcatcaattttcaacctcgttacttggtatttggtgccctgtttgagcttaaacactgtgtctcgatcgcgctttcggcacgatggctaagcatttaaatcgctagcatcattgttgctctccatctgttgtcagatctttaatggtgtcatggacc

SEQ ID NO: 37514 - DNA, 389 bp, Triticum aestivum
  Clone ID: PAT_TA_37514
tttctccacataagtcaaatcactatccaactgaatcgcttatagcggcactgtatctctcagcggtatatcagccatctctgcgtgacacttcttcaactgggaaacgtggaatacgtcgtgaactcctgacaatccttcgggcaattccaacttgtaggctacttctcccatacgctccaaaactttgtatggtcctacaaaacgtggcgctaagtttcccttaactccaaagcgcttaactcctcgaagtggtgacacacgaagataaactcggtctctgactttgtaaactgtctccttacgtttagaatctgtgtagctcttctgcctggactgggctactttgagtctatcgcgaatcaacttcaccttctgttcagactcct

SEQ ID NO: 37515 - DNA, 387 bp, Triticum aestivum
  Clone ID: PAT_TA_37515
cccacttccacaatgaataacctttcattcacttctcacgttcgatgaagttgcagtgttgaaattttatctggtgaagcaccagaagagtatgactcgtgaaaactttcgggttcacagggtttagagaaggcatatgttcaacccataggggcttcttagaaacatataccacaagtttcaagagtaaataacacaagcccgaaagcagagcatggttggccaagcagaggatacaacttaacaaaggcattatgtatcaggggaagaactcacaaggtgatcaaatgtgaaggacactgtcggataacaatccaacaaacgacttgatggtccacaaaggatctgatacgagtatcggtactcaactagaggaagaagaatgca

SEQ ID NO: 37516 - DNA, 219 bp, Triticum aestivum
  Clone ID: PAT_TA_37516
tcacactcgagtggatttctcacttccactccttatgttgatagcatgaacattagcatactccttgggattctgaattgacttccttggaagtcacgtaactttgggaccagacgaagatgcggattgtccttctaagtatctgactttggaattcaacgcctccacttttgcattaaggtcattgtagttgcaggccagcttgtggtgcaattcaga

SEQ ID NO: 37517 - DNA, 413 bp, Triticum aestivum
  Clone ID: PAT_TA_37517
gacggcggacccgagacctaaatcgccgccaccgttcctcgccactgcggcgaccgccgttctcctccccctcccaccccgcatcggagaggaagatcgccgcgccagcgccaccatacccgaccctcgactccaccactctcggcggtgtgtgctagtctagtctgtctccaccccgacgaatttgcttcgcctgatagcgattaggctgcaatgggtagatgattaatttttgaagcccagctcatcgttaataacaggccgaaagcccagaaacccagcagcagtgtgcaacgagacgatcagattgttctcttttaccatcgtctcggacaaggcaacagagagcaggcagaaggatggatgagcaagatgataaaagtacaaaggctgagctgaaactatgtggggac

SEQ ID NO: 37518 - DNA, 375 bp, Triticum aestivum
  Clone ID: PAT_TA_37518
ttcccggagtcacgggatactcttagaaatatttttcataccccaaatcaagtacttgtagtgcaaacctcaactcagggggttttggaaaactaaattttgaaaatactatttggccaaattatttttgtaggaaaatactatactgtactatacacatggcatgatcattgggcagaagtttggggcaaggagatgaagtacagaaggtggattagttgactttaaagagcacttgaaaaaaatcactcagagaaaaccaactccaaaataaaagccaaatactgcaaaagtttttgttggtccaatttttttcattttttaataatgaaaatgacatgttacaaaattcacggtgtgactacaccatttccc

SEQ ID NO: 37519 - DNA, 397 bp, Triticum aestivum
  Clone ID: PAT_TA_37519
ggcatgaggatagtaccaccaagatgtccaagcccgatgagctccaagacgatgctcccaagttcgacttcaccgccatccctctttgtggcattgatgatgccgagtcctccacgattctttttcaagatggtgcggcgacgagtacgactacggagaccttcaaggaccacgctttggaggcaagcgacttggtgacgatcaaggatgatgtttccatgttaggaggcgagagcgatgatgtgccatcttcggccttcatccatggcgacgatgacaagatgatcgagcatgggatttccccttcggtcatggaggagagtgatgatgtgccatcttcggccttcatccatggttgagtatttcacctcgaccactgtgacctatgatgacctga

SEQ ID NO: 37520 - DNA, 264 bp, Triticum aestivum
  Clone ID: PAT_TA_37520
aacgaatctgttagtttcaactcattttgttgaggttaatgaaatgagaaatcaaaggattaacgaaagttaatatacttagccgcaattaatgatgaacggacggtggatggatatcgaccactaattctccaagtgacccctacaacctcctctacttgtccccctataccacatcctatctggtaaagattaagtcaagacttcccaccaaaacttcacttttaattttgataaaccaaacgtttttaaaaaacaaaatgt

SEQ ID NO: 37521 - DNA, 175 bp, Triticum aestivum
  Clone ID: PAT_TA_37521
tggcggagaccgcgtgtgggtcttaggctgtggctgggagctggggctcacgtctttgtggcggtcgagtggcggtcgtccgcggctgtcgggtggctggttggttctggggttggttcgttgggcgtgtgtgcttctgctgccttggtgtcttcgctgccggtgtgttgtgttc

SEQ ID NO: 37522 - DNA, 423 bp, Triticum aestivum
  Clone ID: PAT_TA_37522
atgcacagcccactagtcgtgggactctggtgcacgcacttgctaggctggtcgagtatttaaccaaaaactaccacaattgtcggaaacgtgacgaaaaactaccactttacgtttttgtgcgaaaaactaccaaatttagactaaaccgtggcaaaaaactaccaactcgggaaatcgctcgcttcgcccgcgctaaccccgattctgaccggttgggcccgcgaatcagtcgccacgctggcgaacagacggccgccgcgcgttgacggccgttaacggcccgtccattgtcggaacggcgcctgtcggtgggccaataagtgagagcgagctcaggcactcgctcagtctcctcctcggcgctcgctctcactcgtcctcactccatcctctccctctccctcgcccgggtgctctgac

SEQ ID NO: 37523 - DNA, 380 bp, Triticum aestivum
  Clone ID: PAT_TA_37523
gaggcgacgatacacggcaggcctctttccgttgacgtgatggcgtccgcgactcctgttcacgtgagcgcttggtcaaaacgtgcagctcgacggagtagaccaagtttggtgtggcttggcattggcgcagaactgcgtccttgttgcggcatgcgttgcacatctcctattcctagcgggttggtttcagctcatgtggagtggtggcgtcaggccagtgattcagttagtttacgtacgtacagtggtcgtacccgatcggatctgagcagcccaggatcacgcagtcgagactctaatgttcgctggcacgttggtgccagtatgcccagttggccgcgatcaagtctggccactcgtcacagtcggttcatcgg

SEQ ID NO: 37524 - DNA, 354 bp, Triticum aestivum
  Clone ID: PAT_TA_37524
agagctctacctcatcgagtgttcggcgcacaggccatatttcttttattactcactttgcataaattattgattatgcaacaattttattattattcctaatatctccggcttgcactattttccgtgcacaagtagataatccgggcaacgctgtcaacgcggggtatccacgtatcacatcacctcgggtgagccggggggttgtcatcacttcacttacacacacccggggggtttgggttacactaacgggctgctccacaatctccggggtcggactggggtttacactttgcccatcgactatgctgtgtcaccatttcatcaaatcgtgttctttacgcggacatc

SEQ ID NO: 37525 - DNA, 408 bp, Triticum aestivum
  Clone ID: PAT_TA_37525
tggtcattcgggtacgccataaggatgcaaagaggcatcctatatcagcaaggactggttgttccaccaatagctcatctaagagaactctcaagttaactgtgctcaggctggagcagccatcagatgggtgattggatgggaagttttcttaatgttaaattaactaatgggatgggtcatagaggtcaaattaaatgacctctatgatccatctcatcagttaaataaacctcgaggtccttgttttttttaacacatgttaaagaaggtctacttcataactttttgacaatgtgcgatacgtcgcatatagttgatccatccaagttgtttgtgatggaataagttgtgtgtatattgggaaaacgcttgctggtatacaaccgtttgtcattgatgaattca

SEQ ID NO: 37526 - DNA, 357 bp, Triticum aestivum
  Clone ID: PAT_TA_37526
aatatcagacattcttacatgttatcgagtctgcacatacttgcacacatagtcaactagccattgatgatcacgtatgtcttatgaagtatgttgtcatttgctctagcgcatatcttacatctttgacaccatggaggcattgtaaattttaggacatagatgaacgcacacgaatcacttaaaatattgtgagagtcataaacatcatggtaatttgatgtaaaaactatcatagtatgtgaattgaatgcaatgatcaatttcacacttgatagttgtgttgagataacgatgtagtggtaataaagtcatgctagatgcgtgactacgagtttaatgaatgcttgtgttgaa

SEQ ID NO: 37527 - DNA, 300 bp, Triticum aestivum
  Clone ID: PAT_TA_37527
gtaccatacaacagcttccaacacatgccatgcactgtacacagtaatcaccatcatgtgaggtcatgcagaacttcacatgatctaatcagcgtcgtaccgggcatttcatgcaacaatggaggtaaacgtgacagagatgcagagtggattcaatttgtctctcagttcgttcgtgtttagccgtgcgacaggatacagacttaagctccttccaggcacaattggagagccacgaaactgacgacgacgtgcaattcaccgtgccatcggatacaccgacgcaactgggatcaccct

SEQ ID NO: 37528 - DNA, 404 bp, Triticum aestivum
  Clone ID: PAT_TA_37528
tctatacaattcaatagttacaataattgttgaattccaatatgtatacgaggtctatagtacttcacaatatgttcaaactcacataatcccagtcaaatgagaatctaaatgcatttcatagttactactttgtaggatgcaacaaaaccaaccataactctacatcatccattataaaatcaacattttgaacacattccaatgtgtgaatgaagcgtgtagagagagcttgcgaagatggagcagatagggcgggaaagctacatgctaaatagggtttgtgtgtgtgtgtgtgtgtgtgtgcgcgcgcgcgccagatactgagagaaatcaaacctatggagagaaatgtgtgtgtatgtgacggaaagctacatgctaaatagggttttcacgaagag

SEQ ID NO: 37529 - DNA, 395 bp, Triticum aestivum
  Clone ID: PAT_TA_37529
atcagcatggactaatggtcgcttaagttttctagtgtcaatgatgaaagagtactcagatgtggggaagtaccgtggccaaaatgggtggacaaaggaaggatggcaggctatgaaagaccgattaaatgcgagacctcctggagctaattttactgttcaacagctgaaagatagggagcaaaggctgaagaaggaactgaatgtcgtcaagtctattgtagacaagagtggatttggttgggatcccaagaacaaagttctaacggctctagatgaaaaatgggaggagctatcaagtgaacaacgcaagtggaggcacaaaccatttccgtactatgatgttctatatgaaattcatgaaggtttgtttctgacaatgattaaatttaaga

SEQ ID NO: 37530 - DNA, 396 bp, Triticum aestivum
  Clone ID: PAT_TA_37530
actcaatcacacaagcaaccagaaatgacaacctacgacaccacaacagttgctcaaaaaaaaagtacaagtgcattttacttacaaatggctacgaagaatcagagcctcagaagttgaagaaaaagtagatagcatcgtgctcaaaagaaaagcaaaagagtagatagcctcctgtccaagtccttcagacgctggtcgccaactggcatattcagtacacagactcacgaaatcaacatacaactcgcaatctaataaatatcttatcagccggcataaacaaccaagcagcatgcacgcacccaggatcgacggttagcaaggaggatgccatgagagacttaattgtgaagcttcttaattaactgtgcttactttgaaaatacctccctt

SEQ ID NO: 37531 - DNA, 372 bp, Triticum aestivum
  Clone ID: PAT_TA_37531
cgaatatttgaggcatactctggcatattacagggtataaaaggtccaaaagctcagctgatggtaccttatgcaacccacctattgcagttcactgaagctgtctacaaggatgggagcagggatgagagtgtgacaaaggctgcagttgcagtccttggtgatcttgcagatacacttggcccaatatcaaaagatctgttcaggaaccacctgttccatgtcgaattctttagggagtgccttgattcggacgaagaagtcagggaggctgcatcgtgggcgcagggaatgataaaccaagcagtggttgcttaatatgtgaaatcattttctgttgttggttgtggtggaagtttcctccttgtgcat

SEQ ID NO: 37532 - DNA, 405 bp, Triticum aestivum
  Clone ID: PAT_TA_37532
agcatcggagaaagggcggtggctggaggcgtgcatgagcttgatttggccatggcagagcgggcgctgagatgagatgtagagagggaccatggtgggtcaacgcttggggaaaagtaacgagtggctgtgcttgctcgagagaagagataagaaggggagggggcggtgcgtgcttgaggtaggtgcctcctcgtgcgtgcgatattgccagatcgtacgcgaccggctcgatgttcggccggcgcgccgagcgcaaacatttcccataaaaaaatgccatccaataaacatattcacgaatttcctttaaacatagtgaaaagagatgttgaaaatcatttaaacattcattttttgacaaatagttgctttaattggattattatgctgatcaaatgtatg

SEQ ID NO: 37533 - DNA, 322 bp, Triticum aestivum
  unsure (1)..(322): unsure at all n locations
  Clone ID: PAT_TA_37533
gggtcgagncgcaagggttgggatattggggcgctggtgggcatcgggcgctggagtgcatcggtgggcatggggtggccgattatgaagactcccaggcggaatcgcgcgcaggtacagcccggagtcagtttgacattttgggtggtaataattccaacatggataaccagagtgaaaataaatactacacggactccaaaaatcccgaagtacattttcaccgtcctctaaaaataggccggacaaagtggaaatttatttggcccgaaaatgcaattttgaaaaaacagattattcctaaatcacataaaatagcgat

SEQ ID NO: 37534 - DNA, 402 bp, Triticum aestivum
  Clone ID: PAT_TA_37534
gacgtgtagggcgagctattcgtcacggatgctgtgtttgaaagccgctaaggcttcggcgtccggacagttgacaatttaattcttcttagtgaggaatctattccaaagctcgcgggcggactctctgggccattggattatgtgacttagatcgtctggatccggaggccagacataattcccttgaaatttttccctaaaagcgtcttctagttcctcccaactcccaattgagttttcggggaggcttttcaaccagtgtcgagatggtcccttcaacttgaggggaaggtatttgatggcgtggaggtcatccccacgagccatgtgaatatgcacgataaaatcctcgatccagacccctgggtctgtcgtgccgtcgtatgcctctatgttcac

SEQ ID NO: 37535 - DNA, 254 bp, Triticum aestivum
  unsure (1)..(254): unsure at all n locations
  Clone ID: PAT_TA_37535
cattgaaattgacggggttctcttgttgtatggcaccggaagtggttctagacagatgcttgcttatgtagctgcagaaagtcatgttttagaaaaggaggatgacccccggcctttgcatctgagcgatgcatacggtcactttattaattattctcataagaccttacaaagtaataccacagtaagactaanaaataaaagggaaaaaagagaaaataaccaaaataaaaaaaaaaaaaaaagcggccgct

SEQ ID NO: 37536 - DNA, 268 bp, Triticum aestivum
  Clone ID: PAT_TA_37536
taaaagttctgtcagcacgactgcgtgctggccatattgatattctaacgtcgcatggcttcgcctatcacaacgcatacaattactattccaagattatttctcgaaagggcatctcataatgcattgagatcaatgatcaattgatatacctatagtgtgcccctgcgcccgtatatcaatgatcaatgaggaagaagtgtcgccaatcacagggcgcaccattacgagtcttactcccaccagtagtatgactcccatccttcca

SEQ ID NO: 37537 - DNA, 399 bp, Triticum aestivum
  unsure (1)..(399): unsure at all n locations
  Clone ID: PAT_TA_37537
acgcaggcatggcatggtggacacgcgtggtcaccgcgcgaactcttccctcgggccagcctacgtccaaaaatcatgtctggcatgttgttcgtggtggttttaaagtttaccacgctttggtttggatccaggtgaagtagaggagtttttacatgccaagtaagtttctcatcagtaactttgagaggttactgaggtcaaatggctgggagttgggggctgtgctttggaggttagccatgatctactaaggtgaagatgcacaagaaaatccaggcacaatggagcaagtaaaatggtagttgctatagaaaccaccatttctgtccagaacagaaaatatttttctgtagcanaaatattccanaaagtgatgaaaatatttttacccaggaa

SEQ ID NO: 37538 - DNA, 375 bp, Triticum aestivum
  Clone ID: PAT_TA_37538
gggccgaggcggcactttattgacaggttaaattgtcacctggtttctgggtcccacctgacagttggcagagcaaagaaatcagttaaacaaaactttacgcaggcgcgacacgagtccaacccttgcgcgcgaaccgccctggctgtgtatgtgagtgcatgcacgtgtcctccctcggtcttccaacaaagagtgtacatcggctataaaacacagagtgtagtacatgatgtacatctacacttccaatgatttagcctttaatctaaatcgatattgattgactaatgcaccaacttgtgctgtagatataggcgacatgtccaacccttaattacagcaatcaacggccttcaattaatcctcctaacc

SEQ ID NO: 37539 - DNA, 372 bp, Triticum aestivum
  Clone ID: PAT_TA_37539
gtacatcaacacatgcaatgcctttggtcttcgaatgttgttcacttttgagagtgatgttgttcacttgcgtatgagaaaaaaaacatccgacaaaagaaattatgcagctcacttgcctgtctgatgcagtgcagtttttatttctgaagcagtgcggtcggcctatgatgttgttcatcccgtaagtgcaaaaaaattgttacggaaacgaaaaaaaataatgcggttcacttcttgatagtgttgtgattcatttacaccatatgtgaagtgcactctactttctcgtccttgaaaaaatcacgtttgaataaaagaaaccatgcagttctcttacctgtatgatgcagtgcggtttttcatccaatg

SEQ ID NO: 37540 - DNA, 332 bp, Triticum aestivum
  Clone ID: PAT_TA_37540
ccgggtcgacggggatcttcatccggagatgatggataacgaaacacctccccatgcctccacgccacatgaggcgggcgaacccgtggtgtcggcacacaagatttctcctgatgggctaatgccatagggtaatcctacggcctcgctaagtccgaagtattcggctcctaaatggagcatcagtcgtgctctgtagctgtctagtcagctatgggaagtatagatgagtcctctgaaacatgaggctaactcataatctcatcgtacgcttctaggtatagcggcttacatgatttcagatcgtgaacaccgataggatcaggcatata

SEQ ID NO: 37541 - DNA, 394 bp, Triticum aestivum
  unsure (1)..(394): unsure at all n locations
  Clone ID: PAT_TA_37541
caacttgacctttcaagtaacaaaatagttggccaacttccagatgcaatcggaaacatgacatctcttcagacactgaggctaggtgacaattacctctcaggtgtaaaatctgaactgttcggaaacttgtgcaacctcagctggctagagctgtggtcaaatgagatcgaccaggatatgtcagattttatggaggggtttccggtgtgtacaaagagtaaattgcggtccctagatctgtctgctaccaaccttactggcaggattccaagcagtattaagcagtggaaaaatttaagtgatcttcaactctctgagagtangcttgtgggattaatacctttgggaattggcaagatgactaatctacggtcattgattctaaacaaca

SEQ ID NO: 37542 - DNA, 395 bp, Triticum aestivum
  Clone ID: PAT_TA_37542
gaatcagattagacaacttccaaagggagtgaaagggatgacgcttccagttgttaagataaatgctcgggttgtcaaggatcattcctctatcgaaccatgcataaagtccagagcagctgagcggtcactttctagatcttcacgctcccagtcaactggaactgataggaattctgttcatgaaggtttgtctcatttgaagaaacatcatgaacatgatttacaaagtctgcagaagtccaagtctgttccaaacatcccagaggaccatgtttgcactgttgaagaattgtcagtcaaactgggtgactggtactacatggatggaactggacatgagcatggcccattttcttactctgagttgcaaaagttagttaaaaggggcacta

SEQ ID NO: 37543 - DNA, 389 bp, Triticum aestivum
  Clone ID: PAT_TA_37543
tttctgaagaggtaagttctattaattcctttccttccaaaggcaacgcggactttattcctgcttttaatcttttccttcatctgaggcaaaaggctgaatttgctccttcttttattttcgttccttcccgaggcatggccgaatttccttttttttattccttcctaggggcttttgcaacgattgttgacgcatcttattaattttggatgacataacatatataaattggtggaatgatgtgcatcgaggcgatgtgagactatttaatataagaacatatcttttagtttatatcaaaccatgttgtagtttggtggatcgtaacttttgatacacatgcaggatctgccccagatttaatggatttacttgggccatagagc

SEQ ID NO: 37544 - DNA, 402 bp, Triticum aestivum
  Clone ID: PAT_TA_37544
cgaagtaatagatgagttccggcagcacgacagcgtggtgacggtgttggtgaagaacaatctccgcagggcttcgcctaagcaccacagaaactatgacggaggataaactagaggggacggggttgccggcacacggcttggtgtttcttgatgtatctttggtgctagcacctacccttctatttatatgttgagccttggggtcgaaacttggtgtaaaagccttcacaaagtcggtttcacccgaaaggcaagagtccttctcggactccagggccagacgctagggttcccgacgtctagacccagacgccagggaccctggcgtctggccccttggactcgccaaaacttccttttgcgctttcaaaaaaccttgtgggctttcccctttggccc

SEQ ID NO: 37545 - DNA, 409 bp, Triticum aestivum
  Clone ID: PAT_TA_37545
gtagaccaggataattttgtgcatggcaggtggatcaggattgtcgacgtcccacatgtcggcgaatgaaagtattctttccgatatagaggacgagcaatgagtattcattgtttatttttgatgaaagctattgtctccattgttactccttgactttgtcaatgcctctctctcctccacataagcggggactacttgctatgcatgcagcgggcagctggcatcttgaggggccagagcggtgagagcgggctccggaagcggtccggactccagcagggcccacctcacattatcaccatatatttcttggagtccgtgcacggcgggcgagcgatctcttctccctcccccatttctctcttctcagtcgatacccgccgagcgattaaatttcggctatcga

SEQ ID NO: 37546 - DNA, 402 bp, Triticum aestivum
  Clone ID: PAT_TA_37546
ggtcaccatggagcccaaggcagcgtcgccaccagagccttttggcaggcaaagactgcttttgtcaggataagctgtactagctgtcccctttcaaattggtcattgttggctcccttccttgctcaatatttggggagaggaccagggcctctataaataggattagccaccacagtaggaggcaactagtctcaaacgagtctcgaactcattcagagacatctgatctttagccgatccttagtcacacacggagcacaagaacacctcacctcaggaggttgttcttccccttgtaatgtcatccatagcccaagaggcaatccaccaccaccacactcactacaaaaagaagacacttccgtgatgatacgtgtttgtcacagtaggtcatgtttt

SEQ ID NO: 37547 - DNA, 381 bp, Triticum aestivum
  Clone ID: PAT_TA_37547
acattttagattagctgatcttgtaggttttggcgttgccgttgccactggaaagcaatattataagagttatccagagcgatgttataaatcacgtcttactgaaattatgctcgatgagaacaggacaggtgaatcttctcataggggattttatctttataatgataagcgacaagcttctccagatcctgatatcataaagtatgttgagaaatcaagaaacatggcagctgatgaaattaacagacaaggacattgtagagatggtcatctttcccgtggtgaatgaggcctgccgagtgctggatgagggaattgcactgaaagcatctgaccttgatgtagcatccattatgggaatgggcttcccttcattta

SEQ ID NO: 37548 - DNA, 415 bp, Triticum aestivum
  Clone ID: PAT_TA_37548
acacgtgaagataatgcatagtagaagaaaaaagaacaactgaggaatttcaaaaatgaggaaaaactcaaattgaagattttcaacttttgttggtggcgtgacccaccgtataagaatgatgatttcagacaccgcgtacaattttcgtagggctctgagaatcaagttattcgttaatttcttcacacttagagggttaatctttactgattgaagaaaaacgttacgtgtgttgcacatcaaggtcataaattttgcataagtgttaggatgtgtgtccttttcaaaggacattcgaagattataggatattagctcacaccgcaacttgctaaatctcttctcatccaagggctttgtgaagatatcatctagctggtcttcagtcttcacatgctcaatagatatgttg

SEQ ID NO: 37549 - DNA, 420 bp, Triticum aestivum
  Clone ID: PAT_TA_37549
gggtcgacgggccccaagcagttcattttttttctgcaactatatgtgcacaagtgttgctttggcattccacacagttattagtcttcgaggggcggcacttgaatcttggacggatgacgagattaggatgaatttttttttgcgggtaaagggagttttattgcaaattcatagagttacagtcgagacgccacacatctcaatacaaggaggaactgagcgtagccagacagttgtggctcgctccgtacggctaaagtttgccagacaatcaccaactctattttgagaacgactaagtttctgaggaacaaactccctactaccagctaagtacttgatctccaatactaagtggtcataagctgaacgctggagagcatccatacacaggcgtgacaacgcttcagaagaatc

SEQ ID NO: 37550 - DNA, 354 bp, Triticum aestivum
  Clone ID: PAT_TA_37550
acggggaagaagcacaaggcggagaatgcgggcgccggcgtccaatgaggccggcggcgatgggaagcagcggggcacgaagaagggcatcaatgccaagtagggcgtggagacgtacaagatctacatcttcaatgtgctcaagcaggtgcaccacgacgttggcatctcctccaaggccatgtccatcatgaactccttcatcatcgatatcgtctataagctcgctcgctaatctttcaattcgtcaaagtacactttcacacccattatcacttcacgggagatccaaatcatcatcggcctcttcaacgtcggagagctcacaatgtatccattcttccaaggtctctc

SEQ ID NO: 37551 - DNA, 421 bp, Triticum aestivum
  unsure (1)..(421): unsure at all n locations
  Clone ID: PAT_TA_37551
cgggtcgacgggtacaataaactgcagaaacttctgtgtgatgaccgtgttccctgtcattgagtggcgattttgctaggaaaatatcatagccaaatttcgctgttggatcntggattttgctaggaaaattaagttgatgcttgtgacaactctgctttcctactcaattgaatactgctgtgcgatgaccatcataggcaaatcttgttgttggatcctgtgtgtgcggcgcctctctcaactttggcttcctgagaatgacctttctcaaagttgcccagtcatggaagcgcataatgatcactggccggtttaacgtgggaactaacaaaatgttgccaagcctccaaaaacctctcgcaacatctaatgttatcatgacagaaaaaaataacttttttgaatccaggtggtttga

SEQ ID NO: 37552 - DNA, 430 bp, Triticum aestivum
  Clone ID: PAT_TA_37552
aattcgccggtcgacgggataattgaataacgatagctggaatatgaggatgaagaattcttctggaatgatggctttcggtgaaataaaatagaaaacaagttctgaagtagtctagatgggcaaggaaagaatactgacaaacggaataattcgagaggataagaagaagctggaaccatgaatcttcgagagaacggacaagatttagagaaactcttcttcgatcttcaaatgacgacgagaaacaccaccaaaattgttgagatactccgggagaatgaaaagaggaaaggttgaacaaacaatgaaaagaatttgaaagcgatcttggagaaggcatgtgactgatggaatccattcttatgtcacacttgaaaagaatttgagaatcactctagaaaattagaaaagtcaggtaagattctgg

SEQ ID NO: 37553 - DNA, 438 bp, Triticum aestivum
  Clone ID: PAT_TA_37553
gggtcgaccggggcaagaaactatatttgggactatacgcgggtgaatgggggtttcagtgaaggagatgaacggagacgatgaagctgatgggagtatacacgggtgtctctttggtttgggcccacttgttaggtgtaacaatgaaatattaggataaaaatgcagcatacattttttaatcaagggataaggaaaatatatgtaaaataacagaaaatgtgcaaaacaccttattttgttggaagttttgcaattaaaatagaatcacaacgtagcagacttgtgggacgtttccatcaatgccatgcatcgagaataaataaagtaactaaattacattcccaaatttcaaaacaaggacttagaaattattctaatgatgtgacagggcattaacaaaatgtttatatatgactctaacacatcgattaaatc

SEQ ID NO: 37554 - DNA, 288 bp, Triticum aestivum
  Clone ID: PAT_TA_37554
acgggatcactgagaggattcatcgataaattccgccatcagaatatttatctacctgtcacttctcaagagacagctgatcaccatacacagtgtacatctgagctcaagcaagatgtaccaagtgaaggtctgcatgccatcgtcatgactgatcgaccagttgatgatgcccgtgagtacacagatactttacatattgccagatcctgtgtgatcagcacctcacgcaggctggtcatctagcaattggacttgctgagcgtttctcagtcgcagatgcgcatg

SEQ ID NO: 37555 - DNA, 422 bp, Triticum aestivum
  Clone ID: PAT_TA_37555
gcaagcaacggagactttgattatccctgcagttgacatagctaaaacaccaggtgcttaaaccgaatcacaccgaacaagggagtaccttgctctgataccaattgaaagtgctagttatcgactagaggggggtgaataggcgatttttatgaaagtattcaaaacatggaagttttgaagacaaacgatagaaatgaacctattaacatgcagcgaaaggtagactacactaagcaagccatagtcaagtatacaatgaagtgaaagcacgaagactaatagcagctaggcagtatggatcaggatggaagatagtatgaagccaattagaacaaacagtcacacagtgaagacaaacaagtaatgcaagtaggcaatgacttcacaaggaccaactattgattaagaagaaggaaagg

SEQ ID NO: 37556 - DNA, 412 bp, Triticum aestivum
  Clone ID: PAT_TA_37556
aatcactcttctgtaaaaaaaatgacagcaaatctcgtgagggcaaagtttctgttttttacagcaagatcacattgactttctcccaagtattcccaaaggtcttacttggcactttattgaaacaaaagctataaaacatgattaatacagtagcataatcatgtaaacacacaaaaacagtaagggtaaatattgggttgtctcccaacaagcgcttttctttaatgccttttagctaggcatgatgatttcaatgatgctcacataaaagataggaattgaagcacaaagagagcatcttgaagaatatgactagcacacttaaatataacctacttcctatgcctagggattttgttagcacacaatttatgggaacaagaatcaactagcataggaaggcaaaaca

SEQ ID NO: 37557 - DNA, 435 bp, Triticum aestivum
  Clone ID: PAT_TA_37557
actcgcgggtcgactcaccacgtcaagacgcgttctacgtaccacgtgcacggtagcaacggtcactgttatcgagaggcaacccaacaccagctcgatcggcttcagtaagcagcagcagtgatcgatcgctcgggttcagttagcagctgcagcgaaggaattgctcgggttcagtcagcagcgaattaatcgctcgggttcagttaacacccaagggatcgatcgctctgattcagtaacgtgtgatcgctctgggttcagttagccaatgcctcgcacacacgcatgtacacaagagaaacacacaaaccacactgcatcgctcagccccgaccacccatcgtaaccgggaactccgcgatattttcctcgccctcgcttcaaccacgatttattctatcatggaccgcccaaagaatgtcatgcagctgt

SEQ ID NO: 37558 - DNA, 412 bp, Triticum aestivum
  Clone ID: PAT_TA_37558
ccggggggccaaagacaatgcggctcgatgcggcgagcgaggccgtggccgtcgggacggaggagaccgggttgtggtcgtcgccgtttttttgggtcgtccgggtcaaatttcccccttttttactattacttagatgcgactcgtcacattagcacgtgataatttgatatgagctagctgactagctcggtttccacgcgggcagtgtgatgattctgatggatttgatgtatgcgctgcggcaacattacctctgattgtctagtagttattaccatccaacttgtttacaatcatcatatgtgatttccttggaagccgcaaacgacaacttcgacggacggctggtgcctggacatatccgaactcctgttgaactcggcgtccttgcgtcggtgtacagacacgc

SEQ ID NO: 37559 - DNA, 405 bp, Triticum aestivum
  Clone ID: PAT_TA_37559
tattagaatactctatgtgcttcacttatatcttttgagttatatagtttttgctctagtacttcacttatagagcacggtggtaactattgttctctcatgcttcacttagattattttgagaatcctacaaaacagcatggtagtttgccttaacaataataggcattcaagattagaaaaaggaaaaattcttatgagtgtgttgaatgctatgagaagtttgatgcttgataattgttttgagatatggacatgatgatattagagtcatgctagttgagtagttgtgaatttgagaaatacttgtgttaaagtttgtgattcccgtagcatgcacgtatggtgaaccgttatgtgatgaagtcagagcatgatttatttattgattgtcttccttatgag

SEQ ID NO: 37560 - DNA, 341 bp, Triticum aestivum
  Clone ID: PAT_TA_37560
gggtcgaccgggacactacactcaggatacatccatccgtacgtcggtgacggcgcgtctcgtcacaatgacactacttgcttgcggactcacgacgatcatctgagatatagtacaacgcataagagcagttcgagtacacgggcaactctgtcaactctatcactgatccgcattatgctcgggcaatacgcaagggtggtcacatcgtcatcaaggaacgtcactgacaagttgttgaagtacacagctctataactgtgaagattagtcacacacactcatgattagtagatactgagatcgttaatgaaaaggagcttgaggatcacgttcattca

SEQ ID NO: 37561 - DNA, 418 bp, Triticum aestivum
  Clone ID: PAT_TA_37561
cgggtcgaccgggaagaagcaccaaggcggataagcgggcgccggcgaccaatgatgccggcggcgatgggaagacgatgggcatgaagaagggcagcaaggccaagaagggcgtggagacgtacaagatctacatcttcaaggtgctcaagcaggtgcacccggacatcggcatctcctccaaggccatgtccatcatgaactccttcatcaacgacatcttcgagaagctcgccggggagtccgccaagctcgcccgctacaacaagaagcccaccatcacgtcccgggagatccagacctccgtccgcctcgtcctccccggcgagctcgccaagcacgccgtctctgagggcaccaaggccgtcaccaagttcacctcatcctacgctagtctgccgtgtccgtgaactgatgg

SEQ ID NO: 37562 - DNA, 428 bp, Triticum aestivum
  Clone ID: PAT_TA_37562
gggtcgaccggttggttgacagctcatgctgatgctgaggatttagtcaaaaggtgtgacgactgtcaaaaatttgcacgtcgcgctcatgttctggctcgggagttgagattattccaatcacttggccgtttgcaacttgggggcttgatatggttggaccctttaagagatccaaggacaaaaagactcacctgttagtggcagttgacaagtttaccaaatgggtagaagtagagccagtcagtaagtgtggtgcggccacgacggttcagttcaccaaaaaggtgatattacggtttggctttccacacagtattataactgataatggtactaatctgtcaaagggtgagatggagtaattttgccaacatgagcacatccggcttgatgtagcatcagtggctcacccccaatctaatggt

SEQ ID NO: 37563 - DNA, 411 bp, Triticum aestivum
  Clone ID: PAT_TA_37563
tttagtagaacgacaagacaccattgttgagcacgaaataatgacacaattgagctggagcttcggtcgagggagtagatgtgtatttatatgcgcgttcatcggcctctggaacagccaaaggagaccctgccagagttcctgccgggctccccatggacgcaggaagtgtttgtgtcagagaaggtttcaagcgcaggaaggattggatcaaaaattggaacgattgaatgaaagaagaggaaggagattgtgttggatcaaaaagaagagaaagaagacctggtctgccgtggaagggcatcgagctgctgtgctctacaaaggaagaagcaagagaccggatctgttttttttttttgagggatggagaccggatctgctgggtaacgcatcagcgtatcctttttg

SEQ ID NO: 37564 - DNA, 404 bp, Triticum aestivum
  unsure (1)..(404): unsure at all n locations
  Clone ID: PAT_TA_37564
ctcagtaaacaaagtgtgtgtcggtgggacagcttgggaggcgcggtattcctccgggtgggtangggcatgtccagaaacaggaggccgcgatcagcatcagcatcgatcaatcaactcacgcattcttgtttcttcatcaagacgcaccgtccgttgcattgcattgcatgcacggacgaccctgcgtgcataactaccattcaaaccgcccgctccgtccgtcggcctcctccgatccgtgtttcttctctccagtaatggtgctacctagaggctatagggcattggttttgttccgtggtggccatgtaactagcaagacttatctaatgaagtcatatcaattcaagatttttgccatcaatggcttaaaacagatgaagtctatcgattgacttcca

SEQ ID NO: 37565 - DNA, 356 bp, Triticum aestivum
  Clone ID: PAT_TA_37565
ctactccagtgtggtggtggtggattgcctcttgggctgatgatgaacagtacaaggggaagaacatcctcctgaggttgaggtgttcttgcgctctgtgtgtggatgaggatcactcaagatcagatgagatgcctccgaatgagttatctcctacggtggtggctagttcaacttatataggccctggtcctctccccaaatattgagtggaaagggagccaacaatggccaatttgaaaggggacagctagtgtcacgaccggtttttcaataaaataattattgagaaaccaatccctattatggatcagcgaggaagaatccttctcactgatagacaatacattggtcac

SEQ ID NO: 37566 - DNA, 392 bp, Triticum aestivum
  Clone ID: PAT_TA_37566
gggtcgacgcgaaagtggcaaagactcatgaggccatacaatggagctggcagcacggcgcagcaagcatgagctgcttgagagtgcggatgacaaggcaagaaaggaaaaaggcttttatggtgatcgggatcaataccgcgttcagtagcaagaagcgccgtgattctgtcagggagagatggatgcctcaagatgagaaactcaagaaactggaagaggaaaagggagtcgtcattcgatttatgattgggcatagggtttaaaatgtgagtatgatgtgtgtggagagattgtcatccatgctcagcaccggcctgcaagcaccgtcgtcttgatggatgatgatgatttaatagtcaaggggcttccacagctctctgccatttgtg

SEQ ID NO: 37567 - DNA, 395 bp, Triticum aestivum
  Clone ID: PAT_TA_37567
ggtcgacgggtgcgaacgataaagaagctagccgagcctatgaggattcgcttacgtagctggaacgtacggtctcctcctatgaagagcttctcaccattcggtacactcctaagcatgtcttccacgccttcccagaactccctcttggtgttctcattgtggcctacttgcggggcatacgcgctgataacattgagacccaagtcctcatctaccagcttgaccaacataatccgatcgccacgtctcttgacgtctacgactctatacttgaggctcttgttgagtaaaatgcctacgccatttttgtttgcagccgtccccgtgtaccacatcttgaaaccggtatcctccacctccatcgccttctgtattctccatttggtttcttg

SEQ ID NO: 37568 - DNA, 405 bp, Triticum aestivum
  Clone ID: PAT_TA_37568
atcgatcatcttggcctcctcccggcctcctctttctcgtcctgctacactggagtcattttcgacgtcgatcatctcagctcctctctctcattctactacactgatgttaccatggcgtgagcactgcatttcttctcctctctccactgtctttgtgcaagcactccaactagttcgccgacagggtcgctcgcccatgacttcgtgctcgtcatgtcggacacggcgccacgatcactatccaccgcagtcgccatggtccggtgcacaatgcatttcttctcccctttcctctgctagctcttaaccatgtgtgctaagtgcaagtgctagctcttaatcataccccatgcgggcaaccaaacaacgtgtagttgcagtggcgaacgcaggaataatttc

SEQ ID NO: 37569 - DNA, 382 bp, Triticum aestivum
  unsure (1)..(382): unsure at all n locations
  Clone ID: PAT_TA_37569
cgggccgacgggaaaaccgattagtcatccgcgcatcgtcgtggccgtccgcccgtcccttccacggcacatgatagcctgacggttgccaactttctttggacgtgagaatttgatcgtcctgtgctcagcaattcggcataatgcatgatactggtgttgtcgtcgagctacgtccacctcttcactctgggagttctggaccaccacgcccacatgcacaacacgccagttcagcgagcaatcttgcgaggattggagcttggaaagacttggctcacgtacgtgcgtgcttggccgacttggactcgatggcgtgtgtggctggcggcaaaacaggcagaagacgtgcctgacctggaaggangatgccgtcgtctcg

SEQ ID NO: 37570 - DNA, 328 bp, Triticum aestivum
  Clone ID: PAT_TA_37570
cgggtcgaccgggatggcctggcgggtaatgttcactatccgaattcgctgtacggtcttgtcggtcaagagcttcatgaccgtgtcttgtgcagtgctgggttcttgtgtcgaggacgagtaccagccgcggggatccgttgtacttcaaataacactacccgttgtaaattgactcctggcgaatgtatggatcaatatccagtgggttgtctgtcatgacaacaatagagcaatccttgaagtacaaacaaagtcttcggaggtttccatcttgatcacactggggttcacctatctgataatccttccttatacttatatgtga

SEQ ID NO: 37571 - DNA, 367 bp, Triticum aestivum
  Clone ID: PAT_TA_37571
gaagggcaaccgcgcgctgcgcgacgcagcaatgatgggtggccgccatgtcctgcagtgtttcttcagatctgaattatgaacggggtgagaaagaagaaagcgaactggatggacgaggatcctacggctcgtggtgggctaatcgggcggctagggtgcgaccggccgaaattttgggccggcgcaccggcgccgatcagtcgccttttttctggctgatgtatgcatgcttttatagtttgagcgatggtggttcacttttaagctaacttgggtgattcgttacccaaaattgtaccaaaaaaaaaaaaaaaaaaaaaaaaaaaaaaataaaaaaaaaaaacaaaaaaataaaaaatgaaaa

SEQ ID NO: 37572 - DNA, 298 bp, Triticum aestivum
  Clone ID: PAT_TA_37572
acgggcgtaggtagaggcgcccacatcagcctcaatgtcaaggggcaggatggcaatgaggttttcttccgcatcaagagatccacacagctgaagaatctgatgaacgcttagtgcgacggtcagtctgtggatctcaactccagtgcgttcctttttgatggtcgtacgctccgtggtaagcagacccctgatgagcttgagatggaggaaggcgacgagatcgacgccatgcttcacgagaccggagggtgctttcctggcccttagagagagcttgctgcagcctgactgttct

SEQ ID NO: 37573 - DNA, 415 bp, Triticum aestivum
  Clone ID: PAT_TA_37573
attcgccggtcgacgggggcagttactcagttgccccttagaggttagtgctaattgagttcatcattttacttcagttaatgccaccgctcatcaagaatactatttaacattggcagggatatgaagcttgtgcctttgttaactggctggatgaagaatggcatggcatggctcggagtgttatcaccaagctcacagaagataacgtaaagctaaagaagaaacctgctgatttgaaatgtacaatcagtacgatgaagcaagaaataatcaatcataggcaaccgatgaaagcagagataagaaggaactagcatgtgtagttgtggttgtcgcattagccatgttctatgcgctgtttgcaatgatgattaggggttttgtttgacagtattgctgaagcacatctaga

SEQ ID NO: 37574 - DNA, 374 bp, Triticum aestivum
  Clone ID: PAT_TA_37574
gacggggggtgtcattgggtatggtatcctagataggtccatgaccctaccttaggtacataacctcatcattagcccccgaatggatcgaggttcgagtgaggaaggagttgttggttttctccgacctatttcccgtgctttgattatgtcgtatcctggatcagcgatttttctttttggcgttggcatcaacttttctttcagtcgccttgatccattcctttcttctgtcgagtgaacttttgaactttagtgaacttccgagtgacggatcgtaggaaagatatcgtctgacagattgatctgccgttagcggattttgtgggatccgaattttgggaagcgcatgaaacggggcggaccgcggtact

SEQ ID NO: 37575 - DNA, 228 bp, Triticum aestivum
  Clone ID: PAT_TA_37575
attccgggtcgacaggacaaaatagacggtgcaagcatccgtactatgatgcgatgcacgcgatacgggttcactgtgtcggtggaaacatcaaacttagctgaatttcttttcaccttcgtcagttatatactcactagctgaactctgtcccacagcgcaactgttgtacgtgcatacataggatgtatggcttgtcataactaattatgacttcatatgttgcct

SEQ ID NO: 37576 - DNA, 340 bp, Triticum aestivum
  unsure (1)..(340): unsure at all n locations
  Clone ID: PAT_TA_37576
gtgcgacgagaacgcgacgcgtacgagttgtaagtgtgccgccttttccttttgaacttgcaaagcgtaacattttcgtgcgatcgattgatagaaatccagaacaaaatgacgagggcggtgctttcccgcgggttaggcgggctagtttgagtgatatgacgtgctacagtgtcatccacttgctccatttttatgtaagcaagagtctacactcttacgtgggaggagtgcgaaacacggcggatctgattttgatcaagggataactgttccctgcgaaataatggagcactgttagcgattatagcatgatagttagggacaaannannaatnng

SEQ ID NO: 37577 - DNA, 175 bp, Triticum aestivum
  Clone ID: PAT_TA_37577
ataagaagtactatgattaaaccggtaaccatcgttgaaaagggttggattaaggttagcaccaataatccggggttggatgcaatggttctaaccaatgtgcagcggggccccttcaaagacataacgaccaacacacgagttacctcatgtgccaccggtttggaatgatggc

SEQ ID NO: 37578 - DNA, 381 bp, Triticum aestivum
  Clone ID: PAT_TA_37578
aaagtgactctaattagaatcttgttatcgatgcacggagtcgagcttctgcgagcacatcaacgacaagatcagcggctactgtcacggtcactgcaagaatgacggcgagcacaatgagaagaatgccatggagacgctcagggacaactaatcatggctgatgggccatagtgacgacaatggatactgtatcatcagtagatttatcgactgctactgagccagttctggtcgcgttcacttcaggcgatatctgtacccttggtatatcgtgtcttgtgctaacatatttatgtaatgcttgcaatgtcgcatggatcatgtagtctttcagcaccctgccatgcatggtgcctgtgataccaacgttaaagaatt

SEQ ID NO: 37579 - DNA, 408 bp, Triticum aestivum
  Clone ID: PAT_TA_37579
gcaccacacagcaatcatgtcatggaggaggtggtttggagcagtgagtgagtggggcaaggagtgaccagtaacagggcaggtatttttctgtgcaagggaccactgttggcatgatttatcaacagtctgcaatcaagcaaagcaaaacgtggttactgggtcaatctaaaccatgggagtgttccagaagaagcacaagacactgtgaataaatttattataataattgatcatgaccactaatgaccaaccttagcattctggaacaagaaaaggacataatacagcttacataaaacctacacccatgcgaccatccgatgaatgtaagcacagcatgtcagtttcactttcaacttatccgtgggacatagtatttccttggcagaaaatgggaaaaaagat

SEQ ID NO: 37580 - DNA, 420 bp, Triticum aestivum
  Clone ID: PAT_TA_37580
attccaggtcgacgggacccggtcagcatctgaaacagctaggtccgcagatgatcatgctgatcaatatgctcatgtgcaatggctttggagttgagctttctagtttcaattgatcagatgcgacgatagatcacgcgtgttgacagtgtcctaggaagcgtttgtccgcagttgtcgatcgatctcacattcggaactcgaggctgaaactctttggcttcggtccggtccgaagatgcgctcgtgcctcaaattatgggcacactccatgttgcagttgcagctgttgctattgttgacaacatcaacactaacacgtacgtgtatacccttagagcatgttaaggaccgcacacaaggaaatgcctccttattacgcacaaaataatgattcctccaactgaaaatctgggaacc

SEQ ID NO: 37581 - DNA, 340 bp, Triticum aestivum
  Clone ID: PAT_TA_37581
atgacgaaggtcatcccctacgcgtttgtcataggctctatacggtatgccatgccaactaccgcacctgatgtgtgccttgccacatgtctggcaagagggtacatgggtgatccaggagtgggtcaccagataccagtcaaaattgaccctggagtaataacgacatgtttctcgattatggaggtgataaaaagttcggcgtaaagggttacatcgatgcaagctttaacacctatccgactgactctaagtggcataccggatatgtataatggagcaactagttggaatagctccaagtggagcgtggaagcagcatttataatatgccaaagca

SEQ ID NO: 37582 - DNA, 394 bp, Triticum aestivum
  Clone ID: PAT_TA_37582
attcgaaatttcgggaagcgcgcgggacggagaggaccgcagtaaacggagcggattaggcaggggcgcctcgattcttgcgccacctttttcaccacgtaccgagcgcgcgactgttgcgggatttgacgggattgccttggcccacaagtcagtcactcggcgaataggcctatataaggcgtctgggccggtgttttttgcacagtgagtcccattttctttctcctcctctacttctccactgcatccgcctccactctcggcgccatcgcccagcctgagcgcaacccgctgcgatggcgaaggacaagacggcggctctggagcgtgcgaagaaggcgaccgcgaaggcgaagggcaagaaaacgagccggggagggtcgtcgtccag

SEQ ID NO: 37583 - DNA, 194 bp, Triticum aestivum
  Clone ID: PAT_TA_37583
ccataagggtttcccttaaagtcggctatatcattctcacaaaaaattgtggaagggggcaccgcaaatggcgaaggacacattcacctggatcaccttgttgcatctttggtgcaatccctgcccaactatttatatgttgatccccggggtcgaaacttggtgcagaagcctcctcaaagtcggtttttccc

SEQ ID NO: 37584 - DNA, 174 bp, Triticum aestivum
  Clone ID: PAT_TA_37584
tggggtcaaaccgtaacctggtgtcgaaggcctcctttgaagccaaaaggaataaagaccgggttgccactaacctttgggttaatggcaatgattttaaggacaaccatggcagttaacatgggcctggcggttaacggacaaaaaagccattgacgcacccattccattttg

SEQ ID NO: 37585 - DNA, 142 bp, Triticum aestivum
  Clone ID: PAT_TA_37585
cataagatggatcaatgcgcggctgcaggtacactcggagacggatctgacacgccagtggcagacattctattgccgtagacaacggtctgtgacggatacttcataagctgtcatttcctatcaaccctctgaaccagta

SEQ ID NO: 37586 - DNA, 349 bp, Triticum aestivum
  Clone ID: PAT_TA_37586
taaagacagagatggaggacggcgatacatggacaatacaacggctaaggtgatctgggagaggatatgagatgcagatggcacacaatgtactgcgggacatacaggtttgtgatgggtacttggtaagctgacatttgcgtatactccccggcaacagtgccagaaatccttcttgctacctcatgagcactgcattggttttcccttcaagatgaaacggtgatgcaccaaaatagcgtaagtatttccctcaatttttgagaaccaatgtatcaatccactaggaggccacgcacaagtccctcgcacctacacatacaaataaaatcctcgcaatcaatgcaat

SEQ ID NO: 37587 - DNA, 358 bp, Triticum aestivum
  Clone ID: PAT_TA_37587
attcctagtcgacggggacttcaatgactttcagaggattggcctggggtctggaaacagcttcccactacctgagaattggaaggctgatgtcttacaggcacagcgacctggacataccccatcccatgaggttttacaggtttatttaacctcttggcttgctaatgtgaacatcaagacgagtagaattgacgagatatttgagcttgttgaggaagagatgcagatcaaattgcgttgaagatttcgattcatagaatttaagtgggaaccattcgggaatgttcaggggttctttttcattaacggaagtgatttacgcgaaaatcatccacttagactcaaaacaaaaaga

SEQ ID NO: 37588 - DNA, 121 bp, Triticum aestivum
  Clone ID: PAT_TA_37588
gtctggtgacatcttctcactacctgacaattgctcagctgatgtcttacatgcacaacgacctggtgataccccatcccatgagcgttttacaagtttatttaacctcttggcttgctaa

SEQ ID NO: 37589 - DNA, 424 bp, Triticum aestivum
  Clone ID: PAT_TA_37589
gccccgtaccctgggcgtccggattcatcgaagatttgtgtccgccagccggtagagctaacgtcgagctccccaacaaaccacccgtacttggaattgatgcagtcatgtcttatctctgttagaagctactaggtgccatggatctcaggctctcagctcaagctccgtgtcgggacgagctctggtgcccttgctcggcgagtactttcagatatgcacgtcgtcgatagtggtgaatccatgctgcaatgaacacaacaacattataggaccccgactgttagcttttttgacaaaggggatatactaatatcgtgaagatatcaattacacccagcctttgcatcaacacagacaataagcatgcacacaaccaaggagaagaaggatttttcgggacaaataaaaaaggggccgctct

SEQ ID NO: 37590 - DNA, 221 bp, Triticum aestivum
  Clone ID: PAT_TA_37590
tcgtcgtcgcacacggggctgccgccgggctggatctagggcgattggatccagtcttcggtccgacaggaggatctggatgaactggaggagtccgggctgattgccaagggggcggcgaggctgccaaagggggagacggaaccttaacctcgaccggctgagtgtgttctgcttgccactcacgtcgaccggggtttctcgctccctccgcaccctgc

SEQ ID NO: 37591 - DNA, 394 bp, Triticum aestivum
  Clone ID: PAT_TA_37591
ttccaggtcgacgggggcgcgtggggtttcaaggattttggtggcctcggtgtacgaatggggggtgacgaaggggaaggtagggggagccatggcttagggacgcgcttgtctgaaatgtagggtaagttaccagcgtacccccaccggttttgacaccgcgacgtcgagccggcatttctggctgaggggtcgaaggggaatttcgcgtgtctgggctgcgggaccaatttcggatgaggagggagttttcgtgcgcgtcgaaatttcggggtaacaaggcgcggcgcgggttgaagaggcgggagtttcaaagcagatgagacaaaagatactcgagcttgaaaattttgggataacaaggcgcggattccttgttcggcagaacaaactt

SEQ ID NO: 37592 - DNA, 305 bp, Triticum aestivum
  Clone ID: PAT_TA_37592
acggggggccggagcgtttttttagcgcaatatagaggcccttctggtgggtcccagctgtcaaatggaggaatcattattttgcgcgtaaagtcaacggccgatggatgtcgttcgttggccacgttgacaaggccgcgccgatagcaccatggaggtggacgacggcgaggcctaagaatggaactacacggagccggggaagactcggcactggttgcccatgcggtggggagtacgaaggtttacaggtccagctgccgtcgcccgaaaataacatgaggtgtgggtgagtagatgaatgg

SEQ ID NO: 37593 - DNA, 298 bp, Triticum aestivum
  Clone ID: PAT_TA_37593
ccggcgggcataacggcttcaaaggaggctggcgtcaagggaaaaacccggggccccaaaaagggcaccatggcgaaaaagggcttggaaacttacaaaatctacatcttcatggtgctgaagcaggtgcaccctgacatcggcatctcctccaaggccatgtccatcatgaactccttcatcaacgacatcttcgagaagctcgcccgggattccgccaagctggcccgctacaacatgaagcccaccatcacctctcgggagatccagacctccttccgcctcgtcctccccgggg

SEQ ID NO: 37594 - DNA, 133 bp, Triticum aestivum
  Clone ID: PAT_TA_37594
gatgtggtccaaaaacacaatggtgggaaagggttcccctttggaaaccaattttgccaaattaacaacttccttaattttcaatccaaggaagttaagaaattccaaaccctccaaattccggcccaagctt

SEQ ID NO: 37595 - DNA, 397 bp, Triticum aestivum
  Clone ID: PAT_TA_37595
tacggctacgagagagagggagagaggaggaggacggagttcatgtgtgacaaagacacaaagagtgtgtgtgcgagaggtatcagcttaaaatgaggtgatagtgtgtgtgtgcacgatcgagagggcgtgtctcaagaagggacgaaaaatctacatagatacaaggagcgcgagagagacatgtacgcgatagtggaagcacgagtgtgcgggtgtataaacctatctggaggctagtcgatcaatgtttgtgagagaaatacgagtcgggtgtgcgaaagtgagagttttgtgtgtgtgtgtgagagagagagagacggtagtcgggaaggggagtggaagcaggagttgtgtgtgtgtgtgagagagagagagagggggggggagagttttt

SEQ ID NO: 37596 - DNA, 337 bp, Triticum aestivum
  Clone ID: PAT_TA_37596
ctccagcagcgctgcgccggatagcgtatgacggatagggccggaagaggccagcagcatgatcatgagcatggccgctggtacgttgcttggcgccatattttcttgttaagctgcacggtttgaatgctccaataccttcttgcttaattagaacaagaaggtcccctggtacttcattttcttggtatgaataatacattacgagcgatcaacctgtatgatggttatccttggatggacgcgtctcaatataatctctctctcagtgcacatttagacactctatcatggatagataacaatgtcctactcgtgtctctttttctttcccttt

SEQ ID NO: 37597 - DNA, 108 bp, Triticum aestivum
  Clone ID: PAT_TA_37597
atggattgaatggcaacctccacggccggccaagaacccaagaacccgaaactggaattggcccctgggaaaactggccggggttgaaacaagggaaattgcttgttg

SEQ ID NO: 37598 - DNA, 224 bp, Triticum aestivum
  Clone ID: PAT_TA_37598
tccaagtccactccttacaggcgggtttgggtccaaaagatcggtaatagtcccaatcaacgtttacctcaggatatcaatgggattaactaggataagttttaggagcggccacctcatgaggtaaaccggcctttcaagtcaaacgattactttcttcagaacaaggaacttttttacaagacctcctttcggtgtgccattgaaaattattacccgtagga

SEQ ID NO: 37599 - DNA, 336 bp, Triticum aestivum
  Clone ID: PAT_TA_37599
acccgtccctcaaccggcagatagcaacaattaagccgccaattaatccccttccggggtccattcacgaacggacttgaaggcattgggtgtgcccccctggccggacattggcaagaatcattccggctgcacttgcaacggaaggttcacaccagtttggggctccaggataggggacggttcaggaacaataggatgataaatcccacccctgaatgatacagttgccctgctgaatggccggtaaaactgcagtaatacttctgttacacatgtcattaacactgcttataattcctactacttgggatgtaacgataggacatcatgggg

SEQ ID NO: 37600 - DNA, 406 bp, Triticum aestivum
  unsure (1)..(406): unsure at all n locations
  Clone ID: PAT_TA_37600
cgcctgtggtacggctcgtagaattccaggtcgacttggtaccctgctcaacatgccaaagaggagcaaagatgggccgaaagcaagggcagacttgaaatcaatgggcattangcaggagcttcatgctaatgatgatgataatgatgatgatgatgatgatgaggcgaagcaggacacagaaactcctcgcaaaggcaaaaaggctaagaataccggaaatgactaccctcccgcgtccttcactctaagtcatgaggagatcgagcagtttttcacctgctatcggggaaaccgatccacgaacacctatgggaccagcggaccgagcccctttcggttcggcgggagcggagatcgcatgaagagcggatcgaggcgaagcacacgagcagtttacccagct

SEQ ID NO: 37601 - DNA, 424 bp, Triticum aestivum
  Clone ID: PAT_TA_37601
cgggctcaaattccatcgacacgaagcaaaagaacactaccggcggcgatgaggggcatcttgagggcggtcgatccccagcggcgacagcgacaaggtgcggctcttctcaacggatctgcagggatggtgcggcctagcggtgattgagggtgcaaaatgcctcgccgacgctattccaccggctgatttggccggaatcggtggcggaggacgggcggaacttgtggcgggcggcggcggaaggaggtgggcaaaggggcacgggctgaaatgtccctccagccaaatgcttcactgcgatatggggcaccgcagggacgaggcggaaacccgcgaacacgcgggttagggccgagtttttgtcgcgcccctcaaaaaatttttgcggggccaacggttgtttccggggtcggtttgggtg

SEQ ID NO: 37602 - DNA, 382 bp, Triticum aestivum
  Clone ID: PAT_TA_37602
aggcatgcacaaggggaatcaggcgacttgccgtacgcggtaggttgccctgcgttcagtcgtgagctgcgcaagtctagtggcccagcacgaagaatttcaagcgagacgtaccagagatgtatgacggcaagtcgcatccgtcggagttcctgagcatctacaccatcgcggtgcaagctgccggggggcgggacgacaagatgctggccaacgacttcccgctggtgctcaagcccaatgtcagatgctggctcatgcacgtgccggacaactccatatcctcatgggtagacttatgcgatcagtttgtcagcgcctttacaagcggtcacaagcctcatggccaagagagcgaccttcatctgctcgcccagaagga

SEQ ID NO: 37603 - DNA, 261 bp, Triticum aestivum
  Clone ID: PAT_TA_37603
gatattactacggcattgcaaccttatgatatgagaaagaagaacgcggtggaagtctctcatggtgaaggtttgctagtcaagggtgggcagtggcagaagggatatgaggcagggaagaacaagatcaagaaaaagaatatacagtgtcacaagtgtaagcagtggggacatatgagaaaggactgtccagaactcaatggtggggcaagtgctaataaggcaactcatggtgatgactcagatagcagtagtgatgtt

SEQ ID NO: 37604 - DNA, 305 bp, Triticum aestivum
  Clone ID: PAT_TA_37604
ctctggtattgtcgtctatgagtctaaaagtcattgtgtgggagattcataaaagatataacacagaaaaaaaaaaattaaagaaataaatagagctaaaaaaataataaatcaaacgatcattcagataacaagagattcaaagtgtataatagataatggaaccacgattgccagtaaaacaaaaatagattaacaaaagaattggtccacacgtaggttccctatcaactctatggttatatcctacttaaacgcctttcagtggtcataccatattctaatctggggtcaatttttttaaa

SEQ ID NO: 37605 - DNA, 185 bp, Triticum aestivum
  Clone ID: PAT_TA_37605
aatggggaagtaatgggactagtaatagtgtatctagggtaatgcgtctgaaaggatcaggcaatgggtctttctgttattatccttcttctacctggaaactcctgcatctactgctgtggctccatctagtgattgtgatgggcaacagaccagaaaccctcttgaacattgtttacctctat

SEQ ID NO: 37606 - DNA, 397 bp, Triticum aestivum
  Clone ID: PAT_TA_37606
ctggctatattaaagcaaacgtgtggtgtttcggccgtcaggactttcagagacttcagagagtttcgccggctgaagcaagctgcagctctgctcatctgctttcctttcttgctttgtactgctccttgctactccctccgtcccaaagtaaatgtctcgactttgtattagcattagtctaaaattgtactaagcttgagacacttattttgtgacggagggagtaattaacagctgttaacactgagagcaggaatgaatggatggtgcttgcattagttacctggcacatcaaggagggaagcttggaacttggcctggcactaacatgtatggtcatgccacactagacttgtcagttcttctcactggtttctctttccctccgctgttg

SEQ ID NO: 37607 - DNA, 330 bp, Triticum aestivum
  unsure (1)..(330): unsure at all n locations
  Clone ID: PAT_TA_37607
tcccgggacgacggaggccatcacagcctatgagctgattatgaacgctatcacggtcctgaggcagaagctggacgccgttcgtctgcatcacgatcaaagggagcctggccagctcagcccacaccttaacggctgctaaccacttggctgggaaagaaatcgccaaccgtatctttgtttctccgtatctaggctctaactagcttgcctgtggcaagaggtagtggatgcttcctttgatatccagtaccaaaactctacggtaatcgcctttgtatccgtctgtttatgccctgacctctgccggaactctgtacgtacaanana

SEQ ID NO: 37608 - DNA, 429 bp, Triticum aestivum
  Clone ID: PAT_TA_37608
ctcgaggagcttcagtcgtggtagaaaaagagcgtgcacgttattaagggggatggcagttcatgaaattggcgaggcgcagcgtgggcgcgaaggggagtgccgacgttggcagcgagcgcatatgtccatcattaaaacagagatcctcgagctgatcaagggcgggggatcggaaccactcctcaagcttggctcggtcattgccgttggaacagaacttgccgtgccaaggcctctgattgggccatggtgactgccgaggatctgggagaacgcatccaagcttttgcaatagccatggcagagctcgtgggtgtcaaggaggtcgagatgggtggggagccatcgggggcgccacgccgggaaaggacggttggtctcgccccaaaatttgattggaaggagatttatgatgactgtcaacat

SEQ ID NO: 37609 - DNA, 420 bp, Triticum aestivum
  unsure (1)..(420): unsure at all n locations
  Clone ID: PAT_TA_37609
gaatggtcaaggtggatttatcacactcacgttttcttcangagtttggcaataaaaaattaggcgcaacccctagtatctgaactagtgtgctgtaaacacctgatggatacgaacctattcattgcataatgcggaaaaaatcgctaaagatttgaaacctccgaacagctgaccgattcacgccgcatcatgatagtcagttttcggctttctctactaaggtgctcatccggataaactaggtcacaatcgtagtagttctccctttactaccctagccgatattgcggaatgtatggtagtaagcacaggagccgggcaacccaactattgaccaaagacatgattcggagccaatgcatataatgccaaattcgtggtgggcaactatactgtaaaaagtgttcggactttttg

SEQ ID NO: 37610 - DNA, 249 bp, Triticum aestivum
  Clone ID: PAT_TA_37610
ggtgctgaaatctcgcaagctacatcaagaagccaccatcactccagggaatcaaacctcgtacactcctctccctggggagctcaccaagcacgccgtctccgagggcaccaaggccgtcaccaagtttacctcctcttagatcgcgtcgcctgtatctagtagcaaatgtagttccatgctgttggcttaatgcttgtctgtggactctggttatctgcaagtaatattagtcctactgttggaaaa

SEQ ID NO: 37611 - DNA, 419 bp, Triticum aestivum
  unsure (1)..(419): unsure at all n locations
  Clone ID: PAT_TA_37611
gggctacaatgcatttacatgaatcaaacaaatgattatgatcgtattaacatcaaagctcatttctcactcatacgtccgggcatgttcggacatcaaataggcgcccaacgggctcctcaaaattcaactggcaggacaatctgggctccccatattattgatagtaaatgggaaaatcccattcatttgtctgccaaattatcaaaatatgaagaatccatcgtgaccattttttcggaaggatgcaaccgtcattttctagtgtaacaagcagtcaaattatttgatggttaacaaatatttccgttttaagggaccgcaatgaacataactcatggcaaagttccttcatttcccaatattaaaacaaccccataggccagtgtgttaggcatcatctaataaaanaattaaat

SEQ ID NO: 37612 - DNA, 441 bp, Triticum aestivum
  Clone ID: PAT_TA_37612
aaactcaccaaagtggctcactttctgcctatcaaagagtcaatcactgcagctcaattggcggaactctatacctctcgtattgtctctctacacggtattcctcaagtgatctcttcagaccgtggtagcatctttacatccaagttttgggattcttttcagaaggccatgggcactaacatccgcttcagcacagctttccatcctcaaactagtggtcaagtcgagcgtgtcaaccagattcttgaagatatgctcagggcttgtgtcatctccttcggcatgaaatgggaggattgtcttccttatgctgaattctcccacaacaacagttttcaagcaagttcgggcaaggccccattcaaaattttgtatggcaggaattgccgtacccctctcaactggtctgaaaccggtgaacgtcagcttttgggtaat

SEQ ID NO: 37613 - DNA, 431 bp, Triticum aestivum
  unsure (1)..(431): unsure at all n locations
  Clone ID: PAT_TA_37613
gattcccaaggcaccccaagtaaatatgcaaggagactcaagcgtctaagcttggggatgccccagaaggcatcccatatttcttcctcgacaattatcggtatgtctcggtttttgctttcttcacatgacatgcgtaaattcctggagtgtcgtgtgctttttatttttatttttagtaatgcactgttctggcatgagatagtccttggtttatttatagaattctctttgcacttcacttatatcttttgagtgtggctttatagaatgcttcgtgtgcttcacttatatattttgaagtttggatgctcgtttctctacattggagcaccattatttgtagaatgctcttttgctttagttatatttgttagagcgtagaagagtcttttgtagaagaattaaacttgcatgcttcaattanatat

SEQ ID NO: 37614 - DNA, 415 bp, Triticum aestivum
  Clone ID: PAT_TA_37614
acgaagcaaatgcggcgtgtgcatagtcattgccgaaaaagaacacaatgacggggaacaccacgtacctaattttgggagcttctgttccgtgccttaaccgcccgaacatttccctcgcgctcacacatccacactggtgggccggcacaagaagaaggcgagcggcttgatcgtctgttcacgagaaaatgtgagcaccattttttaactgtaatttctcttttggagttagagcatctaatatggatgctgataggttagccaagtttgcacattctcttgatcaggggctgacatgtctggctagaacaaacccatgttccgaattgtaatccacatcatgtggactttgagtcataaagcttggtttaacacttacaaaatgagacaatgtgaacggcctcgttcgttc

SEQ ID NO: 37615 - DNA, 434 bp, Triticum aestivum
  Clone ID: PAT_TA_37615
aagaataatcatgaagaaacaaatcatataaccgaggaagagcgcaagagagatcatagaaatgctcttaggagagcatcttatcggaggaaaaaggataagataaaagcagatgaaaatgtacggccacgacctaagacaggtacgtaccagcatttttagatatgcacggtgcataccttatcataccaacagtttctttatgttcacgttgactgacaaatcatttgctcacaaagcctaccgtcatatgcttgatcttactaaaggaatgttcttcttttcattagtcactaaaatagactttttctaatgatcatttcacatctactttcataaaggcacctctgatagcgctaactatccagacttgttgcatgatgatgcaacattaccaaactcatcattagacgcctccggtgttacccttaatt

SEQ ID NO: 37616 - DNA, 253 bp, Triticum aestivum
  Clone ID: PAT_TA_37616
ctgcaggacacgcaagatcacctccctctgggcgcaacctgaaatctcacccacatcatctctcctaatatttgacaaagtcatgatgcagttccggctccatcgacgaccagcattccttcctacgtatgctgaaaggagtcatcgcaaaatcgccttctctgccttgcatggattcatgcaaatgatacatctccgggcaatgtatgtgttgaacccgcaagtgacgtacgttcggcactaagatcctccg

SEQ ID NO: 37617 - DNA, 413 bp, Triticum aestivum
  Clone ID: PAT_TA_37617
ggaggctattacttggcatgtccgcacactttttaagctgaaaactatgattactcctgtttataatctgtcagtaacgagttctacttgtgtttttatttgatgttatgtgtgattatgatttcatatttaagctttccttgtatgtactttttctgttctaaatactttactcaggataacaatactcctgcctactatatatttggtgctatctctgatcactacattctacttttgaatctttgtagacaccgtgtggccacaacttctgtttgaaatgccttgagaagtgggttaatagtggaaaaaggacctgtggaaaatgtcggggaccaatcacatccaaaatggcttcgcagccaatgattaaagcagcgttggttgcggatatccgtatggctaggactgca

SEQ ID NO: 37618 - DNA, 136 bp, Triticum aestivum
  Clone ID: PAT_TA_37618
gggtcgacggggtacgctataacaagtcatatcatcatattttcgtatcagcaagtcgtcgagacacggattaacaacctgtcaatgaccacttccatgcacgtaggaaatcgcccttaagtgtgaatgagaattt

SEQ ID NO: 37619 - DNA, 387 bp, Triticum aestivum
  Clone ID: PAT_TA_37619
cgtgcaccacattaccaattcttccaagccagcagacctgcggtcaatcttttgctggtgctgttgctgttgttgcatgttctgtggtaataatgttgaatgaaacagtaactaaagcgttcttttagtaaagagaaaaaaaggtaaagagactataaagatatagtatatttgacttaactgaaaacttaagaaggatataaacaaataagctggtattgcactaacatcgttagatgaaacaaacattttccataaattccaaatggttccatccgtgaaggacggaattatagagcaccatagtttagtgtactttaaaatacaagtggtttctcatgctatgcttataatcaacctagaaagctgaatatgctacaacacaaa

SEQ ID NO: 37620 - DNA, 445 bp, Triticum aestivum
  unsure (1)..(445): unsure at all n locations
  Clone ID: PAT_TA_37620
cgggtcgacagggctaacaaaaaactgctctaaaagtcttgttgcccccgttcgatgtgactccttcgatcttgatgatatactcagctccttccccgccaaccgcacctccttcccaatgaaatatcttgggctgccgttgtcaaccaagaggctcaaaacaatccattttcagcctctcgaagataagattgctgctcaacttaccccttggatgggcaagcatgttgcgcagccgggacgggctgtgttggtcaagtcggtcatcacggcaattgccatttactacttgacggcgctagacctacggctcaggttatgaagaagatcgactcccttaggcgtgcctatctttgggcaagttgtgacaaggtcacangtgtcaaatgcaagatcaattgggaccaggtgtgcaaatcaaaagtgcatggtgggttgggcattc

SEQ ID NO: 37621 - DNA, 287 bp, Triticum aestivum
  Clone ID: PAT_TA_37621
cagctcaaagcgtaggcgtcaactgttatgtactcaacatgttacccacccattggctggcgttgtcacggattgttgcagtagcatttgtagggttccatgcggcgctctgacccggagctaaagttccaccataggaagtttgaccaatttgaactttaacagtatgctaattgcctgccctcaaatttgggagcctatggttcaaccgccggtacctctaagtggacaatcgtgttgcgtgtttgtaatcaccatctggtaccaatcccattcacgatcacggt

SEQ ID NO: 37622 - DNA, 432 bp, Triticum aestivum
  Clone ID: PAT_TA_37622
ataaagaacttcaagcacatccggatgagctaattgaaagtttctccgtgatgtgggaaaccatgctccagtgccgtcggcgccaacacgcgatcatcaagtcactatcagcggctgcaaactagaaacaccattcgactccgagcctcgacgccaagccgccctctttctgtcgatcgagctcggcaaactatgctcaaacctccgaaactggatcgcatcccgcagggcctacctgggcagcctcaacctgggccttttcggaaatttcagtgcagaaataccttgatctgcagaaaggcgtctgtgcggctaaatacaggcttctgagataagcttgaggtagtgattactgcagcctgcgggtgtactgtactgtatatcggctgggtgaaacactgcgacttcatccttgtcaattttccaagtaca

SEQ ID NO: 37623 - DNA, 430 bp, Triticum aestivum
  unsure (1)..(430): unsure at all n locations
  Clone ID: PAT_TA_37623
gcgcaggaagtggcacgtacaaccaccatggagtcatcttgaaggtgtaactggagtctgatggacgacttcagtctgtgctgttggagggggtacggagagtcgaagcttatttcagcgggatagcgagaaacacacagatcggactagggcccaatggtctgatggaggcgtgatactcggcatcggtcggtgatgttcggtggttctctgcagtaggggtttgagtggtgtggttcgcgatccaggagactcgaccgggacagcagaggctcgacgcggctatagcggcgaggcgtgcggtaagcacaggacacagcgacaggccaggacactggtggtcagacatgtggtcggacaaattgtgcanggggtgctgaagcagtgttgacgagtaacggattcaagttggtgaacgggtccaaccggt

SEQ ID NO: 37624 - DNA, 383 bp, Triticum aestivum
  Clone ID: PAT_TA_37624
acggggacgaggaggccgaggacgagctaggagctgaatatctagtgcagccgcgtggtcgtgctgaagatgaacagcattccagtgactttgatccggaacattctggtgatggtgctgaggatgaggatattgatgatgatgatgctgaggatagtgaggattctgtcaatccggattcctcagctactatgaagacgtctgctgcagaggataagaataattctgacggtgatgatgatggtgatgatgatgataatcctccatcagatcgatagtcaatttgttcatgctgatctggtaccatttctgcttgcgcctagaatgacaatactcctctgggagaggattgttggtaaatgctgtaacattaggacatctgt

SEQ ID NO: 37625 - DNA, 391 bp, Triticum aestivum
  Clone ID: PAT_TA_37625
acagtgttctgagaccttcacatcaaacaatgcaaggaaacgaacgctccgcaaccttgccgaagtctaccaagtagcaacaataaacccatggagtgacacggctataacctttaatgccagtgacgaacctaaattccggacagcccgagcaccagccgcattggtcctcagtccgatagtggacggcttccgacttacaaaggtactcatggatggcggcagcggactcaacctcatctacgaggaaaccctgcgaaaaatggaaattgactggagccgcattgagtgaagcaacacaacctttaggggaataatcccaagccgggaagcgtggtgttcaggaaaaatcacactagatgtggtgttcggcacgccggataattacaga

SEQ ID NO: 37626 - DNA, 223 bp, Triticum aestivum
  Clone ID: PAT_TA_37626
gagggggaagctgcatttggttgaatttttggtcaaagttagtaatggcgcaccgtgagtgtggtgtgccattactagtacgacaccgacgatgcgccattactaactttggaaaaaaatttaaaaaaattgttagtagtggcgcaccgagggtgtggtgcgccattagtagttaaaactagtaatggcgcaccaggggatagtgcgccattactagttttgg

SEQ ID NO: 37627 - DNA, 417 bp, Triticum aestivum
  Clone ID: PAT_TA_37627
atcattgatgcttcttcagtcaagaaaataaaagtgaatgtcgtcgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaaaagggggccccccaaagggttcaagcctaatttacccttgaaggcaagttaaaacccctccaaaggggcccccaaattccattccaggggccttcttttaaaaacttctgacggggaaaaccccggggtttcccaatttaaacccctttgaaaaaaacccccttttcccaagtggggttaataccaaaagggcccgcccgattgccctttccaaaaatttgcccaccctaaatggcaaaggggaaccccc

SEQ ID NO: 37628 - DNA, 416 bp, Triticum aestivum
  unsure (1)..(416): unsure at all n locations
  Clone ID: PAT_TA_37628
tggagaagaccgggagaangtgtccacggagtggaccgcgggccgcggcactacgacccgaaggagcgactgttggggaacgtagcatgcaattttaaaaaaattcctatgctcgcgcaagatttatctaggagatgcatatcaactataggaggagagtgtgtctacgtaccctcgtagaccgaaagcggaagcgtttgacaatgcgtttgacttagtcgaacttcttctcgttccgaccgatcaagcaccgaacgtacgactccttcgagttctgcacatgttcagctcgatgacgtccctcaaactcttgatccagcagagtgtcgaggaagtagatgagtttcgtcagcacgacggcgtggcgacggtgatggtgcaatgatccccgcaaggcttcgcctaagcactacgag

SEQ ID NO: 37629 - DNA, 357 bp, Triticum aestivum
  Clone ID: PAT_TA_37629
ctctaaactgagtcgtatgaaatttcatttgagattatcatacatgtctattactattccgctcgggcacatctcatgagggtgttccttactctcatgctgtgtcttgtacacttttgctattctggtgcagaggtcgtgatatttgattgtttactgaagatgttttctgcgtggacatcgcgagtgaatatgtctctacggttacgtctttaggtcattagttaagccggtgttttgttgcatgtcttggttttactgatcctagctcgtctgtagactagttaagttcagtcttctgagtttcggtattagacgtgtgtctatcaaattcttttaatctgccatcaccttttt

SEQ ID NO: 37630 - DNA, 419 bp, Triticum aestivum
  unsure (1)..(419): unsure at all n locations
  Clone ID: PAT_TA_37630
tcgcgggtcgacacaatgcacaagacattatctcactacaggatggtactaactattataccttgcatttttaattcctttgccccatttccaatatagggaagatatttatgcacatccttattttcaggcctttccaaaccagttcactgacgattacctctcaaaccacctgtatggtcaggaggcgaggaaggtattcatacaacacccatggttcaatattgaagtgttcctaaagaggacgaaggatggacggtcaatcatccacatgttgtcagcgtcctgngaacgggggtcnccagacttgcctgcctgtggcccacaacgtggattctccagcggccctgtacgaaccatcttcnacagcaaacactcaagaacctcgcgaagggccaagcctcgcgaggcggacgacg

SEQ ID NO: 37631 - DNA, 404 bp, Triticum aestivum
  Clone ID: PAT_TA_37631
gaatgccaagaccggtgatacagtgtcctccgacgccaacttgggttcctccccgaagcaagaactggaccaaaccaagcaaaaactgcaaacgctgaaagatcctcaaaaaaagggccaagattcctcaaacaacctcctccaaattaagaagatgacttccgaaataaaacaactcaaggatgctgcaaatgcctccaaatccgaaaccaagaagttaaccggccaaaattaacaaaacaaaggcaacatccggaactggctaaatgagatgtcttggcagcaaagaggatggaagaagctgcaagagcagctgaagctcttgcactagctgagatcaaggccctgctctgcagtgaagcctcagctcaagatctccaggacacagatggagtgagcctttc

SEQ ID NO: 37632 - DNA, 399 bp, Triticum aestivum
  Clone ID: PAT_TA_37632
gatctaagcaccctaaaagtctttgacaactaaactgctggctatatgatgttggccatatatattgtacgtatataatgtgaagaaacgagtggtagtactataccaactaaaagatgaaatgtaagaaatactagtatgtacgtactgaagagttaaagtaacgagaagaaacataacatagttctgctgggggctcagcacaacacacccctcaaattaaattaagcacacctgaaattaaactttgcaactattccggtagacactgcattagaaccaccatgagcaacgacactgccaccttactcagagtcctcgtccacgtcctcgacttcgtccttgtccctcttcctctaggccgatacttctttgcttgaaccgcacacttggctgttg

SEQ ID NO: 37633 - DNA, 126 bp, Triticum aestivum
  unsure (1)..(126): unsure at all n locations
  Clone ID: PAT_TA_37633
taccggtcaaancattcgcgggtcgacagggaanggttattcttattcctactgataattatcttttcgagattatcctactcggaagttacatattcccgtctgtcacatagatatagaacgtgt

SEQ ID NO: 37634 - DNA, 395 bp, Triticum aestivum
  Clone ID: PAT_TA_37634
ttactgaaaagactatccaaggacattcaagccttaatatactggtgacttaaagtcaaaagccagggcgggttatcaaacctcgcatatttatataaacaggaaaacatacctgtagaattgacttatactgctggcttacatcaccacaggcagtgaaggtaacaatccaatgatttataagcgcatgatttcaatggcgcaatccaaaatataatggcgacttaacgtccaaagccagggcggtttttcaaacctcgcatattcatccaataatataaaaagggccaattctagttctgcccctaactcgaacccaccactcagttttgcccctaattttcaggtatgctcagttttgcacctccgccgttagtgtcacttatagaaatgcc

SEQ ID NO: 37635 - DNA, 410 bp, Triticum aestivum
  Clone ID: PAT_TA_37635
gaatctcatgagcttgctgtacaacagagcgctcatcagtcatcttgtagtcatagaattgctccatgacgtacaactcgctgccggcgtccgagtcaccaaacttggcctcgagcgcaacccacatgtccttgccgttgtcaaacgacatatacgaatccacaatggagtcatcaaaaacacttagaagagcacctttaaagagagtatcgatcttctcgaaagcttccagctgtgctgcattaagatcgccctcagtcttgcccttagtggcgtcatagcagcacatggtctgaaaccagtaaactgccctcgtgcgccacctcttatattggacccccttaaaggcggatggcttcaaatgcgcagcgaaaccactcggagtaaattgcctataatcaggtttttgg

SEQ ID NO: 37636 - DNA, 141 bp, Triticum aestivum
  Clone ID: PAT_TA_37636
tccctccaaatccccaacgaagaataactccggaacggcaaaaattgccggattcttgaaaacaaacgcctggaaaccagtttaaaaggcaagccttcaatcctccgttccaaaggatcgtccatggccggtcccaaggat

SEQ ID NO: 37637 - DNA, 401 bp, Triticum aestivum
  Clone ID: PAT_TA_37637
cgggacacttcattccgatccattctatatatacaactcactagtactattgaaaaaaaaaaaaaaaaaaaaaaaaaaaaaaaaaaaaaaaaaaaaaaaaaaaaaaaaagaaacactaaaagaataaaacaataaaataaacatacataaaaaatcaaaaaaacttaaaaaatatcaacaaaaaacggggccccccaaaggggtttaaccttatcttgcctgggaaggaattttaaatccccttcaataggccccctaaattacatcccccggccgccattttaaatatttttgacggggaaaaccccggttttccccaccttaactcccttgacataaaatcccctttgccaagtgggtgttaatgccaaaaggcccccaccgtttttccttgccaaaat

SEQ ID NO: 37638 - DNA, 414 bp, Triticum aestivum
  Clone ID: PAT_TA_37638
ggtcgacggcgcactataaacatatactcaaaacatgttcaatgtgtcttcgacaaatgttcaacttgtatttcagaaaaatgttcaaggtgtatatgaaaaatgttcaacctgtatgcgaaaatatggtccacatgtattgaaaaataaaaaaaaagggggaaatgtattagataaaataaaaagataaaccaatacataacacgtgaaaaagaagaaaaaaaccacatgaaagattctagaaccagttcatacaactttccccaatccgttcctagaagcgaaacgaacgcatttatgggtcaaccattaatgggagcgccggaggcaagacaagcttatgtctcgtgatcataaccgagctttcttccctatagacaggtctactcaatcagccccataccaatgttcgta

SEQ ID NO: 37639 - DNA, 281 bp, Triticum aestivum
  unsure (1)..(281): unsure at all n locations
  Clone ID: PAT_TA_37639
tatcgctacgataagtcgacagctaggaatagccatctcaatttgtgctgttgtactaaaactgagctgtgtacatttgaatgcgcacaatgaaattatatggagatagacatccctgtttgcgcaaatatgacatacgggtatctaaatagtgacagatatttgtaatggcatatgantaacatcaacatccaatgtgttaaatttgcaacaaaatgacagtatgaaagtgcccttaagtaagtagcatcacatcacatcaacactgccactagattaag

SEQ ID NO: 37640 - DNA, 402 bp, Triticum aestivum
  unsure (1)..(402): unsure at all n locations
  Clone ID: PAT_TA_37640
aattcgtactacattgagctagaggagatggtgcaggtggcgctgctgtgcacccagtatctccccggtcacaggccaaagatgtcggaggtggtcaggatgctcgaaggtgacgggctcgcagagcggtgggaggcgtcgcagcgtactgactcgcacaagttcaaggtgcctgacttcaccttcgggcgttgctactccgacctgacagacgactcgtcgttgctggtgcaagcagttgagctctctggaccgagatgataacacgacagagagttgaagaaggaaacgtcatcagttgtttccagcaggacctgtacagcaaaacctgcttaaaatggcanacaacataatgtagccaacatctaatgatgcattctgtcacgaagtgtagcacatctc

SEQ ID NO: 37641 - DNA, 236 bp, Triticum aestivum
  Clone ID: PAT_TA_37641
gggtcgacggcgggctccaaccacaaacggtccatgaagaagcaaccttgtctatcccaccatggccatcgcccatgaaggacttgcctcactagggtagaacgaagtaggcgatctccttgcccgtacaaactccttggttcaactccacaatcttgtcggaggctcccaagtgacacctaaccaatctaggagacaccactctccaaaaggtaatagatggtgtgttgttgatg

SEQ ID NO: 37642 - DNA, 423 bp, Triticum aestivum
  Clone ID: PAT_TA_37642
tcccgggtcgatgggcaaccctatagtgtgtcatttgacgtcggagggcatccagggggcccatgaggtaggggggcgcgtcctagggggtgcgccccccaccctcatgagaagggtgtgggccccctggtcttcatctttggcgaggattttttattattttttctaagatgttccgtggagtttcaggtcattctgagaatatttgttttctgcacataaaacaacaccatggcaattctgctgaaaacagtgtcagtccgggttagttccattcaaatcatacaagttagagtccaaaataagggcaaaagtgtttggaaaagtagatacgatggagacgtatcaactcccccaagcttaaacccttgcttgtcctcaagcaattcagttgacaaactgaaagaaagaaagaaaaacttt

SEQ ID NO: 37643 - DNA, 344 bp, Triticum aestivum
  Clone ID: PAT_TA_37643
gtcgataggacacactagagtgagtcgaattatattctttggctcaccttgtgtaaaatcaataaatttacgtgaaatactacgctcgaagactgatgcggtccctatatttgtgtgtcatccggcaacaagaggttgaagaaaactgatggctcaagcctcccatcaatccactggattagatgacaaagaggaataaattgttgtggagaatggacgagccaccatggcactgaataactgggcaatgatctgaaacaagtgggagaaggggagcaccgcccgtgacgtcacggcaagtacaatgtccatcacatggactagaatttttcacgagggtggat

SEQ ID NO: 37644 - DNA, 159 bp, Triticum aestivum
  Clone ID: PAT_TA_37644
atccctatactaagtcgtattatgtcggcaattttcagttttatggtaagcatcagtgctagtctgagatactccttgggttacttatatgaatgctctatgcacctcagttacatcgggtgtgtttgggtttatataaagcatcatgtgtttcactta

SEQ ID NO: 37645 - DNA, 430 bp, Triticum aestivum
  Clone ID: PAT_TA_37645
cgggtcgaccggcatccctcaaatacggttccatgccctgtagtgggtttttgcttttttgtaattgagtcgggtgactaatgagagtgcacccttttagttcagactggggattttgtcagagccagattgtcccaaaattgtgtttgggtttttcaggcgctttccatcgcacagtatttccatactatggctgccaagtcagcgaagtgtgctatgtcacggcgacttatggctttagggattcccttatccattccattgttgcaaaagaacgaaattgcgtcttcctcgcgacaatccttgaccttgttcattacaaggaggaatctgaccccgtcttcctcgcgaaattctgtttttcgtgtgttgtttgcttattttgatgaatctatggccagtaatagagtttatgaaccatagaaaagtt

SEQ ID NO: 37646 - DNA, 400 bp, Triticum aestivum
  Clone ID: PAT_TA_37646
ccggggtccctaaaatgagtcatagtagctcgggtgaagttggatctcgtccaggagggctgtggaggtcaaattgaagcctgggttagatcactgggtgctctgggagactactgacaaggtttgggtggcggggatggcctcaccggagtggatcgagctggtggctgaggcggatcggggcggccggagttgggggaggagacctcctcggggtcctcctggtggcttggcagggttctggtgaggagtagaggtggtgcgtgcttgagaacaagctcgggacccctttttagaggtgatccgaagcggtggccgtgaacggggatctccggcgatggttacggcggtgcagtgcttggtcaggagattatgggacatccgagaatttcgatcgctt

SEQ ID NO: 37647 - DNA, 449 bp, Triticum aestivum
  Clone ID: PAT_TA_37647
ggtcctagaatagcgggtcgacggcaagtctcaacatgcttagacagcggattacattgagcgaagactaatgatcaacatttaacttagtaatgcagatgtccaggtgaacctccttgaagtccccatgcacattgttgggggtcaaataataccatgcgtcttccatttccacatcggcgggaaggtcccagctcggcagagtccaagtcagcttgacgtagccagtgtcgccgcccacgtacctccgaggggtagtaacagtgagcacgcacccgtacatcggcctcgtgtcagtgtcagcgtcagcggcgtcgcccctgacgcacactacatagatgacgcagtggcctgcacgggcctcgccggtgggcacgatcaagacgaagacgctgccgtcctcctccgagactagcatggggcgctaatcctccagtgactccgggacg

SEQ ID NO: 37648 - DNA, 134 bp, Triticum aestivum
  Clone ID: PAT_TA_37648
tctcaaaagcaaatctctgttctacaagaccgattgcatcagccagtactattgcacccccttcatcacatcgtccatcgctctcacgcagcactataggagctggtatctgcgtgggcggggtggtggtctcc

SEQ ID NO: 37649 - DNA, 327 bp, Triticum aestivum
  Clone ID: PAT_TA_37649
gaccggcatggctaaacagtcttggacaaactgacttgatcatgggtcaataactgattgccacatgttcaaattattcgtgaagtcatcgctgaaccacaatcggtagtccagcagtgtccttatcatgcatcgctcgaccgtacacgaaggggtcgtgacacatgttatagcatcttcacgtccctgaatatctacagatagcaccagcttacgatagactactgtccctgacctcaggactgtctcggacccgtgtagaagcaatataggcggatggaccagcatacttacagcagatcacacaatcattcgtacatcatgaga

SEQ ID NO: 37650 - DNA, 406 bp, Triticum aestivum
  Clone ID: PAT_TA_37650
ccggaatcccaaaagtgagtcatagtaggtgttggcaagggcttgtatccccaataacccctccggaaattaagcaacaacaatcaaatgaaatcattctcggcctttcaatcatatctacagctattctggcctttttggaattcttgcaacaaccagcccagattttgcctcgaatgctgtggatttggcagctggggaacttcttgaatttgccactcctggaaatgttacacaaggacagcttgattaagctaaacatgcagcaaagtgtaaagttttgatggacttggaatcaagagctgttgcatgtgaagacattgggaggcaggttatgacttatagtgaaaggaaacccatcgagaaattcttgaacgatgtcgaagcaattaccctgaatgacatt

SEQ ID NO: 37651 - DNA, 162 bp, Triticum aestivum
  Clone ID: PAT_TA_37651
gggtcgacgacaaccccgaacactaatgaggttcctacgagtacgtgtcgaccgctgcccattaccgggagtggtctaagacgatcccactcatgagggacggtcaccattcgctcaggaccccatgttgtacccaccttctggacgtcacatctgacgtca

SEQ ID NO: 37652 - DNA, 377 bp, Triticum aestivum
  Clone ID: PAT_TA_37652
attggctcaagtttcttcaaaatttattactaaattaatataacgttgagtgacttgttttgaaatgaagggattagatgaacaatgtaaaatttaaaataaacacattgtattagtattgtttggcccctgttatcaaacaaaattaagtcatttggccccccttgatctttaattcctggtaccaccacaggtcccggtatacgatgccccgagggaccgagccaaggcgatgcatctacataggggacctcctatacggcgatgtgtgcgttgggaaagagagaagcgtgttgcgcctcgctcgccacacatgaccttgggccggcgcaggtgcgggggctcccctgttttaatcatcattactttttagtttt

SEQ ID NO: 37653 - DNA, 271 bp, Triticum aestivum
  Clone ID: PAT_TA_37653
cggtcgacggcggtcacacagccaatctacacgggtgcggactagcacatgaatgggggggaaagagacaaacacagtgcacgcgcactgtgccgttggccggaccgtgctcatgctcgctgcggcgagctccggcatcggcgagccgcagggtggagttattgacgtggagacgaggattgttgcgaggggtgactgccgctggccgtccgtgcagcgagcagaggctcaacagatgtgctggggagcgtcgcagatcatacggttcggc

SEQ ID NO: 37654 - DNA, 418 bp, Triticum aestivum
  unsure (1)..(418): unsure at all n locations
  Clone ID: PAT_TA_37654
cgggtcgagcccatgatttaagtcaatagggctcttcttgacctgnggcgccttgctttccgtagcgcttttgggctggcagaatctgctgcctggcgtgagttgcttgattgtgtcgcgttgcacgagccattggtggatggcaggtcggaccgtgtccagtggcggctggagccgtcgggcctgttctccaccaagtcgctttactcggccattgccccttcctccgcccccctccccttatcgatggtttggtccgtccgcgtaccattgaagattcgcatcttcatgtggcagtggattcacggtcgggtcncgtctggagtggaggtctgcaagcgcaatggcccgggcaccggtatctgcccgctctgtggagtccctgaggactcgaaccacatcttgttctcctgcgttt

SEQ ID NO: 37655 - DNA, 409 bp, Triticum aestivum
  Clone ID: PAT_TA_37655
ccgggtcgaccgggctcgtgaaagagtgtcgtatcacgaaacagacaacgggaaaaaggaccggatgcaatttttgaaaacatgatgatgcacagcatatgatgacatggaaaaatgcaacacacaagcacatgacatggcaatgactacgaataaacggaaggcacctcgcgcatcggatccggggcgttgcaatttttctgagttgcagaagtttgtgttagatccaaattactacagactgttctgtttttgacagattctgttttcgtgtgttgtttgcttattttgatgaatctatggctagtatcggaggttatgaaccatatagaagctggaatacactaggtttaacaccaatataaataaagaatgagttcattacagtacctttaactggtggtttgtt

SEQ ID NO: 37656 - DNA, 407 bp, Triticum aestivum
  Clone ID: PAT_TA_37656
actccttagactgagtcgtactcagaactactagtactactacttctcacatgctggccagacgccgtcgttctccttccccgctttgtcggcgacctctccgcagcagcgcgtacttggatctccaccgacctctccgtagcagcgcgtgcgtccttttctttcttgcggcggcgggcctctcttttcttgagtgctttctaacttttcctctccctctgtgcggctttggccgcctcttgctctaccgcccattcggccttggcatcttcaaattcctcccacatagttgtgaggtcgcgagcggcgatgaactcggcacatcaggatgccattgcttccctaccattttgtgtgcagtcgtgggcagcgaggaactcggcgcggcgggatgccatcgctgcctt

SEQ ID NO: 37657 - DNA, 446 bp, Triticum aestivum
  Clone ID: PAT_TA_37657
cgggtttccaaatattctatcataaaatgttgtttttgatgtaaattattttgcagtcttgcatggtgcatggattgaatcaataatcagtcgtagtttggttacttacatatgaaagttcactatgcgtatgaacaagataaaaaccctaaatttattagcatcagttgaaaattcactatgctcaagactcctattttatgtctccaactattcatttcaaaattcttatttccgatgtatattttgcagtcttgcatggtgcatgtatcgaatcaataatcggttgtagcttggttgcatatatgcaattatgcccgtgaagtagatacaaattctaaatatctcagcattagttgacaatttaacatgcttaagaatcctttattagaaattggtgtttccaatgtatattttcgaggctttctatgcatgttggttactta

SEQ ID NO: 37658 - DNA, 465 bp, Triticum aestivum
  Clone ID: PAT_TA_37658
gaataagtgaacgttcccaaaagagcaaaggttttgcgcgaagagatgcgatgagatgggacgcccaaaaatgaaaagacagcggcccaattccagagctattggcaggcaccgactgtactagctcgattttgtttgttcaaaacaagtatttgattaaaaacattaatcaaaaaaaaaaaaaaaataaaaaaaaacataaaaaaaaaaaaaacaaaaaaaaaaaaaaaacaaaaaaagaaaacaaatagaaaaaaaagataaaaaaatttaaagcaaataccaaaaaaaaaaaaaaaaaagggggccccccaaaatgttaaaccattttaccccggtaagagcatttaaaacccctcaaaagggtcccccaaatttaaatacaggggccgcttttttaaaaattcttgtggggaaaaacccggggtttccaaaattaaccccccttgaaaaaaaacccctctt

SEQ ID NO: 37659 - DNA, 448 bp, Triticum aestivum
  Clone ID: PAT_TA_37659
acgggccacaaaggacagaagttaacacttcggctgcctgaagtttggactattcggctcccaaggagaacgatataaagagtctggggatgtccggcatagacccggacacactgatgggtctgctagggcgagcggctatctcaatgacacattgtaatttaatgggtacggtaattgataggatttcatccgccataagtggattgactgaagcctttacaagtctgcatgagcggctttgaggtacccaacataatatatgtatttctgactgtaccgcacatgctacgtgtgctctgtatatatactagcccctgagactctggttgccactcggaagtggcaaacagaggatcgtaatcccaggtcataatcgtgctgctacgtatgtgcatgcggttgattgtccagccgctgaccagactgctgattttgccgaactgaa

SEQ ID NO: 37660 - DNA, 472 bp, Triticum aestivum
  unsure (1)..(472): unsure at all n locations
  Clone ID: PAT_TA_37660
ttccgggtccacgggcgctctgcaaaacttagtagaaaggccacacacacaccacacggactttcttcagatgacaagcgcgcgcagaacccacctagaaagagacgatggaatttacaatgggatggggctagctagattattcaggcgattcggaaaaattattaagtcgtgcaatgtactagtactagtacactaagcagtctagcactatgtaagctgctctctgatgtgagaaaaataagagtgtgtaagcgatcccgcgtgagctcttaaatttcctcgagagaacgttgtcgcagcagactagcagaggagtcccgcgtaatcgattgtcagttaaagaagtaactggacagagttcgcggcggggtacttacatgcggcgtatccagccaggcattccgtcgagcaggtantgagccgagtcctgcacaaggagttgggcatggtctgacgagagtatacccga

SEQ ID NO: 37661 - DNA, 201 bp, Triticum aestivum
  Clone ID: PAT_TA_37661
atggagttaaccactttgctccatcgtgtgtgtccgcgcaagaaattgacctgccccatggcctaacaagtgaccttcatccctgttagcttcttctaagttgctcctgcaaccgtgcagcgctcctagtgcccagcaccggcatagaaatgtgaattcattcagtctatataaaggaccaaataaattatgtgttgtcat

SEQ ID NO: 37662 - DNA, 445 bp, Triticum aestivum
  Clone ID: PAT_TA_37662
gggcacctatggattggctgcgaccactgtcagaggtggttccacggcaggtgtgtcggcgtgactgctgatatggcgagaggaatcgaggactacctgtgccctggttgcagctacaaagccacgactaaagcttctgactcgatatatcggtgatgatgaaagcttccgactcgtgatggtggtgactggtgatgcttgaaccatgggaaatctctcatttcccaacaattcatgctgtatgctccgctgttgcgtaagcttggtgacatgtaaagattttggctggtgatggggacatgaggtggatttgtacatctgcacgcaaacgaatatggtgctccatttttgaattacgataccgtttcaaaacatttctcatctgagcggacatactgtaagtactacgtaatctatatgttggcagtattagcacgccatctgc

SEQ ID NO: 37663 - DNA, 254 bp, Triticum aestivum
  Clone ID: PAT_TA_37663
cgagagtcaaccaatgctgtcctgattgttcccctctgcgacatatgagtgtttccatactcagcagaggaagcttgcgcttcagaagcttccgttcagtaatgtcattggttagatgtaagtaatgtgtacaggtttctttctcggcactgaatcatcatgaacctgtgtgattagtgtagatctgcactgattgtactcctcaagtgacgatgtgtttctgaaaagaacaagaaaaagacatggtcagataa

SEQ ID NO: 37664 - DNA, 357 bp, Triticum aestivum
  Clone ID: PAT_TA_37664
cgggcatcaacgaagtgcctgtctgcaattatagtagctcgtcctctaatgttgtctaagatgtatcacgaggcttgtccaaagttaattgacggctttatggaaagagaggacattgtaaagatggtcatcttcaacacatttattgagttgttacactaaactggcactatgacaaatcgacagggcgacattgatgagtccagccctacatggttgctgaatcacgaagtacaccacgttgtcaactcgatcaataggcacttgcctgaacaatcaatcaagactaaagttgaagcattcccagtatggacggaacttgtttttgtcttactagattgacttgctgatcatttt

SEQ ID NO: 37665 - DNA, 457 bp, Triticum aestivum
  Clone ID: PAT_TA_37665
ttcccggcggtcacgggttccatccaaatccacgcctttgttgttatctaacatacttgtgtctctccatcttattaaaaatctagtttgcattcattcttttactggtgaaaatcctgtcatcgttgagtttgacatgtgtgttttttccgttaaggacgcccgtacccggatggtgctccacggatgtgatagccctgacagctttacctgatccacccacccgcctccaccaacacctctctggtcgccctttccatcgatgtagacctctggcatgctcgcttgggacatcccaaccacgccaccctttgtcatattcttccgagtttttttcacgtgtaataagaccgatggtcacacttgtcatgtgtgtcatcctggaaaacatactcgtcttccttttagtgcatcctcctcgattgcatcgtatccatttgaactacttcatagtgat

SEQ ID NO: 37666 - DNA, 443 bp, Triticum aestivum
  Clone ID: PAT_TA_37666
aagactaccgatcttattaacaattgcctaagataattcctcacaccaatccatcattacccacactcgctatttataagatatagtaatatattctaaatttatgataacagcacctatttttatattttagttctatgatatcatgcgaagttatcctcttcatacccacaacgtagttttatttctcggttctagatggaagcaaacgtttggtgtatgtagagtcatatcagtggcagataggacttgagagaacattgatcttacctttagctccttgtgggttcgacactccatacttatcacttccacctttggaaatttctatgatgattccttgcacttagggattatcactatccaacatgcatcttaaagtattaatgtggagatattatatattatcttcaccctgcattcgaaggacaaatacacaatca

SEQ ID NO: 37667 - DNA, 432 bp, Triticum aestivum
  Clone ID: PAT_TA_37667
ttcgcgcggccacggggtacaatttaggtgcagcagtatgggcatgaagcttgattatgcgtccgtcgatcatccgcatgcgaatggtcaagttgagctatcaactggtcttatcatgagcggcattaaagccggagtagtgcgatccttgagcgaatccgatacgcattgggtagaggagctcgactccgtacaatgggggctgctgaccatgcctaatcacactaacggatacacaccatttttagggtgtacggctcataggcggtgcagccctgcgacataattcacgactcacctaaagtgcacatgtgagtaaagaaataagccgaacttgatcggcatgacagtttggacgccctgaacgacgatcgtgacgtgcgaaaagcccgttctgcattctatcagcaccaggctcgattgtatcaaatc

SEQ ID NO: 37668 - DNA, 430 bp, Triticum aestivum
  Clone ID: PAT_TA_37668
gggccacgggaaagagaaaagaaatgacccttcggtcctatttataaagaaagggatatgtcagacgcgagaatcaaggagccgtgagtttggaaatgaagctgcggccttaattgtcacaggcttgttaacaggataaggttctttataaccagtgacgtcacaccggtccaccgcgagcagagaagatgacatcacggcggttcaacaaaatacaagaagatgttgaagatgaagatttttgctaaggattgatatgaacctgttcaaatcaatttggggcctaatgttggggatattactacggggcgtaaaccggccaggacaggccgggttaacttcatcagtagttgagtatgataaaagcccatgagggcagatgagggctaaaggcccataatcggtttaaggcctatagctataaaccggc

SEQ ID NO: 37669 - DNA, 459 bp, Triticum aestivum
  Clone ID: PAT_TA_37669
cgggttcttaaatagttttctttagttttgtttcactcctgtaagaaactcttgtattgtaagttgtaagaaagagccattataccaattcagaatttctactagaaatgacgaatggttaaaaaaagttctagacataagaaaattagactttcttccacggaactattcacggcatatcacacattttccatttccttttactttttactatagtctattcttactagtatttttctttccttccatggattctttggtcaagaattgtcgtagttttttttattttgacctgattgagattaagtggatgcaatgaagaaagaaattgaattagactacttaactatttcaatctactaatctagtctattctatgtagattcaaagatcatataatagagagaatctaaagtgtcgtatacaaaactatatgtagttctttctaccacactttaa

SEQ ID NO: 37670 - DNA, 259 bp, Triticum aestivum
  unsure (1)..(259): unsure at all n locations
  Clone ID: PAT_TA_37670
tcactagaggtggaagaatgaaagtagggggcttggttcgccggaatcgaagtgagcagaggcggcggccatggcggcaatggggggcacagagagctccgggagctcgggctagtggtcaaggaggggaagaggagggtggtgaggctgtggtgtgctcgancgaggcaggggatggctatttatagccggggcgagagggatgggctcgggtgctgtcgtgcgcatccggccgacacccgagctcggcctcgctcgc

SEQ ID NO: 37671 - DNA, 442 bp, Triticum aestivum
  Clone ID: PAT_TA_37671
ccattcattataacctgaaggacggggcatatactcaatatcataacgttcccaagtcagacctttggataccatcctagtacccagacagaaagctgcatcagttcgcggtgaagccgccaatgggtaatatgagtaagctagtttggactgtctcgctcgccaaccgcgagggccgtagtcgagttcaccctttggtatacttatagctttaactatgggacagtcttggtcatcggagctaggttcatatagtttctgttgcttggctagctcgacaagggatagtcgatgtgagggaaccgtgggcgaattctgcgccatctctatacaagaaaaatatacgtgtgttggtacagttacaagccatgttcaaaacagcaaaaacaagtgaccatggtaaatgaatggaaattttaccacggaggcaatagtccgagcg

SEQ ID NO: 37672 - DNA, 266 bp, Triticum aestivum
  Clone ID: PAT_TA_37672
cggggagctattcatggtctcatgttaggagcatcactacaatatcataatgttccaaagtacagagtttgtcgaccatcctagatgtgcacatacatatctacaagtctacgctgtaaataccacatatttctacgatgtctcagctatcattcaaagacacgatcttgaatctcgtcggcagtcgtatagtaggtgcttttttatatgtctatcttatattataatacttacttgacttaggttgcgagccatatattatttct

SEQ ID NO: 37673 - DNA, 427 bp, Triticum aestivum
  Clone ID: PAT_TA_37673
gggtccacgggggtaaagattgatatataggactatgatattcagacaccgaaagagattctgagtgcaccggtaatgaggacattacctatgtaaataccagcaaagatattaggtgcacgtacattacttaggattattgaaggcatttgcaaaataaatatcatgatgaaagattatgcacttgaagtttacacgagctatacaagtgcaccatgcacatgtagccaaggaaatgctcctctacatgcatgcgacagaaagatggaaggaggagccacccttgcatgctacgatgctcatgtacatcacgttggggccacacatcttgtcaaccgaaggaaacatcaattccgactgaggcgtgcagaagttggactccatacgacctgcgttccataaacaaggacccaacgcggccgccaat

SEQ ID NO: 37674 - DNA, 453 bp, Triticum aestivum
  Clone ID: PAT_TA_37674
ccacgccagctacgacactcagttggaccagatgatcgttgccaccaccaacaagttcgccgtcgtctagaagctcatggatgacattgctgtactcctcccgcttgcccgggctcctcattgcctgccaccctaattggcctccatggtcggaacctcttttaagcattggtggccctgcgactgcccgccgatgccacgaagaatgtccacctggaggtcgcgctcgccacgaggtgcctcgccctgcaagaattcatcgacctacacatcaacgtgtacgagcaaatcgtgtacataggtatctacaaggacaacgaggacgctatgatgtttgccctcttcaactggttggatgccttggatgcctttgctgagaagcaccttgactttgccacaaaagccgacaatccttagccgctggtcggtggcctggcacactgagttgaggag

SEQ ID NO: 37675 - DNA, 447 bp, Triticum aestivum
  Clone ID: PAT_TA_37675
gggtccacgggtactgctggatctgtgactgatgcttcccgcactgagcgatcaccctctacacagtcaggtacaccctcatgggttctggactctggagcttcttttcatatgtcttctcattcttccattttgtcctctcttagatcacccgattctcctattcatgtcctcactgctgatggtactcccctttctgttgctagtagaggcaatcttattactccttattctgttcctgatgttgctcatgttcctcgacttaccatgaatttgttttctgctggtcaacttacggattctggttgtcgcgttatccttgacgttgactcttgttctgtccaggaccgtcatacgcacactctggttggggctggccctcgccgccgtgattctcaaggtctttgggagttggactggcttcatgttccctctgctgcaacaaca

SEQ ID NO: 37676 - DNA, 440 bp, Triticum aestivum
  Clone ID: PAT_TA_37676
aactgccgccagaatgccttctccgcctcatggccctccaattggttgaagtgctatacaacctctgtcacactctccaggagatctgcgaaggcctctgcagaatgccacagttgggtgagcttgatgcaccctttgcagccaaacacacactacaataaatatggcttacccgcgggtatttgctccacttgctggtgcatctcacagtcggcccgggccacggtctggagctcggagtgcgctagctggagcttcttgagctcttctttcgcttgcttctccttggactgaagtttatcgcgtgcttagaacatgcctttcagggtctggtcgatctccaggacccacgctaggtccttctctcaaccaccttcttggcaacttgggccttctctgccttcgcggccgcaaccttttgctgctccacctcctaccga

SEQ ID NO: 37677 - DNA, 432 bp, Triticum aestivum
  Clone ID: PAT_TA_37677
tcacttataatattttgagagtcctttagaagagcatggtaatttgatttggttataaatttcaaatactaagagaagttggatgcttgatagttgttttgagatataaaggtggtaatattagaggtgtgctagttgagtaattgtgaaattgagaaatacttgtgttgaagtttgcaagtcccgttgcatgcacgtatggtaaacgttatgtgaaaaatttgaagcatgaggtgttctttgattactttccttatgagtggtggtcgtggacgagcgctaccaatctacccccccccccaaggagaatgcgcgtagtgcttggttttgatgacttgtagatttttgcaataagtatgtgagttctctatgacaaatgttgagtccatggattatacgcactctcacccttccatcattgctagcgccttc

SEQ ID NO: 37678 - DNA, 388 bp, Triticum aestivum
  Clone ID: PAT_TA_37678
gggtccacggctggttatacatcgtaaccttgttgaaggcattgctcggatatgctcggacaatttcttcaggatgaaaacttagattccggtgttgactgctggatccagtgacgacgacgtttcaacgttgctcctttcctgaagacgttgctgttgacgaatcacgatgttcatatggtgtcgtgagacggttggtgcggatatattctttcctatagtttgccgatcactgaactgatcactttagttttatttctttcgattgctcgctcaggcataactttggtcttatatgactttgccaattgctggcatggtttttgtgtgggttggtgcttgctgtgtgcatcctaactgtgcagatgccgggtatgtgctcatcatg

SEQ ID NO: 37679 - DNA, 457 bp, Triticum aestivum
  Clone ID: PAT_TA_37679
ttcccgcgtccaccatttacaacgaaatcaaaacctacaccatagcttttttgttactttcaggtacgaattgatgtgtgcggcacggtaggcagtccaagttcatcctcctgcaccaacagacaaaagtaagcagagcaaattagtatactggttgacaagtgttgacattacaatcagggggggaatccatgaataaatcatgagcgtgacatggacatcattgataacacactaattacgatctaacagagcatgtactacgcacatagtagaaacatctacgcatatcgctagtactgctacaacagaaagaaacatgagaggaataagcgatgtataccgcggcggcggtgacgcagcagccgcgtcatcctcggcggcggcacggtcggtgtcggtcaacatggtgatgacgaaggtagatgaacagacgcgtgtggagagacgtggcgag

SEQ ID NO: 37680 - DNA, 442 bp, Triticum aestivum
  unsure (1)..(442): unsure at all n locations
  Clone ID: PAT_TA_37680
agctctgcaacttcccgttcttgcatggctgtgtcacactttctgtcagcgggcgtggttgctctgtctggactacagttttctattgcttgttttccttagcggttttctatattttcagcgtatcatccccatgtatgtagggtttgtggatgcacacacctcatttgtatttctgtcacctagaggaattgaataaaaggcttccgtttggggaaaaaacaacgtggctgctcccggaaatggttgtattgagggagatgattggtggccctgagcctcgaagtgaataaatgataagttcatggtgctaataacggggcaaagtctcatccatgctagagtaatcttgattagtaatagcaggagtctacgtggtgtttgatattgtntgagctagctctacgtgttgtagtagcattggagttgcctgtatgtgtcc

SEQ ID NO: 37681 - DNA, 450 bp, Triticum aestivum
  unsure (1)..(450): unsure at all n locations
  Clone ID: PAT_TA_37681
cgggtctcaagaaaatgagacatagagagagagattaaacacttagctactggtacaaaccctcagccctgagggtggattactccctcctcatcgtggtggccgtcgggatgatgaggatggccaccggtgatgattcccccctccggcagggtgccggaacggggtcgagattggatctcgtggatacagaggccttgcggcggtggaacttctgatctagggctaccccgaagggttttggaatatttggaattttatagggtgaagaaggggtgcgggaggtcaccgaggtgggcacaacccacatgggcacgcctgggggcccaggcgcgccctggtgggtgctgctctagcccatcctgggtgttctggtcnaaaaaaattgtcctangagttacgcggtgtttggtctccgtttgatattgatttcctgcgatgtaaaaaaca

SEQ ID NO: 37682 - DNA, 434 bp, Triticum aestivum
  Clone ID: PAT_TA_37682
gattggtagaggtttgagaagacctggtgaggctgctctgtctggttttgcttgttggcacaccctacagcacttcacatagtgtttgacatgggttttcatcttaggccaggcaaacaaacaattaattcgacgataagtgactgggaacccggagtgactgcccatagcactgtcgtggaaggctgccatgatttgttgcagaagagaagtcaacccgcccaaccaaatctggccacggaaacacaggataccttgttgtaaggaaaaccgccccttggggtctgctcggatagctagtcgagtaagtaatttctgcgctcgaggattgctcttgtagctgttcagttcatcttccaaccaggctggctgacaaacagatacaagggtcaatgtctctgtcgctggacctctcgaaagagcatctgccgctg

SEQ ID NO: 37683 - DNA, 447 bp, Triticum aestivum
  unsure (1)..(447): unsure at all n locations
  Clone ID: PAT_TA_37683
gataaaattatgtgtagaacgcactctctatttcgagcctgtaaagtgccttctccctcagccttcgaccaccggcatgtcaaatagcccgggttgtggcgttattatctgtaagatggcaattgacatataaatcaggttccagtgaacataatccgtattcagtgtttgctttttctaaagaactgaattttgcttcttcggttgtttcacacacgcacctcggcacaaattgccaggggctcgatacggcaacaaatgagttgccgacaagtccgaacagctttatagcacacttcgacgtcacgagtttggccttatatgcaccagctccgaatcatgtctttggtcaatagttgggttgcccggctcttgtgcttactatcttacgttccgctatatcggctaaggtagtaaanggagaactactgtgattgtgtcctggtt

SEQ ID NO: 37684 - DNA, 322 bp, Triticum aestivum
  Clone ID: PAT_TA_37684
gggtcgccgggatctgattcaagtgtcagtttcacggcgacattcgttaccacgtaacggtcaaaatgtggactccgccctacgcgggcccactacacagagtgatcgggcaagccactgacccgacggcaacatcggcgaagacgagttcagacggttcccggcaggggacgagggaaaatgttcagagttgagaccgaggcgagccaatgctcgatccaacgatccaatggcacatgcataacggtcacttgaatgccattagacccggactaacgccgttttcagcaggtctaccatagagctggttttgtgcaagaat

SEQ ID NO: 37685 - DNA, 404 bp, Triticum aestivum
  Clone ID: PAT_TA_37685
tgaggccggggcgtctcagccggctccaggcgatgacttggcatccgctctgccaggcacgctgccaggaattcgacctccgtctgcgatcacgcagcaagagactctaacttcgccggctgcggcgccagaatatgatttgcctctgcctccacgccctcgactgatgcagcatgaggaggatggaacgcgataagatgatctgtctctgcctccacctccaccactgccccatcatgaggctggagcgccacgttcagcgccagatgcaggaaccgtcgatgacaagtgtgcaagatgtggcgatgacaattgggtcaggaggcccggatgacaagtgggtcaagtggttgcatacggcgtggaatcgaactgaactgaactggctgtacatagatgctcgt

SEQ ID NO: 37686 - DNA, 220 bp, Triticum aestivum
  Clone ID: PAT_TA_37686
gatgaaaattaacacgtggactctcgttatgcggtacgccacaccccaccgccccgttgcgaccgtcgggctctaacagagatccgtttcgtcgaattagcggtacacaacacccctcccgatcaacatggacactgtttcgagcgtaagacgtcggtagcgaccgtactgcagcaggccatacacgtccctaatatcacgaaacaggtgtcagctgtac

SEQ ID NO: 37687 - DNA, 336 bp, Triticum aestivum
  Clone ID: PAT_TA_37687
caccgatttcacgatactcctcaacatcacccactacagcctcagtatcgacggacagtatcaccgtttgttagagagaggcgctccggagtcaactccgataccacaactggcatcatgcgatcctattaagtgcacgacgtaggcactctcgtcttcgatgcaattaactttatgactccgtcagttgatcgagtttgacaagctttacggttgccgtcacgcgctcgatgactgtcttaagacggccactgatgttatgatcgacagcagggttgctgtagtctgtagttaggctgcatttcgccatggccggttcgcttaacctagacacgc

SEQ ID NO: 37688 - DNA, 395 bp, Triticum aestivum
  Clone ID: PAT_TA_37688
ggcgaaagccgagcagtgggctctcgtcagccagtgacgtgtcttggtaatataaccacgtcagattccagtcctttgggtgactcggtggctcgacgtaagggaaaagacagtctctccgtctctgaatggagatgccgcctacttccaaacttggcccgttggcgcactcgttctgggggttcaggtagaaaatctctctgaagagcaacaggctgggctcttcgccaagataaacctcgcagaacacttggaaattgcatatgttggacaccgagttgggtcctatatcttgtggccgcacgtcaaagaagttcagcacgtctctaaagaactttgagccgggcggtgcgaagccccggctcaagtgatccgcaaaaatgaccacctccccg

SEQ ID NO: 37689 - DNA, 332 bp, Triticum aestivum
  Clone ID: PAT_TA_37689
gttcactacagtgagtctgattagatcgcttgtaatcatgcgtcatacggacgaagtgcagtacacgagggagcgccatgtgattgtccgcaatgcttcagctgaactgaaccgatggagctaccgtggagctctcaggcctgctgatgtgtgtgtataggtattgctaagagtgcatcccgtttcatgaagaagtttgttgcttcgatgaaacatgagttgtagttgtatcagctagagctgtagctgtagccctgagttatcttgtcgaactgacaatgtaacaccgtatatgcattcatgaatcaattgggcgttctgcatctgagcag

SEQ ID NO: 37690 - DNA, 470 bp, Triticum aestivum
  Clone ID: PAT_TA_37690
ggtccgagataacggggccacgggtgatagtaaaaagacccggttcatcttgaaaagataaaccggtccttaagggctacacagggaaaattgaagtattttctacaaagccccggttcatatcaatactataaaccggcccttggggactactggaattagtagcactaaaccggttataaggaagagtagttatacagaaatcagcagtgtttacctcatatcgctccttcatcatgttcaataacccggcttcataatcacagctggtgtacaaccagtttaaaaacccagagtggatatcttgggcgctgagatgggcataactttctggatccaccttccacttgcccttgtctatagcagaaaattcttctttggcgctatgttttgacagagcagtggggttgctgggggccgtatagccgacgccggtaatgacaacatcatccgttttatcatcagcagct

SEQ ID NO: 37691 - DNA, 276 bp, Triticum aestivum
  Clone ID: PAT_TA_37691
gtccctaccgaaaccatgaggcctgttgtgagaagctctggtttgtgaaaagcttatataccccaacttgccccaaatgggacattattttaacaacggcatgtggatgccttccaaggcaaccaggtcaggttccataatttccaaacgcgttttggattaactaaattataaaacccatgtataccagtgtcaggggccgagagacggtggcagggtttttgacacacactcacatctcgtgcatgagacatacccatgtacacaacgaaacac

SEQ ID NO: 37692 - DNA, 470 bp, Triticum aestivum
  Clone ID: PAT_TA_37692
ggggcgccgggattacctctataagcattgttattaaaattatttcgcgagacaaaattcacatctacggaatcactattttgctcaatcaaagtagacaaaggcacatcattaagatcaataggagaattttaattagcaaccaatttcataagagcatcaactttttcactcaaagaatttatttcttcaaccaaattaacctttttactagtaggtgctctttcggtatgctattgtgaataatttgccataatattatcaagcaatttagtagcttcacccaaagtaatttccataaaagtaccacccgcggcggaatctaaaagatttttagaaacaaaattcaatcccgcataatttttttgtataatcatccaaagatttaaaccatgtgtaggacaatttcttagcatcagtttcattctttcccaagattgtgcaacatgttcaagcctgaaattgcctaa

SEQ ID NO: 37693 - DNA, 468 bp, Triticum aestivum
  Clone ID: PAT_TA_37693
ggtcggaataccggggccacgggtagtacgcaattcaatttgcttgttagaaactgactaaaaaaacatccaatcaagtaaaaaaggatgtacaacgttatttttctaacagaaaagaaaaaagaaaaatgagagagatgtgaaacccctctgtcaaaaatttataatcgcagtatcaaattaccttttattttttagttttttgcaggaaaatttaccttttattgaattagagcataggtgaattattgtgtgagatagaaatggaagttaaggtagtaagtgactgatcaagttacctgcggtcttgcaggtactgattaatgttgcaaaccagctcctgctcatcctggtcctcgccatcttctgacatggtgatttcggatgtccccgtagatattgacgctggtgctatagctgcttgtttgtcgatctggcaaagaatgtgtctcagaagcaccttgatgc

SEQ ID NO: 37694 - DNA, 416 bp, Triticum aestivum
  Clone ID: PAT_TA_37694
cacagaaacaatccatcgccacccacccacgaccccctcaccctggctagggttcctagcccctcctcctcagccgccgctgcatgttcctcgctggcctcgcccgagcgccttccggacctcgccgggagaagtcagccagcgccattccgatctcgctgggagaagccagcaggaccccgccgccatgcctccctctcccccttctcctcttttccgctacctatctctttcctctgaacctgattggggcactgcgactggcctccactccagatccgtccgcctttgatcccgtatcctccttcccgacggggtctgtcctccgacactgcgcacgggtgctacgggattcaccactctagcgagcaggagtagcacggtggctgtggtctgctcagacccccgaccaacga

SEQ ID NO: 37695 - DNA, 303 bp, Triticum aestivum
  unsure (1)..(303): unsure at all n locations
  Clone ID: PAT_TA_37695
gatgctcttgaaagtanggcttcagcttcttggcggtcaagtacacgccgtaacacatcttttggtantgcgggtagttctgctttgaagcggacatcacctcgctcaagtaatacatcggcctctagaccggctgggctcggccttcttctgggcgttggactacgatgacggtgctgaccacccgactggttgtggcaatgtaagggagcatgggctctttctcagtcggtgccgctangacgggcggcgtggctagcatcttcttcagctcgtgaaaagcttgatcggcctggtcgttgg

SEQ ID NO: 37696 - DNA, 195 bp, Triticum aestivum
  Clone ID: PAT_TA_37696
tccggcgcgccggggtcatcatcatgcggtccgagaaggtcaaggacgagatcgtcctcgacggcatctatatctagctcgtctcccgctccgttgctctcatcaaccagaaatgcatgtcaataacaaggatatcaagaagttcgtggagcgcatccacctcagcgacaatggcgccatcagagaggactatac

SEQ ID NO: 37697 - DNA, 396 bp, Triticum aestivum
  Clone ID: PAT_TA_37697
tgggcatgcattgaccagccacttcacgagtctaaaatagctgctgggtacaggcttggcgggcaaaagtcggactatgacgtccttcatggccaacccaaccaccctatgcagcacggtcagctacttcagctgatcactcaggggtgccgaatgctctagcggaaggtactgcgaccaaaacagctcctccattgagctcccctcttcggctcagaagaactctgcggtgtcagcaacactcctcggcagatccgcaaacgcgcctgaagaactccaaactcgggtcagcatgatatatctcttactggcaaatttactctgcagaagaaaatccttaccagccgctatctgcttcgcctgctggatctcctggccggcgctctgggactcaac

SEQ ID NO: 37698 - DNA, 342 bp, Triticum aestivum
  Clone ID: PAT_TA_37698
gtctggaatcagcattgcacgagatgtcatctgaatccagagaggcgcacgatatatacctcatcaatcaggaagagatagatcatgctcgggcacatgtagacgatctcaacaatagtctgcataatgacaaggtgagctatgaggtgatgctcaatgaagtaaactacgagatagtttgcctcaagaagtccgttgagagaatggatgcagacgctaataacgtgtctgatgaatgtcagtcgccagagctaggttttgtcaactcaattatgaagtcgtaagatgagatcgtcacgatcagagtgcataggttgaactacttgggcgtggtgtatgaaa

SEQ ID NO: 37699 - DNA, 443 bp, Triticum aestivum
  unsure (1)..(443): unsure at all n locations
  Clone ID: PAT_TA_37699
ggtttaatgatgaactcttgtgttgatactcactcccatagttcatttcccaagaatcttacaatgtcatctcgacagtttgtgttgcacctttcttctcaagcattctgagtctgagttatcctgacaccaatcagatctgaatctcggtcagatatgatgattggaacatattcccaagagttataacaatggtttttatgtgacccggtaaggtgttttcatgcctagcacacttggctggaggacctattgttatagcttacttctagcaaggttatctattcttccacgaggaaatggtaagacttattctataagttcttcctgatgaatcctttgtgtatccaaagtccgacctttgcttgaagaccatgttaatgctatctcgaaacatgtcaaaggtactccgattttcaacaaganaatttaaagcccaatgc

SEQ ID NO: 37700 - DNA, 440 bp, Triticum aestivum
  Clone ID: PAT_TA_37700
cgggtgcacggcgcaagaattgaaggaacgggaaaagggaaagggcggtgacggaccaaggaactggctaaagacggaaaaaggaattaacctgcggttcaaaatgtaaagaaagagaaagagaaagatgggaaaaccgggattggatggaaaaaccaattggactgcggaaacaattggtggtggacaaggatagttttgcaaaatgattttgtgacagaatttgcactaaaaaagctaaaacgacatatatttaggtacaaagggagtattaccgaaaaaggctttcgccccgcttaatattataaagccaaccgcacattaagcatccaacaaatccaacacacaacagacacacacacggaggtccacaggagccaaaatagtacaacaaagggtcacaactgagggcacatcacaacaagccctaaacccaaaaa

SEQ ID NO: 37701 - DNA, 435 bp, Triticum aestivum
  Clone ID: PAT_TA_37701
gcggtggaactcagaggctggcgacgcgaggaagatgaagaaggcacgaaaggagaaaagaaatgacccttcggtcctatttataaggcgaaagaacatgagtcaggtgcgacaatcaaggggccataaaacggagctgtcgcctcgatttccgctgatctattaaacaaagaagcataacggatagcttcgttatgacaggtgacatcactccggtttacaacaatcagagaagatgacatcatggcggtttaccaatttataagaagatgttgaagatgaagcttttattaaaggattgacatgaacccgttcaaatcaatctagggcctaatcttggggatattactactgggcgtaaaccggcttatctgggccgggttaacttcatcagtagttaagtaagttaaagcccaagaagacagaagagggctc

SEQ ID NO: 37702 - DNA, 344 bp, Triticum aestivum
  Clone ID: PAT_TA_37702
gatctggacgaaatcatcttctattcacgcatgctgtaatgtgatacgcaaacagtgcacatagctcctcttgaaatgtatgaggagaccataccaagtgctctgggacatgaacttcgtgatagaacgactgcttcattcacaacatcatgtctgatcgggtttcactgcattcagtattctctcaatcacggcaccgatgttgaaaacctcagcatctgtcgtgtaaattgcacttcttattctaccacaacacatgcgtataatgtttctaacgcagaccgctatcctgaacttcaagtgtagtgtggctcatgaatggagattcagatttgagctgatcc

SEQ ID NO: 37703 - DNA, 196 bp, Triticum aestivum
  Clone ID: PAT_TA_37703
tcccaacccattacaaaccgtaaaggtaccaaaggctgacggggatccgatcgcattcaagggggctaatgctctcaaccctatgatcgtaatccggcttgacaccccatttctgacaatcaggcggcatcaccaagcaaggagctagcttaaacagatccggcctgaggtctttgagtaaacggtacagccccga

SEQ ID NO: 37704 - DNA, 403 bp, Triticum aestivum
  unsure (1)..(403): unsure at all n locations
  Clone ID: PAT_TA_37704
gcggacatgactgagagtggagtggagaggggagagtgagggacggccggttggagaagataagatggctttagaattagcgcgcgttaggataaagcgctactactaaatgccataatagtagcacattttactccagacgcgctactgctatacctatagcagtagcgccttcttcgaaagagcgctactactaaggctaagcatgtaaaaataaacataaaatacatttctcatcaatgatctctttgtgtagaatctgagttgtcaatatgagtcctgcccggtttaagaaccggtgtagacttatattgagtccacaaatcctacacatagagttcaatgaagaacaagtggctgtgatagtttgagaagtaacatatttaaggtggtanacaccctg

SEQ ID NO: 37705 - DNA, 443 bp, Triticum aestivum
  Clone ID: PAT_TA_37705
ggtccaggcgtgaagcagacagtcatctggaatgaagggctctccgagggaagtagttgcaaaaacctagaattagagtcagtaaaatcctataacctgaatagaagagatatcagaatcccagagtaaggacgaggaataaatgatcctaataccacccaatggcgacatgggcccataagacacacatccatgttagtaaaactgttttggatgactagactcaacttcggccaatgagttggaaatggggctacctacaggcagtcggctctaataccaacttgtgacgccctcgattcaatcgcacactaatcatacacgcaaatatgtacaatcaagatcaagaactcacgggaagatacacaacacaactctagacacaaattaaaataatacaagccacgggcctccaaggctcgaatacataagctcgaatacac

SEQ ID NO: 37706 - DNA, 441 bp, Triticum aestivum
  Clone ID: PAT_TA_37706
tacggtacgaaattccgggtgcccggggcggattcgagacggtgagccatgagcgcgattgcatgcgccggtccggtcgtggtctctcgtggtgccttgacaatgccgagtcggagaggtactgccttggctgcaccgttggaaaccatcgcctggtcttcgtcgtccacggctccaggccatgacgagcttgcacattgatatttcgtagcgtcgctccgtcagctcatggacagggatgtggtattacggagtgacgtgaacacgatgtcatgcatacatcgtggagggatatcactgcaggcacaaggggattgtctcaagagaatgtccaaagtcatctttcgtctagacaagtgcgcactcgatcgactctgcacggagattgtctcaaggtccccgccgttaatggttcagccttcttggggagtgggatgtttt

SEQ ID NO: 37707 - DNA, 391 bp, Triticum aestivum
  Clone ID: PAT_TA_37707
ggggccacggggaggcagcgacggcggcagaaccagcggatggcaagccaaagattcccctcgcacggcttggtgccggcaaggcccggcccccggcagagtctgatgccaccaaggcagtgcccgcgcagtcgagtgaggtggtgcagaagaagaagatgatgtagcacccggtttactttgtcagctccctcttgcagggggctaggtcgaggtattcgggtgtgcaaaagttgctcttcggcctccttatggcctcgaggaagctgcgtcataaattccaagccgaccagatcactgtcgtcacccgccacctgttgcaacggacgctgcataacctagatgcaaccggaacgattgtggactgggccttggagataacaagtttcgg

SEQ ID NO: 37708 - DNA, 263 bp, Triticum aestivum
  unsure (1)..(263): unsure at all n locations
  Clone ID: PAT_TA_37708
aaacgccctcaatgcctcgacaacttcacgggcgtcggaattgtaaactgacatcatacttataactattcattttaccgataaaccctacattttagttttttgctaggtgtcctatatgcacttttaattttttataggtgtggataacttcttgaaagctaaatcagcccatattgtatgtgattttccgtgaggcagactaaattggcatcttgaggattcaaaanaacaacaaagtacaacatcaggaaaaggcaaaa

SEQ ID NO: 37709 - DNA, 162 bp, Triticum aestivum
  Clone ID: PAT_TA_37709
gggttggaatctattctgtacgctggctactttggcgacgtctcttgtcttgtctggtctcgaatctcagcccgactttcgggggaatcataatccccttcatcctttcatcactgaggcaatgctctcgctatgtggattatcagacttttatgtacttac

SEQ ID NO: 37710 - DNA, 283 bp, Triticum aestivum
  Clone ID: PAT_TA_37710
gggtctgtcacgaggtagcagatttccaggttgctcggtgacatttgacagttcttcgtagtttatattgagtctgttcttcatagttagagtcgaagagaaagccatgcaccgtatgagggttagttcagctcatccgaagcaatctgagccttgcataatcatttcggtaattgctatgtcgaagttgcggttgcatcgtcgtgtcaagttgatggtcttagcgtcaagtcttttagagttacgagttctgtacacaggttgtgacgtcgccgctgcgata

SEQ ID NO: 37711 - DNA, 396 bp, Triticum aestivum
  unsure (1)..(396): unsure at all n locations
  Clone ID: PAT_TA_37711
gccatgggcttgttcttgctggcggatggggtgcactctaagttggataccccgcggtcccgtttcttttgggaaggagcgggaccaaaacagaaataccatatggttaaatggcaagccatttgccgtcctaaagcccaagggggccttgggatcatcaactccaagctgatgaacatcgcactaatgtgcaagtggatctggaaaatgtctcaaggagagactggcctttggatcgacctcctccgtgcgaaatatttcccgcagggggatttctttgacacggcttctcgagggtcacctttttggaactccattcaatcncttaaacccttctttgccaggggtgcgaagtttggggttaacaatgggcgctccacgcgtttctggcttgat

SEQ ID NO: 37712 - DNA, 438 bp, Triticum aestivum
  Clone ID: PAT_TA_37712
cgggtccaaataatgaggccacatttgatgaaccgccccctcaagatcataatgctgatgaacaagcagaaattgatactgctgtgccaggtgataaaccggcaagtccaatccgggttgatgacggaccttctaatctagtgaagactactgacactccatcaactccagaaaaggctgctggagataatgaagatgagcctatcattaccggtattggccacacctctgctggccatcctgttgtattgccaaaacatagtgccaaagaagagcgtgctgccatggagaaagacaagtggagcaccgatttatcaagctatgcccacttcagtgctcaagaactccactctggctttctaaaccgtctgcacacaacccgtgaccatgaatccagtttggtgaacctgatgaaggagcgctatgaggtaatgacat

SEQ ID NO: 37713 - DNA, 392 bp, Triticum aestivum
  unsure (1)..(392): unsure at all n locations
  Clone ID: PAT_TA_37713
ctccgccctcctttgcgcgtagaactcgcgctcgttgatgatgtcctacgggaagtgttggcgccacaacgccatggcttcctcgtccatcttgcgatgtcgagacggtgatctcgcctccggttgtcgcgacgatcctcgtcggtgctaagccacggcagaggcgcgagctcctgcgcccactcccgcgtcggcacgttggggatgttcaatgttctatgaggccaccggaggcgccacgccgccgcgtcgtacgcgcaggcagccttgttggaggtgttgaaattgccgaggctgaggcgcatcccacggaaccggatctcggcggagaagccgccggaggggcgcgtgccgcggtatcnccaagtttcccgatgacgcatcggcatggt

SEQ ID NO: 37714 - DNA, 439 bp, Triticum aestivum
  unsure (1)..(439): unsure at all n locations
  Clone ID: PAT_TA_37714
gggtccacggggagggccactagagctcagctggaaaacggctggaggaggttaaggtaccaagagagcgaccccctcccggcaccgtctctaagagaccggcgatgattgtgcttgggagggaggggaagagcggaaagatgaggcagctggctggcagtacgagatgaaggtgtcggtgccatcgtactccgacctgacgacctgccacccaccttctccatcctccctcgtttttccccatcaccactgctccaaggagatgccggacccccagcccgtcaccttccctggataggcagctggcgactatgacgtccaaggcgcacgaagagcaccgttccccaacttggcaggcangaaggtgccgctgtcttcagcaccaaccctagctccgctggaaggagcagtgctgggattcgccatgatcccgaacact

SEQ ID NO: 37715 - DNA, 176 bp, Triticum aestivum
  Clone ID: PAT_TA_37715
ggtccacgggatgatgttgaggggacatccaacaacaacaataagaagaagaaggactaaattaagtagactgtatatatctctatttttgttagctcatattaattcgttatctcaatttcccctgtcaatctcatcacagacaattagtaatacgtattcgacagagatgtttc

SEQ ID NO: 37716 - DNA, 380 bp, Triticum aestivum
  Clone ID: PAT_TA_37716
cgggtccacgtctaccagacacatgcgctacaagtaaatgggtctacctcttcgcccatgaccctacccatgggcataggagcagacccatgcgcatacccattgggtaaccctacacaatgggttacccatcgggcatgcactagtaatatttttattaggccactgtgtcctacatcttgctaactttgctaaagcacttccgaacgaatgcttacaacatcaacatcaagttcttttacacgcagagctctacctccagtgtgcttcgcttggctacgtggtactaactaagctgcctctagccgtgcacacagtgcacccatgcatgacaaaagctatattggcttatatggctttatacgcccaacgggctagcg

SEQ ID NO: 37717 - DNA, 368 bp, Triticum aestivum
  unsure (1)..(368): unsure at all n locations
  Clone ID: PAT_TA_37717
aagggcatacatcgtgccggcgcaggacagggccatgtgatgggcgcatgcaattgttgcggtatgattactttggttcagatcccggcggggccaaatgtcggttgtaccggtaccattggcttcaataccgttggcgttgaaaagcgaccacatgatctgtttgatattcggcatctcacgtggtgacatgagtacatatcttgaatagaaccaaaccaaacctatcttgttgacatgagtacatatgtaagcctatgtggttcagtagaggcagctgctcatctgataatgatcaccagctatgtgtaacctgttgacaataagacggcactgctcaaacagaccatcanctaaaggctggggct

SEQ ID NO: 37718 - DNA, 378 bp, Triticum aestivum
  Clone ID: PAT_TA_37718
gccacccaagacccaacagagccgcaccactccccacctcgacctctctctctccccgcgacccttctccgccgccgccacccacgccggtgattcctgcagcttccggcgattccggctgctgccgacgatgccaagcacactcgcatgatcgcctccgtccgctccgtcttcccttccgagcagattcgtcgctcgcgtcctctaccggttacccgcgaccgtcccctaagctagggtttcggccaccgcgtcgccggcgtggctccggcggctcagatcgagcacgccaatgtcgccgtcgtttcgcttgcgctggaacagcaaagggaaggccatggacgacgccgctccagcccttctccgacgccatcaagc

SEQ ID NO: 37719 - DNA, 409 bp, Triticum aestivum
  Clone ID: PAT_TA_37719
ggtccgaatatccgggtccacggggacatgttcgagagcatcgtgtgcccggccaacggcagcgtgaagctcccggcgacgagcgaggtgtttgcgtgcaccgtggggaagaagccgagcatggccaagtactacctggacgacacggtggacgtgatcaagatgctgcaggggctcgcgagcgcgccgtcgcagcagcggccgtggcccgtgcagctccgggtcaccttcgaggaaggaaacggggtatgagcaaaccgacgtgatgatgtcaataaccgatgaaaaaagaaggacgacgacgatgatgtcaataaccgatgaaaaaaggaggacgacgacgatgatgatgatgattcaggaagtcagttggtgtggttttaggattagctgcagttacaggataaac

SEQ ID NO: 37720 - DNA, 295 bp, Triticum aestivum
  Clone ID: PAT_TA_37720
gggtccaggcgaagcagaaatggaactggtggaactcacccttttcagcagtataagtgattatcatcagcaagatgtagatcacgcatatgtataatatgaacattaataagaatcacctcaatacgaggaactctagagaaacgtcgtagatgaagaagattaccaagcttacgttcaagatgttcactaagatgaagttacgaactagagtacgcagaccgagaatgacaatgggatgatgatgatgaagaagctgaagctgaagcagacgaatatgaataataagtttaat

SEQ ID NO: 37721 - DNA, 396 bp, Triticum aestivum
  Clone ID: PAT_TA_37721
cggagcagaagaaggagatggccactattgctgtcggctggcaggtgggccagcagacgacggtggcaacaacccaatggaggacgaggcggcgccaccctcctcgccggtgcatgcggacctccccatcggcgagtcccgtgcgcactacacggacatgccacaggaggaggaggaggccaagttccagcaggcgtaggccgaccaggcctactacctccgcctcctcgaggagccccggcgtgcggaggagctgctcaccgcccgcacatccatcatgcctgacgtggacgtgcccaagcaggagacgttgctcgagtcctaccgctccgcacgcgagattcgtcacgaccgctggtggtaccgccaacgtcaggcggagttagaagccgccta

SEQ ID NO: 37722 - DNA, 397 bp, Triticum aestivum
  Clone ID: PAT_TA_37722
tggcggaagcgtatacaatacaagtgaccaatatccgggatcgcgcaggactgactgggactcctctaggcgtcggacacgctatcaaactcttcatccaagagatcgccttcgtcaacatctggccaaatcaacaagccaggtgagtactatgaaagtactcgcaaggcagttcggacataagatataacaaatgcaaacatgaagcatatgaacaagttaaccagtgcgatcagacatagagataataaatactggatgccaagcgagggtctgaatgacgcctcgagcggaaactgcagaatagtaatactggtgccaaacgagtgtctgaaagactcctcgagcggaaaatgcggagtaataatacaggtgtcaaacgagtgtctgaaagact

SEQ ID NO: 37723 - DNA, 192 bp, Triticum aestivum
  Clone ID: PAT_TA_37723
tgacggtggtgtcgctcttgaatggtggcagcggcatggcgcagttgagcgtgcggccaacgacagcaaacagacgggaaaagatgtctaagaggtagagtgaggcgagcgaacttgtctggtagaaggaatttggagggggtgctcacctacggcgacggttggcgaaaaacagtagagatggggctgtat

SEQ ID NO: 37724 - DNA, 426 bp, Triticum aestivum
  Clone ID: PAT_TA_37724
cgggaatcacctagttgtgtatgtgtctgtcagggcctgatgtgtgcgcacgcacgtgtaggttgagcacttgagcgtgagagtgtgtgttggtggtgtggtgtactggtgtgtgcatgcatgcgtgcgtgtgtgcgtgtgagtgttgcgtgcgtgcgtggctgcgtgtatacgtgtgagtgttgcgtgtgtgcgtgggtgcatgtgtttgtgtgagtgttgcgtggatgcagttcgcgtgcatgcgtgcatgtgtgtataatcaccacaccagctcctgtgtgttaaaacagacgactcagcataccaatacaaggccaccttatccgttgtgcccgcgatcatgacttcgaaccaccgtccagatattttttgtcgtttggtttcattcttaccagcaagatgcccgtgcgttgtatgtaacat

SEQ ID NO: 37725 - DNA, 289 bp, Triticum aestivum
  Clone ID: PAT_TA_37725
cagagtgactataattaaatatttgaaatatatgatgcatgattacccaaatcaatacgaactaaatacaataagaaagcacgatagcgggagagccacccaacaagcaccgcggccacgccgccctcttccggactcccctctctccctcgccctgcggccaacatggccacgccaccttcgttcgacctcccgtctctccatgccctccagccaccgcggccaggaatgacacgtcaccctcgtccagcatcccctctctccctcgcctccaccttcctatgtcatt

SEQ ID NO: 37726 - DNA, 256 bp, Triticum aestivum
  Clone ID: PAT_TA_37726
ggtccatcacatcagataatcatcatctcatcacagacgggacacctttgcctctatcaagtggtatcagatttccaggttgctcggtgagattttacagtttttcgtaggtgacatcgattcagtccggtatacatacagtccacgaacaagccagccaaaaaattaaggttacttcaacatatccgaaccaatccgagcccttgcataatccttttacggtttttgcttggttaaatttgcggttgcaccgtcg

SEQ ID NO: 37727 - DNA, 409 bp, Triticum aestivum
  Clone ID: PAT_TA_37727
attaatgaactgagtgagtccacgagatcatattatgcattgtctggtgtagctggaacagccgtatcaacaggaatccagattgcgcttggagagtccaacgaacggttgtcaacaccatgtgggaggcgatatcgtggtcgatgtgtgactgatccatcgacgcgtgcgatcccatatgagcgaaccacaaggccctctgaaactgggcgacgtataaatcttcgtggtgggaattttatgggtacatggcgacgaatccaagttggtagatacgcagtaatgcataacgatgggccttgatcatcatctgtgggatgcgggagacaatcacagtagcattataacgttgtagtggatggggagcttgcttcatggaggtgggtgaatgcaaactggggggtgctgc

SEQ ID NO: 37728 - DNA, 118 bp, Triticum aestivum
  unsure (1)..(118): unsure at all n locations
  Clone ID: PAT_TA_37728
gtccaaaataccgggtccacggcaangaggggcaggacctcaggcaggagggcaccagctagtaagatgccccagtcgacgccggcaacagaaccagctacccagtagtccggggagc

SEQ ID NO: 37729 - DNA, 451 bp, Triticum aestivum
  Clone ID: PAT_TA_37729
gggtccacggcgttgaagaaattgatctagcatggactccaagaaataatatggtgtcagatggatgtcgtggtggtggcgtgtgccgtactcctggacgtgaatgcttgttctggcccatgctaccctactactcctactacttactcctatcagtatatactatactattatcgaggattcgatgtgctggttacgtacaacgaacacattaacatatggctacagtataaacccgcccgacgcgcgatgcatgtgaagctagtactacaaatttagagaagtgactcgaaagccattcattaatttattaagtttatcacacgcatatcattttattacatacaacacgtcatcaagccacatcgacaacgatgatacattataaatactaaaattttcaccacacattagataacacgctatgacatgaacttcaacttaaccaatc

SEQ ID NO: 37730 - DNA, 295 bp, Triticum aestivum
  Clone ID: PAT_TA_37730
agatggatgtcatttttttcagggatactagatgggtgtcgaaatcgtgtctaatatgctaatcgaacggatgctaagattgcgggtgcatgtggttccgatcgaaaatgccttgctcctttggttggacccgccgcttactatcggttccttggatggttgcctctgtcatttccatcttggtgtccatgtacgtgcatgcctcagactccttgtagtcctgaggccctttgaacggggcaagccactggggtagcgcaatcgtcacaattggccgtggcttcatagatgatga

SEQ ID NO: 37731 - DNA, 442 bp, Triticum aestivum
  unsure (1)..(442): unsure at all n locations
  Clone ID: PAT_TA_37731
gggtccacggcttgcagctacagaacacatatcacagttcaatgaggaagcacgatcaccttttgtaaagaagtacaagactatcattcaccctggagaggtaaaccgaatcagggagcttccacagaacagtacgatcatcgccactcatacggacagtccagatgtgcttatttgggatgttgaggcccagccaaatagacatgctgtcctangagctactgattctcgccctgatttgattttaagaggacatcaggaaaatgctgagtttgctcttgccatgtgtccagcagaaccatatgtgctctcaggagggaaggacaagtctgtggtttggtggagcatccaagatcacatatctggacttggagactcctcanaaagtgagacttccccagggggatcaggcatcaagcatagcaaaactgcaaatgaaaag

SEQ ID NO: 37732 - DNA, 428 bp, Triticum aestivum
  Clone ID: PAT_TA_37732
actgaggaatttattgaatacgagtgaagagaggggtattgggatgctgactttcccaaaagtcatcgttcattgctggtgtagtgcatccaatatccacatcttcatcttctttttcaatttcctcaacaccagcctcttcagctgtgaactgaggcatacgtgaggaaatgactggcattgaagggaatgcttccacttcaatttcttcatcaaactgttctgaggtagtaacagaatgattttcttcatcagatccgcttgggatcttgtagtcttcttcataaggaacaatttccttaaacgacatggacgaaatgggaacgacatcaatacgattttcaatcgagctggtcattggcttcattttcttcgcgaccgaagaatttgccgcagctgatgccttccttttcttcacagcagcacct

SEQ ID NO: 37733 - DNA, 390 bp, Triticum aestivum
  Clone ID: PAT_TA_37733
ggggcactacttgtatctatcgtcccgttcatgcctagctatgggcgtatcacgacatcgctaattgagaggcaccccaatttcatttgtaatttcatgtcattattttctgtctagtaatcacttttgcaactaccctatgtttacacgtgtctttacatcttacttactgtttgtgccatgtcaacactacacgataacctatcatcatagtctgatttaattctgcagacatacagatactttgcactcacacaattacttctgttaaatcccacacatgtgaggttgccttgattctttttacttccaatccatagactcattttccacaacttcccacattgttaggatttgtacagatccataaatttacctcagttacagatt

SEQ ID NO: 37734 - DNA, 439 bp, Triticum aestivum
  unsure (1)..(439): unsure at all n locations
  Clone ID: PAT_TA_37734
gggtccacggccagtcgaggaaccgcagggtccttcggaatctaagcatgatgattcaaatggggcggtcagaccagaagctgcagataatgaaggggcgatcaagccagaagctacggtggatgaaggagatgggactggtctgattgtanggatgtgcacagatgtacagaaaggctacttccgtctcacggggcctccagatgcaacaaagataagaccaaagcctgtacttgtagaagccctgaagtttgtccaggtctcaagtaaagactataattttaaaacagatcaactgaaatcaattcgtcaagatatgactatccagaacatagaggatgaactttctgtgcangtttatgagtatcatgcaagacttgcgttgtgcaatcgagatatggctgaacttaacttgtgcctcacgaaactgcactgcctc

SEQ ID NO: 37735 - DNA, 424 bp, Triticum aestivum
  unsure (1)..(424): unsure at all n locations
  Clone ID: PAT_TA_37735
atagacgatgatttatcatccatttgcaaggatatcttagtgggtgtcaacttacttaattcaagtctacggtacaaggaaagaggcataacactaacaccggctcctaaagcacataaagcagttttaacataattcctttttatggagcatggtatggtgggtactccgggatcaccaagtttcttaggtattccatccttaaaggtatagttagcgagcatggtggagatttcagcttcatgtattttccttttattagtgatgatatctttcatatatttagcataagggtttgttttaagcatatcagttaagcgcatgcgtaagaaaatacgtctaatcatttcagcaaaacgctcaaagtcctcatcatcctttgtcatggatggtttacgangaaaaagcatgggtttctcaaccc

SEQ ID NO: 37736 - DNA, 401 bp, Triticum aestivum
  Clone ID: PAT_TA_37736
ctgattgcaataattccctagaaaagtcagaatgtgataaaatgttgaaacattttgcatattaatctatgataaatttactacactgggaattttctttaataatttttgcagctaagtaagtatggatgttgctgcaatctttacatactgtcgtgtttatgcagaatgctgttaggtttgcattgtttgcatatgtttgcttcgtaagtgattctagttgaggatatgactattaatcaagcatatgcatttaatatgcaatgttgactaataattttactgatttgctatactagagtatgataatgttttggcaatggtttatactaacttatctcacgagtccttgttgacttttgtgtgcatgaaccttttgagatttagggagaccttgatat

SEQ ID NO: 37737 - DNA, 270 bp, Triticum aestivum
  Clone ID: PAT_TA_37737
cggggataaactagtgctaagacaagaaactaaaagattctattgcagcatctaaagatataccttcaggcacacacctccccggaactggggcccgaaacttcttgatgtctactacacaaccttcttcctgtgcacgttgttgggcctccaagtgtagaagtttgtccgacagtatcaccattcgcgcaactggcagacccaaggtttgtaaatccgtcgcaggtgaatcatgaagacgggctctctcaaacaagcatgcaaccaaat

SEQ ID NO: 37738 - DNA, 174 bp, Triticum aestivum
  Clone ID: PAT_TA_37738
ggcgaaataaaatccatgataagtcacttaacggtaatgatggaacagcatctatatatttgatcaatacactgtgggaagatgtcaagactaagcttggagatgctgcttcctctggtaacgatatgatagattctacaatgaagcatgctttgcgttcgaatgattatagct

SEQ ID NO: 37739 - DNA, 213 bp, Triticum aestivum
  unsure (1)..(213): unsure at all n locations
  Clone ID: PAT_TA_37739
gcagcagctcatcacagttgctttctcatgctaattcgatctgggacctctcnaacctatcgatggctgcagacatcggaagtccggcagttccctcgctctgggtctctcaacagggcacgcggtcggttcgcataggtcgggataactcgtgtgcttcgatgtccttcgtaaactgaccatatcttgttcactccgtgggtatatctgcgt

SEQ ID NO: 37740 - DNA, 445 bp, Triticum aestivum
  Clone ID: PAT_TA_37740
atcacctcgacagacgacgcctgaattcacagaccatggccatcgcccataataatttgtatgtatataagagaaatctgtcataaacaaaagggatttcacctttacacagttaatacaaaagaatgacctaaaatcaaatgcctctagattaaacaaaaatcgagaacagaattgttcacccatcagcatgaaaggaatggtgtgctttatacagaaaggaatgatgtgctttataaaagtgagcacactacatggatgcaatggtcgtgtggtgataatctgcatcgagattggtcattcatatttcatctatgatctgtaaatagtcgaaaaagaaattccacttcaagatgaaaaacacaatagcatgggtattgaattgcaagatgggccttgtttcaaaactaaatcacatcccaatggtggtaatggtttcccttta

SEQ ID NO: 37741 - DNA, 428 bp, Triticum aestivum
  Clone ID: PAT_TA_37741
tatgtggccggtcagtagggtgcaatatggtgctctatgatgagctagtgatcgtataatcgccgcagaactatttctagtgaccttaaagagcgtattgttacatactttgaccttctgtgtatttttctcatttcaaattaagccatattaatcagaaaggacgcagtatggactactactactagtactagtactgctttgatgtgtcccgtcaactcgccgaacgaggagaagcttgcttactacgcctctccctcgcccacgcacgcggtggttcgcaggacgaggagagggttttgactacagcaccctctccctctccctcaccctcgccctcgccctcgcggtggacgtgcaacagttcaatcggtgtcagattgccagaagcatattgtactgtaatatcatcattgttggaccttccg

SEQ ID NO: 37742 - DNA, 353 bp, Triticum aestivum
  Clone ID: PAT_TA_37742
tttcctcatcttcttcgcctcctctcctcttttttcttctgcatcttcctcttcttcttttttcttctcgtcctcatcctcatcttcgtccgttcgtttttcctcatcttcggctactcatctcctggttacgtcttctacgtctttccgaaaattgaagtaaacggaaatgtaaagctaaaactaaaactatggctaaaactaaaacgaaatcgaaggtaaacatagaccgaacactaaaaatacagattgtaaggaaaaaacgaaatctaaagctaaaactaaagtaaaactaaagctaaatgtaaaactaaacctaaaactaaaattaaaaggaaatcgaaactagacat

SEQ ID NO: 37743 - DNA, 358 bp, Triticum aestivum
  Clone ID: PAT_TA_37743
atatgtatgggtatgatcttcatgaaacgaatgaacaacctataaagactatagaaaaagagatatttgcatcggagagcaggttgattggaatctgaaaattgtattaccttcttccagtaatcatgcacagcagccgaaaaccatgattagaatacatggacgggggcacagtcaagcttgggtctgattcgtttgccatatagggcgccaggattgttttcctggccattcagcagttgcaatttcggatcccagagtcatgtgtggcatccatgaaggatattgcgtcgagcagttgcacttttttctccatatacgagatacgagattagacttcaaaggcagcgagcgcact

SEQ ID NO: 37744 - DNA, 415 bp, Triticum aestivum
  Clone ID: PAT_TA_37744
accatacagctccgctttgaagacgggcgaccgcattgcgagcacgatcttgtgggcaggaaaagcctctccttcaacctcgagaaccacgtcggtgccatctttctcccgcaacaactttccaagatgctccgcgatgtcggaaggcggcaccttagcaatcgacttcacatcgttgacgagggcgatctccgcgacgcactcgatggtgaggcgatcatcgcgaaggtaaggcgacccttccagctcacttcttttcatgaacttgtgaaggccgacgcatgttttatcggtggtattcagctctgttgcccccgttgtcaaggtacgcggcggcgcagacccggtgacgtccaccaggctgagctggaaggatgccctcacgctgatgtccttgttcttgctctctaagaag

SEQ ID NO: 37745 - DNA, 369 bp, Triticum aestivum
  Clone ID: PAT_TA_37745
tcacttcaccaggccgaagtagctactaggaatgggttcggttggccacagctggactatgacgtccttcatggccaagtcggacatcctatgcagctccgccagttgcttcatctggttgttcaaaagcaccgggtgttccggtgccaggaactgtgaccagaagagcttctccgttgagctcccctcctgtgctcggaagaactatgcggtgtcggcggcactcctcggaagatccgcaaaggcatttggagaactccacagtcgagtgagcaaggcatatatttgacccccaaaatagacaatgcaagagaaagggcttaccagccgcgatctcctcccgagcactccaggattaggtgcgcgcct

SEQ ID NO: 37746 - DNA, 427 bp, Triticum aestivum
  Clone ID: PAT_TA_37746
gctggagttaattttggctttcccgcgaggtgataagttttgttatgtcctaaggctaatgtttccctgcactaacaatgcagctaaatatgcggcttgattccatggcctcaggatggctaaagagatgaacctaagctgggtcaggtgttttggcgattaagatctagtggcccagcaattctcaggaacttgggattccaaggacccgctcattgtggcttatcgctgggcggttgatgatattgttgggcatttcaagggttatcaggtggaacatattggtcgcaggaaaaaaatgacgcggctgatgctttaagccggttggggtctcagcgtaagccaatgccacctaatgtctttcttgatgttctgagtaatccttcagtttaattgcctacacaagaggatcttgctatccctgacc

SEQ ID NO: 37747 - DNA, 185 bp, Triticum aestivum
  Clone ID: PAT_TA_37747
cggtcctacaatccgggtcgaccgggtgcaccattgagtatcctcaaaacaaacaatatcaattgaaaatatcctcttcttttcttctgccggttgtattcaagaaataaatccctcccttgtacttcactaataatcatgtacgtgcaatgcacgtattaaataatataaataaaattaaggac

SEQ ID NO: 37748 - DNA, 437 bp, Triticum aestivum
  Clone ID: PAT_TA_37748
caccatatccagcccccaagtagcaaatgaccaagtgattggaatcatccttagctcttgagctggaacatgagctcggcgtgaaaatttctaacaagcatcacaccattttatcaagtcctcagcatcagcatgagccgtcagccaatagaagccatgacaaaaagctttagcaaccaaggattttgaaccggcgtggtgaccacagtctccttcgtggatcttatgcagaatctcacagacttcttcaggagaaacacagcgctggaacacacccgagacactgcagtggtgtaactcgccattgtgaatagccatggacttggatcgccggattatctgtatggccaaaacttcatcttctggtaactcgcctcggttcatatatgccgaatatggaaccgtccaatccggaataatatccccaacagtatatg

SEQ ID NO: 37749 - DNA, 404 bp, Triticum aestivum
  Clone ID: PAT_TA_37749
atcttcagccccatcaacgaatcagtaaccgcttacttcccctcatcagcaatatagtgcctgcaaagtttcgaccaactggtccatctgttgttaggcaggattttttgctcggttgaagctagcagtttaccacttcaaatttagagtcttgaatctcaaggcatgtgagaactgagtttggttctccatttagtacagttgaaaatgtttgttttggctgtgtggcaatgccgtagcgtgtttgataattaggtgcaacttttaagatgactgaatgccttgcctgattgtttttttacctctgttgttatcattgctctaaattttaggtctgctcacgctgcatatcttataagttttgtattgtctgtagtatttctcaatcaagatgttcgaaggaa

SEQ ID NO: 37750 - DNA, 368 bp, Triticum aestivum
  Clone ID: PAT_TA_37750
tatactacatgcatatatggctggtggaaagctctatgattacaatttttgcatcaagccaattttccctactgcaaaggaataaatttttatttaactatcatggtagttgttaaacattgagaagatagacatcctctcaatcctaattaaacatcatcattaaatcccaacaaaattaattagagtaacatgatgagattcacatgctaatccaattatccaagtactagatactcaagacgtccataactggggacacggctaaccatgattagtttatacactctgcagaggtttgcgcacttttacccataagactcgatctcctccattgtattttctcgcactacatgatgtttgagaaa

SEQ ID NO: 37751 - DNA, 431 bp, Triticum aestivum
  Clone ID: PAT_TA_37751
cgggtcgaccggtcctaggtctgacagtctcatgaagctcaggaaggttctacatggccgaagggatgtcctgcaagatgcatctggcagatcaaaaactacttgtatccctggaggtgttgttcgagcagaaagataaagcgtgacggcagctggggcgtacgaactagcttaggcacaatgactgaaatacaagtttttctagaatcatacatgtgagtgacagagaaggaacaccatcttagcttttagattttaacaaattgtggaacctaatgatgaattgccaaacatgattttgaattttaacaaattctttacttccgaattaaatgaacctaataatgatgtgctagacaaagtacatgtcagtctaactatgggtatgaatgaaatattcttcacgccatatatacttgaagaactaaaaa

SEQ ID NO: 37752 - DNA, 404 bp, Triticum aestivum
  Clone ID: PAT_TA_37752
tgggccgcgacccagtacctgccgccagtgccggattccacccattggcggatgcacttcgacagctcaaagatgcgcaccagtttgggagccggcattgtcctcgcctctctcaaaggcgacaagctcaagcacacgccgcaaattcactttgccgcctccaacaacgtggccgagtacgaagcgctcatacacggactctggctggccaaggagattggcatccgccggattctatgctatggcgactcggacttggtgctccatcagtcgtcaggcgactaggtcgccaaggatgcaaacatggcgagctaccgcttcctcgtctagcagatcagtggacacttcaacgggtgcgagttcctccatgtgccatgggccgacaacgagcaagctgatgccct

SEQ ID NO: 37753 - DNA, 428 bp, Triticum aestivum
  Clone ID: PAT_TA_37753
cggtccgacgatccgggtcgaccggggtgcgagcaatgtgacagtcagtcatgccagcgcggtcaatgaggtcggagaggtactgacgttgtgagagaaacatgccagcagaggagcgcgtgacattaatgcctaagaagtgatgaagagctccaagatcggtcatggagaattctgaccgaagagaggttataagagagttaggaaggcagtggaggagcaggttaggatgatgtcatcgacatataagaggaggtaagcggtggcgttgtcagagtgataagtaaacatggaagagtcagactttgaagagaggaagccaagggtctgaatgtatgtggcaaaccttgttggaaatatgccctagaggcaataataaatggttattattagatttctttgttcatggtaattgtcgagtagtcatg

SEQ ID NO: 37754 - DNA, 323 bp, Triticum aestivum
  Clone ID: PAT_TA_37754
ttttatgtacatcgctagacaacttacgcaggacttcatagttttgtaggatttttaaagttccagagctagtcgaaagttacaaattgctacaaagtgttctttatttgacagattcagatctttcgtgtgttgattgctgagtttcacgaatctatgagcactaccagggggtatcaaccatagacaccttcatctatatcatgttcaacaccatcatcgataaatcatgcattcagtacagtaccttatgtggtggattatcattcctgcactaatggagcttacgatatttcccgtctacttctgtgatctcaaatttt

SEQ ID NO: 37755 - DNA, 361 bp, Triticum aestivum
  Clone ID: PAT_TA_37755
tggcagaggaagacaatcgaaaggggacataatgatcagatgcagttcgactctagatataacgtacaaggtctaacaggtgggagtcaaaaatgaagataccaacaacttggttatcgagctgctcaggcgcctcaattctcgggacggttactaaatatacagatctgttgagatatgtgggatattgtgtgaattaatgacacgtgacatcattgtgggttactacaaatcgagaagatgatgccatggcgggttatgagtgctcacacaaataaagaagggaagatattttctaaatgttgaagattgacatgaaccagttcaaatcaacatgggtcctaatgttggagatataact

SEQ ID NO: 37756 - DNA, 352 bp, Triticum aestivum
  Clone ID: PAT_TA_37756
cgggtcgacgggaactgttagtcacagcaaagatagcaatttgctgtttccattggctgataaaatgtattggtttcgatttcatggtgtatgtaatccttcatacttcagtttgtcgcggaggcaacgtaacgatttccactagaaagattttgtgcagaatgtttcgctggtgtaatgtcacttgagatgccaaaaaaaaaaaaaaaaaaaaaacaaaaaaacaaataaaaaaaaaaaaaaagaagaaaaaaaaaaaataaacaaaaaataaacacaatacaaaaaatcccccttaaaacaacctgaaataaaaataaacaaagaacaaaaaagagggcccccccaaaga

SEQ ID NO: 37757 - DNA, 274 bp, Triticum aestivum
  Clone ID: PAT_TA_37757
gagttccaagagtttagtcaacatgtcaggtgacatatggatgccaatgttgactgtcagtaagatggactttgtgctcgtcaggatatatgaccgtcctccctggtctgtcaaagcagggtgtatatcctgtgatcattttggaaacgcatatattactacaaaaactaccatgaaatatactttcgttcatgctatatattggagcctgagatagtgcagagtgatggtaatgcagtgtcagtcacacagaggccgctgaacggcacctatc

SEQ ID NO: 37758 - DNA, 434 bp, Triticum aestivum
  unsure (1)..(434): unsure at all n locations
  Clone ID: PAT_TA_37758
gagactcaagtcacaactcaaataaccactaatgctatggggatcaatatgggttaggttgcggaaggctatggtggttttgcggaagttatggcggaagccctaggcaaagatgccaaagtgccaaaatttgatggagtaaaatggcgttgaaacctatctagatggatagaggatgtcaatagctactcaacgagctaaagaacgcgaaaatcagactccggatgtgaaagttacgaccaaaacggtgaaacaccgaaggctgaaatgccaggggccggacatccgggggtgggggccggatatccggggtcagtgttcagaaccatgcagatttggtgctccaggagccggattgatgaggacatgactaccttggatatgaacaaaaatattgcatataagcatatttgtcanggtgattctagtgcaaa

SEQ ID NO: 37759 - DNA, 378 bp, Triticum aestivum
  Clone ID: PAT_TA_37759
gtcagaattatcttggccaatttccgatagcgatacactgtcatcttaggaagtacaatcgcgtcacattgttggtgtaggcacacataacactggttctaagcaccttaaatgatagcactatttatgctacacacgtatgggcaatattcttgatgtggccaccgtgcccctatgtatttaccttcatgtagaatctcttgatgattcaagtcaagcttcagctgaagctcccggggggaagaagaagacagcgtccggtctaaacgatgaaacctaatctagccatcgaagctatttcgaatgccgtccaaactttcatcacgcttcatctagctcgacgtccttttacaacatcatgattgcaactccactcga

SEQ ID NO: 37760 - DNA, 417 bp, Triticum aestivum
  Clone ID: PAT_TA_37760
gaagtggattcgggcggagagcgaagaagcttctcctcgtgtggccgagaagtgagcggggggatatggtacgcgcgagctaccaaggaagatggcgcgggcgggcgagcagtgagtgagggtaaatggtgtgaggccgacgatggggaagagaggaggaagaagaagagaggaggaagaagagtggaagacggggaagaaagtgcattaaatctcaattctactagtactactaccaggatataccggacttcggagtgtaaatagttactccgatgacatgtgggtctaccacaagagggtccatatgtcaattaatggaggacagaggtgcgtaggcgtatttgcggaagcgtgctctactggcaaacatgatggcagtactaggttacgctgatttagtaacaccaacacact

SEQ ID NO: 37761 - DNA, 374 bp, Triticum aestivum
  unsure (1)..(374): unsure at all n locations
  Clone ID: PAT_TA_37761
attcgncggtcgacgggcccttccccagaccctgcgcaagcgggagctacatgcactggggctgccctttaacaatatgctatctcccagtgatattatctcagctggttctgcaagttctgcgtgcactgccggtggtcgtgggcagctgtatgtgtggggaaagttgaagaactggggcgatgagtgcatgtatccaaagccagttagagatttaagcggttggaacatccgctgcatggcttctggcgacatgcaccatattgttggtgcagaggattcttgcataagttggggtctttctgaatatggagagcttggttatggccctacacattagtcatctgtaaatcctaaaaaggttgacattcttg

SEQ ID NO: 37762 - DNA, 427 bp, Triticum aestivum
  unsure (1)..(427): unsure at all n locations
  Clone ID: PAT_TA_37762
attccgggtcgacgacgtcgtcctcatcgagcggcttgccggcggctgcaagttcgtcggtgatgcccttcatcttggtgaagaaggccacagcggagaggtcacccttgcgggtgtgctcgagctgtgagcggagctggatcaccctcgccctagactgcgacgagaagctctacaggagcgccgcccagagagtgctgacctgcatcaggacctctcgagacagagatgcgatcagaaaagtaagaacctgctgatcctgggtgacccatacggcatgctcggggttgggcgtggaggtggtctccttcttgccagcgacgtccttcttcgtgacgatcacagcggggggctcccgaagggagccgtcgatgtagcctgtcatcnctgccgccttgatgtgcggcaggacttgtgccttccacac

SEQ ID NO: 37763 - DNA, 343 bp, Triticum aestivum
  Clone ID: PAT_TA_37763
gaagcggccgtcgatcttaggccactgacgatggaggacctgaggcaggccaaaaatcaggtgagctgcttgctgccctgacttgcattttcgcatgttggcattgatagaaacggggccactgaaccgtttgtgatggtttgcaggtcgccgcgagcttcgccgcggagggcgctgtcatgaacgagctgaagcagtggaacgacctctacggcgaaggagggtcgaggaagaaggagcagctgacctactttttgtagaaccggaaggatggtggatgtgtcgtgttgggcaaatcgctgaagccttggcagagcatgagcatacatatgtgggtgggaaa

SEQ ID NO: 37764 - DNA, 397 bp, Triticum aestivum
  Clone ID: PAT_TA_37764
gcatgccaatttttgtgggaaacatgacatgctatttagggacttctatccaggcacagcacagctggtcggtagatacctatgctagagcctagagcctagagcaatgcccgtctgcttctgctgacttctctcgcctggtgctggtggtgaactgatgatcgctactggccatgcgtgatccctaacctgtgtcctgccaggtgcccgaaaaatcacgtacgtacgtgctactctcgcgtaggacctgtaccgcgcatgccgttccctcgctattgcgcaacagcagagtttttggtcgcacatgtcactgatataaaagttgcctcgctattgcgcaacagcagagtttttggtcgcacatgtcactgatataaaagttgttcgttccgttgcc

SEQ ID NO: 37765 - DNA, 423 bp, Triticum aestivum
  Clone ID: PAT_TA_37765
ggcctctaaaaaaaaaaaatatccgttctcctacccgtgagctcgtggccttcccaaagcgctcgtcactttccccaatttggccggacggcagcctccaaatctccgattcgtcgtcgcctttgcctccggccaacaccaccacttctcggcggctcgccctctccgtgtccagttaatcactgctcgtccccaactcgtagaagccacagctcgcctcccctctgccatggacgacatggcacacgcgcgacgccggcggtcgatttccctcgatgcctaggttgccgcctctatctccacttcgtccgttcttgcataggctttgtacggctttggtagtcagcccgccggagcccaaaataaggacacggacatcggtctcgcctgcgtcgtcgtcaagcgcaagctcctggtggatgc

SEQ ID NO: 37766 - DNA, 317 bp, Triticum aestivum
  Clone ID: PAT_TA_37766
ggagaactctacaagaaaagctctaccggagtacttcaaagatatatctctgatgaagaagggcggcatctcttggctcgtacttctctgctttgatacctgcgggcctgttgttgataaaattcggaacgagctttcgcaatgtcgcgcttctcctccagggcatctaatctatcctgccgatcaagctcggtctctcactccacacacatgtccaatctatgtcaattcttttgaattgctaacgatataactcggtctacatggtactgaatttttgccagcatccagagatgatgctgattgggcgtagtccg

SEQ ID NO: 37767 - DNA, 342 bp, Triticum aestivum
  Clone ID: PAT_TA_37767
gaggatgaataccaggattaacgcgaagaccaagcccaccacgaggactaaacatgacgagcgaagcgagtatgatgaatgactacgttatgacgcacgcatcagcatggacagtgcatatgacgttcttttggattaatgcttctgcctgataaattcatcacctttataggtcgcaggctgtaaaatctctgcatgttgctgcttgcttgttctgccactcgatatgctcaaatcctatttcaacttagcatactacattctattccttacaaagtgtcatcaaagttcattacattggactgcgtttaaaatcatgatttctgacaaaattctgttcta

SEQ ID NO: 37768 - DNA, 153 bp, Triticum aestivum
  Clone ID: PAT_TA_37768
cggtctagactatccgggtcgacgggatagggctcgaatagctgtaccacgagaactgcatggactgagcagtccatgacttatagcaggaccgcgtcatagccatacatacgtgtaccaagagagatctagatgtacaagtcgtcccaggtg

SEQ ID NO: 37769 - DNA, 292 bp, Triticum aestivum
  Clone ID: PAT_TA_37769
cccgaccggagaagaatacatgaggcatcctttttaacgcaacttgtgagtttggtacagattcgtgagacactgtgagttgggtcacgggatagagatacatgattttcatttctcattggacagatactatgtgagacgtgcgagcttgagatactacggtcatgagagagttatatctgagtttttttgttgattttcttctcacagagtctatctacatcgtcaaattaccgcctcatcagattaactgcccgtataatccagttaacatggtaatttctatggactc

SEQ ID NO: 37770 - DNA, 403 bp, Triticum aestivum
  Clone ID: PAT_TA_37770
aagcgtcacaatacacttcataatctttgtgttgatctggtagaatcaacactggtgatgtaaccaagcgtcttttcaactcctgaaaactggcctcacattcctcagtccaattgaatttggtgtccttcttcaacaattccgtcataggctttgcaatctttgagaaattctcaatgaacctccggtagtatcctgcgagtccaaagaaactccggatctctccaactgtcgtgggtgactcccaatttgtcacagtgttaaccttggtgggatctactgctattccttctccggatataacatgtccaaggaatccaacttcctttaaccaaaactcgcacttgctgaacttggcatataactaatgttctccgagcttttcaagttccaaacgcaaatg

SEQ ID NO: 37771 - DNA, 291 bp, Triticum aestivum
  Clone ID: PAT_TA_37771
gggacttgacgacatggatgttgcaagtctcaagaagatgaacaagaacaagcagcttgttaaaaagctagccaataagtaccatgctttcctggcatcagagggcataatcaagcaaatcccacgtctccttgggccgtgacctaacaatggaggcaactttctcactcaagatatgccacgtcaagtccttcaaaagaaggtaccaccccatcataccacatcataaacatagctagagcatgttccttgcaagggtgtagcagtaggccacatgtctaagcgagcata

SEQ ID NO: 37772 - DNA, 176 bp, Triticum aestivum
  Clone ID: PAT_TA_37772
ggtcagctatcgggtcgacgggaattaagtaagtgaagaaagcacgggcttttctgaaatttttgtaaatctcgtttttatccagtcctttcctgtcacacacagtaagtgatgtcaatactcctaaaaaatccttggtcaaacccaagaatcttaaacgtagatctcaagtgaat

SEQ ID NO: 37773 - DNA, 374 bp, Triticum aestivum
  Clone ID: PAT_TA_37773
ggttgatatggcagatatgacttctttgaaaaagacaactacggagcacgatccggtgttgaagtttaaatcggccacagacactaaggtggttgactttgttcccggcgattcatccaagcagttcaacatcagcactaacctggatcccaaataggaaagtgcgctcatcgagttcatccgtgagaaccaggacatctttgcatggatgccttctgacatgctaggtgtaccaagggaactcgttgagcacacacttaatattgatcctatgtttaaaccggtcagacaatttctccgccacttcaacgaagaaaggcacaaggctattggtgaagaggtagctcggttgttggctgcaaggtttatcgtgg

SEQ ID NO: 37774 - DNA, 377 bp, Triticum aestivum
  Clone ID: PAT_TA_37774
gggggacatggaagagcgcggcagacgtcttgtgctggacgaggagtagcggaccctgcgaggcgagggttgaggaagacagcggggggcgagcccggtatgcgcggcaggcagcgcggagggcgaagatgtcctcgagggtcgtcaagcggcttgcgatcaacgggatcagctccggtaggaagtagggcgatggcgaggtggtttcttcggggtttgtggaggatgacgacgaggacgtggtgattgtggacgcgagggcagtggccgcaggcaagcaccttgtccggcgcttccccgacttccccaacgaacccattcctcgccgccgcatcttcaccgagtgcgacgctgcgtgcggtactggaggtgaatgt

SEQ ID NO: 37775 - DNA, 429 bp, Triticum aestivum
  Clone ID: PAT_TA_37775
gctccagtgcggcgtacgaggtcgtcgatgaggcagatgcgctgcggtggacaacatgctcaaactcacataatcccagtcaaatgagaatctaaatgcatttcatagttattactttgtaggatgcaacaaaaacaaccataacgctacatcagccattatataagcaacattttgacatatcccaatgtgtgaatgaaacgtgcagagagagcttttgaagatggagcagatagggcgggaaagattgtatgtatgtgggcgagagagtacgagacaaacctaacgagacagagagagagatacagtagagaaagagagaggaagaagttaggtctgtgagacagatggatacatgtaatagacatgagatgcgtgtacatctggattctggtagacgtggaaagagaagagacgacatgtttgatg

SEQ ID NO: 37776 - DNA, 379 bp, Triticum aestivum
  Clone ID: PAT_TA_37776
aatgatgcgtagcttgaaggcgtccctcgcgacgacgaagtgtggatgtcatgtcgcgccggataagtcaatgaagaattgctcgctttccacgccgacctggttgtgttgatgccgcaagagctcgatggagtcggcctggtggagatcgcatccgtgcgcgtgcagtgtagtcgatgcacgtcgcttgcagatggttctatcgctcggtgcagtctgccggcgccgcgccgatcgttgttggcgtagtcgcgaaaactgaagaagtcgatgtagcgactcgagtcacagctgacgagggcagatctgatcgatcgcgatcgaagccgccggtgcgtctgtagacgcgtacgtgtaagctcatattgatgcatgcacg

SEQ ID NO: 37777 - DNA, 370 bp, Triticum aestivum
  Clone ID: PAT_TA_37777
attggaatgcttaagttcccctctcgacttattaatcaacccgatctctgtccaggagttgcaactagtttctgttgtttgtaggttatgttagtagtctatcacgtggcacccggtacaggtgggcttgggacagactatgcaccatggcacggtgtaccaagtgtagatccatccgtcgaggtgggcttgggaaccctgcacacatcatttagggccatgagcgacaccccggccggatctccttgcggattgatgtgaccatagaccgtgctattccatgtacactgcagattgggtgtttctgtattaaggcgccatcgacacaaccatagaagcaagagatcaaaccaacctttagaacaccatg

SEQ ID NO: 37778 - DNA, 282 bp, Triticum aestivum
  Clone ID: PAT_TA_37778
tctggcatgtttgcctccgtgcaatagctgttgccacacagcaatggcgcgtctagtgtcgtcctcggcgatggcttctagcttggccccatacatgtcttcaaggttatgattggcgtcgagacgtacatgatgtgcatcttcatggtgctgaatcaggtgcatcctgacatcggcatctcccctacggacatgtccatcatgaagtccttcatcaaccacatcttcaacaagctcgccggggagtccgctaagctgggccgcttgaatccgatccccatt

SEQ ID NO: 37779 - DNA, 403 bp, Triticum aestivum
  Clone ID: PAT_TA_37779
agaggcctagcagctggtcggcacgtgcaatggcctcctctgcctgtgcaacaactaggagaggctcggtggcgctctcaccctgttcaacccggccaccggcgaggcgctgtcacttcccccgatgccgtacgccggcctcttctctgagagctctcattggcggaactggaacgagacttacaccttcgcgcaccatccgacgtccgggtggtacaagctgttgcgcgtcccctgcattttcgaccgggtgtttgagccggaagccgtgcacgtgctcacgctgggggaggcgtcatggcggaaggtgctcaccggcatcaacggctgggcggggtgccgcctcggtccgggcatcgtcagcattgacggcacgacgtactgggtcacgcgtgatgctccg

SEQ ID NO: 37780 - DNA, 331 bp, Triticum aestivum
  Clone ID: PAT_TA_37780
tacggaccagaattcgcgcggtcgacggggatcaaggtgtcaagccggcgacgatggagatcatgactgtgctttggagatggagatcacaggcacaagttgatgatgaccatatcatgtcagatattttgattgcatgtgatgtttatcttttatgcatattattttgcttagtacggcgatagcattataagatgatccctaactaaatttcaatgtacaagtgttctccctaaggtatcaccagtactagagttcgtcgtgttgagacagcacgtgatcatcgggtgtgataagctctacgtcgacagacaatgggtgtaagctagtt

SEQ ID NO: 37781 - DNA, 440 bp, Triticum aestivum
  unsure (1)..(440): unsure at all n locations
  Clone ID: PAT_TA_37781
attcgncggtcgacgggttggacgatgagatgggcgtagcttgataagtctgtgttccacttgccttcgcctatagcagaaagttcatccttggcactatgcttggataaagcaacaggattgccaggggcagtgtggccaaagccagtaatcatgatgtcatcttccttgtcaccagcagccttcactggagttggcggtttatcaatagccttagctggacttgccggtttatcagtgtctcggactgggcttgttgttttttcggactggcctgatggagcaacttctacttgttcaacaacgaagtcataatcttgtggtggcagatcatcaagcagagcgtcagtatttgtttctactggatctggagtcttctccggtttaatgactacattatcgtccgccggtttatttaatcaggccttcttgctgggtct

SEQ ID NO: 37782 - DNA, 308 bp, Triticum aestivum
  Clone ID: PAT_TA_37782
cgggtcgaccgggagcatttggatactggatctagccgatgggagacggtatcacgggctaacttcaaccggtttggatggctgtcatgtaataggataggtgtcaagtttcctagcggttgttttgcctgccggttgtggttgtcctacatttgctttcttgctccttgtgagcattattgcctgtcgtctgaaagcttgacacttatgtaggagcattggtcttgtccataaaatcgacctatccatgagtccgatttataggacgttgcatcgtgggctattaaacttttggcatctttatatca

SEQ ID NO: 37783 - DNA, 145 bp, Triticum aestivum
  Clone ID: PAT_TA_37783
ggatacggagaaaaagacatatcgagtatgtctgagcgaggcacagagacacaatgtttgagggagaaaccaattgacagattaagatcagatcgagttgtcatccttttgctgtcattggtggggtgggggaggggagggaggc

SEQ ID NO: 37784 - DNA, 360 bp, Triticum aestivum
  unsure (1)..(360): unsure at all n locations
  Clone ID: PAT_TA_37784
ggtcgaccggtcctttcaggtaggccgtgttgggcccctttctttttcccttctgtcaagtggtcaaagccgtggatccgtgcacggtgcgaccttggaaactaaagcgaccactatgagcatcaagacgatgagtactccggcgcaatccgcgaaagggcggctgcngctgccaaaacagcagctgctgcagctcagagtccattcacgccaaaagtacgcgtaacctcttgtaaacattttccagatttagttgatttcaatcatctttagtacttgcaactaaattttaccaagtaacatttgtcaaacccatctgaaaaaaaaaaaaaaaaaaaaaaaaaaaaaagcggccgctct

SEQ ID NO: 37785 - DNA, 438 bp, Triticum aestivum
  Clone ID: PAT_TA_37785
caagaagaaacaatctctagggctagacacaaagagccggtttaccggcgactccctcgtgatcataatgagacctagcctcaaacagtatgtagggttgttacgggatgatgtttcccagggcccgaagctgtctaaatccttgtcttgtgttgcgtctctcgattccgctcaacccctctcaagctaccacatagatgtgttagcctcgcgactaagtcctgacaaaaccacgacattacttgcttatgctaaccatcatgacatcactttatatcaaatggatgtgaaaagtgcgttcctcaatggtaagcttgaggaagaagtatatgttgctcaacccccaggttttgaagatccaaagcatcctgatagagtcttcagacttaataagggcctctatggcctcaagcatgcccctcgggcgtggtatgatac

SEQ ID NO: 37786 - DNA, 402 bp, Triticum aestivum
  Clone ID: PAT_TA_37786
gagacgcacggaggtcgggccggcaccgccacccagaacgggtcacggatgttcacgtccccgaatttcttgggcgaacatgccgctgcggccggcgcaggcagccggagaaaggaagccacccactgagctgagccggagatgactatttaacgggacatcaatggacggtgagatgtgcgacttggggaagatcgacggtggtcatatcagcttgaccggtcagagtcaatgctctatttcttttccatttccgtctttttaaacagtttcccttagatttctgggatgccgttggacagccgcaatgccatggcgactgccaggagctcccgacatggaccgccaaagcgaacgcgaccgcttgccaaccagccattaattttgcattgctcgctacac

SEQ ID NO: 37787 - DNA, 419 bp, Triticum aestivum
  Clone ID: PAT_TA_37787
cgggtcgaccggtcctcacaaacgcgacgttaccggaaccaacccgaagaagcagacaccggaaagaagcacacaacatagtaaacaaccaacacatgaacatggtatgatatgcgggatgcggtatgcgatgcatatgcatgatttgcaaaggaatgattgaacctggcctcagcttggaaatccaagagtgccactggtaaggtgaggtgatttcggttgaaatcgatataaagaacactggaatcggatgcacggtttggaaaaggcaagcaaaacaaatatggcaccggtctgcgataatcagcaagtagccatctaaatgcatcaagataattatgctacaacactcaaacatgacaacaaaatacatggcagggattcactcatgatgcttgacacaagatgaacactgagct

SEQ ID NO: 37788 - DNA, 345 bp, Triticum aestivum
  Clone ID: PAT_TA_37788
gccatccggactccgcgcaacagagcggtcgggcacgatgggaagtattcgccgtaggcagcaacggcatgaaggccgcgaatggagtggctcacgtgctcctactaagatgtgtcgcgtgatgtcgaaggtacactccagcgtatgcatcacatgaagggccatatcgatcagtgcagtgatcatatcgaagtgcttatagaacatgccaaggaagtcctggatgataagtcgatggtactcgaggacgacaatgaaatgttccaaaatgtagacctcgctgtgctcaatatcctgagcggtggtatctgaagcctgcatcactttaggcacaagagagatcat

SEQ ID NO: 37789 - DNA, 421 bp, Triticum aestivum
  Clone ID: PAT_TA_37789
gtcgacggggggacacggatgcaacatatctcaaagctgttgcaaaggcaaacaatttctccatggattcaaattcaagtgattggtaaaagagcggaatctctttcaacggatgacttggaacataaaaagattaacttattattgggcgaaccattttattgtggcagtgaagggatgcttccatggcaaaacctgcgtttctggaatgcaagaactctgtttgattcaatgctatctgaggatgcactcataatgccttgcaaaggagtattaaagttatgtgccatgtctcttccggacttgtggaagagtcgtcgcagccttaaagatgtcgagggtttcgaccacttggttgttaacgagactttaagagcctgcggtgatcttcctggagagcagcaaggtccttgtctgccct

SEQ ID NO: 37790 - DNA, 400 bp, Triticum aestivum
  Clone ID: PAT_TA_37790
gagcgcagtcggcagaacatcccgacggagaaacaggccgaggatcccttccggcaggcgcagatcgtggagggcggggtccggtaccagcagacggtggtggtgcgctcctacgaggtcggccctgacagaacggccacactcgagaccatactgaatcttctccaggtacgcactactctatctatcttgtttagctaggctcatttctgacgttgagggcacataacatatgcatgcacgtacgcacgcaggagacagcattgaaccacgtgtggatgtcgggcctgcttggcgacggcttcggcgcgacgcacggcatgatcaagagcaacctcatctgggtcgtgtccaggatgcacgtccaagtcgatcactacccattatggggtgatgtgct

SEQ ID NO: 37791 - DNA, 433 bp, Triticum aestivum
  Clone ID: PAT_TA_37791
acagtgcatagagtgatggaccatgacatcaaagaatgacgatgggaaagacatctctatgttgcacaatattcttgcaatatcatcttgcatatgatccaactcttcatgatttaacctttctgccatagatggttgaagaaatcatacaggtcattgactgtgtttcttatatccttgtcaatcagattcatgatggctagcaaggggatttgtgtcaacattacgttgcagtcatgtgacttcatgtgtcacaacttcatttaagctgagctcatatcgaccggacatgtgatgtttgcgcattaggaagacggtgtcttaactgataacaatgttgtgtagacctgtgtcgcttctcttgtactgaaatttgtaatctggggagctttcatgaattttggatcaacttctgcttcagtcatgtgttttg

SEQ ID NO: 37792 - DNA, 430 bp, Triticum aestivum
  Clone ID: PAT_TA_37792
atatctcataactgaaaccatgaacaacaagtgctttggttctggtggtggcgatccattgcttgaggcgacatcgtgtgcaagattatccttgtggaggccgttggcacggtggcaccctcctcgacctgctgatcccattacccaggttgcctgttgcgcctaaaggttggatatatggtgatatggtaatgccgatttgggaaagcaggtgtacagtgtgtgtaaattaagaaaacaatttataatctgtgatgtgatcattgcattttaatttagtatatgcgactcaagtagggaagtattgagtgcacctctctggcaagtgcacgcataaggtaccattttttactcaatcgatttcaaaacaaggcatgagactgacatacactcttttattgcatcgtgtaaagatatgtggtgtgaaggg

SEQ ID NO: 37793 - DNA, 331 bp, Triticum aestivum
  Clone ID: PAT_TA_37793
aacgtgaaaggcaccgtccacaagggcatgccgcacaagttctaccacggccgcaccggccgcgtctggaacgtcaccaagcgcgccatcggcgtcgagatcaacacgcaggtcggcaacaggatcatcacgaagaggatccatgtgcgtgtggagcacgtgcagccatccacgtgcgaaccagggtttctccacaaggaactccacaattgcaaaccgaaaggggggggcaaagcgccttgcgaaggcctcagcaccaaaaagcagcccacaagggcccaacctggggtcaagggggagggcgacaccatccagacagggacccccatcg

SEQ ID NO: 37794 - DNA, 428 bp, Triticum aestivum
  Clone ID: PAT_TA_37794
gggaaaacgtaatcgtttgtgcagttcactgggagaaaaaattgctgaacttaagaatgaagcagaaggtattcaaagaacaatcgtggaaaagaacggtcagaaaagcaagttagttaaagatcgatgcgaccttgaacagaaaatagcagattcgaagagaaaacgagaacctgaggagtattgtttagagaaaaaaatactggaacttgatgacgccaagagagcttttgctgaaattaatagatatggtgctgtggataacactgaactagaggaggacataaagaaagagaagaatatcattgtggagagggaactattacttaataagattaatacaaagttagcagcagcttcacgagaagtgaacgatagaagagaagcttacaagacctttatggattctgtgaatgaggagacagggg

SEQ ID NO: 37795 - DNA, 272 bp, Triticum aestivum
  Clone ID: PAT_TA_37795
ggtgagaggcgccgtccacatcggcatgccgcacaagttctaccacggacgcaccggacgcgtctggaacgtcacgaagcgcgccatctgtttccagatcaacacgcaagtccgtaagatgattatcgcgttgaagatccatgttcgtctcgatcaccttcatccatccaggtgcatcgaagactttttccctcaagaccccactttccgtggtcgacgcgttgtgaccttcgacagtcacctggtctctatactattccgtcatcaaaagt

SEQ ID NO: 37796 - DNA, 410 bp, Triticum aestivum
  Clone ID: PAT_TA_37796
tctgccttaaagaaacataatctgctgatgtatcaagtcccgaggcaagcaatgtacttgtacatgttaaaacaatcaagaaaagaagcagaagcttgcggagcacccgaggactgtgcgtgcgcgtggactggcggagtactacaacaagtttatcatcacgtcaagagaaaaggaaggagtgcctcacgttcggatcagctaccatatccgaattctactaaatgttggtacaagtccaacacaacaaatacagatcggatagctgcctaattatgtgatggtgcatgctgccaaagcaaccccgtgtactgatcgaacacatacctctagcaacagtacttgcatggtttccacagcacagcgggagaccaaaagtactgcttggctaataagtgtatcaaagaaac

SEQ ID NO: 37797 - DNA, 354 bp, Triticum aestivum
  Clone ID: PAT_TA_37797
cggggaaacaggagaagaagtagaacgagaagaagtagaggagcgagaagaagtagaagtacaagaagtgcaagaagcagacgacgaagaagtagaagaagtggaagaagacgcagaacaaagaggaagaggaagaagacgaagaagaagaagaagaagaagaagaagacgaagacgaagaagacgaagacgcagaacgacgaagaagaagaagaagaagaacacgcagaagacgaagaagacgaagaagaagcacaagaagaacaacaatcacatgacgaaaagtccaggaacaagaagacgacgacgacgacgaagaagacgaacaagaacacgatgacgaagaggaagaag

SEQ ID NO: 37798 - DNA, 202 bp, Triticum aestivum
  Clone ID: PAT_TA_37798
gtcgacgggctcattgatcttgggctaacctattttgccattacagttccaattggattcagaaaagttatgttagccaaccatcctcactgggagtaactacagcaagccaaattggacatcaatgcaatagagcaattcagttcaatgctcaacacaagttctgaatgtcatttcaccccagagtggcagcatcacccca

SEQ ID NO: 37799 - DNA, 275 bp, Triticum aestivum
  Clone ID: PAT_TA_37799
gaggagagcgattagggtcgcagctggactaactcgccttcgtctcgcgcttgtgatgcacagaaatgtttctatgaactgttcccttgtggaagtacatttctgcgattgcatccagtttaggcctttaggtaccttatttatgcatcatgagcgtttaatttcgaggtatgacctaatttaagtgtttttatcgagtaaacaagtatcactgctggtgcttctggattatgtttccgcaaccttggtcttgcttactgagataactagatctg

SEQ ID NO: 37800 - DNA, 287 bp, Triticum aestivum
  Clone ID: PAT_TA_37800
cgggtcgaccggttattgaatttaaaatattactttctgtgcatccgtttatcaaaaaattgagagatggccagtcgtcggcttctgcccccatgccactagtgctagggtgttcggcataaacctgggcgctctttttcccatagttgggtccttcgagggagtcgctcagcacaacgaaccaggcaatctgactataatgcttgaacactctcacttagccatagaactctataattttaaatttcggcgaagcccctggtgttcggaaggccgaaattggggag

SEQ ID NO: 37801 - DNA, 408 bp, Triticum aestivum
  Clone ID: PAT_TA_37801
gtcgacggggataatgaatgctaggctgtagtagctgatgccgacctcgacaactgtagatgacactgttgcgtctcatacatacacggttaccatacgttcttcagcagagtgcgttaggccagaggtctgctgtcactctcggtctgcgtgagcgcgctcgttatagtacagttaacccatggaatcgaggatgctgctcatgatacttggtaaacatcaggtacactctgagtatcatccgaaacccagttgcataccacagtcaatttagtgagtcggctgtgttcggtcgtagagcgatcacatccatatctggagatcgctcaagtggcatccttattaactgttgtactagagtgacttgggtttatgtgttgaagaacatgaacgatgtctttgaatgct

SEQ ID NO: 37802 - DNA, 426 bp, Triticum aestivum
  Clone ID: PAT_TA_37802
acattattcatagccaaatttatcttttttgaatctctaactgtagatcgagttttgagttgatttttttaagttatagacctaccccgcaggtatgttgtacattttttcatatttttttaggattacctaaatatgaaatgtttgggttgattctacgatcttaccgtggcccagtgtcttttttagggacgtgccatcattcccctcatgatcgttgttctgcctaacaatttatttcttgtttaatttggctaccccacaacgtggttacgtaataatcatggcttacatgattccgttcaaacacatagccttttgctaataacaagtccagtaatctaacccttacacttacacgttcaacccatatccaatatggtttgatgcaacctttagaacaataaagaccgggaaattaccttt

SEQ ID NO: 37803 - DNA, 240 bp, Triticum aestivum
  Clone ID: PAT_TA_37803
ttttagcatttatagtacagtattgcataaacagtttcacctgatccctggttcgatgtgggttagtgttttccttactgatgatccaaaatgagacctttgggatacttaacggtgatgatagatttgatcttgctgaaacacagaaacttttgatccgagtgaaattaatttgcaggtgcatcagaaccgtgactacaatcgggccgactttttccatcggatgagcaaacaaatttc

SEQ ID NO: 37804 - DNA, 321 bp, Triticum aestivum
  unsure (1)..(321): unsure at all n locations
  Clone ID: PAT_TA_37804
attcngggaatcatcactcaacatcgctatgtactcctagatggggaggtgggctatatctggcagagatgcagcgtctccgatgaatgcaatacgggcatacggtggacgaaacaactgcggtggacgcggcactacaccagccgttggggctgggcggcgctgtgcattgctgcctgtctagatctgtttcagattcagaaaagttgcccaatacgtgtctccttgcggtcccacccgtcagcaggcaacactcagacgaggactcggccccactcatcatcaattaacggtcaacggacggtcaagatgacaaacgcc

SEQ ID NO: 37805 - DNA, 410 bp, Triticum aestivum
  Clone ID: PAT_TA_37805
gatggaggcgcaggctcgccatggcgtcctgccaacagggaggcagcagcacctccatggccatggccaggctcaccatcaacctcccgcgggagaagatgagtggtgggagtacttcccatgccccttctgctacattgaggtggaggtccccttcctctgtgaccacctgcaggaggagcactgcttcgacatgaggaatgctgtgtgcccgatctgcgccgacaacctcggggccaacacggccgggcatttcagggaacggcactcacaacaactcaagatgaggaagtcttcttcttccagggcaggagcagcagatgacaaggaagcgtatgaagatgatgactcctactatgaagaatcatcatacatcatgggcaggccagtacctgatgatcattcacctg

SEQ ID NO: 37806 - DNA, 182 bp, Triticum aestivum
  Clone ID: PAT_TA_37806
atcaccgataagtttacagtcaatacaatgtcctactcatgttcgatggctctcatctccgaataaaggggttcaatgggttaagatctatacgaactgacacatctattgccttcactggatgcaatatatttcatccaacgagctaaatagatgcttgatatgttcctctctgaaatgtc

SEQ ID NO: 37807 - DNA, 331 bp, Triticum aestivum
  Clone ID: PAT_TA_37807
gggtccacgggttgactttaaaacgtgggcatgttcatgtcagagcgacactgcacgtctgagcagctgtcggcgtgacctcgatcatgatatgttacagtggatgattcttgcatgaggtcgatcttcgcacatctgtgcgtctatctttggcgttcgagctctaacttgctattcttgtatgtcactcaatgctgtcctgtgtcgttgtcgtgtgcatagtgtcggataggaggtcatggagagtattggaattccactggcatgtttgtgtcttggattgcagtgtcccagttgggttatgttgatggatccgaacggttcctaagtc

SEQ ID NO: 37808 - DNA, 294 bp, Triticum aestivum
  Clone ID: PAT_TA_37808
catgccatatggtaattgttgcgtaataggaatacttgtgttgaagattgtgtttcccgtagcatgcacgtatggtgaaccgttatcaacttccttctcaacttcaaggaaataaagagtgtcttacttatcaagttgtccacccaagaaaagggcatgtcttccgaacaggctaaccccttaagggcatgcccagtagtactttgcttcaagggctaataaacttttgcaatgaatatgtgaattctttaacactaatgttgactccacggattaaacgcactctcgtgctcc

SEQ ID NO: 37809 - DNA, 254 bp, Triticum aestivum
  Clone ID: PAT_TA_37809
actgctgagttcaacgaactgagatttgccaaacgttccttcgtgtgatctggccgattggccttaactgatggtctggccggttgaagggtttgcgttttgtggttgggttaaaaacctgtggtaagtttgaacctggttcgcaccctgggcaataagcatgttatacgggtttccgaaaatgcttgttgaatttgcggttgcaaagcgggcgctctaaagggtttcaaattaaataactcgggctcgcacgt

SEQ ID NO: 37810 - DNA, 425 bp, Triticum aestivum
  Clone ID: PAT_TA_37810
agactcttgaaaaacactttgagtcctcttcatttaacattggcagctctggtgcgacacctgaagttactgattcctcggttgctccaagcacgaaagttgaagagttgagctccagccagcaggacgtattccttcttccattaagatcacatgataactcagcaaagttagagtatgggacatactcatccatgctaggaaagcttcgtgatcaggtcctggcgaggccgttgaggccgttctcgaagaacctcacagagcgcgactggctgaggagctcggccaagatgtgggacatggtgaggagatctcccgtcgcctcggactactgcaaggcgctccagagttcaggattgttcaggaagtagccacatgtgcgttgtaatgtcctcgattcaaccgacctgagacacaatttgaat

SEQ ID NO: 37811 - DNA, 360 bp, Triticum aestivum
  Clone ID: PAT_TA_37811
cgggtcgaccatttggttcaatttgatgaggaacctattccaaaatttgcgcgctgactctccgggctgttcagtttacgagtaacatcagctgcatccggagggcggacataagtcccgtgaaaatctgctctaaacgcgtcctcgagctcatcgcagcttcccatagtgttttctgggatgcttttaagccaatgcacgctggccctttgagcttgaggggtacgtatcttatggcgtcgacatcagctcctctggccatgtgtaaatgtactatataatcttctatccagactccaaagtccgttgttccagcataggtctctatgctcatggagttaaatcctgcagggaattcat

SEQ ID NO: 37812 - DNA, 378 bp, Triticum aestivum
  Clone ID: PAT_TA_37812
gagtcggacaagctcgcgaggtacaacaagaagcccaccatcacgtccagggagatccagacctccgtccgcctcgtcctccccggcgagctcgccaagcacgccgtctccgagggcaccaaggccgtcaccaagttcacctcctcctagactgatgaactgatgatgcgtccgtcgcctctagttggtctctgtatctgcatctctgttaactctgcttatccctctgcaagtagtgctggtagtctgtgctgggtgattgccaacgcttcgttggctcgttcctcgttgcttgggaggaccgaagcttctgcttttgacaagctgatatctatctagaactgaagttgtggtggtaaaaaaaaaaaggataagatg

SEQ ID NO: 37813 - DNA, 420 bp, Triticum aestivum
  Clone ID: PAT_TA_37813
ctcatagggttcagtggcatcaacatgtggaaggccaccttgacgtaatcggtcaagcattgacaggtcatctgcagcagtaacatcttcttgttccagctcttcttgttcctcctctagggtgatgtgggattcactatcactgtctacttcaatgttttggggtgaagtatagcggttcttgaaatgctttttgaaaagacgtgtctcttggaagaactctccttcatatgtgtctgggttaatgtgaggttcataatcctcttcctttgggggagatagtctagcacgtggcgacacttcataaacgacgtcccaacctttcagatttggattagtttggcaggcccacggtagatagaatacttgggtcgcctgttgaaccgtaatatagacatccggaacatctaaatgggtgct

SEQ ID NO: 37814 - DNA, 358 bp, Triticum aestivum
  Clone ID: PAT_TA_37814
gcgctagacttaccgcaggtttagggaggggagagagctctagtttcgtcgctgctcctgaattgatcgttcttttttctctctctctacccgcgccaccttgctgcatcggagggattgctaacagagaaattagtagccagcaagaacgcggatcatgaacgcgaatcatgcgcccggtcggtagatttctttgatccgtcttgtttgttcaccttgctgtatagaaagatgagagatcagtgatcggaaccgatgcattctgagttagagagtatctgttcatctgcacggggtgcaaatatcagtttctgtaccaccatggagattactatctgaaatggagtctgcttttctc

SEQ ID NO: 37815 - DNA, 305 bp, Triticum aestivum
  Clone ID: PAT_TA_37815
tccgggtcgacgggtcaattcaaatcaactcagcggaagatcgggaccctcgcctctatcaagtggtatcagaattccaggttggcccgtgagattttaaagtttttccgaggttagattgaatccggtccgcaaaactaatgtccaagttagagccaagaaatagaatatgggtaggtcaacacatctgaagtaatccaagccatgcacaatccagtacgtacacgctttgcagaaggtgctgttgcaacgacgggttcacttgatggccttaccatcaattgcgcaacctgaatggctaatgg

SEQ ID NO: 37816 - DNA, 119 bp, Triticum aestivum
  Clone ID: PAT_TA_37816
cggtggaatcacactcaacctggatttggttgctggatatcgggggttgatacaataccaacaaagttttgaagctttgaaccccagggcatttgccgtcttgatcgatcccatccaaa

SEQ ID NO: 37817 - DNA, 393 bp, Triticum aestivum
  unsure (1)..(393): unsure at all n locations
  Clone ID: PAT_TA_37817
tcctcctcaccggcgtgctggagcacacgctcgtcctattcttcgtacgctacatgcatagacacggctccaccagctgctcgcgtgcttggcagcgctgcggcatggcgaggtcggactgcagatgacgtgagcgggcgagccttcagcttcaaggcacanggatggcggcgacacggcggtgatgggcgagaaattgttggccggagcaggctggtgccgacatgcgcaacggtggcggcggcatgttgatgagtgcgtgtatgggagcttactttagttttatataaggttggtcaaccctttttttcctagtacacgtaaacattagacttaggcaacccttttttttgaagttagtaccacaaccacgatacggaaatcctgtgcaag

SEQ ID NO: 37818 - DNA, 360 bp, Triticum aestivum
  unsure (1)..(360): unsure at all n locations
  Clone ID: PAT_TA_37818
gggtcgagtcgagaggaggagtggataggccaaagtggtcggggggtgcgtggcgtctccagccagcctacaactttggtggaaccatgaggtggcttgggcgcttgctggcgcccggcgtccgtcttgcgggagctggacgacgactggtagcgccaggtggtgggttgggccgtgctgggctaggccaggtgagcgccaggtgataaacacctctctctctctcctgtttcctttctgttttctgttttctgttttcttttgtttgttttatttgatttgaagcatcaaatcatttanaatatttttgtaaatttttatgtgagctcaggaaaccaaanaatgatggaacccttgacc

SEQ ID NO: 37819 - DNA, 414 bp, Triticum aestivum
  Clone ID: PAT_TA_37819
tccatcgtctcaaggttcgacatgatccaagccgaggcgacacctagccactccctcggagccctggctgtgccaggctgccagcggccagttggaaaaggaggaaggcgccgcaccatccctgcatgcgacgtcttggggctggagccggcaaccgcgcgctgcgacccttggctttctatcgagttggtgggctccgtgatggagatgggggccgatggaggcgccgcgtgagggctcagcagccgcgagctttacgatgctccgttgtactgtagcagcgatgtactagtgctatccagtggaatccagctttacgatgctgctgcagcactgtggggacgtacgacggtacgagcaatatctatttgctaggaataactgtgctatccagtggatgttaaccttttgcgc

SEQ ID NO: 37820 - DNA, 435 bp, Triticum aestivum
  Clone ID: PAT_TA_37820
ttcgccggtcgacggggaagacggacggcatggagggcggcgacaagaagggcaagatgaatgccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacatgaagccaaccatcacgtcccgggagatccagacctccgtccgcctcgtcctccccggcgagctcgccaaacacgccgtctccgaaggcatcaaggctgtcaccaagttcacctcctcttaagctgttcgtcttcctgtgtctcgtagttagctgttcgggtgtgtatgttggcgtgttaacctgtaagaatcccaacgcgaatgtt

SEQ ID NO: 37821 - DNA, 419 bp, Triticum aestivum
  unsure (1)..(419): unsure at all n locations
  Clone ID: PAT_TA_37821
gtcgacggggcagctccatggaggtggaggacggggcggctgatctggcgggacgacgagatcgacgacggatcctcatccggtgcggtggatgagggacggcgagctattgcggtggacgacgtcgtcggggaagagtctccggctgggcggcagtcgggaggccaacggaggagcgtggggtttcgcgggttttggcggcctcggtttatgaatggggaggcgaaggggaaggtaggggaccatggctcagggacgtgcgtgtccgaaatgtanggtaagttaccagagtacccccaccggttttgacaccgtgatgtcgaaccggcatttccggctgaggggtaaaagggggatttcgcatgtctgggccgccggaccgatttcggatgacgagggagttttcgcgcgcgtccaaa

SEQ ID NO: 37822 - DNA, 284 bp, Triticum aestivum
  Clone ID: PAT_TA_37822
tcgacaggcacatgatagggacttactagagtatactatgtgcttcacttaaatccttggggctagagatgttttgctcgaatgattcacgtatggctatacgatcatggaggtggtctgattatgaagtaattattgatcgcccaagctacacgtagatgactttgaaaatcttattgaacatcctagcaatctatatccttaggggcatggttataagaagattgccacacaggctaagtatcttttgcaatatcttagtaagttaattgagagcaatgttc

SEQ ID NO: 37823 - DNA, 400 bp, Triticum aestivum
  Clone ID: PAT_TA_37823
tctgcaacattcagatccatatgtacttcgcaaatttctatgtcatcttgtagatgcaactactacgctacatttggagctattccaaacaactgttctactatatgaatccagtttactattcagaataatctagattagtgtcaaagtttgcatcggcgtaaccctttacgatgaactcttttacacctccataatcgagaaaattccttagtccactagttactaaggataactttgaccgctgtcttgtgatccattcttggatcactcttgtaccccttgactgactaatggcaaggcacacttcaggtgcggtacacagcataccatactgtaaagagcccatgataaaagcataggggacgaccttcgtccttcgtctttcttctgccgtggt

SEQ ID NO: 37824 - DNA, 466 bp, Triticum aestivum
  unsure (1)..(466): unsure at all n locations
  Clone ID: PAT_TA_37824
ggtccaaactatccgggtcgaccggcaattaagtttcaacattaaccccaacaaaattaattaaagtaacatgatgagattcacatgataatccaagtactagatactcaagttgtccataaccggggacacggctaaccatgattagtttatacactttgtagtggtttgcgcacttttccccacaagactcgatctcctccgttgggattctcgcattacaggatgtttgagaaacggatgaccgagacatagtctttcagaagtgtttgcaccttacgatcgggtagacagtaccacctacaacccctacatctgctagtctaccactgtaagagttcacacaacttaatcaactatgctagagcccataatagcttgtggctgcacacggaagtttctagcgtgaataatctcatgatccgtttgagcctgngtggcggtacataaaanaaacaggcaatcg

SEQ ID NO: 37825 - DNA, 330 bp, Triticum aestivum
  Clone ID: PAT_TA_37825
gtcgacgggaggattatgcgcattttgtctatgaaagtaactgcagtcctaacgaagatatgggtgagatcttcaacgactcagatgatgactaggatggtgtctctactaccgttctgcggctcgcatctcatgcatcacggtggtcgagcttggaatcattcatctggtatacgtggcatctcaattctggacacatcgtgacttgcatcgtctagggggtcacggctgatgcgacctctcactgcatccgccatttgaaacagcgcaccggcctatggcgccacccgctgcactcccacttgtaactgcctcctccccgcattcaaa

SEQ ID NO: 37826 - DNA, 170 bp, Triticum aestivum
  Clone ID: PAT_TA_37826
ctggtggatgcgtgcctgctggttgaagtcatcaagcattccgcctgtattgaaagtgtccatcgggcccatgcccgtgtaaaggtgcactggggcaagatggatgcccataagctcgtgacagacccaccaccatatggcaatgagcatcgcactcccgagatgtatta

SEQ ID NO: 37827 - DNA, 374 bp, Triticum aestivum
  Clone ID: PAT_TA_37827
cggtcaacattccgggtcgagggggttgttatgagcccaacgttagtgttaaaaatcactcaaccccaacggggaaaccaaccgcaacgcaaccttcaaaacaatgaagggggaacaatccccaatggcccaacaaaatccggcctttaattaaccaacgtccaagttaaaacaatcaaactcaaagttcaacctgcaagctcctaagttaataaccaaacaatgttttggttcaaatgccttggcctaattcaaacctttgattccacgattaaaaaatggagttaatccttggtaatttttaatggaaaaacgctcggatgggtgaagccttttcttaagggcatgaaaaatgttccttaaacctttggtcc

SEQ ID NO: 37828 - DNA, 391 bp, Triticum aestivum
  Clone ID: PAT_TA_37828
attcgccggccgacggggggcataacgcacgaaggctccagaattaagcatccttgtctatcccagcatggtcgtcacccatggagggcttgcctcactcgggtagatgttcaccaagtatgcaagtctccggtgcacgttacagcacttcttcggttcaactctacatattgtcggaggctcccaagctacaccgaacaaatctagaagacaccactctccaaaaagtaatacattgtgtgttgatgatgaactcctcgatcttgtgcttcaaatgataatctccccaccaatcaactcagtttcacagatttggctatggtggaagaaagatttgtgtggaaagcaacttggggaatgctacaaatcaatgttcaaatggtaagaatgg

SEQ ID NO: 37829 - DNA, 392 bp, Triticum aestivum
  Clone ID: PAT_TA_37829
acactggctgacacagtagcacgcactcttgcagaggagaacggacgggatgtacctgttgtcaagccactgactgttttgggcccgatgagtcaacaaaggctcaatgctaacatgggtatgtttcgtcacctaccatatcggctgcactgacgactacaccgacttcatcattgagccaatccacgtcgaacacgtcacagttaacccatatcacactgttcaagatttcgtcgttgtccaggaggcaactctgattcgcacacatctctaacttgcaacgatgtcacatctaaagtcacctagctctattctgatgacaacgtctcaaaattctcctctgacaagtaacctttgctcttaagagcatcagcagttcttcaaatacttaa

SEQ ID NO: 37830 - DNA, 133 bp, Triticum aestivum
  Clone ID: PAT_TA_37830
gtctgttaataacagggtgcaagagtgctataaaatgtgagctcctgttagtcagcagattagtatcatatgtcatttgtgtcacatttgatgcgtccatgatccacaactggggcgctagacgtgtatgggt

SEQ ID NO: 37831 - DNA, 381 bp, Triticum aestivum
  Clone ID: PAT_TA_37831
tttgtcacttcggtggaaggtgaggcgggcttgttttcttcttcagcccttacatgcgtcttcagccatctctatctccgagacgccggcttcgacttctcctctgtcctcactcccgtggactctgactctgagggcgatgctgctgccgccgtgaagagctccatggacgccatgatgagcaggttcctggtcgtcagtcctccgatcgggaccgaggggacgggcgacgcgcctggcgatggggctccgctggcgggtgatggcggcacccaggtctgaagaggtggcttcgtaacgatgcaccttcatgtttgtcctgtatcatgtagcatgcctcacagaggcatttaaaattgtttgcttggaacaatatgtttt

SEQ ID NO: 37832 - DNA, 379 bp, Triticum aestivum
  Clone ID: PAT_TA_37832
cagcggacgctcgcttggcaaagctactggttccagcaccctatgtggtgccagaaaagaaggccaagaagaaggcctcggggactcagaagagtgcccagcgcctaggggtgtcggattcatcatccggtgactccaagacgtactcctcccgtgaagacgaggaggaggaagaagagacctctccccctccagcggggggagagaggaaaaggaaggccgccccacctagggaggccgaagggtccaagaaggggaaaacccttcctccggacggctccaccaacgccgacgacggcgaagaggattggccgcacatggccaagcccctagcgagatcgtaagtgtctggataccagaatgattcatagtattcttc

SEQ ID NO: 37833 - DNA, 448 bp, Triticum aestivum
  unsure (1)..(448): unsure at all n locations
  Clone ID: PAT_TA_37833
gggtcgacgggcaagccagacttgatgaacaggctgtgaacgatgactcagaggacaacaattacatgccgctctccgaggatgaggtgagcctcggcgatgaagaatttatcgtgcctgaggatcccgtanagcaggagcgttttaagcgccggcttatagccacgacaaagagcctgaagaagaagcagcagcagcttcaagctaatcaagacctgctcactgatagatggattgaagtcctgtcagccgaagaatgccgacttgaacgcccaaccaaaagttacccgaagtgcaaattgctacctcaattcgatgacgaagcgctggagccagcactacaagtgcataatgcggctcaccgaccaccacgtggccgagataaaatgacaattctgcccgaacaccaaccggcactgcgtcaccgaacaaattgaaatacaacaac

SEQ ID NO: 37834 - DNA, 374 bp, Triticum aestivum
  unsure (1)..(374): unsure at all n locations
  Clone ID: PAT_TA_37834
ggcgccaaaacgcgcagcacgcgcgcctcgcatgcggtggacgtcctcgctccactcccgctttgtccacgccgtggagcttctcggcggccacgagagggcgacgccaaagtcagttcttgaactcatggatgtgaaggatctcaccctagctcatgtgaaatctcacttgcagatgtacaggactgtgaagaataccgaaaggccggcagcttcgtcaggttgatggcttcgagaacgggtcggctggcgagatctgcgacgacaacttgcttgacctgcgaggcggcggtaagcccgaggcagtggcaccggccacacggaatggaacgttanctgcaaacgacgatgacaggagcatcggcgccggtgcc

SEQ ID NO: 37835 - DNA, 441 bp, Triticum aestivum
  unsure (1)..(441): unsure at all n locations
  Clone ID: PAT_TA_37835
gggtcgacggggagccccggcatccgaacacggggggacagaagaaatttcctccccaggtgaaaacggtcaatatgatatacgccacccacattcccaaacgggaacgaaagcgagcactatgggacgtctatgcgatggagccagtcgccccaaagttcaacccatggtcggcctgtccgatcacttttgattgtagggatcacccgaccagcatccgtcatggcggttcagccgcattggtcctagacccaatcattgacggatttcacctcacgcgagtccttatggacagcagcagcagcctgaacctgctttatcaagacacagtgtgcaaaatgggcatcgacccttcaaggatcaagcccaccanaaccaccttcaaaggtgtaattccaggagtanaggccattgcacgggctccataacactggaagtggt

SEQ ID NO: 37836 - DNA, 390 bp, Triticum aestivum
  Clone ID: PAT_TA_37836
atcaaggcaacatactactccctgaagacatttgtctgtcgtcttcaggcgaggttgaagacctggagaagcttatcgaccacgtgttcccgagtctagatgacaacatgtccaattcaaattacatgacatctcgagcaatcctttccactacaaaggaacaatgttgacaagataaacatccgcatgatagagcgttttcatggtgatgaagtaatctaccatagctttgacaatgcggaggacgacccgtatggctactacgctcaggagtttctgaatggattgaatcctaacggtcttcctccacatgcactcaagctaaagttgaactgccctgtcatactgctaaggaacattgatccagctaatggattgtgtaacagcact

SEQ ID NO: 37837 - DNA, 396 bp, Triticum aestivum
  Clone ID: PAT_TA_37837
tagaaaaattgatcggtcgaagactccatgatatccgctccagcttcatcaacatagtcatcatcgccatcgtcggggtccgagtcggtgtcgtcgatgatgatgtagttctccgggcaagtggaaccgtcatctcctcctctgggcgcggggtctcccatgaacactcctagcttccttgtcaggtcgtcattcttctccactaatacgacgctttcctcctcataatctttgcgtgcaaccttgagttcttcctccagttccgtgatccttgtcatcgccttcttcaaatctgtcatgcctgcgcacatctggttctcctggcgtcgaatgtgctagtttaactcctggatgaaagctgcaatcgatctatccttcctggtgctgatcatctcc

SEQ ID NO: 37838 - DNA, 390 bp, Triticum aestivum
  Clone ID: PAT_TA_37838
catgacaacatgatctccatcatcttgatctatatcaatgtttcgtcacatggtcgtctcgccaactattgctcttgcaactattgctatcgcatagcgataaactaaagcaattatttggcgcttgcatcttatgcaataaagagacaaccataaggcttctaccagttgctgataacttcaacaaaacatgatcatctcatacaacaacttatatctcatcacgtattgaccatatcacatcacaacaagccctgcaaaaacaagttagacgtcctctactttgttgttgcaagttttacgtggctgctacgggttgagcaagaaccgttcttacctatgcatcaaaaccataacgatatttcgtcaagttagtgatgttttaaccct

SEQ ID NO: 37839 - DNA, 378 bp, Triticum aestivum
  unsure (1)..(378): unsure at all n locations
  Clone ID: PAT_TA_37839
tcgatgaatgatttgagatatggaggcagtgatattaaagttatgctagttgagtagttgtgaatttgagaaatacttgtgttgaagtttgcaaatcccgtagcatgcaggtatggtaaacgttgtgtaacaaatttgaaacatgaggtgttctctgattgtcctccttatgagtggcggtcggggacgagcgatggtcttttcctaccaatctacccccctaggagcatgcgcgtagttcttggtttttgatgacttgtagatttttgcaataagtatgtgagttctttatgacaaatgctgagtccatggattatacgcactctcacccttccatcattgctagcctcttcggtactgtgcattgcnctttctcac

SEQ ID NO: 37840 - DNA, 431 bp, Triticum aestivum
  Clone ID: PAT_TA_37840
ggtcgacggactcagcgggaaggaaagcaacaagctgctgggggtcaggatgacacagattggttcaacgtcggctgcttcgttgtgccagtgccacacttatgctggtacatgcacgtacgaccatggcgtctgcgcgacttcatcatcttcacccgaactggcccatcctcgccatttccagcgggataagcgagttgtatgaatatcgagaggtgagctggctctactcattgatatgaaattagttgggcataacttcctttttgcaacaggaaatgaaaatgttcccatgagattgattgatcgtgccccgcttttggatgctgccgttgcttttgaaccaatgtcatctatgtcatcggtcatgtaacctctaaggcagctgataatatatatgatgtgactgtcttttcatctaaagatgacct

SEQ ID NO: 37841 - DNA, 377 bp, Triticum aestivum
  Clone ID: PAT_TA_37841
accttgtttggaccgaggaggacacatgcatactagcttggaggaaatgacaaacctgtttgtgtaattaaaattacatgaaccattttttaaacctacgcaagctttttaaaattatgtggacatttttcttaatacgtgaacattattttacaatacatgaatattttaattatttaaacatattgtaatctataattttcatcgaaattacaaaacacaaatctgtactgggtcgcagtgatcccagacgggagctcctatttggcaccatgtgtgttgggaaaccagccaacgcaccccatcgcttcccgtgcgcaattttgggctggcccatgtgtatggtaggaacaccagtttcattcatttcatttttt

SEQ ID NO: 37842 - DNA, 386 bp, Triticum aestivum
  Clone ID: PAT_TA_37842
cgggtcgacaatcaaccaagattgccaaaggtgggcagccgcactcaaggcggttgacaagttgaacccaagtggcactaatgatagagatagggtaagtgccatttctttcatgattcttccacgctcatcatgcttcttcttggtgtttctagtgctaacttgttttcttgtttgtagctcaatattgcacaaaacttgttccaaggagatgagaagaagaccaagaaagggagaccatttaccttgcctcattgctatgcagaattgaaggatgatgagaaatggaagcctcgtgatgctatcgatgctgatgatgatgagagatttggatgatgatgaggatgaggcatcaagtgatgacggcaagagacgccctacacaaa

SEQ ID NO: 37843 - DNA, 203 bp, Triticum aestivum
  Clone ID: PAT_TA_37843
tgcattatcatgtgaatcatgttggcacaatgggaaactgacatctgtagttcaaccattgcttcagttgctcggcaagacaacaatcatccaattccctgctaatttccttcagcattaatgcagtttcagctatcaagtcatccagccaagaagaaggcatagcaatcgatcttgcagaatcactccaacactgcttcctg

SEQ ID NO: 37844 - DNA, 290 bp, Triticum aestivum
  Clone ID: PAT_TA_37844
cgtacgaacatgcgaaagctatggtccaatagccacaatacgccagggaaaagttggtaaaataaaaaagttaataaccaaccaaaacgaaccaaaataaaattaaaattaaaattccgccggatccttttcggcaattcaagggtaacaagggaaacggcaaattcgggggccccccaaaaaaaaggccgcttggggatcaaaaacttctcaaatagcagctagctaaattgagtccttcatgtttcacaaacaaaggaaaattcaatttcgagacatgtgcttaaaca

SEQ ID NO: 37845 - DNA, 393 bp, Triticum aestivum
  Clone ID: PAT_TA_37845
ttgtcctaagcttgggggtgctatgattaatgaagataatcttgttagtacccgtacttttaatgaacaaatttgttatgatgacatcatgcctcctatttatgatgatcacaatgatgaaagtgggtttcgaagagtataaaatctaggtattaatgatcccactaatttggagggtgttgaatcttattacaataatgacaaaagtggatttggagaggtcttgactttatacagtgatgaatccactactttggaagaggtttcaattgattatgacaacaaagttgctatctatgatgattatggtaatgatatgtatgctataaagagtaataataaccatgaaacttgtcaccatgattttaatgttcaatttggttatgtcaatca

SEQ ID NO: 37846 - DNA, 384 bp, Triticum aestivum
  Clone ID: PAT_TA_37846
cactacagggtctggggcagcacgaaggactccctggtcgaactcgcctcggccatcatcgacccctactacgaaaagatgaagcaggatgcccagagaacaagtcccctatcctggcacagggcctggatgtggcaactggatgaacccacctcaggttcgaggccaagtgcgtgtacacatgctacgaggtgcacaggcagatcgttgacatgaggaagtgcctcgtaaccaaaatcgatgagcccagatcaagccacaagcagagcaagcgtcacaagaagtagatgatgatcagatgatcgtttatgctagttaatcatgcatgtaatatatagtttactttattggtgtgttgaaatgtcatgtgtgtagtatccacct

SEQ ID NO: 37847 - DNA, 351 bp, Triticum aestivum
  unsure (1)..(351): unsure at all n locations
  Clone ID: PAT_TA_37847
tctaacaagctttgaggtaagaattttaatatttataaaatagtaccgcatagacagtagcccctgatgcttggttcggtgtttggaaagaaaagccggactgaggatctaaaaagatatacgcaggagtcttaaanaaatatttcaatatgggattgcaagcttccctgctgaacttcaacggccctaactgcgaaggcaattgctttgaaccaaaccctcaagcggtccgaaaacaacccctccgttgcaaaaaacaacttcaaggacaaggaaggtaattaaaaccttattaaatttgtaccttacaaaaaaggatttggttgcaaaaggaatgacaaggataacttg

SEQ ID NO: 37848 - DNA, 363 bp, Triticum aestivum
  Clone ID: PAT_TA_37848
gatatggaacagtgatccagatgcctcccaaaatgtagccgtgtgcgatgcagcacacactaaattctttcgcacatgtggtatcggtgattaagcgtttctaatgacgtagtgaaaccatacggtttgttgttacgaaccgtttaggaaatagtatgtaaggcacacgggccaacatatgaactgtgtgcgatttgtgcccgatcgcacacaagttttctatgtaacccgcctgccatgctagactccatcgcacacgttttccaacaattaccgtccgcgataatgttctatcaaaaatggttcaggagccccttcgcacacatacaagtgttgcagaccgaaaaaaaacacagaagaacc

SEQ ID NO: 37849 - DNA, 274 bp, Triticum aestivum
  unsure (1)..(274): unsure at all n locations
  Clone ID: PAT_TA_37849
ngtcangaagnaatggggcggtggtgtcatgggctccaagtcgcaagccaagacaaaggcaaggaaaaggtcaacccaaaggaggttccccaaaggatgaactaagccaacccttaaatttcaaaacatatccaatgtattttccctttcagtgtgtcctaattttgacaaggaactcaaacccttttaccacaactgtggaacctaattgtggttttctgattctctgttccgttcgcaagactatatcaaagataagatgaggtttacccgg

SEQ ID NO: 37850 - DNA, 386 bp, Triticum aestivum
  Clone ID: PAT_TA_37850
gggggggggcgccacctccccttggcctgcctcctcctttcccgtatggtctaataaggcccattacttctctcagtgaattcccgtaactccccggtagtccgaaaaatacccaaatcactcggaacctttccaatgtccgaatatagccttccaatatatcaatctttatgtctcgaccatttcaggactcctcgtcatgtccgtgatctcatctgggactccgaacaaacttcggtcatcaaaaacataactcataatacaaatcatcattgaacgttaagcgtgcggaccctacgggtttgagaactatgcaaacatgatcgagacacatctccgatcaataaccaatagcggaacctagatgctcatattggctcctacat

SEQ ID NO: 37851 - DNA, 300 bp, Triticum aestivum
  Clone ID: PAT_TA_37851
gatcagtaattcctctcctgcttctccacaaatcgcctcggactctcgcgagagcaaccaacctactcgcgccggatccacaccggcgcttcgaggcccaatgggcgagaatctcttcgaggagatcttcaacatgcatgaggatcgaacccagaagggaagagattcaacacagtgactcgcattgacgccacaagtggatacttgcttatgtacacgtacatacaaagtccaaccgctgtcaaactatcgcatatgggtaactcattcaccatcgttttacatcctacacagagtcag

SEQ ID NO: 37852 - DNA, 382 bp, Triticum aestivum
  Clone ID: PAT_TA_37852
tatgacggtcctactttcagatgttcagtgcagaaggtttactcttatatattacagtttgaccagtagaaaagagacattgttatctctatgggttggggtggcactctatccattccactgattagcaagttgagcgtcagacatatggtttggcttttacggatggtggatgatgtcagacaagccattatcttggggccgaataaggtatttaagttcaacgagagcgacgttgagaagatatacggaatcccggcagctggaacagatgtgatggacaaaacccatgaataatggttatatacgcgtacaaagaaccgattaatggtatatgaatccagaaactcattatattacctatcatgtttgcaagcacctg

SEQ ID NO: 37853 - DNA, 363 bp, Triticum aestivum
  Clone ID: PAT_TA_37853
acgtattaggcaatttggctaggaagtggtggagtaagtaacatacttgtatacgtagtatgcatcgaaggtggatacggtgtccgcggtggtggtggtaaccgatgagcatggcatccatatagaacattagagcccttatccaccggtgttcctcggaagggagaagcctcaccccctggaattctacctggccatgtcttgcctctcgtatttgtattctctgcgagctgtgaacagaatcttaactgaagtttacaggcagttttctagttgcttgtttcaatttccgcatgtgtaatggtcgatggaatgtacgggaattgtttgctaaaaaaaaaaatttaaaaaaatagaataata

SEQ ID NO: 37854 - DNA, 376 bp, Triticum aestivum
  Clone ID: PAT_TA_37854
ccgatgaaaattgggtggatcttggcaggaccgcgaggcaagagatcgagggaaagcaaggaagtacctaagctacacatgacgctaggaccgaacacgggatgaccacctctgactccattgggaccgggagaatgcacatactccctctgtttacaaatataaaatgttttgaatatttcaatatagactatacatggatgaaaatgagtgatcaaagacaccaaaacatgtctatatacatttaattcagaaaaaatctagaagatcttatatttgtgaatggagggagtactatcggtgtccctccttaagttagaggtgcacgtgaatccctttcctcctcaagatttttgttcacctcgtgatcctcatg

SEQ ID NO: 37855 - DNA, 377 bp, Triticum aestivum
  Clone ID: PAT_TA_37855
gatctaaacttgtatccattcctcaatacgcgagggcgtgcaactttcagtttgcttctgtggcgtgtgaaggcttgtgccaccgcagcaattaaccaaggaaaggaaggaaattggatcccgagaatgctgtagactgatctatgggttaattagagattccaaacggagctgctgatgtttgaaggattgatttgattcatcatgcctgcaccggaggagatcaagatccacgcacaaaacatcgatgctgcagcaagagagataattggcattttggaggatacaagcataggaaatgtgatcttcgtccgtggttggcgtggatttggggcatcagcggcactcaaggcagtagcacaacgcctgaaatcatc

SEQ ID NO: 37856 - DNA, 401 bp, Triticum aestivum
  Clone ID: PAT_TA_37856
cgggtctataaatcttcacctctaaagccagctgtttggaagttctgataaatatgtctaaggcagaatctttgagggcaatttaggaatacattggctattgctttaagtagaccctgtgaaagtaaactaatgtttgaatatgatgccagaagacactatttgtaagtactaagcatgttctaatttgcactatttgtaagtactaagcatgttctaatttgcactatttgtaagtaccaagcatgttctaatttgcactatttgtaagtactaagcatgttctaatttgcactatttgtaagtaatatggtgtatgagttaccttttgtctatcagatatgatagcgtagtagccatgcttccctgactcaccaccaagagcatacttcagttgtgtt

SEQ ID NO: 37857 - DNA, 387 bp, Triticum aestivum
  unsure (1)..(387): unsure at all n locations
  Clone ID: PAT_TA_37857
cgggtcgaccggtactgctatacgttagctgtagcgccggtccccacgctactgagaggcccaaaacccgcgctgctgctaggcttttccctagtagtgcctgctagagccagcgctgtcggccatgcaaaaccaggagaagggcgcgcgacaaagtagtttttagtgcacggcgcgtagcgcgtgttggagatgctcttagggttagggacttagagtcagtatgtccagtggcaaagcttcggcagtagaagcgatgttgtgtcgaataaatcttctcccaagtccagctacacctggacggctttcatgatggcggcgataaggagccagtgggtttttctcttctggcattcctatggggtgtcngatctggtgtgtttgggt

SEQ ID NO: 37858 - DNA, 396 bp, Triticum aestivum
  Clone ID: PAT_TA_37858
gaattcaaaatccttatcatcaacaaacataggtgaagtagcaaacttaggatcacatttcattctagcattcaaagatttctctttcagtttgcataataaatttttaagatcatctctatcattgcaagcaagaaagtttctagttgtctcctcatccataacataaccttcgagtactttaggcaattcatatctagaatggctagatctaataggtgttacaagattcccagtttcaagtatttcatcaatttcagcattctcaatatctttagctctagcaagttgttcatcaagaaattcacccaatggcatagtcttatcaagcaaggtactagcatcatcataagcatcattcatataagaagtagcatcatcaataacttgtgacat

SEQ ID NO: 37859 - DNA, 334 bp, Triticum aestivum
  Clone ID: PAT_TA_37859
ctagtggatacagaaagttgcaacggtggaattaggtttttggctcctgttctgatcgtttgggggtacgtgtgtatatctaggaggaagaagtacgccggacgagcaacaaggggcccacgacgcaggggggctctcaatttgcttgggatcctaatatgctatgtattcaacaataacaccactttcctatgactgtgtcgaatacatctagaactttgatacttgatgattgttttgaaatattgcggtaataatatcaatgtcatgctccttgattactgtgaacttaataaatgcttgtgctgaaatttgcaagtcccgtaccattcac

SEQ ID NO: 37860 - DNA, 294 bp, Triticum aestivum
  Clone ID: PAT_TA_37860
gatatggatggtgacttccccggtggcgaatccgaaatctccgaagcgagcgattctaataatcgcaacgctattgacaccacttcgaatcacagatgtgattggtgatgagaatggcgaggataataaagagtatgcagacgatcaggccgctgcatcaggtgacaacaattataactatcaccacagtcactatgattctggggactactactatcattactatcatctctctgctgtcgacgatagacatcgagtcttataggaggatgattactatgaggatgacgacga

SEQ ID NO: 37861 - DNA, 391 bp, Triticum aestivum
  Clone ID: PAT_TA_37861
ccgggccgacgggaaagtatatgatgagaagcccaagagcatccctgacaagccgctgaacaaaaaaataaagtttgacgactctgattcctccgatgatgaggatcaaggtcattcagtggaggaggctaacaatggaaatgatgcagaaaaaggtgaagccaagtcatctgagcagcaacaagaggtacctggtgccttgggaattgccagcaaggaggatgaagaacaagtggaaactgctggcggatcagcgccaaagaagcaacggatagaagatcctctggtttctgaacagacagaaccaaaagcgcccactgatgaaccagcagagactactgatgataagccaaaagagtccactgataaaccagcagagactactgatgat

SEQ ID NO: 37862 - DNA, 306 bp, Triticum aestivum
  Clone ID: PAT_TA_37862
aatgcccgggccgacgggagacaggacacatcctgatgatgcggggcgcaggcaatcaaggggcactcaggacagtgctctgcccatatcatcggtggcggattcgccgcgtgaatcacagctggcgatagcacaaaattcagacacgacatcgacagccgacaacgggatttcaggatctgcccctgcattctcctcgagatgctgcgaggatcagctcgatataagcatctgatcatccacaccagaggtctcaacactggcgcctgcgacaactctaagtcccacatgacaatcatcaagagt

SEQ ID NO: 37863 - DNA, 385 bp, Triticum aestivum
  Clone ID: PAT_TA_37863
tctcacaatgtgtacggttcgtgtagagagagcttgccaacatggagcagataaggcaggacagatcgtatgtacgttgacgaaagcgtcggatacagccctaatgacacatacagagactgataaagagacaccgagagaggaagaagttaggtctgtgacatagatggagacatgtaatatacttgagatacgtttgcatcggtattctgttcacatcgacggagaagacacaccaggtttgatcacatagctcgacacgcattgacgagaggggaaggatctcgtgggttgagggattgataattttgtgcgggtgatagagggataggtaattctgtgcaagagacagatgagggaggagtcagtcagctgtcgtcccatc

SEQ ID NO: 37864 - DNA, 407 bp, Triticum aestivum
  Clone ID: PAT_TA_37864
gatcaagaaaccactttgacaaaactctgtttgggttaaatccttcgaagaaccactttattagacgcctgaccctcgctccattgtatgggcatcggcatggttctgtctgccgtggtcatgctcagtgccgagagctgtacatcgccgctagcggcgcctccatgtccatggagcatcgtgtcactgctattggtgttctagctagtgccacaagctgcggcgttgtgcctctcggaaggcgttcaatcagctgagccagatggcgttccgatacaaattgttcatgtagaacatgcccagcattgccagctcgctactgttctgtggccaggcgctatcaaaactaccaaagcaggctcctgtgcacttgaggagggtcaggtggaccaaaccggcttggttta

SEQ ID NO: 37865 - DNA, 281 bp, Triticum aestivum
  Clone ID: PAT_TA_37865
aaactctgtctgggttagggctttcggatgagcactttattaaacgcctgactctcgcaccattggatgggcatcagtctggttctgtccgacgtggccatgctcattggattaagttgtacagctctcctggaggagcctccatgtctaaggattatcgtgtcaatgctaatgttgttctatctgatactccacgctgtcgcgttttgcttctgcgaaggcgttcaatcagttgaattacatggtgttccgattccaattgtccatgtctaacatgccca

SEQ ID NO: 37866 - DNA, 396 bp, Triticum aestivum
  Clone ID: PAT_TA_37866
gacgggctattaaagaaaagaacggagcacatacatgttccaaacatggactttgcgcatttacgtgaagggaacaatccatgagtgcatggtgcgtccctgctctatcactagcaatagcatgcaggatggctcttgacaagaacaacttctatagatagaatttagcttttataaatattaatatggaggaaagaacaaataattatttgctggtagaaaatctggattacaatagtccgtctgacaaaaaaaaaacaaatggaaaattacattaggtggtaagaacaagaaacaaaaaggcatccgatgcatctactataatagttctctacttgcgcttaacaacgccgacataacgaagctctaccgaacccaagtagatcatgccattgc

SEQ ID NO: 37867 - DNA, 422 bp, Triticum aestivum
  Clone ID: PAT_TA_37867
ggtccagatatccgggtcgacgggagacaaggcgatacctctgtatcagatgttgaagaaaatagacaatttagtctagagtgacgcaactaatgcggcgtttgaggacttgaagagacagctagtcgaaccgccagttcttgctgctccggttgataaggaaccattgttattatacatggctgctaatgatcaggctgtcagtgtagccattatggtggaacgcaaggaggctgggaaggaatatccggttcaacagccagtttattatatcagcgaggtgttgattgagtcaatgcaaagatatcagcgaggtgttgatggagttgtccttacttcccctcgaggtgataaaatttattatgttctccgcttaatgtttccttgtactatcaatgcagctgagtacgaggccttactcc

SEQ ID NO: 37868 - DNA, 394 bp, Triticum aestivum
  Clone ID: PAT_TA_37868
caaatctacagcattgtccatttcatgctccactaaagcaagtactatgtgaaaagttttgcttgccccactgttaacttaccacaatcagtcatcatcaatttgaacgccgcacttaatacattacgcgatcttcgacaaacccgtcggctaagcacacactctctgctaaaacacatacacatatcagcattcgatgagttgacgttctatgatcactaataaagcagatgggtcaagtattcattgatataacaaaatgcactgctttgtggagactgtattggggggcaatacaccatcgtttaacatgacatgtgcttaattagctgcacgcttggctgcaaattacgcgcgaaagtatgggggatcaatacgatacactcaactttta

SEQ ID NO: 37869 - DNA, 382 bp, Triticum aestivum
  Clone ID: PAT_TA_37869
gggggggaggggcaggggcgttgggagcatctttctcctacctttagccctaggttacccgattgttgagagcggcgacccggtgggaaaaatctgcagcgactaggcgactgcgtgctagggtaggcatggagttcttgatgcagcccgtaaataggcagcaggactctaatagaagaggtcaacgagaacaagatgaacatggagcctcttcattaccctgtgagtctatgacgacgcggccggtggtggagttgccggccaacacggaatcaagcgccaacgaccagatttgcactgagggcgctgttccaagggcaggcagtgcagacaacctcaagcttcagagcactccatcgaacagggtccgggttggggcaac

SEQ ID NO: 37870 - DNA, 421 bp, Triticum aestivum
  Clone ID: PAT_TA_37870
attcgccggtcgacggggataacgaggagtgcgcgtgcaaaaccaaaaactgcaaaaccggagcctgcggttgcaacaagaaactgaaagggtgtaacccaaattgcacgtgcatcgggtgtgagaatggctacgggatgaaaggggctgataagtccaatgctggaccgggaggtacgggtggcacaagtgacgccggaggctcaggttccaacaagcaaataagaatcgggtgatgacagtaggcttgagacataccagagcatgatgcaagtcaccttactttcttaccatcctcaagtcacctcctgttgagatatctcccactgtaaagcacagccaggttcctgtagattccttgtaatggttggttactcgaagcaagcacggcgaaaactccatgttcctcaaccctcaaggg

SEQ ID NO: 37871 - DNA, 340 bp, Triticum aestivum
  Clone ID: PAT_TA_37871
acggggacaaccatatgtgtgcctgtcagggacgagcgagcgtcatttcctactactcttgcactctaagatgaagcagatgtagcccaggttgcagatgaatccgatgttatagcggcaactggatgaattgggatgacaaatcgagagcccaacgatgaggtacaggtggcacatttgactagtgcgacccacttcgataacacacattgcactctcgcaacgagagaatgcgtgcaacatacgacatcatcatgcaagtcagctctacactacttagcaccatcacatcaactcctgctgagatcttcctcactgtagccacacagacatattcatg

SEQ ID NO: 37872 - DNA, 380 bp, Triticum aestivum
  Clone ID: PAT_TA_37872
agatgcaacaagaaaaaatgaaggaaaagcggaaagctaggaagaggtcgtcgaaggatgatgatgatgatgacgacgatagcaacgaagatggtgctgatgaagatgatgatttctttgaggatgaaaagtctgatgaagacgttaagccaatgaagaagcagaaggtgaatgccaaaggtaaagaaaaagggaaaggaaaggacaagcttccagaggaacatttcgaaccagaagcaactaaagaagagttggagctcttggttgctgatcaggatgcaggcaatggtgcaaagggctttaacatataacgcaagagtaaaaagggcaagaagggcaaggattctgtcgaggacaaacatcctcatattgatcttagc

SEQ ID NO: 37873 - DNA, 135 bp, Triticum aestivum
  Clone ID: PAT_TA_37873
cgggggtaaccaaatgagggaagatgatgctgatgacgacgaaacatacgtaaaaagaagaatgaagactacattacctacgaaagatcgtaatccctgcagaaggaaaagtcacgaccatgggctcaattattc

SEQ ID NO: 37874 - DNA, 362 bp, Triticum aestivum
  Clone ID: PAT_TA_37874
actggctacaaagtgggtggtgggtgggctctgaatttcttcgtcgtccgtaccccaaccatcctggccatagtccggccaggactctcccgataacgagaggtgctttagcgaatttaggatgtcgccaaagggcgagtgttggaagatgtccgcggcggtgaattccataaccggcgcccaatccgaatcgattggtaggggcgcgggaggttcggagtccggcaaggagtccggaacctcggaatcacgagtttcgcaggggacaagattagcgttcggctccatcgtcgtggaagttggagcccccaatgcagtgtccatccaccgatcctcggtctgggcgatcggctccggactaa

SEQ ID NO: 37875 - DNA, 350 bp, Triticum aestivum
  Clone ID: PAT_TA_37875
gaacttgggcgccgtccacaagggttccaggggctcagatattggccgtggcgagcgggaagcgttgacagttggtctacgcagaaacatagagttgtgctgcctagccttgattcatatcctactaccagagacctttgtcaatttattaacccgccctcttgagtttgcaccttacctcagtggctgtctggcgttacagtcttggactgccgtgatgagtttaattatattgaatggttcatacgttgggtcttatcacaacggcttctggagctgctgagattcgctcatcagcgagatgcctgagatacgactgatccagacggtctaggcgctccatctttacc

SEQ ID NO: 37876 - DNA, 424 bp, Triticum aestivum
  Clone ID: PAT_TA_37876
attcgccggtcgactcccacatctcaaatgcatacccattcgttcacttctcattttcacgaagtcgtagtgttgagattttatctggcataacaccagtagagtatgacccgtagaagtttccgggttcacacagattatggaaggcatagattcaacccatcggtgtaccttaggaacatataccgtaatcttctagagtaattaacacaagctcggaagtagagcatggttgaggaagcagaggatacaacttaccaaaggcattatgtatcggagaaagaactcaccaggtgattaattatgaaggacactgttggataataatccaacaatggatatggcgatcgatagcggagctgatgtgagcatcggtactcaaccagaggaagaaggatgcaaggagatctgagtatagaaacat

SEQ ID NO: 37877 - DNA, 384 bp, Triticum aestivum
  Clone ID: PAT_TA_37877
cgggtcgaccgacatgggtaagatgaaattttgacggagcatcatactacaacaagcccattaaatggtgctcactgttggaattaattaggatgtgacataagaaccgccgacttcggaattcctccatcaagttgcttttgttttaatttctttgcaatttttaatttaaaactctggtacacaagtgtgtctgctaccttttcatctcatgtatatgctaacattttcgaaaatcggtaaaatttgcaggggttactttgagacggcagtaaagccaacgaatttaaaacacactcgtcaattagggtgcggtcgtgttagcatgtgtaaagtgtacatatcccacattgcttgatcccactcaaactccgttataaaaac

SEQ ID NO: 37878 - DNA, 408 bp, Triticum aestivum
  Clone ID: PAT_TA_37878
gctctctctctcactctgtggtgtatttcttcctctggctctcttctcctgccccaaacatctcacgccgccgccgccgagggttagggtttgtggccggagatccctcggattcgattccattcgagtcgaatcgaagagaagagaatcgatagagatggacgcgcagcgtgccctgcttgacgcgctgatgggttcgtcgcgggacctgacggaggaggagaagaaggagcaccgggaggtggcgtgggacgaccccgacgtgtgcgccccctacatggcccgcttctgcccccacgacctcttcatcaacaccaagagcaacctcggagtatgcccaaagatccacgacccggccctaaagcaaagcttcgagtcctccccccgctacgccgccggcctccccaa

SEQ ID NO: 37879 - DNA, 385 bp, Triticum aestivum
  Clone ID: PAT_TA_37879
cgggccgacgggggccgtcacggcctccacctgtgccctcttgcaggtggactgctggtcattgatgcggcgagtcaggctcttgcagcaaaatctatgatattctctggatgagctgcaggtaggccaagctgttgacgaggatccgacggcgaccaccaaggtatacaaacaacagtgtaacaactctaggaatctacatcttaatacagctctattttcggggattcaaatctccaggctgaaatcaacaagcccacataatcttcagccttccacaattatgttatgcttcatgttctatgatcaggttgtaatctgctggtgcggtgctgccctgctttgatttggggattcatctgggatctaattttgaccgaacaaa

SEQ ID NO: 37880 - DNA, 382 bp, Triticum aestivum
  Clone ID: PAT_TA_37880
gtcgacgggtgcaatgagagtccatagcatactttgaacctggaaaccagaagatttgactgacggtagattgttttcgtctactgctgtactatataccaagaggacaagcacttgggagtgaaaaagaccaggaaagcagtcattagccatcagttttgacagggtagatccaacaccatctgttcattgaattactgagcttgatgggtagtttttctgcagttacagaaattagtcttaagtcgaaggataatgcggtaggcaatggtgatgtgtactggtgaggcttcacgtataacggagtgtcactctcgtcatctagatttacggacaagattggttgttggtgatgcgttgtggcacctttaagttaaaattt

SEQ ID NO: 37881 - DNA, 381 bp, Triticum aestivum
  Clone ID: PAT_TA_37881
tgatcgctagatccaacgctccaacgactacgaggggctgggcagatgcaacaggacgaggggctggtactagcataggaaccataagtagggctgggaggtgaacacgaggaggtgccgcaacaagggcaactgcatcaactactataggagcacatgcaaatgctacaagatgaccaagtccaactattgctagacgatcactagcagcatctccttgcatccatcagctccctcctgtcgatcaccttgttagtgttactcgatcaagatcctcaagatgaccacctcatgtcccatcaccagaccacgttgtgttctcacatcatgcaccattacattatgattggcaacactttccctcactatacttcaagtcga

SEQ ID NO: 37882 - DNA, 144 bp, Triticum aestivum
  Clone ID: PAT_TA_37882
gggtcgaccggaggtgggaagtgaaggcgcggacctagggcagatcggcgagagagccgccggatcgaactggtctggagcagagaaagacatcaaccatcagcaaaaaaagtgacaattggatcaggaggcgagttacaatgc

SEQ ID NO: 37883 - DNA, 395 bp, Triticum aestivum
  Clone ID: PAT_TA_37883
actgtggaaaccagatcgaagcagagtggataagagaacggaactggcatcgtagaagaaaagctggattgattatcacgagttgcaatcattgtggtaaaaaagaacctggctcgatacaatgttaggaaaatatacctcttcgtattatcatataagtaggctgaagccatcatatataaatataccgaaggaaggccgaagatcataatgcaaaaggccaaaggacactataaatataactctaacagataccacttctcttaaaatgtacattgaaaataccaaagccgccggcccgagggggtttacatactaaccacgctaatggaaattactgaggtactcaacacacagaatagcctagaaaacaaaatttagaaatcacagacaca

SEQ ID NO: 37884 - DNA, 103 bp, Triticum aestivum
  Clone ID: PAT_TA_37884
cgggtcgagccgggaggcaaatggacgagtcaaacatctcgtgtccccataacacctcggaatacacgcacaccatctacagccatcattcattccatttcgc

SEQ ID NO: 37885 - DNA, 380 bp, Triticum aestivum
  Clone ID: PAT_TA_37885
gtgctctcaagcgggtgctttttaataagaggctgatagctcaacataaaagtaaatagataggcccttcacagagggaagcagggatttgtagaggtgccagagctcgattttaaaatagagatgaataacattttgagcggcatactttcactgtcaacgcaacaactatgagatggcgatatcttccatgctacatacattataggcggttcccaaacagaatggtaaaagtttatactcccccaccaccaacaagcataaatccatggcttgctcgaaacaacgagtgcctccaactaacaacagccccgggggagttttgtttaattattttgatttgctttgatcttttttatcatgggactgggcatactagt

SEQ ID NO: 37886 - DNA, 412 bp, Triticum aestivum
  Clone ID: PAT_TA_37886
aacttctacggattgcctggcgcgttgatggagatagggtagttttgcagtagagctactgttttgttgttctgaatgtttcctagctctgctgctcttctccctggttggagctgaaaatgttctgttaatttctgagggacttgctgaacctttagtttaaattctcccttataataatttctgctgcagctactgttctggctggaccgagagctgtaaacagtatagtctggtttggccttggctttttaataaaagttgggtctggggggcaacccctctcatttaattcagttctgtatttctcctatggctgttggccgctttcatttgtttatataatttcccagtggcttttagtccacgagtgcttcctgaatatgttatttcttcggaaatgttaacgccc

SEQ ID NO: 37887 - DNA, 397 bp, Triticum aestivum
  Clone ID: PAT_TA_37887
cgggtcgaccgggaagatgaatccacagggtcctggttggaacaagagattgaggattggagcctctgccccaagcttgacaccttgcccaccccgcataagcgcttttgagaaggcggtgagggtgttcataaaaaaacccaactgaagatgagccgtggatcataatttagagagtcaattccctggtaccaaaaactgtatggagtttgcgctgaagatgcagactggaagtgtactacactccgaattacactgggtgtgtccaaaaaaatacacctgcagcatacattaatgattcttggtggtaccttgtgcattggaaagttgtattttagcaacaaattcgtatggtaaaaatgtcttgccttgtgcaatgcagcccatgttgtgggat

SEQ ID NO: 37888 - DNA, 401 bp, Triticum aestivum
  Clone ID: PAT_TA_37888
aatgagataaatggtatatttgctaagtaaagattctgtctaaagtgatgataaatcataaccagaggggtgttatgaggtattgatgtctatgcttagtgtggatatggttgacccagttatttctgttgatatatgatgcatatgtttgtggtgcattttcatggcatataatgccacaggttattttcaccttaagtagaatctgataataactcaacttgaacatatcgttgatcgggtcatggtgccactgaatcgagttttcccagtgcaaccacatttgcctttatgggaaggcctttattcagtccgttgtcatgcctctggtcggtgcctccaacgattgaaggttatgggcatgtggtaccctggcccggtaagcagacataaccttgtgt

SEQ ID NO: 37889 - DNA, 392 bp, Triticum aestivum
  Clone ID: PAT_TA_37889
attgtatattgtcgtatttatgttgtgtcagttttgtgatatactttacaattaaaacaatttctgaagaaatctcactaaatttcttaactttttttgaaatgaaaagatagatcattttctatgttatgcattcaaaacaggcaaaagcgcctggatgaccggagtcatttacatgaaggtgatgtaagcgccgcacagctggccatcaccaggccatcagaaagacgtttcagaattacatgggaaggagatgggggggttgtatggaggtgtgtaaactatgcagaaccaataagattagcccaattcactagtacttccctggttggttctccccgagcccgcacagtgcagagcttgatgagatcggcaatctccttgtagacacg

SEQ ID NO: 37890 - DNA, 402 bp, Triticum aestivum
  Clone ID: PAT_TA_37890
taaaaacaaagatggtagtgaagtgtttgattggtttgagaaatatgttctgcgttcgaaattggatgttagcattgatcacctagagctgtgctcactgttatcacatggtggtgatgcaagagataaacatatcaccttattgatgaatgctggtctcctgacacgccaactaatagatccaaacatgtactggttttctattccaagtattggtcctatcccaggttcacacaaaagattggtgaccatggcatcagtatacaaattaactctacaagccttttccatgtccacatcatttccctcgatgcagtccaaaagaacaatttgtaatgattctatagttagcaattaccaatgtaaaggaaatctattatttgcagcagctcctactgagct

SEQ ID NO: 37891 - DNA, 105 bp, Triticum aestivum
  Clone ID: PAT_TA_37891
cgggtccacggggacaccacacaccctcacagcaagatgattcaggaagtgtccaagtttcagtcatgaaagattggacaaatggttgatccaccaaatcaatct

SEQ ID NO: 37892 - DNA, 382 bp, Triticum aestivum
  Clone ID: PAT_TA_37892
gggtcgacgcgcgggtaaaacaaaggcaacttggaacggggaaccgacgaataacttgaagagaaaacactgttgaaataattgaggaaagaatgcaaaggcttcgcacgggtagggtggatactcgattacgaactccggctccgagaagaagggtgggcgcgtgggaaaagaaagacaacttcacagagggaacaacgtcgttgagaaagaactgaggactgatcttgcaaaagatgaaggggatcacatcaacttgacgagaaaagcaccagatgaaaagagctggcatcggaacgaacgagaactaaccgcgagatcctaataaaaagttttgaaggggaagaggagtatatcaaaacacctacgtcaagatttctca

SEQ ID NO: 37893 - DNA, 390 bp, Triticum aestivum
  Clone ID: PAT_TA_37893
cacggggctagggtttggggggggttccggctgggcctccccagcttataaagccggacgagccttagtgtccgggtcggacacggcccgtaggtcggttgcgcatttttttaaaataattacgctcagaaaaaaaacaaaaagactactaaacggactccaaaaatcctgaaataaattttccccggcttctaaaatcaagccgcacatgatgaacatttatttggggcctaaatgaaattttgaaaaatgcacattttcctaaattcaaataaaatagcaaataaaaccaaataaaaatcttgtttgacttttttattaaatcctcaatgtttctttatttttgggaaagtcattttattccctctctcatatttttatattagaaat

SEQ ID NO: 37894 - DNA, 401 bp, Triticum aestivum
  Clone ID: PAT_TA_37894
aggggttaatcataagtgggatgcttgtccaagtaagggtagtacccaagcaccggtccacccacatatcaaattatcaaagtaccgaacgcgaatcatatgactgtgatgaaaactagcttgacgataattcccatgtgtcctcgggagcgctttcctttatataagagtttgtccaggcctgtcctttgctacaaaaaggattgggccatcttgttgcaccttatttacttgcattacctgttactcgttacaaattaacttatcacaaaactatctgttaccgataatttcagtgcttgtaggaaataccttgctgaaaacagcttatcatttccttctgctcctcgttgggttcgacactcttacttatcgaaaaggctacgatagatcccctacac

SEQ ID NO: 37895 - DNA, 399 bp, Triticum aestivum
  Clone ID: PAT_TA_37895
ccgggtcgaccggtttggccatgtttggatccatgggttagagttagtttgagctagttggggctcagatagccctaaagtatccaaacatgagggttaaattggagcaagttgcaccaaacccacccgagaaaaactatcccacccaagagtcgctaacatgtgatgagttaaacgacatcaatagatggcaaaaacgctagcccgccgcactttgagagagacgaggagcgagaagcgatatgggctggtggattactagagctaggtatcgcacggaggccaagaaatatggtgatagctgctacctgttgagcttgcgttggtttttcccttgaagaggaaacggtgatgcagcaaagtagagtaagtatttccctcagttttgagaaccaagat

SEQ ID NO: 37896 - DNA, 397 bp, Triticum aestivum
  Clone ID: PAT_TA_37896
tcctgagaggctggcggcggcaccttggcggggtccttctcatgatctccggcctgcttccgggacatgtccgtgaactgcgtcacgtagagcttatggcccatgacggggcctgtctccgtgacgcgctggcggccatgcaacatcatcatcgacagcaggcatgcgcggagagccctcaaccccattcccgagctgatcaactcgatgagcttatccagctgggccctgaggatgtcaatcatggagttggaccgctcaagttgaaggttgttcctggcttccaccagcttgttattggctccttggaggcccacactgtctgccagtgtaatcgcctgccgtaagtcctctatgtagatttgacggacttgctcggtgagcacgggctccgaaa

SEQ ID NO: 37897 - DNA, 369 bp, Triticum aestivum
  Clone ID: PAT_TA_37897
accggcatctatgcggcgcatccttcctttgatgacagtggcatcccgccacctccatcaaagtggaagggttcatgccatggtactgctgctgcccattgcaataacaaattgagtggtgcgaagttcatcaccgtcaatgactctggagatgtcatagggcatgggacacatacctcgtccacggctgctgggaactttgtcagtggtacctcggcccagggtctcggcagggccacagcagccgggactgctccacatgcacatctggccatgtacagcatgtgtacgcttcgtgggtgtgactccgctgacatcgttgcggggatagacgaagctatcaaggatggggttgatgtgctctctcgg

SEQ ID NO: 37898 - DNA, 198 bp, Triticum aestivum
  Clone ID: PAT_TA_37898
gattaggaaaagtagtagcagtaacatgactctgcatagaagtggtttcgaaaaagctcgaacagcaatgagcttgttttatttgctgataaggctatataatgtgatttctctatcaaaaaaaaaaaaaaaaaaaaaaaaaaaaaaaaaaaaaaaaaataaaaaaaaaaaaaaaaaaaaaacaataaaatcataaaa

SEQ ID NO: 37899 - DNA, 340 bp, Triticum aestivum
  Clone ID: PAT_TA_37899
gacgacatccacaagttcctacactttattgatcgtcttgaggtccttgtggggtgtttcaatggtggaaggctacgtgggatatgtgtgccactgctgcacacgttgaacaagtccaactgtgtcgagaaacttatggtacgagctgttttctgttatatattttgttcataaactctttcttatacacagttttacagctttgatcttcttgaaatagaaactgcccagttgtattgttcctatacagatgcctgaccattgccgggtcagacttgcacttggtcacaacatgatgtttatgtcaacctactccattccccttggaggtgaaaatata

SEQ ID NO: 37900 - DNA, 428 bp, Triticum aestivum
  unsure (1)..(428): unsure at all n locations
  Clone ID: PAT_TA_37900
acggtcaactattccgggtcgaccaagaaggaggaggcaaacggacatcgggacgacatcacactccaaagtgtcctcatatgcaccaattttgaaggagacttggaccgtatgctcaactcggatagtgccagagacacttagccattggactttgtatgggtgcgggtgcttcatcttgaccaattgaagcttggagcatagttcttcacttgccaagttgtggcaactacctccatcgatgatgaccttgacggaccttccattgatgccgccctttgtgtggaagatgtggaatcgttggtcttccccctattgatgttgaagagtcaaggctttggagacaacgagagcagggctcgaatcctcatcacaaaagacttgatcatcttcatcctcgttcatgcgtcngtgcatggccacttgct

SEQ ID NO: 37901 - DNA, 406 bp, Triticum aestivum
  unsure (1)..(406): unsure at all n locations
  Clone ID: PAT_TA_37901
ccgggtcgacgggtgaaagggagtgcggtgccctctctctctctcactgttagtcactaattcggccgcatcccgtccgccgggggacagggaggaagtgcatcgtttctccgttcgacggtgccgaggcagcacgtcccgatctgcggtacacgtagttctctctgaccaagctccggcgcggcagggcctacgccacctgctcgcagattccgcccgccgccgctcacctagttacatcccgacgacctccaggtatcccctacggccttgctccactgcccgtcttcccacgtcgctgcatgtggatcttccatagttctttgcccaaaacgtagctcgtccggcgtactttccatattgcattctcgtcctcacaccattttagacanacacaaccgtgttg

SEQ ID NO: 37902 - DNA, 436 bp, Triticum aestivum
  Clone ID: PAT_TA_37902
aggcggctacgggtgttggcttacgaagctcggatgactgtcgtctcagcttgttttgtaatcggatacggcggccgatacgcgtcagttataagcccattgagcttgttgcttccgtgcaaaacatggaaagcccatgacccgtaaagaaactaaccaatacgacgcttattaaatagagtatatatatatatatataaaaagagtatatatagaaaaaaactataggccgcttattgcgagcgagatagcctagcatcggtcaaagcgcttccttgattctgctcactataaattagagcaatttttcattctttgaaattgcggtaacattacatatataaataattatgatcagtttaaataataaataagtgaaaactatcgcaaaacagtgaaacattcacgtgttaaaaagttatagcatatatcgaat

SEQ ID NO: 37903 - DNA, 411 bp, Triticum aestivum
  Clone ID: PAT_TA_37903
gagagggagtggttgcggagctaggggtgttggatggtgtaggagtgcgttgtgaggaaggaaaaatgtgctcaacaaacatgacatgacgaaagacataaacgtgtccggtgtgaaggtcgagacagcgatagcctttgtgctcgtcagagaagccgagaaaagcacatgggatagagcgtggtgacaatttatttgcagaagtggcgtaggcattgggaaaacagagacggccgaaaacacgaaccgcggagtagtcggggtgggaaagaaagaggaaataatagggtgtattgttgggtttagttttagaaggtcgaatatttagaaggaaggtggccatgtggagggcttcagcccaaaacttgagaggcatagatgattgaatgaggagagtgcgaactatatcat

SEQ ID NO: 37904 - DNA, 386 bp, Triticum aestivum
  Clone ID: PAT_TA_37904
acatgttcagataaaagagagagttgtcttgtgctcacaagcacactagggcagttgccatgtaaaagaaagagttaccgtctgcttacgtgcacgctagggcagttgccatgtaccatgcaaaaacacatggcaattcgggtaaaagagagttgccatctgcttacaagcaaagctagggcagttgccatgtaccctgcagaaacacatgtcaactgacagctttgggtgtggcgaggagacgggcgtgtgggcgaagtgataaacacccacacaccagccccctctgcgtgcgtgaaaactgatgtgtgggcgaattgctaaacgcccacacaacagcccccgtgtggtgaaaaagaacggtgggcgaccggatgaatgcccac

SEQ ID NO: 37905 - DNA, 447 bp, Triticum aestivum
  unsure (1)..(447): unsure at all n locations
  Clone ID: PAT_TA_37905
tacggtcgtagattccgggtcgacgggtttttaaagaaaaagaacctatagttaatgaaagaatagatcaagattccacaagaattggtaaacttgaggatatcattactaatttagggtctgccttttcatccgtttgaaataacccaaatcctcctacctccaatattgctaaattaatgtatcttcctaaaaataagggtgaatcttctagtaaggaaaatgcggatctcaaatcaataagtgttcaccccaacttcttcaatatcattagggaaccttttgctacaaatgaatttcttgatttcttgcctaggagtttgatcattaataaaaagaaggaaactccaaagggttataagtgttccattgaataattacataccaaagatgataatacctagatctattcttgcttttatgcctagctangggtgttaaacgatg

SEQ ID NO: 37906 - DNA, 393 bp, Triticum aestivum
  Clone ID: PAT_TA_37906
cgagaataaatatgctaaggagtccaataaataaaccgatgatattttgtagatgtttggggatgttctggacccaatggtgatgactatccgagtcgggtccgggacagctttcggacgcgcgcgtggagagccgcgggctactgagagaggttaggttgggcctggcggtgaatggtagtggactgtggagagtgggttggtgtaggagaagaggggagagaagcaggccggcacggtttccggagaccgaaaatgtccgacgaaaagaccgactaatattgccgctatagtttaacggttgggctatcgaacgaactccgaatgcgatgaaacttggcaggcggcctacctacactaaaaccacaccgcatgccaactttcatcctaatc

SEQ ID NO: 37907 - DNA, 399 bp, Triticum aestivum
  Clone ID: PAT_TA_37907
atcatctttgttgacgcgaagtctctcatgacatcctttaatatttctggagttgcgttccaaactttagggtttcaacatccttggcatgagccatggtactactgtccttcagtccctgatgaatctcctgtatcataagatttttctcctccaacttggctactttcagtttctggctcctgatttcttcacgaattgcctccttgtcaaatatgatttcctaagggtccacctaaaattcttcatgtaatactccagatcccggcgatacaccagctaaggttaaagttgcatcctttgctgacagatgctccatcagccttctaccatccaatccttccatgcatacgcttgcttaactccgcacgatgacaataacataagaggtcgataaca

SEQ ID NO: 37908 - DNA, 423 bp, Triticum aestivum
  Clone ID: PAT_TA_37908
cagggcttgggcaaggttcatcagcatcacggaaggcgaatggaaaccaaagctgaaatggtttctagccaaggtaagtaattaagtagtactagctagctagctagctgccatctctttaattatcatgcttgattaattattatctaatcaaattaaattccattctggtaataaaggccctgaagcaggcgcaggggactgatctgtgtgcattctgcatttgcgagaacattcgcatgatggcgtccgaaaggagcagatctcaaagacaggaatgggtacgcttgtcagaacactattcacaatttttacaccattattgatatctagtcacacaactaatacacatgcatattgatctccttaatagttcaaagaggtgcgggacaagctcctaacaacgaagcgcgtagaagcact

SEQ ID NO: 37909 - DNA, 410 bp, Triticum aestivum
  unsure (1)..(410): unsure at all n locations
  Clone ID: PAT_TA_37909
agctagcagtggcgctagggttttgacgaggtggagaggtggaagaaggttttcttgacggcaggggacatgtatttataaagaagtgtgcggcacagtgcaattacgcaggtacccctggctgttcacatctgaggggcatgtggcaagcacgcaacatactcagagttgtcccacgttcccacgcccgccaggtttgtcggatggttgttccggcttctccggatttcaacaataaggatgaatcatttaaaacaaacttaatgtttgtctctgtgtcttctgctgacaaggatgcagagaagacatttgacagtttcaatagtatgcatatgatttggacagatagagtttgagatagaaagcatagagagattanggtccgatcacattcacttagttcaaaagtt

SEQ ID NO: 37910 - DNA, 402 bp, Triticum aestivum
  Clone ID: PAT_TA_37910
ggtatctcctcagaggaggagataaacttgttcaattggcatataccaaatctggagtacgccaatgcaggattatcttcaaggcttagccttgcattctgggaccaggatgatccgtatgacatgggtggggatcactgcttcctgcctggtggcaacgggaggcttgtgcaggccctggcagagaatgtgcccattgtttacgagaggacagtgcacactatacggtatggaggggatggtgtgcaggtggttgtcaatggtggtcaggtgtatgaaggggacatggcgctgtgcactgtgccacttggggttctgaaaaatgggggtatcaagtttgttactgagctgccacaaaggaagcttgatagtatcaagaaactaggctttgggttgttaaac

SEQ ID NO: 37911 - DNA, 375 bp, Triticum aestivum
  Clone ID: PAT_TA_37911
gtgtaggtgcgtgggtcttttgaggagcctcctactggattgatactttggttctcaaaactgagggaaatacttacgctactattgctgcatcaccctctcctcttcgaggaaaaccaacgcaagctcaagaggtagcaagaaggatttctggcgccgttgccggggaggtcttcgctcaagtcaagacataccaagtacccatcacaaacccatctcccttgcatttacattatttgccatttgcctctcattttcctctcccccacttcacccttgccgttttatttgccctctctttaacaatcttcttctcctttttccgtttgccttcccgttgccatggccgaatcaaaaagaactaagggccctttc

SEQ ID NO: 37912 - DNA, 391 bp, Triticum aestivum
  unsure (1)..(391): unsure at all n locations
  Clone ID: PAT_TA_37912
ggaaacaatgcttcttcagagaactcttgatgcaatggttgatgtcgtttattgtccgagatgtcaaactgcttgcttggaagatgcaggtgatgaagccgtgtgtccaagttgtttgttcagcttctgcgcactttgtagagggcgacgtcatgttggggttgaatgtttatctgcagaagaaaaacttcaaattttggaggaacgtcaaaagtctgcacgaacaaagggagacatccagaagcttatggatgaagtatgcagtatcaaggaaattttgaaggatgcaaagcagtgcccgcattgcaagatggctatatctaagattgagggatgcaataagatgacctgttggaactgcggtggatttntctgctaccaatgcaacgct

SEQ ID NO: 37913 - DNA, 402 bp, Triticum aestivum
  Clone ID: PAT_TA_37913
tctcaataagtattttattgaaaaaccggtcgtgacagtgggtctcattcaattttaaagccgagggctcctggaaaagggaaagggtgtgtcctggggtggggtttttgtgttgggatcgtgtgcgagagataacatgccagataatccagacaatcacatttctcccccacatatgggctcgatttgaaggagttcagattatccaaatagttgaattttggagagcctgcaaggcgcccgtttgacgtcctagcgcatctggatgtatgagggagaaagacgttttgaccttggtgatgaccttaattatttgtttgattcatttatatgtattgtagctcgtagcaacgcacgggcgttctcctagtatacttggtattcaagatatgtgaaactttc

SEQ ID NO: 37914 - DNA, 433 bp, Triticum aestivum
  Clone ID: PAT_TA_37914
caaggatgatgtttccatattaggaggtgagagtgatgatgtgccatcttcggccttcatccacggcgatgatgacgttcccttcgaccacggcgacgtatgatgatttgagtgacttgtgccaccatattgagagtgagagtgacttcaccactagccccatatttgatgtgttgccatgattcccatgtaaggagagccacaaccccaccacttgagtgagatgagtgactccaccatatgtgacattgagtgcacctaccttgacggagtgagtgaaccaccacatagagagagtgaggtagctgatagggcatgtgaggccactatgatttctaacaacttaatctctacttctattgtgtcctctcatttggtgctaggtcccatgtatgatgacacgccgattcacgacgacttcgccctccatttg

SEQ ID NO: 37915 - DNA, 370 bp, Triticum aestivum
  Clone ID: PAT_TA_37915
cgaggcggacttggccgagtccatgctttcctggttagggagagcctccaacacaagagagagagagagagagagcatcgtgactgccatggcttgaactattttgctgagatcctggaaaaattgaatggtataattctgttaattgggaaccttggaattgattttcacctgaaaaggttgatcgagggtcggataatggacgtaacacagctgctagagaagatattataatatggaaaatagcagatgaggagcaagctgaagttggtagatcaattgagcaagagttccagacccaggttacaccaagaacaagtgcctcagattattcatttttcaggcagcggaaggatcactccccctccac

SEQ ID NO: 37916 - DNA, 388 bp, Triticum aestivum
  unsure (1)..(388): unsure at all n locations
  Clone ID: PAT_TA_37916
agctcgactgctacagttttcagcaggagctccatgcccgtggaggcccatggcattggcaccatcccaacaaaattgatggacgaagtaaccaactgccaagtacttcaaggaaactaaatgctttacaatactccaaatagccaatgcgactctgtttttaagaccttttgcacatttataagaccctgtttttatacatctgtgtaaacagtccaatgtgattctaactgatgatagttcatctagaagaaaaaggagaaggggcaacatggagaaagacgcggtgctggtgtgcatgatcttgggctttctaggctccgtcgcggtcacnctcggcttcgtcgccaacaactatagctccaagcgtaaagagctatgtgagccc

SEQ ID NO: 37917 - DNA, 441 bp, Triticum aestivum
  unsure (1)..(441): unsure at all n locations
  Clone ID: PAT_TA_37917
acggtcgtagattccgggtcgacgggttggtggatcaaaaagaataacgtgaggatgaagatgatgatgaatatagtgaagcagtggctatggtatccgttgccatttccacaactccccgggtgtctctcttcgactcacccacgagaacatcaccgccaagtgcctcatggctaaagccactaacaaggtaagccccaacatcaaaaccaccattattcctaatccttctttgacggttggctttgatgatggtaaggggtctaatgaggaggtaaatgaatttgagtccttcatgagtaagctcaagggcaaatccaagaagcacttcgtttctctcttggaacaacttggtgaagccaatgacatgatcgaggctcacgaagaaaccatctctaagatggaaggtcatantcgtgactatgccgatgagatatcgga

SEQ ID NO: 37918 - DNA, 340 bp, Triticum aestivum
  Clone ID: PAT_TA_37918
gtcaggaagatttctcgtgttaatctcatgggctccaagtcgcaagctattcctactgccacagaaaaggttatcgcactggaagcgtgcttcagccgcagaactaatgtttagtaatgtcgatgtagatctactcctcatccttgccatagtgttcatccatacagaggctgtttggtaccagtttctggaactcatttttgtttgactgatacatcttggtcaatatcagcttctggaattaacgtatatctgtataattcctagttactatttttgtcgagctgtaattccctttgttttttctacattacggtgttactacttgatgaaaacttac

SEQ ID NO: 37919 - DNA, 376 bp, Triticum aestivum
  Clone ID: PAT_TA_37919
caattagatttgttttagattcatcttcagcatgaggaaagaaagaaagaaaggacgaaagaaagaaagaaaagatgcgcacgcacgcttgaggtcggcgacggtggtggcggaggcggggaatgagacggcgaggcgggtgcccaggctcgtctccaggaacaccgtcgccacctccattcgatcccctcgttgccggaggcggaggaggcggagcggcgtcccgaaatggaaagctctcctctgctttggggtttctccaggagcaagaggccaagagcagaggaggggaggccagcggaccacgtgacgtgacggcgctccctctcctctcctctcctctccggtcacactacttctagactcttgttgactg

SEQ ID NO: 37920 - DNA, 402 bp, Triticum aestivum
  Clone ID: PAT_TA_37920
cgtgagaggccggattcggttctatattggagggggagctccggtctatgcagaggaggcagcccagcagcggtctgatctggccagggcattgctgacggttggaggatgagatcgatccagaggaaaattaatcgaaatgagaccgaaaatatattgatcgtccaagaccgatctgaagaaaccgatagagagaggaggacgagtcgcggtgtctggaataaactctaaaccttgactcttgataccatgctagaggagcaacttgattgtactaaaccttgactcttgataccatgctagaggagcaacttgattgtattaccatagcccatggggagaatatatggtacaagagacttggggtacacgtaaggaaacctagaccaatgagtacatata

SEQ ID NO: 37921 - DNA, 447 bp, Triticum aestivum
  unsure (1)..(447): unsure at all n locations
  Clone ID: PAT_TA_37921
gcaagaccacctccaaggaaggcggcgagaagaagggcaagaagaagagcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccaccatcacctcccgggagatccagacctccgtccgcctcgtcctccccggggaactcgccaagcacgccgtctctgagggcaccaaggccgtcaccaagttcacctcctcttagactgcgtcgcctgtatctagtagcaaatgtagttctatactgttggcttagtgcttgtccgtggactctggttatctgcangttatagtagtcctacttttggatgaaaatt

SEQ ID NO: 37922 - DNA, 264 bp, Triticum aestivum
  Clone ID: PAT_TA_37922
acggggatgatcaggcaccctcaattgcagcaccgccgcgacgcggcatggttctgtacatgtcactgtcggttcgaacagcacagcacggtgctcggcgcgcttttcaatgccgtcgtagctccacgtcaagcggatttaatatctcatttgctgttctgctaggatcatgtgtaagaccgtcgatgcactgcatcctttgggggctgcgcacatgtgatttgtacggataccctgcactgttgatagtcctatttgtgcaca

SEQ ID NO: 37923 - DNA, 248 bp, Triticum aestivum
  Clone ID: PAT_TA_37923
gtacctttaatagcctttgttgacagtggagctcagtcaaccatcatatcaaaagactgcgctgaacgttgtgggttactcaagcaccttgatcaacgttacaaacgggttgctaatggtgttggtcaaactgagatacatggaacaatacatgtatcagctacaaacatatgccatgctttctaaccctgtaccttcagagtattggatgatccaaatatggaaatccttttcggacttgagatgct

SEQ ID NO: 37924 - DNA, 312 bp, Triticum aestivum
  Clone ID: PAT_TA_37924
gggtcgaccgggaagaagcacaaggcggagaaaccggcccccggggtcaaaggaggccgtcggccaaggggaaaacgaggggcaggaaaaagggcaccatggccaaaaaaacctttgagacgtacatgatctacatcttcaaggtgctgagacaggtgcacccggacgtgggcatctcctccaacgccatgtccatcatgaactccttcatcaacgacaccacaagcatccgcatccgcatcccatctcacatcccatctccccacacgctctaaccaccagcagcaccagcacccatggcacccaaagccg

SEQ ID NO: 37925 - DNA, 337 bp, Triticum aestivum
  Clone ID: PAT_TA_37925
cgggcgccggcgtcatggaggccggcggcaggggaagagaggggcacgacgaaggcagcatgccaagaagagctggggacgtacaggatcgacatcttcaaggtgctgaggcaggtgcacccggacgtgggcatctcctccaacgccatgtcgatcatgagctgcctcatcaacgacacgagaaggatccgcatccggatctcacctcacatcccatctcgccacacgctcgaaccaccagcagcagcagcacccatggcacccaaggcggcggataagaaccccgctgagaagacgacggctgggaagaagcccacggcgggggaagcggggcgcc

SEQ ID NO: 37926 - DNA, 231 bp, Triticum aestivum
  unsure (1)..(231): unsure at all n locations
  Clone ID: PAT_TA_37926
gcgtgccaatgtgaaggtaaaggtgggttccttgctggcccgggtgttccttttgaactggcttgctggggcctggaaagagtttcaaaatccaaaaatgggggtcaaccccccattggatgatcaggtgtctgctctggacaaaaaaaaaaaaanaaaaaaaaaaaaaaaaaaaaaaanaaaaaaaaaaaattaaaaaaaaaaaaaaaaaaaaaaaaaaaaaagcggccg

SEQ ID NO: 37927 - DNA, 247 bp, Triticum aestivum
  unsure (1)..(247): unsure at all n locations
  Clone ID: PAT_TA_37927
aaaagctacctctcaacccacccttcaattaaaaaccattcggaccccttgccccaacccaaggtattgaagaaggcaatccacctatacaggaaaccttgcgccggcaacggaatcaaaggttcccccaaaggttgcattttcaaactcccctgcttgcggcgtaattcgtttggtggcggtgggtgcctgncgcggaaacatgccctttgttgcctgcacattgacggccattaagaagagtgta

SEQ ID NO: 37928 - DNA, 336 bp, Triticum aestivum
  Clone ID: PAT_TA_37928
tatcttttatgaagaccgtgttgttactcccttagatactgccatcaccctctccaattcaaatggctgataaacaagaaaagtaattgaaagtatagatattgtatgatagacaagtcaatggatagtggggaataaaagagggcatgaaataattcatatttatgttgtctaaccaaacaggatagcatgacacaatttcacatatatatatgatggctaactaaacaggatagcatgacacaatttcacattatgatggctaactaaaaaagatggaaagacatagttcaaaatatgagactatgtaaacaggatgacatgatataactatat

SEQ ID NO: 37929 - DNA, 105 bp, Triticum aestivum
  Clone ID: PAT_TA_37929
atcatctaacacggcgaattcgtcatcgccgaggcttgcctcgtcttcagagggggcatgtaattaccatcctccgcttctccatctgccgctctctcaggaggg

SEQ ID NO: 37930 - DNA, 417 bp, Triticum aestivum
  unsure (1)..(417): unsure at all n locations
  Clone ID: PAT_TA_37930
ggcaaattaataaaaattctgtacaccatggtaaaaacaatcattataccctggtccaaatggataaaaaaattactttgcttccaaggacccctgattcaattttgaaagatgatattaatagagctaataaagcaaaacaggagaaaaataagactgaaaatcatattgtggcaaaagaatttgagcaacaaatgcggcctaataataaacaatctagtgttgcttctgaaattaaattgaaaagtgcatgtttacttgccaccaaatctgatattaatgatctagattttagaaaatctatttgctatgcttttgagtgcaaagaggcattattttcattcgaggacgtgccttcctctttgcctcctgctgtcactaacattttgcangagttcgctgacgtctttccacaag

SEQ ID NO: 37931 - DNA, 368 bp, Triticum aestivum
  unsure (1)..(368): unsure at all n locations
  Clone ID: PAT_TA_37931
tcgatggagaataaaaaggaatgaaaggtgtcggaggaaaaggtgacacaggaggaacttaccagggtttatcggaaaggaaaaggaaagaaaggtcatcgacagaaaaactcaaggaagaaaaacttgggtattaagaacgagactcgtcaaaagtcacatcacgcgagatgcgcaagcgacgacctacaggatcccaacatcgatagtccttgtgcctatcgctgtagccaaggaaaacacactcaaccgactgagtagtcagtttggtgcgttctcggggggcaagaagaacatagcacaaacatccaaacatacgaagagctgagtagtcaggagagagaccagtgagacactccatangaata

SEQ ID NO: 37932 - DNA, 375 bp, Triticum aestivum
  Clone ID: PAT_TA_37932
gtcaggaaaaataggggcggtggcgtcatgggctcaaattccaaggcaaaaacaaaggcaagggaaaggttcaccgcaaaggaggttgcccaaaggatgaactaacccaacccttatatgtgaaagcatatgccatgtagtttccctttcagtgtgtcctgattttgacgaggaactcgaacccttttagcagcagtgtggaatcgtattgtggttttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaataagaaaaaaaaaaattaaaaaaataaaaaaaaggggccc

SEQ ID NO: 37933 - DNA, 123 bp, Triticum aestivum
  Clone ID: PAT_TA_37933
gacgggcaaaggcaaggaggccagcttgagatcactgagcttgaatctcttgagcatgtcttgagtgtatttgtcttggttggtgaaggttccttctcttctttgcttgatttcgaactcgcc

SEQ ID NO: 37934 - DNA, 286 bp, Triticum aestivum
  Clone ID: PAT_TA_37934
acgggagtgttttgattatggcgaaggctatgaacaatcgggcttcactggcatgatttcgataagtctttacaacagtatggccactttgctttgctaatgaacctagtcctggtatcagatgcaccaatcagggatgggctccaccctttcagggtccatgaatagaccaccatgaaaattttgctacggtaagatccttttaagaacttaccacagtgatattaatctcatgctagtggagacatagtgcccttacgaactccttgggtcaacgtcagtgact

SEQ ID NO: 37935 - DNA, 306 bp, Triticum aestivum
  Clone ID: PAT_TA_37935
ccaagaaacgcacaagcgagctgttaccctcagactgcaagagatcgaagccactgtaactgtttaaactgttaacatggtctgttgtgccagtctatttgatgcttgggaactgatatttttcttaattcttatcggatgggacttgccagagtttaaggtgaagaatacgaagctgtttcatggaataaaaaagaaaaaaaaaaaaaaaaaaaaaaaaaaaaaaaaaaaatattaaaaaagataaaaaaaataaaaataaaaaaaaaaaaaaaaataaataaaaaaataatataaaaaaaatta

SEQ ID NO: 37936 - DNA, 428 bp, Triticum aestivum
  unsure (1)..(428): unsure at all n locations
  Clone ID: PAT_TA_37936
attatcaaaaaacgaagtcgtgtgcaacttgacaccactgacgagggatatcatatgcgtattgcatctagttagtacaaaaccatggtgcattataggtctttttgagtattgtgcgacctgttagatttgacggcatcatcctcactaaaattaaatattctccttttgctctgtatttgatttgaatgtacaatatagatagtaaagcaagtttgactagaggaattcaataagcatgggggttctacgaagattattcatacaccaacatacaaaacatgacaatcatttgatttaccaaacaaagttctaaagagaaaatgaatatatgaaatatattgcactttataatagcattacatggcatcgangagcagacacagctcatatatttacatttttgcttgcattattcatgtattgtg

SEQ ID NO: 37937 - DNA, 431 bp, Triticum aestivum
  Clone ID: PAT_TA_37937
cgtggacgagtaatatcatcgtctatgaagctcgacttgtggcgaagagtttttcacaagttcaaggagttgactacgatgagatcttctcatccgtagcgatgcttaagtccgtcggaatcatgttagcattagctgcatttatgaaatctggcagatggatgtcaaaacgagtttccttaccagtcttcgtaaggaaaggttgtatgtgatacaatcaaaaaggttttgtcaatcctaaggttgctaaaaggtatgctagctccagcgatccttccatggactggagtaagcatctcggagttggaatatacactttgataagatgatcaaagattttgggtttatacaaagtttatgagaaacttgtatttccaaagaagtgagtgggagcaccatagaattactgatgagtatatgttgttgacata

SEQ ID NO: 37938 - DNA, 429 bp, Triticum aestivum
  unsure (1)..(429): unsure at all n locations
  Clone ID: PAT_TA_37938
catcggattagctgccaatcgtgacgctgcagcgatcatgttatccaacggggttgggaagtgacccggcggtgttggcacatactgaggcgggtcatgattttgtcgaggcgggtctgcagcatgtggctgatccggcactcctgtcccaggtgtttcaccccagtttactgctgccagattactggttcctgctcctggcgtgctgaagagatttcttgcctcataaaccgtcggtagacgagattggtgccttctcctcataacgtcgtttgaagcgttctgatccaacatgagccggtaattttctgcttgaatctgctaccctgagcatccanagcggcctactcctcanccatcctggtttcctcagcagccatctcctcattagcctgagctatctgatctcgcaatttcctgacctctaca

SEQ ID NO: 37939 - DNA, 408 bp, Triticum aestivum
  Clone ID: PAT_TA_37939
cggcggcgagcgccggcggcggcgggaaggacaaggacagggacagggacagggccaggggctccgcggtctccttcacggagggcgagaaggtgctcgcctaccacggcccgctcctctacgaggccaaggttcaaaaaactgaaaatcgggaggacgagtggcggtatttcgtccattatcttggatggaataaaaattgggatgaatgggtcgcaagtgatcgtttattgaagttgactgaagagaatgttcgaaaacaactagagctgaaaaaccagtcaggggacaagaccgtcaggactggtggacggtcagcacagcataacccaaaaggctctaatgtggatgcaaaagccgataaagatgacaccaaaggtcttgtcaaggggaagaagcgcaagaatc

SEQ ID NO: 37940 - DNA, 427 bp, Triticum aestivum
  Clone ID: PAT_TA_37940
tcacctaacgccttgcttctagatactgaccttgtaactctagataccctacctggcgtgtatataagacaaaggttttatcctgtaggggggacatcaatgcaacatcattcaccttgccctagagtttgaccacatctcacgatctggaggtagatcaactctatactcgatacattccattaatataaacgagagaaggatgtagggttttacctccatcaagagggcccgaacctgggtataacaccgtctctttgttcttgtcaccatccggctgagatccatagcacggtcagccccctgcgggctttcatgttttgtccagtccatgcatctataacttaaaagatatggttctagtcctatgattaatcatgttagattggcactagtggcaagtatacagttttgttatcaatgatgc

SEQ ID NO: 37941 - DNA, 402 bp, Triticum aestivum
  Clone ID: PAT_TA_37941
aagggcgaggcgcagatctgccgagccgaggaggagaaggggaggaagggtggggagggagagagggaagaggagccatgcagagttgttgttggaggaggtcccctttgcttcttacaggacagcaaatcgcattcaagaagttggaggaggtgtatggcacctttgatgcgccttcacagaggaatggcttctttctgccaaggcccaagatgaccaacgctgaccttggcaggatcatcaactctgatgaggtgcagtctgtcgttaagccaaccaacaaggagataaagctcaggaagaagaggaggaacccgctcaagaatgtggctgcagtgctcaagctgaacccctactttggcactgcccgcaagatggctaccctcgtggaagctgctcgca

SEQ ID NO: 37942 - DNA, 431 bp, Triticum aestivum
  unsure (1)..(431): unsure at all n locations
  Clone ID: PAT_TA_37942
aagataagagtatcatcttaaagaagagcagaagagcaagcagattgaagatattacaagtctttcaatacaatgtcggttggccacccatgatgaaccagagcgcacagagaaatactattatttccggtctctccatatgtggctcacatgcatttcgaacctaaagtaggaacatttagctaaccaattaaacatctctcagttttactaatattagatatgaatttgtacaactaagcttgtttagctcgatgggtggagtagtgctattacgacacgaaccacgtaggctgattgtggtcatcataaaattgggaaaacataagcatgatgggtacagtgttaaccatggcagtgggatggcagatctgaagctgcaaaccgcgcaaagggtagttagcanccgatgttttctttgaaataacaac

SEQ ID NO: 37943 - DNA, 434 bp, Triticum aestivum
  Clone ID: PAT_TA_37943
aaccagctaatgtatgtaagacgtctgagctggagagataatttaaaaggatcatctgatgattacttgcattcgccacatattgagtcaacagactcaaaatgataatgacaaggaatgttaataagatttctatacttatgggattattcataatgaaagaaaacaagaaattccagagcaataggttgctgaggatttttggaatatcgggtggtatttcaaagacttttgtgtaacacataaacaactgggggatgagcggatattctataaatgcgagaattaaccgtaggggtattcaagtgacaagaacagcaaggcagtaagctcaagggattatcgaaaccacgacgagtttttcagggtatcttgtaataacaagaccaactggggatgatataagaataacaactgtaagtagttatccatac

SEQ ID NO: 37944 - DNA, 184 bp, Triticum aestivum
  Clone ID: PAT_TA_37944
tcgacgggggattcaatctaaaaaaaaaaaaaaaaaaaaaaaaaaaaaaaaaagaaaaacaataagataataaaattatatacaaatggataaacaaatatggtaacttctctaatgtgaggcagcattctcgtctcgagccttatttttacatggtcgcgaattggaggatcttctgttgtgt

SEQ ID NO: 37945 - DNA, 434 bp, Triticum aestivum
  unsure (1)..(434): unsure at all n locations
  Clone ID: PAT_TA_37945
atgtcagggtgcagcgatacgtcgccgctggtgacggcaagctctgtctccatgtccgcgccgtgctccggtgcttcagcagccccagcgtcgccactccctccgatggggcgctttggcggcatcctcatacactgacggcttcgaggactgagagcggcattgaggatgcaagcagacagagaggattgtgtgtgtgtgtgtgccgaggatggggggtgcggccgcttgggcacgccattaatatggagtagtgggagagaggcgggtcgcggtcaaaccgctggctcgcctcccagtgagcctgtgcaccggactgctggcacgcctaccatcgtttcacacagctactcgcacgcctcccgatgacactgtgcagcgagcatgcctcncatcaattcacacacctgcacgcatgcctcctggtctgcctg

SEQ ID NO: 37946 - DNA, 291 bp, Triticum aestivum
  Clone ID: PAT_TA_37946
tctacatcttcggggtgctcaagcaggtgcacgcggccatgggcatctcctctacagacatgtctcagcatgatctccttcatcaacgacatcttcgggaatctcgccggcgatgcggttactgtggccaggtaggggatgaagtccagtatcacatccagtgaaatctagagctccttgcgcctcgtcctccgcggcgacctcgccaagcacgccgtctcggacggcatcacagccgtcaccatgttcatcactaactacggttacgtcgcggtgtctctagggttccgt

SEQ ID NO: 37947 - DNA, 437 bp, Triticum aestivum
  Clone ID: PAT_TA_37947
ttctcttgattacaagaatttgatttacatatcattgatagaaaaggagctgagaaccccgtagctgataatttatctaggcttgaaaatgtgcctgatgacccactacctattgatgatagttttcctgatgagcagttagctgcaataaatgttgctcatagtactccttggtatgctaactatgctaattacattgttgctaaacatttaccacctagctttacataccaacaaaagaaaaaattcttctataatttaagacattacttttgggatgacccacatctttataaagaaggaatagatggtattatttgacgttgtgtacttgagcatgaacagggacaaatcctacggaaatttcactccgaagcttatggagggcatcatgctggagatagaactgttcacaaggtattgcaatctggatttta

SEQ ID NO: 37948 - DNA, 348 bp, Triticum aestivum
  Clone ID: PAT_TA_37948
ccgggtcgacgggcaattcaaaggggaggaccgtcaggtgtggtgtgaagagctgggttgtatatgcccacatgcgtcagtccatgggttgggcatacatgggtatcccaactaaggacatgtcaaggatgtccgctttgaccatcgacatctttaggaaactagcaggggcagcgtctgttcggttcgctgagttggaattggtcaacatcaactcgggcgaggtttattcatgcgtcttttccgactcacacggcgagctcgccaagcacgccgtctccgacggcagcactgcagtatccaagtttacctcatcgtacgtttcatctcacatcccttctatgatgt

SEQ ID NO: 37949 - DNA, 343 bp, Triticum aestivum
  Clone ID: PAT_TA_37949
gcagcggacggcgttgagcgggccggcgattccggggtcgcgggcgtcggcagaggggttggtgagatgcggtggcgcgagggggtcgtcggggtggtgttggagagtgttggtggcagctatcgtgagcgcaacaagctcgagaacctccggttatctccccgtgctccggcgatgcggacgagctcgttgacaaagctggagcatacatacgaggatggaacattgtcaaaacgatgggccacggcgagggcaagcgatttggtgaaagaagaagtcgcggagggctcagcggtgaagaaaaaatgatggtgaactgcgaatggccacagatggcaacact

SEQ ID NO: 37950 - DNA, 333 bp, Triticum aestivum
  unsure (1)..(333): unsure at all n locations
  Clone ID: PAT_TA_37950
aggaccgggctagcccccttctgtaagaccaacccagccccagcggtaagccgctgatctgaacattttatcttcttctgtagacacccttcacctgaatctttaagaaatcatcattgtatttttcaggctgatgacaaattctggaaggtcaaatatgaccatgaggtggccaagaaggccaggaaggctaagaaagccgccaagagagccgctccccgcaagaaaggaagtangcctactgcttcagagctgctgcaactaagcgacagctccgattcagaggtaaccccccaaaaaaaaaaaaggacaacaaaaaaaaaaaccggccgc

SEQ ID NO: 37951 - DNA, 394 bp, Triticum aestivum
  unsure (1)..(394): unsure at all n locations
  Clone ID: PAT_TA_37951
cgggtcgaccggtgagcggatggaaanggggcgagcgggacgggctgggaggcagatggggacccggctacggtttcacaagggggttacaaaagaagctttcggggatttaatactcaaaggtgaaatgataagaataactccgtgggggaaaaaattcacacggcggtggcccaaagatatttcaccacgctggatgcactaagtggagctatcggttgtgcctagaacttcttgaggctttctatgttccattttctggatgcatgcgagtttgactagtggttgattgactccacttctaacggcaacatcacaatagttttctagatgcatccgataatttatgacttaatttatgacttaaaacaacaacttcagattgagataatga

SEQ ID NO: 37952 - DNA, 377 bp, Triticum aestivum
  Clone ID: PAT_TA_37952
agcgctgccaagtccaaggacaaggcggcacagacctcggcgtccatgcgcgcaccgtgtccctctcaagaggcgcgggaccagcagcgtcatagcgttcgcagcgccatacgtccgctgacccaagatcaagctggtggttcacgtggcgttcaagaccagcatgcacggcagcatgctggctccagcgaggtacggtcgccgggatgggacgctgctccttctaacttggttaggagtccaagcacgcccctctcctcgcaccgttcacctctaccgcgcaccaccccagcagaagccttggcgcgggcccagctgctcctggactatcctcctacggtggacaagaccgacgaatggagggccactatccagag

SEQ ID NO: 37953 - DNA, 161 bp, Triticum aestivum
  Clone ID: PAT_TA_37953
attcgtgcggtcgacggggaaacagagcgaatcggtgatgggccttatcgcgggtctggcggcgtgctctgggaggctggggatgtcatggtagtgtagatccagacctacgacattcataggccgaagacaaaggaaattgagttgatgtaaagttgtgt

SEQ ID NO: 37954 - DNA, 421 bp, Triticum aestivum
  unsure (1)..(421): unsure at all n locations
  Clone ID: PAT_TA_37954
gcattgacacttttcgtgctaccaacactacataccagccagtccggaggaggccagcagtgccgacgacggctctgcgatggggaaaggtcgctcatcattgcggcaccagcagttccacgatcacattatatccgcgtgttgatgagcaacatgactctccgcccttcctccctccaggaagagacatgatcatatcgatcaccagtcatggagtcaagtggttgttgtcgtcaagctaaatgttggtgagtgccaaatgagaagatatatgttctaatattcctgagctggacattatggtaaaatattaattttagaaattttgccaatcataccggtctgtagctatatcacattgcaaaattccatgaacatgtggtccacattatttttcacattgcanaattccatgaacatg

SEQ ID NO: 37955 - DNA, 399 bp, Triticum aestivum
  Clone ID: PAT_TA_37955
ttcgtcggcctcttggtttacaatgggcgttttggcgttccgccgttccattggtagcttgacgcctttgccctgatgttagattcaacatccatgtgacactgattggggtttgccatctcgcggccctgggtatcttcatccatgacctcctcttcaccgtgtttggtccaacgtgtatatccatccatgaatccccgagagactaagttccactggacatctgcaacttgatgtgactctatattggcacaattagtacatggacacatgatgtaatccgcatcaccaattatccactttgtactttcagtcaaattcatgaactctgtcacgccattgatataatctgcggttttccgattcttcatccatcgagattgttccatctgcaccaca

SEQ ID NO: 37956 - DNA, 433 bp, Triticum aestivum
  Clone ID: PAT_TA_37956
tccaagaaagaatgtagaaatgaagttatccatccacacaatgtttatattatcagtttgtcacaatccatatgaatccaaacaccttatctttagatgataggtcgttttggttgtttttttggctgttagttcatatcttggcacgccgtgcctgggagtgttccttgtctgtaataagtccatatggaatcgttgacctggggtatggttctaacacttgcaatatctaaagagtatctctgtaaactctgcaagtctgatgcatgatcagcagataatcatagtttgtagtttacaggcaaactgcgattctaggaagtgatacgaacataaatgacgcatgcatgcgagaatcaatgctactcatgagctacacaccatttagcagcatcatgcttatcgtgctactaatgcaacctatgttttgaac

SEQ ID NO: 37957 - DNA, 407 bp, Triticum aestivum
  Clone ID: PAT_TA_37957
gggtcgaccgggtattcggtctattgtaaaataagataggctgacaagagcctattttaagcactttatttctaggtacgtgcaatttagtctgtcgtggccaaatgccaaaaacggcagtatcctctgtgggtatagaacccatgggatggttaaacaacaagaggcagtagataaggtttacacaggggcttaatctaaaaagaaacctattgcacggggccctgctgcacgtctacgcctttgtctcttttgtgccgtatcctggaagggtatcgctcgaatgttgtctgtaaaaaagaaaaactcgtaagagggtgcaacgtaagtatgcgttcaataataagagtgtaagttgttggcctgccaataaggtcgagccaagcgtggggctgtattaaatatag

SEQ ID NO: 37958 - DNA, 432 bp, Triticum aestivum
  unsure (1)..(432): unsure at all n locations
  Clone ID: PAT_TA_37958
cctgccctcagcttgatgccatcaagagcccggtctgcagcgaaggtgcgcagctggccttcgctcgtgtcaaagttcagtgggcgaagatggacgctgtcaagctcgcgaccgaaggaccgcccgcgggcaaggagcaccgcacgcccgagcagtattttgatgatgtcctgaagggatcccgcattgtagagggccagtgtgcaaaagacattatttttgaatgaagacgttcatgttatcccgtcctgtattatgaaacaaagctgatttgtaatataatgcttgttgtttgtttaagtttttgcctcctgtgcggccattttattaagtctgaaagttggccactcgccggcttcagcctccacgtaggtagtacggnggtgttcgggttggaacctanacactccttgaccaagagtttggtccttg

SEQ ID NO: 37959 - DNA, 394 bp, Triticum aestivum
  Clone ID: PAT_TA_37959
cgggtcgaccggagaggggagatacaggtttttggggagcacactcctgtgactgctgccagcgacgacttcctcaacgaaagccttcttccccgacctcggtaacctcctcatcaacgacatgagtgacaacatcaaccacatcggttctgctcccgctatacagtatgtgattctgtcctcctagtttagtccgcatcattactttgatgtttgcaattgtcgtcatgatctatttactgctgattcggattaaatctcatactaaattgctcatatattcaactatccaatccaaaaacctgattacaggcaatttactccgagtggttttgctgcgcttttgaagccgcctacttttaagggggtgcaatataaaatgtggcgcacaaga

SEQ ID NO: 37960 - DNA, 381 bp, Triticum aestivum
  Clone ID: PAT_TA_37960
gggtcgacggagtgaagatagaaaacatcttaatctggatcacaaaaatgtcattcacatgcaacaagcagcaaatgcagcagtaaatggtgctattggagcaactgcattgtcgtcgccttccacatctaggaagagaaagcacatcgattcttcacttgacctttcgaccaaggaacatttagctatcaggaatggtcaactatctcaggttatttatcagaagaacgcaatggcctccgatggttcacttccaataggccagtctgcgcatcctcatatgatggggccctttaaagtcacctacaggcctcttttagcggatattattcagccaggggatgtaaaggagctttgtaaacttttggtgacagtatcggg

SEQ ID NO: 37961 - DNA, 325 bp, Triticum aestivum
  Clone ID: PAT_TA_37961
aacagaaaatggttaatctcagcaatctcctcgttgtacacttcggggttctcctcgtccttaacggctgccttgcgacgcagtcacttggggttcctcctcatctacagaacaagtgtcaactcgataacttatatgttctctaaaccaccgaacacttcactagtgagactggtcacatccactaaggtgattataaccacactcagatccgatctgttggtgtttctgtagcacgccagtctgcttcatcatcagatgtctttacttgttcaccttcttcacttcgccacttttttccgatatcattcatcgaacggatatc

SEQ ID NO: 37962 - DNA, 371 bp, Triticum aestivum
  Clone ID: PAT_TA_37962
gaggagatggtgatggccgtcagggtcgccatcgtgtgcctctcggagctgcccgccgatcggccatccagcgatgaactcgtcgcgatgcttgcccagctccacagcttctagccacctccatcatcgttctagcagaaagtttcttcagaacatcttccatcgcgccagacgacgccgaatggagctggatcggaccccggccggccatacagtcccaccatttcagcttcttgagctgaattcagtttgtccagatgggaaccagcaatgtagaggccgaacaacaagtgtggcaaaatagcttcatggcacatgctggtggttgaggttcatgtaagatgatgatggtgatgttctggccatgaatg

SEQ ID NO: 37963 - DNA, 387 bp, Triticum aestivum
  unsure (1)..(387): unsure at all n locations
  Clone ID: PAT_TA_37963
gggtcgacaagattctagcatttcaagcctgaaaccttgagcgcttttagatcgttgatggtgtccatcgtagagaaattgtagtcagagctgttgataaacctggagaaacgctcgcaaggccttctggccaggtggtattggtagacaaggacgtcatgtcgcacgcacaactggtcagcgacaccttctcatcgtgcccggcacgaccgatggtgtactccaggtcgaagccgaccacttggtacttgtcctcagcaagcaactgttccatagtttggatggagctctccaccgagaccggctcgttcgtgtacaccaccaagagcgccttcncactcatgtgggtgtccactatgtgatacgtggtgaactgccacccgttgt

SEQ ID NO: 37964 - DNA, 261 bp, Triticum aestivum
  Clone ID: PAT_TA_37964
gtacttcaagatgaagaatttgtgctggaggcacacaactatgagatggaaccattgcttgtaccggaagggtatgtgtttgtgctgggagacaaccgtaacaacagcttggactcccataactgggggccgctcccggtgaggaacatacttgggagatctgtgttccggtactggccaccgtctaagataaccgatacaagatactaccaacccgacgcggcactctacgcggtggggatgtcgtgacgactcgtgcct

SEQ ID NO: 37965 - DNA, 388 bp, Triticum aestivum
  Clone ID: PAT_TA_37965
cgggtcgaccggtcacttaaacggacttaactaattacatgcataattaatgtctggctaattaattacattaattgcttgatttccaaattgattgggtgtttggtttccaaattgttttgcattaatgactggtgatgcttttaataattaacgtgatcctcctgtttaagtatcagtaatatttttaataattaatgtgatactcaggtccaaagcaaataatactcttcgtaattagcatgggcctttggttaaacactcgatgatacttttatacttccttcgttcctaaatataagctttctgtagatttcactatggactatatacggttatatatatagacgtagtttagagtgtagatacactcattttgctctgtatg

SEQ ID NO: 37966 - DNA, 394 bp, Triticum aestivum
  Clone ID: PAT_TA_37966
attcgccggtcgacgggctggattagaagggtacgtgtgggcgcaaatccaattgagcggccaccctgcccaggcagggtgggagcgcttgagaagactatcaggggccttgtggacagggagtgggacgaagtagtgaagccagagctagggacaaatttcgactcgctgacagaggctaacgatttttaaacttatattcgtgggagcatggcttcggcattagatacgggaaaaacaggctcaatcctgatagaaggaagaccatgcaggagattgtatgtagatgctcggggaagcctctccgtgagaatacaagatcctgtaggtgtgagtgtccagcaatgattaggctgttgagggcatcagataatgggtatccagatttacacct

SEQ ID NO: 37967 - DNA, 354 bp, Triticum aestivum
  Clone ID: PAT_TA_37967
tcattacaaacatatactacctccttaaccaataaaccatgcatattaatggatgattagttcgcaggggcagccatgttctcgcgcctcgtctgattcatgcacacaggggactgatcacaagccaactgattccattaatttgctggctcgtcctaaatcagaaaataaaataaaaaaatagcactccaatacattgtggagttcaactcgtcgaggccagggtgccgcttctcccataatacgcagggcaccccatcgatccattttttagagcttgtgaatcatctgagcttatatatagttagctgaatgaagaagcatcatgcatatgcatgcaacgtaccggcagct

SEQ ID NO: 37968 - DNA, 311 bp, Triticum aestivum
  Clone ID: PAT_TA_37968
ggagctgatggtgccgcacgccatcggcgtgtactcgctgggggaccgggagacggcggtggtggccatcgcgggcgggcactccgtggaggtggagcccgtgtggatcctcccctcggtcgcctgatccgaccgaccccacgcacccaccggcgtgcaagaataaataaaccgagcccacgccttattcggatgttagaactgtggattgctgtgcgtgttgttttctctgctttgttcatgggattaattggtgatttgggtttctacgcaaagaccgctctgtcccaaaaaagaaaaacatggttaat

SEQ ID NO: 37969 - DNA, 400 bp, Triticum aestivum
  unsure (1)..(400): unsure at all n locations
  Clone ID: PAT_TA_37969
cgggtccaccgggggccaaatatagaagagaggatctacttgggaagaaagaagaaaggaggagggccaaagtaaaaaaaagatagatcagggagggggtcaaaatccctagcactgctccattcccaaatcgagcctggcatcttcatctccctcaccctccttctataccttcggccaccgccatggccaggccggcatggtggtgcgcccccgtagccatccatccactcatttccatccaccactccaccatcaccctacaccaccagcacccccaccatcattccgcgccatccatccaccatctccagccaccgacgcatctggcgcgaccgaccaaacagcccgtctggtgtcncgcgtgagcgcgccatccaccactcctctgctctctgcc

SEQ ID NO: 37970 - DNA, 381 bp, Triticum aestivum
  Clone ID: PAT_TA_37970
aggaggtagccaggcgggctgggcttgtggtgggcgctaggtaagttccaggtgagtctctgctttttccctttttctttctcttttctaattctgacatttgtttctggacttagtaaaaatggctaggcactttcaaaaatcatgcaactaactgaggtcactgtttggaatatttccaacagtaaacatttcagtttgtgattatttggacatttaaaatattttataacattcaaatgcccaaatgcaaatggagtatgatttaatttagagcccaaatatgtcatgaaaaaatgcgcatcacctctggttactgtttccagcattttccaaaaatgatgaacatttttgaaagccatttggatttactgaaaatat

SEQ ID NO: 37971 - DNA, 381 bp, Triticum aestivum
  Clone ID: PAT_TA_37971
gggtcgaccggataggaggttcttctgaaaatgacaaggcgtacggtggatgggaatctgttgctgggcttagtgatgttattcagagcatgaaagaagtggtgatactgcctcttctatatcctgaattctttagctctttaggtcttacaccaccaagaggtgttctgctgcatggtcatcctggtactggtaaaacacttgtcgtacgggcactaataggggcatgctctcagggtaacagaaggattgcttattttgctcgaaaaggtgctgattgtttgggcaagtatgttggggatgctgagaggcagttaagacttctattccaggtagctgaaaaatgccaaccttctatcatattttttgatgagatggatg

SEQ ID NO: 37972 - DNA, 422 bp, Triticum aestivum
  unsure (1)..(422): unsure at all n locations
  Clone ID: PAT_TA_37972
gcttcggatcttcggggtcgcaaggaagaagaagagatgaagaggcaaggggagaatggaaaggacccccggtcttatttataaggacaaagggataaatgacaagcgcgagaatcgaggagccaaaaatcgaatatctgatacaggtgtcgccttggtcttcggtaattaattaataaaagaagtatttataggttttttatacagagatgatgtcatgacgatttgctgcaattttagaagatgacgtcatggcggtttaccaagctcatatggaagagacgtcatggtggtttaaaagggttaaaagaagatgttcaaggaaattttccaagtaatgaagattgacatgaacaggttcaaatcaatctggggcctaatgttggggatantactactaagtttaaaccgccaggaggggc

SEQ ID NO: 37973 - DNA, 437 bp, Triticum aestivum
  unsure (1)..(437): unsure at all n locations
  Clone ID: PAT_TA_37973
cacggacggaggacagagcacctctcttcttccaggttcttctccttatcttcacttaatgtatgtgcatgtgctgcagctcacccatggtcttgtttgtcttgcaagttagtgagcagcttcaggaggagctcaagcacgaccaccaagaggcaccaccgcagcaacagggcgactgtggaaggcatgttgtatttctgtcagcccagtcctgactatgtctgtccgtgagtccgacatttgattgctgttgaagcagctccatgctgaagaagagaacacttgtagagcttgtaacattacttggagagcttgtaaagtactgtagagcttgtaaagcattgtatatgttatagcttgtattacgtgtcattcgtanagcttgtagtgaatctggctaatggtaattggataaaccaggtgggttctcgcttccc

SEQ ID NO: 37974 - DNA, 368 bp, Triticum aestivum
  Clone ID: PAT_TA_37974
ttatggatttaaccatatccccatgatgcctactgagatggtctctccaaattccgttcattctgacactgcaagctctcatcaacaagctatactgcatcaaatgccttcaccccatggaatggctcagtaccaagtgaggcaaactaatcccaataatccgcttgaaggcgaaggtagtttaagtggcaattctaggcatcggggggatggacaagtgctccgtgataaagttgcctcaattgcaactggcggtgttgcaaactaaaatggcaatgttgaaaaggataatggattcactacggttgaacccaaccaagcccggctatcccgaacaaaggatttatgccaaaattggttaacccaaa

SEQ ID NO: 37975 - DNA, 440 bp, Triticum aestivum
  Clone ID: PAT_TA_37975
cgacgggtgccaagtagaaccaataggatcttcttgggtgataattatttgatcttgctgaaaaagacagaaactttgcgctcacgcaaataattattaaaattcaccagaacgtgataaattgccaattctttttgcagtagatcaatatacaaattttacaggttttagaagtttttcagaatttttggaattccataagtattcgaacaaatcagattgctacagactgttctgtttttcgtgtgttgtttgcttattttaatgaatctatggggggtatgaaccatagagaagttggaatacagtagatttaacaccaatataaataaagaatgagttcattacaatactttattgtggtggtttgttttatttggctaacggagctcatgagattttctgttgagttttgtgttgtgaagttttcaagtttttgg

SEQ ID NO: 37976 - DNA, 396 bp, Triticum aestivum
  Clone ID: PAT_TA_37976
cgggtcgaccggtccgatttacaatattagttttcgatctactattttgcaatcttttactttccgatctataaaccaaaaataccaaaaatatttactttatcgtttatctatctttgtcagatctcacttttgcaagtaactgtgaagggattgacaacccctttattgcgttgggtgcaagttgtttgattgtttgtacaggtattcggtgatttgtgcgttctctcctactagattgataccttggttctcaaactgagggaaatacttatttgtactttgctgcaccaccatttcctcttcaagggaaaaaccaacgcaagctcaagaagtagcaccatccttcttatccatcaagtatttggggcagttccgcttccagcgaccattccc

SEQ ID NO: 37977 - DNA, 403 bp, Triticum aestivum
  Clone ID: PAT_TA_37977
ccgggtcgaccggtattggtaaaattacacttactgatttcagtcttggagaacttccaccatatttgcgtacgatgagagtcgtcccaagggatctaaatgaactgtgggctttcgaatttgattttgaatattgtagtaaaataatactgaatgctgaagcaagacttgaggttcaggaaccagggctgcaaaaagacataatgagaactactgtcgaagcagattctaatggcaaccaatttggaccttcgcaacttttggcttctgtaatggaagatgaagatgaggcagatgtgttaaggcggtcaaagaaaactgggaagacatcaaggtggaaaaatatcttgcattcaatcactgaccatgtctctcaagtgccgttttcgttggcaattaaagt

SEQ ID NO: 37978 - DNA, 331 bp, Triticum aestivum
  Clone ID: PAT_TA_37978
gactctaagcaaaggcagggtacagggtggtgtcaagggatcctgggtgggtcacctgggttgggaggaggaggcgtgttctcatgataaaagacttgccggttcatgatgctcagatccaacagcaatgacatgcttgtcctagtaggtccccgtatatatatgtcccctgctaattccttgcgtctggtgtaactatgacattttttttggggggtttaatcattgtgtagcatgaattggtgctggactaaaaaaaaaaaaaaaaaaaaaaaaaaaaaaaaaaaaaaaaaaggtataaaagttaaacacaacaataaaaacaaaacat

SEQ ID NO: 37979 - DNA, 402 bp, Triticum aestivum
  Clone ID: PAT_TA_37979
aacaggaaggtgcgagcggcgctgagggaggctgagaggaaggtgctggaggccaggaagaagaaggacgctgctccggaaaccaatgcggcttacttgggtgggtttgcgatgcccaatgacccagctgagcagctcaagcacaggggataccatatggttgcaggtgcagtggacattgggttgttccggaaggcggcattggaggatgtcaagcggttcaaggaggcgtcaatggagattggtgaagcagagggcgaggaggaggatgagaaggaagatggatactggagtgaatgagcactggggaactggtgatggcttcatttgtttgtgttctgaattgaagcttttagggtctccattttctggactttggtgtactcttgtttagtcgatgat

SEQ ID NO: 37980 - DNA, 435 bp, Triticum aestivum
  Clone ID: PAT_TA_37980
tatatacatgttatataaaaaaaatattagtaattataaaaagagttaaaaaattcataaactttttcggatttttttactttcttttgtagatgtataatttttttaacgaaatcaaaactcccattgacatttgggcgaataacaatatcgtaattacaaaaagagtaaaaaattatgaattgttttggaactgaattttagtttttttgtagttgtataaaaagttcggtgaaataaacacccccattgacttttgggattaaaaaggaaaatcataattacaaaaagattcaacatagtctgaatatttttgaaaattattccactttttcgtagctatatagaaagtttggaacaaaattcccattgatttctgggcgaaaaaacaaaatcacaattacaaaaaagttaagttttttaattttttggaaa

SEQ ID NO: 37981 - DNA, 398 bp, Triticum aestivum
  unsure (1)..(398): unsure at all n locations
  Clone ID: PAT_TA_37981
ccgggtcgacaacacaacggaactctcaatgaaagcaccaatgtcggtgtcaaaaccggcagatctcgggtaaggggtcccaagatgtgtgtctaaggatcgatggtcacaatggacaatggggacacgatgtttacccaggttcgggccctcttaatggaggtaaaaccctacgtcncgcttgattgtactcgatgagtattggggttagaagagttgatctacctcgagatcgtaatggctaaaccctagctgtctagcctatgattaatctgatagcctctacagactaaacccccaggtttatatacacaccggaggggcctaaggttgtacagagttggtttgcagaggaaggaaataacacatcggaaaccaaacttgccaaccacgcatat

SEQ ID NO: 37982 - DNA, 340 bp, Triticum aestivum
  Clone ID: PAT_TA_37982
ttcggcgtcgacgagctcagatgattgaatttaggtcaacctgtagcagaacgttttcgtcacgttcacgggtttgactacaaggagaccttcgcaatactaatgatgcttaagtcggtcggaatcatgttagcaattgccgcattctagattataagattttgcagatggaagtaaagactgcattcctgaattgatttcgagtccaagacttgtacatgatgcaacctgacacttttatctatacaaaggatgctaacagagtgtgcaggctccaccgatccatttacgagccggtgcacatcatctcggtgttggtgtacacgttctgacaatgtga

SEQ ID NO: 37983 - DNA, 134 bp, Triticum aestivum
  Clone ID: PAT_TA_37983
ggccttcccccgcaggaaagcatcaagcgcgctttcctatttggggtaaagattggcgctgatggtgaaggtaccacgagtgccatcctccttagcggacaccttctttgtcacaggtggatctgccatcgcct

SEQ ID NO: 37984 - DNA, 406 bp, Triticum aestivum
  Clone ID: PAT_TA_37984
gagcgcccacaaaggattcagtcccatcgagaagaaattcataaggttgctacatgattgtaatgtcggtccatcaagaatggtccaaatactgtccctgatccacgaccgagatgggagcctgagtagcatgccctacataccagcagacgtcaaaaacctaaaggcaaagtaccgtagagagagcaggttggctgacatagaagacacaatagcctacttcgaagagaaagcaaaagcagataatgatttcttctacaggataaggttggacgatgaggaccgtgtcaggaacatgtattgggtggatggtgctgcaagaagagcctacaaacatttctgtgattgcatttcattcaatgcaacatatctcacgaatatgtacaagatgccccgtgctccattc

SEQ ID NO: 37985 - DNA, 406 bp, Triticum aestivum
  Clone ID: PAT_TA_37985
actgcctgctccctcctcccgcgaccggctatgctgctgcgtagacctcaccgccccaccgtactcccatcgctgacctagccatccctctactcatccacacctgttgttattctccggggacggcagacgaaccagtaaaccctcgtactcctccacgtgggaaacaactactgagtcttccctggctccatgtcgttcccttcctaggcctcgccgtcgtccaccgccctggtgctctcggtgtggcctggtcaacatggtcaatgaacgacatccatcggaagtggactgtacgtggagaggctgacagctgggtccacagccgcacgcaaggaaatgcctccttattacgcgcaaaataatgattccctcactgtcggatgtggggttccggcaaaaccct

SEQ ID NO: 37986 - DNA, 302 bp, Triticum aestivum
  Clone ID: PAT_TA_37986
attcgccggtcgacgggactacattactccctcgtcggacgaccggctatgctgctgtgtatacctcaatgcgccaccgtactcccatcgctgatctatccatctctctactcatccatacctgttgttattctccggggacagtagttcaaccactaagccctcgtactcctccacatgggaaacaactactgggtcttcactggatccatgtcgttcgcttcctaagcctcgcgtcgtccatctcactggtgatctcggtgtggtctgtccaacatgttcaatgagcgacatccatcgga

SEQ ID NO: 37987 - DNA, 403 bp, Triticum aestivum
  unsure (1)..(403): unsure at all n locations
  Clone ID: PAT_TA_37987
atccccgcctcggcctcgcctataaatagagcctcccgagctcgtttctctccacacacgctctccacacacctccacaacaccgtaggaagccgtagcccggccgggtaggcctctggccgccgttctcgccccgagctcgcacgcgatccccgtccactgccccctccctctctagagccgcttgagctctactgacttgtccgacgtgtccgtggtggtccactggtgcttgctggcgctgttggagctattggactggacctacctcactggaatcaccatctccgacgagctcgttgtcgtgcactcctctccagagaaagcgccgccaccgcgccgcccaactctgcttctctcccctcnccctccgacttgattgctggggctcgctgtcagccgc

SEQ ID NO: 37988 - DNA, 413 bp, Triticum aestivum
  Clone ID: PAT_TA_37988
gggatatggtacgcgtgagctaccaaggaagatggcgcgggcgggcgagcagtgagcgggggtaaatggtgtgcggccgacgatggggaagagaggaggaagaagaagagactagttgaatagttctctctgaccgagatggggaataaatggatcgcaaggacttactttctacagtatccctatgcatctacgctcacttcactcattttgctctgtacctagtcacttgttgaaatctgtagaaagacaaatactccgtatttgggaacagagggaggcttttactccgtactatttgggaacagagggagtatcaccatatggagggaacagaggaagcttgaaatatgaacatgtcaatgggagggattaagccccatgcatgcatgcatgcatgcaacatgcaacac

SEQ ID NO: 37989 - DNA, 417 bp, Triticum aestivum
  Clone ID: PAT_TA_37989
cgggtcgaccggtgaagggcttggggaggcttgaggactgcgagggagctcgggacgggcttaaatagccgcagggatgagctctaggggaggggaggaggtgacacgtggcacggctacatgtattgcgccggcgatgtgcacacgcggccaagggtcacgggaatggcgggaaggcaacgagggggatgcgggcgaggcgcgggaactcacggagacgagggccgctcgcggacgagagggagaaggggacaagagcgaggaagacgacggtgcacgggcgtgcactgtgctcggcgacggcgatggctcaacgaggaagcaaacgaaggggaaacgggccaaggcgcacggcgacgatgaggctgagctggttgataagcttggacgagccagagccagccgaagatgcgctac

SEQ ID NO: 37990 - DNA, 147 bp, Triticum aestivum
  Clone ID: PAT_TA_37990
agacttcgagagatgtgtagaagaagaccagggcgctcatgggcctgctcggatgggcaagtgggccataatggaattgcttcttccaaaaatcatgacgtgctacaatattgacatgaatgaatgctcacggacccatctcacgcc

SEQ ID NO: 37991 - DNA, 392 bp, Triticum aestivum
  unsure (1)..(392): unsure at all n locations
  Clone ID: PAT_TA_37991
cggcgggccagatcgaggaggaaggaggcgaagggatcgggatcgggcagatgagaggtgcgcgaggggatctagcagggctcgtgcgaggagaagcaagaggagaggtggcgcggcgtacgggagagatgggatcgagggaaaaagtgggatcgagggagagggaggctgcggcgctggagggaagagggagggagagatcgacaggaggtctcccctggcgctagggttagagggaaggagtgcggctgggcttccaggggtttgctgggccggcctggaccaagggaggtttgggccggactgggctgcagatgggccggccagcagctctctctctctctctctctctctctctctctctcttaatttctcttttcagcanaagagat

SEQ ID NO: 37992 - DNA, 275 bp, Triticum aestivum
  unsure (1)..(275): unsure at all n locations
  Clone ID: PAT_TA_37992
ctcacggcaacagcggagaggtagctacggtgcgcgattggtcaatgaaaaaggagaaaggaacggagaagctcaccgtgcggctcacacggtggcccttgggggtttagtagctgcggnggcgtcgccngagttggtgaagaacggcggcgaccagagaagtggaagaaggggaaccggtgcagcaagacctccgagctccagctgcggccaccggtcgacaaggaagatgatggcggagatgacggacacgttggcgaggcgaggcgatgggg

SEQ ID NO: 37993 - DNA, 424 bp, Triticum aestivum
  Clone ID: PAT_TA_37993
acaggccatgtcatcctccgccccaaagcagctagtggcagggcctacaactgctgaggacgcaccaccggttcagatgccggccgctgaagcagcggggggagacccagctgcagcacatgctcagcagaccaacctggtggaacagactgctaagcagtctgatgcttcggaaccgcctactaagcagtctgtaggtccagaaccgaccgctcatcagtctgttggtccgcaggcgtgtgaccagcataccaatgcgtcagcacttcctgctcagcaaaccaacgcgttggcacggcctcctcagcacaccgacaagttggcaccaccttcgcagaaacccgacatagcttcaacgcatggtcagcagtccgatgcctggctcctacagcccagcagtttgtcacagcagcaccgccagctc

SEQ ID NO: 37994 - DNA, 341 bp, Triticum aestivum
  Clone ID: PAT_TA_37994
cggtcgacaattccgggtcgacgggcgtggtcagcagcggattcgacactattcttttttctgctttcctctgcttctattctcttttttggcatcgcctctattcttttttttcttttttgcagggttggcatcgcctctattcgaaaagccggagaatagaatgggggatgttctgtaatggtttttgatatacttaagtacataatgcatgcagatgaaccggcaacggatgcacggtgaccgaacatctatattgagggcctgcataattttctcgaagtggctgagacaaacaagcagaatggttttatgtattgtccatgtactgtctgtggggc

SEQ ID NO: 37995 - DNA, 427 bp, Triticum aestivum
  Clone ID: PAT_TA_37995
gggtcgacgggtctgcaacatttagatctgtatgtattttgcaaatctctttgtctccctccttgacttgatcgcggatggaattgaagcgtctcttgatgtgtttggttctcttgtgaaatctggattccttcgccaaggcaattgcactagtattgtcacaaaagattttcattggacctgatgcactaggtattacacctagatcggatatgaactccatcatccagactccttcatttgctgcttttgaagtagctaagtactccgcttcacacgtagatccctccatgatgctcttcttcgaaccgcaccaactgacagctccaccattcaatataaatacgtatccagtttgtgacttagagtcatccggatcagtgtcaaagcttgcatcaacgtaaccatttacgacaagctccttgtc

SEQ ID NO: 37996 - DNA, 125 bp, Triticum aestivum
  Clone ID: PAT_TA_37996
aggtcgcaggcgacgagaggatgatccggagaccagaggaggtagagtaggttacgcgcgggcgaaggggttcggagaaatttccaaaattttatatataacgaccctgtcggtgtgaccgaggc

SEQ ID NO: 37997 - DNA, 227 bp, Triticum aestivum
  Clone ID: PAT_TA_37997
cgggtcgacgggggaaaagaaatcagagtaaagtagcaagctgcagcgatgtgtatatttcactttgtccaccccagtttccctcccagctgggctcaatttaccatgtaatctatatgtagcttgagtgatgaattttcaagtttccatgatacccgtctctagtgggatgttgtttatgtgaattaacctatcaaatatgagcattgtgtatattgtgattcttg

SEQ ID NO: 37998 - DNA, 396 bp, Triticum aestivum
  Clone ID: PAT_TA_37998
tgttcctctgtgcgtgaggagcgctctgtgattccgctaacggtgatgacgccacgtggaccgggcatcttgagtgtaaggtagccatagtgcggcaatgcgttgaaccgggcgaaggccgttcttccaagcaatgcatgatggtcgctttggaagggtgcgatgatgaagagtagttcgtcgcttctggagttgcctggagagccgaatgttacctctagtacgaaggagcccctgctgtaggcttcaacgcctgatatcaccccttcaaaggtggtgttgctttgactaattctggatgggtctatccccatcttgcggacagtgtcctcatatataagattgggactactgccaccgtccatgaggacacgggtgagacggtatccgtccaat

SEQ ID NO: 37999 - DNA, 400 bp, Triticum aestivum
  Clone ID: PAT_TA_37999
ggacacgccttcccatcgaaaagagcaaaccacccgcccgcccgtgccccgtaacctaggaactccgccgatccgaaccccccaaggccgcagcatccagagcttcttccccgtcgcgccctcgaagaacccacaaaggaacgagtgtgaatgttctaatgatgtcaaaagccggcaagaagtctagtagtagtaattccatgtacgaagctccccttggctacaagattgaggacgttcgccccgccggaggaatcaagaagttccagtctgctgcctactccaactgcgcccgcaagccctcctgatattcccttcgcatgcctctcgacgtagcttaggatttctttactgcaatttccctttccctttcgtgcaataattctcccttggctggctg

SEQ ID NO: 38000 - DNA, 320 bp, Triticum aestivum
  Clone ID: PAT_TA_38000
ctttagtaccggttggtaacaccaaccggtactaaaaggttaaggggtttgggtttaagaattaattttccgttaaatttggggtttccatttaaattttttaattggcgggaatttaacaaaatcaaaatgtacacgttatgcaaatatataaatagaatttctcgtagaaccggttggtaacgccagccggtttattctgctaatattagcagaataactattctgataacacttccgcactgcacgcttaacgtaagtgcacgtcattgtttgaaccaagtgtgctgcactactcacacgagtgaacttcccgtcgc

SEQ ID NO: 38001 - DNA, 405 bp, Triticum aestivum
  Clone ID: PAT_TA_38001
ggagaggagaaaaatatttttcttaaatgaatctagtcaaaccaaaaatattgatttaacctgaatcggatgatttttggaggctctatgggtctatatttataggtggaaaagaggtttaggggtcaaaggctaggcaatgtgagactaaacgtagacgaaatagaaaagaaacagaggaggcgggtcgcatgggcctaaacgcgtaaggcggttcggccggccgcgcagctgcagtttttttttaaacaaaatttggcgtaaaaaaataaaaaggttggctgggcctggcccatataggaaaaaaaaatggggcgcccattggtactatgatgtgcacctgggcggcagttagtgatgggccacatgtatagttttttcaatagaaacagaaggaaaagagaa

SEQ ID NO: 38002 - DNA, 409 bp, Triticum aestivum
  Clone ID: PAT_TA_38002
agcgacggctacatgcaggccatgtcataggttaattaagtggtccatccccaacccctctgcttcaactgccatcgatctcttcaaaggccccgccgctaatctcccccgccatgcggtcaaggatttgcaatccttgtacgccatcgatcccattttgtccttcccgaaggacgcattctacaacggcggcttggaatcctcaattatcaagtcatatctcatcgaccacgaccacgaggagggcacccacaaagcgtcttccaaggtgaaatagcccatctgcgacatcagagagcacaccattggtttgtgctcttctaactggaaggatcccgtccatgacaagttaggcaatatcctatcagcaaatattactttttctaagctagccaaccgcacccttttg

SEQ ID NO: 38003 - DNA, 354 bp, Triticum aestivum
  Clone ID: PAT_TA_38003
gataagtaccgccaccacggcggcattgttacaaataacagatgcaaccagcgcacggtctcaccaacacatcaacagacgatctcgactcgaagtcaccatatgtcggtgtacgggcccgcagatcgctaatgaggggtcacgtacatcacctcgaatgttcaagggaccaggagacaggggacacgatgtttacccaagttccggcctacatgatggaagtaaaactctacttccagcctaattgatatcgctgcaaaagagtcacacaagtactgatcaatgatcgatcatcttaaaggctaatccctagaagtccacccggtatgactatgataacctcaatggactaaa

SEQ ID NO: 38004 - DNA, 341 bp, Triticum aestivum
  Clone ID: PAT_TA_38004
gtaatggagggcggagtaatgatcagcgttgaatgctgctgtttcatgtgcagtagtggctgccatttcatggtggcgagtagaagggaaggcggcgaagggagtagaagacagagcggtggcagcgagcggaagagaaagatgaagcctcatagacctagtacgatgagttagatgggctaacaacatgaccaaataagcttataggcctgccttttacatgggatagcatggacaaccaacgggccagaagatgtcacacgtagtagaacagttgggcttcttctataaaatacactactaggctgggagacgatgtgcataaatcaacatacgtttgt

SEQ ID NO: 38005 - DNA, 111 bp, Triticum aestivum
  Clone ID: PAT_TA_38005
ttcatggtctcgaaggtagattctgggtccgcactcggtttgcgggctgtacgcgcttgcaaccggcttctggcgtggtatgcaccatgcacgccttctccgcgctggtgg

SEQ ID NO: 38006 - DNA, 260 bp, Triticum aestivum
  Clone ID: PAT_TA_38006
gggtcgaccggggtttacaggccagtcgttgggttggtgtgccaccttcttgtgttgttggtactcaagctgtgacgtctctgatgaaatatttgagcgggcgatcattcttcacgagattaccgggtccaacgagatggatcgttacgtgttctcttgcagttttatccgactggatgaacgtatccaaaatgccagcacctggctcgatagctttataggcacatcctacagcagggtgccaatatttgagcacttct

SEQ ID NO: 38007 - DNA, 327 bp, Triticum aestivum
  Clone ID: PAT_TA_38007
tcgacggggaaggaaagggtgatgctgccgtcgcttctgcctccagtgtgccgtgtagtagaccggccaccgccgtcctgcaccttctcctcaacggaaacgaaccagagcacgcctggaagcggagtaaatccacgtccgtcgctctactggatgtggattgggtcccgtgaatcatcgtcactcagttgatccggaatggagctcaaaactgagctcaaaatgtcaggaacggtgcggccgtgcagaggccgggtcaccatagggcacaccggaggcaatggcgcaggtagtaataaacactcatacatcgcagtcgtggtcatg

SEQ ID NO: 38008 - DNA, 404 bp, Triticum aestivum
  Clone ID: PAT_TA_38008
ggtttgacaaactattcatctttgaattagacaaggaccttggtatttcatccatggagtgtataattgactctatgggtgagttaggtggaatacctcaatcgttgtcggaagagaaggcgtatatgataagggggtatctagttgaatgtggcgatagactgttgatggtgaaacggtggattcatcctattgcccgttcaacaagtgatgactttttcgagcataaccgtactgttgcacttggggtttttgaggcggatttgggcaccgatcctgctggatggagaacagtaaatgatttggatggccatgcactctttcttggccagcatagctccaagtccctgcgcgctggagaatgcagttggatacaagaggactgcatctacttcatgtgtgac

SEQ ID NO: 38009 - DNA, 391 bp, Triticum aestivum
  Clone ID: PAT_TA_38009
cctcgacaaggttgtcaagcccaatgttgtgtttcttaaggagtgcgggctagatgattgtcatattgccaagctgtgtatccctgtaccgaggatgctcgccaccaacccggagcgcgtccgggcaatggtggcatgtgctgaaagattgggtgtacctcgtggcactggaatgttcaggcaagcgctacgggctgtcgcgtttctcaacgaggagaagattgccgccaaagtgaactacttgaagagtacgttcaggtggtctgatgccgaagtgagcattgctgtgcgcaagtatccgattctgctggagaagtcaaaggaatctctgaagcgcaggtccgagttcctgttctataaggtgggggtggaacccgtgtacattgctcat

SEQ ID NO: 38010 - DNA, 218 bp, Triticum aestivum
  Clone ID: PAT_TA_38010
cgggtccgacgggtccggaaagcaaatcaggctgaacccgcccttggagcaataattttttcaatttaaggaaggattcttcctggggaagtaacccctttttttaaaaccctgaagaatactccggtcaagactggcgggtacaaaacaagttgaatggaaagttgattggtgttaggtttcaatttcatttcatggcatatatgtgattcgtatgc

SEQ ID NO: 38011 - DNA, 215 bp, Triticum aestivum
  Clone ID: PAT_TA_38011
agtagagagatggcaattcatgctggtagtgctataaggccacgccagggtttgtgacattgctgggtgccagtatgtttctaccattggcccttgtaaatccctttagtgaaagggtcgtggttattagaatagagatcgtgcattgcacgtgcaagtttggtagagacgtgcattgcacgtgcacatttactagtaaaattaaattatcttat

SEQ ID NO: 38012 - DNA, 242 bp, Triticum aestivum
  Clone ID: PAT_TA_38012
gatgtggacgactacggatatacaagcttcctagatgactgaaaatgaaacccttatatcatgaaacaagcactcactcctattgtcccatgacagtgctactgcatagaatcctactatcccacaaggctcacagtgccatttgagaataacctgaggctggacggatttagaattcctcctgcgtctgatgacacggtgaatgcaataaacaccagatacatcaaaactatgatctggaa

SEQ ID NO: 38013 - DNA, 459 bp, Triticum aestivum
  Clone ID: PAT_TA_38013
acgggtccgtactgagagaagtatcaggcgcgttactcaggcagttcaggttgtgatcagaatattattctgatcccgtgatcagaatagtgtttatgtgtgtgtgtgtgtatatatatatatcatgatctttcaaacacaaagagcttgccataggattaaatgaaaaagggaaaggtgtggatcaccttgactcaagcacaaagtaaaaacataaagtaaaagataggcccttcgtagagggaagcacaggttgtcatgtgcgttttgggttgatgcacaaaatcttaatgcaaaagaacgtcaatttatattgccccttgtatgtggacctttattatgcagtccgtcgcttttattacttccacaacaagatcatacaaagcttattttctctgcactaataagtcatacatatttagatagcaatttttgttgcttgcagcatgacaacttact

SEQ ID NO: 38014 - DNA, 436 bp, Triticum aestivum
  Clone ID: PAT_TA_38014
aggccacttcccgccgactctcaggtatgctacctcttttcgatccatacccttgttcgattgccccatctgccatgtcgctgcatgtggatctttttccactccaccatctacccaatttgctatcctctgctctgctggtcacgcagatgaaaactttaatttgcgctattaaaggaaaccctacttcatgcagactaatccatgtctgggttgaataaggaaaggaagggagactgtactgtccaagagtgtacgcatcgaacccgcatctaggttgaaaaggggaaaatcaatagctaaggaacgagtctcgtgtctcttgggttaagaagggtagaaaggcatgacaacgcaatagagaatgaccaggtcgattggtttgttgtcctcacataggaaaaacgtggctaaacataacaaaattgggacataa

SEQ ID NO: 38015 - DNA, 368 bp, Triticum aestivum
  Clone ID: PAT_TA_38015
gatccgatgaaggatgtatgaaggtgaccatccaggatataaatccttcaaacaccagaacatgcatccaggaaaaggtgccgcctaacctttgcaccttcaaattgtaggattaaaatttggaacctgacatgaaattgaaaaataccatgctttaattaattatagtacataccttgtgcagggcacataaaatatatctgatatcgcttttttatgaatacttttatcttttctatcctaaaaaaaacaaaaaactggagcaaaaaaggcaatcaattaaaggtcgaaaaaaaaaccttacctttcgggaaaaacaaagggttaaccaaattttggaaaactcgaagattaaaaactgttttccg

SEQ ID NO: 38016 - DNA, 137 bp, Triticum aestivum
  Clone ID: PAT_TA_38016
ggacagtgacgagggccatgagtagcagagcctgcctcctgatgctttcccgacgcatgctgctggaagcctatcatcggcccgcgtggcctggtgcgttatcggtccgtttcagcattttcttcgccgcgttctgt

SEQ ID NO: 38017 - DNA, 475 bp, Triticum aestivum
  Clone ID: PAT_TA_38017
ttcgcgggtccacgggagtccaacccttgcgtgcgaaccaccctggctgtgtatgtgagtgcatgcacgtgtactccctcaatcttccaacaaagagtgtacatatacacttccaatgcacttagcctttaatctaatcgatattgattgactaatgcaccaacttgtgctctagctataggctacatgtctatccttaattacaacatgcaacaatcttcatttaatcttcttctctcaatggtcgcatgcacacataagtctgctacttttgggtgataattatgccatgaagtttcagttcctcttggtcaatgtgtaaatctctatatgtatagtctttcatggacggagggagtaggttgagcacttgagcgtgagcgtgtgtgttgcgccgtgtgctgtgtgccgcatgtatgcatgagtattgcgtgcatgcgtgcatgtgtacgtgtgagtgttgcatgttgcatgt

SEQ ID NO: 38018 - DNA, 177 bp, Triticum aestivum
  unsure (1)..(177): unsure at all n locations
  Clone ID: PAT_TA_38018
aatccatnaaaaaaaaatgcgaaacaaaaattggttggttggaaatgggaaggaaacaatggaaattaagtcaaaaggtgtaaccttttccttccccggttaaaacagtcctggattgcttcatatacaaaaanaaaaaaaaaanaaaaaaaaaaaaaaaagcggccgctccaaaag

SEQ ID NO: 38019 - DNA, 476 bp, Triticum aestivum
  unsure (1)..(476): unsure at all n locations
  Clone ID: PAT_TA_38019
tccggggccacggggacggcacaaactgggaggttgcacgggagctgctgcagggtgccgtcgcgccgccgcagcagcgcgtgtttgcggcgaccgagccatcagatgtcgtcgcgtcgagctatctcgcgattctccaggtatgccagagaactacatgttcacattatttgtgcgcaggcggcgaactacatgtcattccccttggactacgctctggagctggaggagaagctgttggcgcgggacgcggagattgccgcgctgcggaagcagctggaggagacgaagggcgagctcgccacggcgaaggtgccgcggaggtagtcagganggtagcaggagagcgagacggaggacatggngcgcaccgcggatcttttcttgcttcgctactctgtaatccagtgatccgttcctttgctatacgagactcgttaactaagattcatcagtgagcaacaagaagggaaaaa

SEQ ID NO: 38020 - DNA, 436 bp, Triticum aestivum
  unsure (1)..(436): unsure at all n locations
  Clone ID: PAT_TA_38020
tccagagaagctcaactcattcctcatggtacgtgcgcatcagaccacataggatgtgggtgaaacatgccttttcgttcaattgatttttctcacagccccagattatgtgttgtctttgtgttccttctctgcatgatgtcaacttgtcaagtgccacggctgcttcaacatgtgcgttgttaaaccttgtcgagggaggcggtggcgactggtggtgcgaagccgatcctccacaagggcttctccatgctgctacgctctcccgtcggtctcttcttgccttcgctcaggcaggcgccgacggggctgacacgccgttgaatcagcgacggacagcgtggcgacgcaggtgtgtgaggagtctccgtccgctacaggctacagcctcaggggacgaagcanacacatattgggagtcttcatgtgtgcagaa

SEQ ID NO: 38021 - DNA, 333 bp, Triticum aestivum
  Clone ID: PAT_TA_38021
ccgcagccaaagacggcggcgacaagaatggcaacaagaatgccaagaccagcgtggagacgtacaagatctacatcttcaaggtgctgacgcaggttcaccctcgacatcggcatctcctccaaggccatgtccatcatgaactccttcatcaacgacatcttcgagaagctcgccggccatgccgccaagctggttcggtacaacaagatccccaccatcacgtccccggagattcacactccgtccgcctcgttctcccccggcgagctcgccaagcacgctgtctcctccggccacagcgccgtcaccaactttacctcctcgttaaag

SEQ ID NO: 38022 - DNA, 309 bp, Triticum aestivum
  Clone ID: PAT_TA_38022
cagcgtcagaacatcaagaacgaagaatgatagtccatgagcctgcttccacagaggctcatgaagttgaagatattccagcagctgaacccaccgctgctgaagacattggtcatgatgacaatgtagccgatgatgaagttcttccttagatcgaacattacgtggtatcatcacctgttcatacgaacagcgaactcatcagcattggtcgtccactgacgccaattgctcaggatgcatcgtgggctgatcacccacaactacaagactcccccagtactccccaataacaacaacaagctacac

SEQ ID NO: 38023 - DNA, 430 bp, Triticum aestivum
  Clone ID: PAT_TA_38023
gtgtgacggagccctgccggagggtcctggaggtggggcagcaggccagcggtggaggagcttgggcgcgggacatggatgtctgactgcgaggccatgagaggcacatcgagaagggtgtgtctcctggcgcgtgcggggatggaaggagcggcgcgaggacggcagaggcatggtgcctcgctcctctccctggcgaagcagggaaggaggggatcgagggagagggcgctgcgagcgagagagaggaaggtgcaggtggtttggacacgggagcgagaggtgggggttcgaacgagtggtgaggaggggatcgagcgaatggagatggagatcgggcctctcatggcggcgctggtgggaggacgaagggaaggagtgggaatcgggctaggttagaattataggtacttgggccgggggagtgggc

SEQ ID NO: 38024 - DNA, 466 bp, Triticum aestivum
  Clone ID: PAT_TA_38024
ggggcagtggccagcgcgggccttgccggtgcccacgatcaagaggaagacgttgccgtcctcctccgagactagcaggcggcagtgatcctctagcgactctggcatggtgaacgggtagcacgtctcgtacttgatgttttctgccaagggccagtagtgaccgctgcatgcatccggaggtgatgcatgatgtctgttggcgagcccctaaacggcatcgggcactcatagaagtagatgaagggctccttggaggcatcgaccaggtcgtccatgaaacaggagtgactgtaggggacgttgcgccagttgaatatatgagcacgttactacaagatttaatccaaataagcacaaaataaatcatgacggctataatagagattaaactaatcatgtggactagaatagtagatgaatagatagaatctagtaggatacagagtagaaacatgaattctat

SEQ ID NO: 38025 - DNA, 430 bp, Triticum aestivum
  Clone ID: PAT_TA_38025
atcagtggcatcgctgacttttggtgcttttgttggtgagggctccacatttgcttcagccatgacagcgccagtggcttcagtggtgttggtggtggcagccgcaagattttcaacctccacttgacgagctggagggttgcttacgatcacgttctcctcgagaactgcttcttggtgggacaggggagtagcagcttgtggtagttcttcttcatcggctgatgtagccggaatgtcttcagcagttttagcttcagacgtagagacttgaggccttggacctttgtgaagcctgcgcaacgcgggcgacgcatgtggagtttgtgttggctgggccttagagtcttcttcctcttgtgggtgatccgcccacgaagcatcctgtgctattggtgtcagtggacgaccaatgctgatgagttcacta

SEQ ID NO: 38026 - DNA, 451 bp, Triticum aestivum
  Clone ID: PAT_TA_38026
tccacgggtcggcggtcagggtcaaccggatgttcaacccgaaaataaacctccagatttgaatcaccaatgaggggaatttaatcgaccggaacaggacctccaacgccaagctggtcaaagctgcaggccaaggtgtcaagtcacaggaagcacctcaccattgatgcatgagctctgaagcttttaccctggcctggaactccttttggcttcaatggttttcctgctgagagcttcatggctgatattgcagtggcacgagttcttcaggtgaaactgtcactgattacatctgaacccattgtaatgttttgggtggtactagctgtgcagatggaaccagcaatgttatgtcgtaacagtagtaacaacgaactggagcaagagtgatcgaggcgcgggtttctcgggaaatggttcgatttcaggcattcacacacaccttttg

SEQ ID NO: 38027 - DNA, 454 bp, Triticum aestivum
  Clone ID: PAT_TA_38027
ttccggcctgcgccaggagtgccggacaatcacgatgagcacggcttagacctactgtcggatagtgctcgggatatcgcccctgcaggaaccccgaacctaaatccggaccagattgcatcgcccgaggatgtgtggatggaccctgccccgcaggccgcacactcatcggcggtagagccgaacataggccttacctctaaggaagcctatgactccagtcccccggactcgtatccggctataggttccagtccacgcgctcccgagcccgctgagcctggttgggctccggtaacggagtttatcgctgcggatatcttccagcactcgccccttggcgatgtgctgaactcgttaaaatctctctctttgtcaggagactcatggccgaactatgtccggctcgagtgggaagcatgcgatgaaggaaattcgttgcccaacccacaac

SEQ ID NO: 38028 - DNA, 394 bp, Triticum aestivum
  unsure (1)..(394): unsure at all n locations
  Clone ID: PAT_TA_38028
tggactaacttgcacganaaaccgcagaggtaaaacanaaaagaaagcaaataaaagcaaagttttggaatagtccaacacgagtgttttgaagctacatgagcttaagtacaacctaattaaatttctttaaataccgccacatcttgatgtagacatgcagattacctcccccaagcttaagcttttgcaagcccaaaccggcggaatcactgtggcggttggtcacaagcccatccatggctccagttggagaagcttgaattcatgtaggcggacgtgcctcgaagggacacgacaaggttgctcatatcattgatggagccctgcaaactgtaaaggtccgcataggtggtgtaggcttcttgttgtggatgttcctggggttgctcct

SEQ ID NO: 38029 - DNA, 436 bp, Triticum aestivum
  Clone ID: PAT_TA_38029
aagtacccatcacaaactcatctccctcacatttacattatttgccatttgactctcgttttcctctcgcccacttcacccttgccgttttatttgccctttctttcccaatcttcttctctctctttcgcttgctttcttcttcctcgcttttgtttgccgttatgtcgaaaattggggagattatcgtcgagatggacaataatgataacatggaaaattccgatgctccggctgaagaagcccctatcttgcatacaataaattcgaatcggtcgtggtaacattattggtaaaggtggtattcaaaatttctttacttgtgtcggtgctttaccttccatgggtggttctattcttcatagaactagtagtcctgcagatgctatcgctatgcttgtagttgaacttgaaagacaatttatgcagtatgcat

SEQ ID NO: 38030 - DNA, 422 bp, Triticum aestivum
  Clone ID: PAT_TA_38030
aggacgaagctacatgtaattcaccgacgagacgtaacaatgggcaggcaggcacatcaggttggagggaactcgaggcgtcaagcggcagaatcggttgtggggtgtcaggatggttggtagctgaaccctcaatgacacgcgagacccacctaaaacctccagccaatgtagatcctatgcaagattttgacctgtggctctgccgaaaacaacggcgacaacgcgtctgattggtgcaactggaggtgatatgtgccattgaaaaacaattgtggcatttccaaactttgaatgccatttgatcaaccatagaagaaaatccatcccaatcttcaaacgaatggcccaaaatcccagggtgtgataattcgcgatcctgactgacttactgcgcattgggagattcaacattgactggg

SEQ ID NO: 38031 - DNA, 401 bp, Triticum aestivum
  unsure (1)..(401): unsure at all n locations
  Clone ID: PAT_TA_38031
gtaggcgtccgagattccaaggtccacgggccgacaagcatcttctacngtgggaaaggccaaacctccttcacggggggctttccccttctcggcggcggaaaacctcggttaccggcccaatggatgatgcattaaagtaaggaagaagaagcaagcagaacagaagaagagatgggcgacgggggccccgcccctccccttttatagcgggagaaggccaactgacaacccccacgatcggaggtaatgacgtcttttctgcatgcaccagggactcgtcaagtcgggcagttaccgaggcagcatggggaagcggagatgcccacgtcccgtcagtcgccacgcgtcaatcatggacgcatgccgttggggcccgcggcgctccgcacttgcccctt

SEQ ID NO: 38032 - DNA, 424 bp, Triticum aestivum
  Clone ID: PAT_TA_38032
ttcatcaagaaccagaacgaggctggcgtgggcatgactgactacggcctcgacaggggcggtggccctggcctctgagtgaatgaggctttgtgttgctttgcttgttgtgaactgggctgggaggttgctgtaacttatgtgtgcctgaagctttgtgcttgcacctgcatctgatgatccgagtgacgcagaaacggtactgtaactgcatcatatgtttatggtgtggatcgcctttggggtgtactccagagacaatgttgcatgaactgtcatgggaaaagtaaaacattgcggtgtaatactacatttcccatgctgctttaagtctgtttattacttttagttcgtgtaagctgcggtgccagtgaggtgtcttgtatgttggctagatagagtgagatcgctcattgttgggctt

SEQ ID NO: 38033 - DNA, 471 bp, Triticum aestivum
  unsure (1)..(471): unsure at all n locations
  Clone ID: PAT_TA_38033
ggtccacggggaggcctttccaatccatagccacgtggatcctaaataaaaatggcgtttaaaataagaatgaagaattaaaaggttccaaaggcaaaaaaaattggttaaccgccaaaggaaatacaatggtggtttaaagacgattttttgaacctaatgtggatatatacatatatatggattatcctcttcccaatanaatcgcacttgtcatattcctatacagaatgtaggagtatgattaagcagatgcagcagcgcattgagttgtgtctagccagatctcgtgcacagtacgtaggaccctttcctatcccaaattaaaaatttctgaacatgctacacgtacctctctatcgacaacataaactgaagacacaaatctggtaatcaagaactttctccgcacaacagcttaaagcacacacatacacttgaaccaatcaggcaatcacgcatgaaacgacc

SEQ ID NO: 38034 - DNA, 273 bp, Triticum aestivum
  Clone ID: PAT_TA_38034
cacaatcctcaggaggttctgaatttcctgaaaaaggcccgcttctctgctaatacaaccatctacttgacatatacattgtggcacaaaggcctcactaatcttaagaatgcattaccaaacacttataccatcgacgacataatgcctgctgaaaagaaatgtgagttcctgaactctggtgattcaaacctatcaagggcccttttacctccaaatctgctcgcataccaacttcttcgtccctgccatccctggtatgttctaccgcaa

SEQ ID NO: 38035 - DNA, 152 bp, Triticum aestivum
  Clone ID: PAT_TA_38035
tttgggcgattggttggttgcgtgaccggatacctgtcgtcgtctcaagcttctttgtcaacgttcgccatctgccatggtgctgggggatgaagtacttctgggagagcttgcgggcgtccgaccttgtaagctacgcgttgggctggcag

SEQ ID NO: 38036 - DNA, 451 bp, Triticum aestivum
  Clone ID: PAT_TA_38036
ccggggccacggggcagtttacacaggctcaggccaccttgtggtgtaataccctactactgctttgtggtggattagcctcgcgaggggctgaggatgaactagtacaagtggaagaacatcctcaggaggcgtgttcttgtgatgagctctagggattcggtctccgggggtccgatccttctacggttgtggctagactatatttataatggccttggtcctcttccttcgaaacttaggcgggaagggatcccacaacggccaaatttgaaagggaacaagaagtacatataatcttgacgaaaggcggtcttcgcctacaaagcctttgagcgtgacctcgtggtgggatcggcgatgacatctatcctgccgttctggcggtcctgggcccctttccaggcaaatggcaacctttggctgattccttggggctcaacacctgcgc

SEQ ID NO: 38037 - DNA, 414 bp, Triticum aestivum
  Clone ID: PAT_TA_38037
aagtttgaatccgaaaacccgttcggttcccctccgggaaccgttgctaaaccttggtcctaaaagccgaaccctggtaccccaaacaactaataataagccgcaattaggtgttccgggtacaagttgttgccatgttgtgtcgggcgcatccgcacatgtttaaagttcccggatttgatatccgtggttgtagatattctaagcacttgtacttggtatatatgcccgggcaagtatttttggtacaagatgattagaatgcgccagtacgtgtccggatacaagttgtggttgtcttgtgccaaggcgcgtcactgccttttgaaggcccgaatttgttgttcgtggctgtagatgctttgagaacatggtacaggtacatatgcccacgcagttgttcctgaaacatga

SEQ ID NO: 38038 - DNA, 455 bp, Triticum aestivum
  unsure (1)..(455): unsure at all n locations
  Clone ID: PAT_TA_38038
ccacgggtatggtcaaacatcattgcttaagaggaatgaacaattcctccagtatcgactaatctttgacagacatagcgatgtccatgttactcttcctgctcccttcctttttgattaccaggcaaaaaggaagatacgttgttaccagggaggaaacagctgaacacaaggagagagcagaggcggctcaccaacattcaaaatcaattctcaagatctggctacgaattattagcacgaacgctaaccctagttagattattagcaaaaaaaatatttgtagagaacaaataattgatcactaatcatagaccgataccattcaaacaatcaatacactacatagatctgacgaatcttactccgatttcatggattgggagaacataaccatatgatttttattccagaaaaatganaatggggtgggggtgactaaccggttttccgtc

SEQ ID NO: 38039 - DNA, 204 bp, Triticum aestivum
  Clone ID: PAT_TA_38039
cattgggtaataagtatgaaaagttcgatcatgatgcattaatcttgcatacagatagagtcgtataatttactcgtgtggatttattcgttatcggtctgtatgcatatttgcttagtagtgtttgttttagacgatgttgtgttgtaagtaccatatgtgtttatgttcattaagaatcatggttaatatgtatgatttggc

SEQ ID NO: 38040 - DNA, 215 bp, Triticum aestivum
  Clone ID: PAT_TA_38040
cccatttgccgggaattgcaagcccaaccaacgttttggggccaacccaggaagaaggtgagacaccaacaccaaaaacctgggtcaaaccttgggtttgccccaaggggccattcaaccaaaccaaaccttgggttccccccgtttccaatttttcccccaaaaaaaccggaacctttccaatccaatttcaatcccaatccaaaggttccccc

SEQ ID NO: 38041 - DNA, 325 bp, Triticum aestivum
  Clone ID: PAT_TA_38041
gtcataggtcatttagtggtggtaggctgtgtaatacaaaagaagcagcagaagattgaaaacatcattctgtgagctgcatgtatgtgatgattttgtgaccatcaggattgatttcttttattaagtggctcatcagatgtttgagaaaatggccataagaggattgatgaaacttgaaagaggttgtggtatttctagcacgttgagaggataactcgtgacagggttcacgtgaagtgggaaagacccaccatgacctgcgagttaatggtttttggggtacgccttttcccagccccaggtaaatatcatgaggctacct

SEQ ID NO: 38042 - DNA, 441 bp, Triticum aestivum
  unsure (1)..(441): unsure at all n locations
  Clone ID: PAT_TA_38042
acacanattgtcatctcgctgcaaaactgaaggtgccaacaaaatacatcgaaactttgatgcccaaggactaaataacgtaactccttgaagaagtcctccaatccaaaatccgaattggccttggaattctggcgccccatctcgatgtccctctcctttgggggcttcgcgtccatttcaaaagaatcctacgattcagttgatcgaaagcatcaacaatcatacagtaattgcaagttccacccatttactgaaggttccaaccaataggatttggacgtatgaccgattacttttcacgtttgacttatctggaaatcaatcagggttatgcagcacgtctaattattgatccatgatgacactagtagaaacaaacaaactttccttgttcgaaaaggangatgaaacccggggcctaaaaagaaacgaactgta

SEQ ID NO: 38043 - DNA, 463 bp, Triticum aestivum
  Clone ID: PAT_TA_38043
tcccggggtcacggggaggagaggaggatgcagtaccagtcgcacatccgagggctcaacgcgtacgatcgccacaagaagttcatgaaggattatgttcagttttatggccatgagaaaaatgtggataacagtctgcccatcaaaactgataaagatacattgagagaaggatacaggttcattcttaccgaggaagatgacatggattcaacttgggagaagaggctggtcaaacgttactatgacaagctttttaaagagtattgcattgctgacatgacccagtataaaaaaagcaagattggattgagatggagaacagaaaaagaagtgatatctggcaaagggcaatttatctgtggcaataggcattgtgatgaaaaacatgggctaggtagttatgaggtgaatttttcttatgttgaagcaggggagcagaaacaagcactagtgaagctgg

SEQ ID NO: 38044 - DNA, 454 bp, Triticum aestivum
  Clone ID: PAT_TA_38044
ttcccggggtcacgggtcacaacgaatgctgaagaagcctctctgctcaccattggtatgacagacttgtcgctccttagatcatgtatgtatcatctgcttctatggagagcctatggcctatgtgaataaatgctttgattggcattgtaatatcttctgtttggctctatttgttaataatgatggcaagcaaaaaaagacattttaatggattcacatgggtgtgttattctggagcaggttgatcatgctgccctgttaaaatttggtaaaccccattttttaaaatagaaattcaatttaaaggggtacccaagctaaataaggcctcataaatcatagtatagaaaaggcggggctggctaattaaatgaaaggatttcgaaccacaatctttgctaattcgacaacgattgcattctttaattatttctcaatttttactacttaa

SEQ ID NO: 38045 - DNA, 284 bp, Triticum aestivum
  Clone ID: PAT_TA_38045
cgggtatatgagcaattcgagcatgcacgacagaatgtttatttgaaggtttagagtttggcacatacacatttacttggaactgcacgtacctagggcacatatgtaggtatagtggagtcatacggaacatcttcggggttcatggagttttgaagcaattccttttctccagattagcccttgtgactgcgaacgcgtcactgggaaattatgtctccagacattccatataataagatacaaccctgtgatagaccccactttctctataagcttaagtc

SEQ ID NO: 38046 - DNA, 328 bp, Triticum aestivum
  unsure (1)..(328): unsure at all n locations
  Clone ID: PAT_TA_38046
gatggatgacaatgcgaaaggcgaacanaaacaataaccaaaaggcaatgggcaaccaactcctcatattacatttatattgttggcaaaaccaaagaaaggaattggcaacaaaacaccgaggattaccctccaagaaacaaaccaagcgccgacgtcagcggcgccgccccaagtctcgccaaagcaaaagcggtgacaccggcacaggagataatagcactccggacagtgccgaagacgacaacaatcccctacagcaagatttagagcangaggatggagaagccagccctcccgagagagcggcagatggagaagcggaggc

SEQ ID NO: 38047 - DNA, 178 bp, Triticum aestivum
  Clone ID: PAT_TA_38047
ttcaaggggccacgggatgttcacgtacgggagagaagcgacggagttaggagttgtagatatgcattgttgtaccccgacctgaatgaatggaatatacgaaataacgctgttggtcatggcgacgagacagcggaggatgacccctccaagaaacaacccaagcgccgacatcaac

SEQ ID NO: 38048 - DNA, 456 bp, Triticum aestivum
  unsure (1)..(456): unsure at all n locations
  Clone ID: PAT_TA_38048
gcggtttgtatgcaatcatgtctgaaactggggaggttatcattgaaacgagtagtattagcaatgtgggaaatgttgatgcttttgattatcctcatgaagaacctactattttacacactaaaaagtttcggattggtagtggcaatattattggaaaaggagttattcaagatttctttacttgcgccgatgctttgcccactatgggcgggtctattcttcataaaactagtagtcttgcagatgctatatctttgctcgtggttgaacttgaaagacaatttatccacatgcatccttgcatatagaggatttttctagattttccaatattgagcattcttctgttaagcgagcagctaccatctttttagctcatgagttcagatttataataaaagaggcgaacggaatttttgcacattatanggtggatngccgacatcctcccat

SEQ ID NO: 38049 - DNA, 246 bp, Triticum aestivum
  Clone ID: PAT_TA_38049
ggggcaacttatagtaaatcatattattactagacatgttaacagataatctactgatactagcatggtatgaaatgtcgatgcctctgaacatctacattaaaaacctaacacattacacacaaaaaatttacagtttggcaatctacttagtattggacaaagagttattcatcatatcttcacatacgacgatcatgtacccaatattggcggatctaatcttcatacatgaagtactctgtc

SEQ ID NO: 38050 - DNA, 312 bp, Triticum aestivum
  Clone ID: PAT_TA_38050
aaaactttaaagactggagggtaccattgaaccacgtgtcagtgttttacggacaattgaggatcagaatcaaactgtggatacccaatctgcgaaacccatcgtgcagctcttaatattctgtaattctctataatcacgtcaagatgcgttaacgtttactcctgatgattactctgatttgaccgtcatctataatgatactgcaacttcattaaatgattagatatgtctgacattctataagttgatctagtaacaatttcaagcactaggtcgtcatccgtagccaaatcaacaatttacagattc

SEQ ID NO: 38051 - DNA, 479 bp, Triticum aestivum
  unsure (1)..(479): unsure at all n locations
  Clone ID: PAT_TA_38051
ggggcttgcgtgagtttccaacctgacaaacaacttgaagggccgtcctcgcagatccaacctgcagaaggtggatctgcagaagctgaagatgaatacgacttcttgaaggatggcaagaagcaggctgaaggcagactacagaggtcattagctcgtgtgaaatcaatgactcaatacccagaagcaagagaacaatacagtaggctgcaagcctgtgttacagaactacaagagtccaaggcgatacaggataagatgctaagcgatgcagctggcggcgatggaggtgatttcatggttgatctggaggatttgtgcgcggatgagctgttagacacaccgatgtccactattttgtgacgttgatgggcttttactagaccagttangctgtgacttgttcgttttaccagactagttgtaaattcctgtgctagatgttcactgctcaacatttgactcagtatagctaatac

SEQ ID NO: 38052 - DNA, 431 bp, Triticum aestivum
  Clone ID: PAT_TA_38052
gacctcgagctggacatggacctcgacatcggcgacgacttcctggagatgcctggctgcgactttggccggggcatggatgatttcctgcaaaccgtcgatttctgcgtgtgaattaagagaggtttaaggtttatctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaaaaaaaaaaaaaaaaaaaagggggccccccaaagggttcaaacttaatttacccttcaaggaaatttaaaacccctcaaaaggttcccccaaatttaatttaaggggcctttttttaaaaatttctaaaggggaaaaccccgggtttacccaatttaaacccctttgaaaaaaatccccttttc

SEQ ID NO: 38053 - DNA, 464 bp, Triticum aestivum
  unsure (1)..(464): unsure at all n locations
  Clone ID: PAT_TA_38053
ctaccgccgacgttgaaacgaggcgagcgtcgagggaaccgtggagaacggcggggaagcaacattgcgccatctggcatcctcttgtggtgggagaacgaatactcctgtggctctggctggctctacaccctcacgaatggcacaccatactcgattgatttgttatcctctgggtgctcgaccttcgacctgtatgcccaccacctcgcctgactgttgcctcgggcgaatctgtctgctccatcgcccagaggagatacttaatgaactcggaggaccgcggcgtgactcccgccgaggagtacatgtacattgccaccctcatcgccgtcttcttcctctttcncatacaatgccacatggccctcaccgtccttgaaatctcccacccattgtcaaatcaagtaaggatatccttcaacctggctaactttgcctggtcccgccggcgatctgcctga

SEQ ID NO: 38054 - DNA, 303 bp, Triticum aestivum
  Clone ID: PAT_TA_38054
gagatccgcaagctcgatgagaagtgagtgggtttgtcctctcgttctgcttactttcttttgtagagcccagcctagtgctacgggttctagacgtggtcaaaagtagacgatagatcttgtcagtaaattgctttgcgatggccatgtatgaattagcactccgtgttttggacgcaggaagtgagtcttatagcagactgcttataatgtttaccctcctccaaaggccacgaagcaaatgggagtattccctaattttgtatgagaactgtgcctgtttgtgttctgtatttctgtcag

SEQ ID NO: 38055 - DNA, 271 bp, Triticum aestivum
  Clone ID: PAT_TA_38055
ttcccggggtcacggggagatctcaaaactgctggcatacttggaaagcctggttggggttcaacatgtccgtgcgattcatcttcatctaagttcatgctccgcggtacggttaccaacgttacctcccttgccatgcacttcattctcatctccgaacttccaatttgacttcctcccgaaccttttaagcaatccagtttttactaggatatcagagattacgatcgctagctatcttagtaaacacatgtatcacattctttcgaac

SEQ ID NO: 38056 - DNA, 445 bp, Triticum aestivum
  Clone ID: PAT_TA_38056
ggggccaggtgggttgggccgcctgctggctgggccggcctgctgcggctgggctgcacaggggaagccccaggtaagcccctcctttttttttctgttttctatttttttctgacatttgttttgatttcataaatatattaaatcatttaatttccttatgccaacttttgcaggagctagatatattattccagagctcttttataattggcataatttttggaccatatttcatatatatataaatatatttccaatgcaaatatttatcgaattaatccaaatggccaaaataaatgtccatgagctcctaaaaatattgttttgatttttatctctgtccaatattttcagagggcaacatgagcattttcttggacccttttggagaaatttttatttgggtcattttcaaaaatgattctgagggttccaccaatcc

SEQ ID NO: 38057 - DNA, 204 bp, Triticum aestivum
  Clone ID: PAT_TA_38057
actcgtagaagccgcccgtggagccatgattttttccagttgagggatggatctttcctgtgtatgtatcgcttttttttacagccttgacgataactctgtccatgactgctgtgtactacaacaagttgatgggaatgtgatttggtgtatggtttcaatttcatttcatggaaaaatcaaaaactcataaaaaaataaaaa

SEQ ID NO: 38058 - DNA, 383 bp, Triticum aestivum
  Clone ID: PAT_TA_38058
gggccgatcgtgatcgcggagaccaacaacctcgagtcactggatcaagcccttgttaggtctgggcgtttcgaccgtcacattcagattcattatccaaatgttgatggccgacaggagatccttgacgctcatatgtcaaaggtgttgaataccaacgatgtggatcttctgccccgtccttaaaacctattgcaattcacataatatctaatttgtgagttctgcattatctaccatcaaccgatgtcactgatgattaccctcaaccttgtcaatcttatcttatttccattaatgtctgtcatgctctacccaaaacgtgaaaaacctctaccaacaatgatgccaatatttttggaccaatatggatttttgccact

SEQ ID NO: 38059 - DNA, 454 bp, Triticum aestivum
  Clone ID: PAT_TA_38059
ccacccataaggcggttgatgcccttcttcggccgcaagaaagctattttttggtaaaaaaatcacggcgaaggtttcagcccaatcggagttacacatctccggatataaaagaaacggtgccaaggcagaatctcacagagcgtagaaacagagacagacagagagacagatccaatcttggaggggctctcgccatccagggagaaggtcaaggaagaagaggaagaagaaggggggctctctcaccctcacttccggtggcgccggaacgccgtcgggggccatcatcatcaccgcgatcttcaccaacacctctgccatcttcaccaatatctccatcaccttcgcccttctatctatagcggtccactctctcgcaacgcgctgtaccctctacttgaacatggtgctttatgcatcatactattatccaatgatgtgttgccatcct

SEQ ID NO: 38060 - DNA, 366 bp, Triticum aestivum
  unsure (1)..(366): unsure at all n locations
  Clone ID: PAT_TA_38060
gtacaggtccgacnatccgggtccacgggggagctacaaggggcccactagggtggggggctcagtaaatcgtgtaagcacactccctgccttctatccttgacattctcgacggtattgttcaattacctttcccacagtggctacttagcgcgaacttcctctgtgcatcgatataccgtgataggatacacactttcatacaggacactgattatatgttccgcattgcatcaagtagacttacctatgatcgcatttcgaaagcgagtcttagaaatattgccatgcacctttcaacgtgtcattcaaactatacacactcatcattggcatactactgacatcatcatatagtagatatct

SEQ ID NO: 38061 - DNA, 372 bp, Triticum aestivum
  Clone ID: PAT_TA_38061
atataattcatattcacatagctaatgaattaaatccagagtcccaaaaataaatccttaaaaatgttcaatatttgggttgggaccagaacccttaccataaattatcaaacatttacgaggagcattttggagcaatgaatgagatttttagggttttttcccttcttttaattaagttttttttaggcttccaaaattcctcagttcaggtttcaacaatttaaacatgatgctcagatgaggtctagcctagtgcataacaggaccatggatgtgacacttttatggacgatggaataacgagtggcaagagcctaagcttggggatgcccatggcaccccaagatagtcacgaataggcaaaagcct

SEQ ID NO: 38062 - DNA, 431 bp, Triticum aestivum
  unsure (1)..(431): unsure at all n locations
  Clone ID: PAT_TA_38062
ggtccacgggccgaaggtacgatacctccgtgatctgcacacattcagctcgatgacatcccatgaactctagatctagctgaggtcgcgggagagtttaattagcacgacggcgtggcgacggtgatgaagaagttagcggcgcagggcttcgcctaagcactacgacgatatgaccaaggtgtgtaactgtggaggggggcaccgcacacggctaaaataattgtctgttgtgcgttctanggtgccccctgctgaaagtgcaatcatgcccttaatcatattttgatgttgatgacaacatgcatgttgggactaatcatgtttatcaagtatatctcaagattatgtctcaagggccgtgtgtggatcatgactacggacataaaacatatatatacatatatcactcgagagcaaagaccaagaca

SEQ ID NO: 38063 - DNA, 449 bp, Triticum aestivum
  unsure (1)..(449): unsure at all n locations
  Clone ID: PAT_TA_38063
cgggatattggaatgaatatgtctcatatacaactcttggattgcgttgccaatggctggtcaggtgcaaaatgtgctaaacagatttgaagaggccatggaaaagatagatggcatggagaagacgttcgaaacacagctcaataacaagtttaatgaattgctcgtgcgtcttccaccaccaccaccggctggacctaacgcacctctactactacaacaacaacaacaacgacaacaacgatgatgattacctccacgtcccgaaacagccctccgccgagtgagccgtctccctcttgcgcctgaccaaactgttggtgctgctgttgatacttctgtggctcctgctgctgatgccgangacgatgattttgcgggagattaccacgatgatgttgataaaattagaactacgtgcaagcaccaggaacacaaccaccaggtca

SEQ ID NO: 38064 - DNA, 469 bp, Triticum aestivum
  Clone ID: PAT_TA_38064
ggtgtagcaacacattcttcttctcttggttcttcttcttggtcatcggctgatgcagccggaatatcttcagcctctttggtttcagattcagagatgttcgcagtaggagaggcttcaggaaagacttcgcgtgaaacggattggcgctcttctccttgtagaacacttgacaaaagtgacctgtggccttggtcctttgcgaagcctgcaaaacgctggcgacgcctatggagatggagttggttgggcctcaaagtcttcatcgtcaatcaccggagtggtgacctaggtcgggggagtaactggtgtttcttcatcatgaggggattcttgagggtgatcagcccatgagtcatcctgagcaattggagtcaatggacgaccaatgctgatgaatttgttgttcgtgagaacaagccatgataccaaattgtgctcgattcgagaaaggacttcgtcatcttca

SEQ ID NO: 38065 - DNA, 383 bp, Triticum aestivum
  unsure (1)..(383): unsure at all n locations
  Clone ID: PAT_TA_38065
ggatattggaatgaatatgtctcatagacaactcttggattgcgttgccaaaggcaattttattgaaattgatcccagtattgtgcatgaagttatagaaggtatantgggaacactacctcaacanaaggggcctcatcatacccaggaacaaacgcaagtttttgagaaaatttgcgaagtaacgaaaattttacaaaaatctcttgaacctcttaagggtgttagtggaaatcttcaccgcatgaatatgttgattaccctttgcaataagcggttggatgctttagatctaaaaatttctgaatatgaagggaaacgtaaagaacctcccggattcgagcatgattccgctaaaaaattgaaaaccgaagatggcaata

SEQ ID NO: 38066 - DNA, 337 bp, Triticum aestivum
  Clone ID: PAT_TA_38066
gggaaagctctgattacgagcttgtcacaccctccatgcgactacagctcccacgtgttcacgcacgacatatagacatcagcgtattgaatgcataagtcacaatttaggcaatcttcacaagatcccatgtcatatacatcatcaattgggatataacatacttggcctacactcgccatgtcaatcaagtgcatagataacattacatcatgcaaactctcattgctcgaccatagtgccaagtctatgagagaacccatcatgcgacacggtctcgatcaccaccaattgggcagcactactgatcatcacgaagttaaacatagtaatgttg

SEQ ID NO: 38067 - DNA, 407 bp, Triticum aestivum
  Clone ID: PAT_TA_38067
ccaaggccgacaaccggctgccggcggggaagtccgccgccaaggaggtcggcgacaccatgggcaacatcaacgctaagaagagcgtggagacgtacatcatctacagcatcaaggtgctgaagcaggttcaccccgacatcggtatctcctccagtgccatgtccatcatgaactccttcatcaacgacatcttccataacctcgccggctaggccgccaagcttgcgcggtacaacaagaatcccaccatcacgtcccgggagatccagacctccgtccgcctcgtcctcaccggtgagctcgccaagcacgccgtctccgacggcaccaacgccgtcaccaagttcacctcctcgtacagtgctcctgctcctgtgtctcctagttagctgtccaggtgtgtt

SEQ ID NO: 38068 - DNA, 425 bp, Triticum aestivum
  Clone ID: PAT_TA_38068
cgccacttgctgcaagcctggcagaacacgcctccttgctgcattcaaatgcctccatgaaacccgcccatgtggaagccgataaacccactctggacacacggccgttcgtgatcgggccggcattaaacgcaacatctgccgagctcctcccgtatgtcatctatttaatctcctatttaaatgatgccaaatgccggccaagaatcacacacctccaccgctcccctatctcctccttcaccatttttttccactcttacaatggcttactaagagtagttattccgcatccaagctggttgggtggcccgccgagcccgccggatatgagatatgcaactcactgatccacctacctcccctcgcccgacggagccagttgccgccccaagccggcgcgcggttcaacaactcgccgctcc

SEQ ID NO: 38069 - DNA, 253 bp, Triticum aestivum
  Clone ID: PAT_TA_38069
cggggaggtggaggcagcagcataagtgaaagtcctctgcaatgaatcactcaatagttaactcacatacttcatgagcacagtcagcaacttacgtcgatcgtcgccatagctacatttcacaatatacatcgtcggcaccatttcattacacaggcctcaattcctaaccaaagcaacttgaccaccatttcttgtcctacctccccttcttccccggttcaaattgaaagttcaggaagattaaggcttc

SEQ ID NO: 38070 - DNA, 436 bp, Triticum aestivum
  unsure (1)..(436): unsure at all n locations
  Clone ID: PAT_TA_38070
gggtcgacggctagcttaacagaaacaatataagataaattcgtaggcattggatcagtgatttgttgaattatattcatcatgagacagtcataacctagggcgatatggcactagctccagttcacaaatataatgtaggcatctatttcgtaaatagtcatacgtgcttatggaaagaacttgcatgacatgttttgtcctaccctcccgtggtagcggggtccaattggaaactaagggatattaaggcctccttttaatagagagccggaacaaagcattaacacacggtgaatacatgaactcctcaaactacggtcatcaccgggagtggtcccgactattgtcactctggggttgccggattataacacgtagtangtgactataacttgcaagatcagatctagaacatagatatagtggtgataac

SEQ ID NO: 38071 - DNA, 366 bp, Triticum aestivum
  Clone ID: PAT_TA_38071
cgggattagggccagctctccatacgcgcgcggcatccagcaaccggaggagggacgacacaggtgtcggcgtcccggttactatcacgccatcatcccaggggacagcctcgtctgtgcgccgcgaccacctagcgcggatgacctacattcgggaacgtgccgtcaccacgtggacgacgaatcgagtagcacttctgcccagttgcaggtgcatgctatagaggccgttacgcaccatgtaacggaccttcaaacgcaggaggtgtcgtgattaagctcctcatcagtgctcctcgtgcgatcgctctagcgccagctcctatcgcattcatcgcttcctctctcgccacattctccagcttt

SEQ ID NO: 38072 - DNA, 370 bp, Triticum aestivum
  Clone ID: PAT_TA_38072
ggcaacaataagttaaggaatgttccaattgcaaccggttgaaggaacaatcagcatatagaaatgggcaccaaggtacactgttcattccctctgaaggaagaatccatgtagtacctagcattcatttttagatgctatgtatctttctgattgtttgggcagtagagagctatttatctgtaaacatctgcagtagagagctatgtatctgtaaacattaaatattgttgcatcaaagagcattatcacctccttgtcattgtcaaaaagtatgacagttcagtatatgggttacaagcttacggcatcgacttacaatacagaccacgtgcattctcgtacattcatccattatcaatgctgagca

SEQ ID NO: 38073 - DNA, 432 bp, Triticum aestivum
  Clone ID: PAT_TA_38073
attaaaaggtattataaaccataaaaaatttgtaataaattaggtttaacaccaaattaaataaccattgatttcattacattaccttaaattggtggttggttttatttcgttaacggagctcatgagattttctattgagttttgtgttgtgaagttttcaagttttgggtaaagatttgatggattatggaacaaggagtggcaagagcctaagctcggggatgcccaaggcaccccaaggtaaaattcaaggacaaccaaaatcttaagcttggggatgcttggagcgtcttgtatgatttgagtctttgctttttgtttaccacagtcatatttgttgtacacaccttttgagagagacacacatgattcaaaatttattacaatactctatgtgcttcacttatatcttttgagctatatagtttt

SEQ ID NO: 38074 - DNA, 432 bp, Triticum aestivum
  unsure (1)..(432): unsure at all n locations
  Clone ID: PAT_TA_38074
ggtcgacgaccaccatcaaagacatgttcatgctgacccagtacataccgttaatgtatttgagggtgacggggatcngatcgctgtcaagggggttgatgcgtgacatgtcgtttctgaagatcacgcggcatcagcaagcaaggagctggcttaaaaagctccggcctgatggctttgagtaaacggtacagccccgacgagcacacggcgagcggcatggtactgagattgtccacacgtgaaacaatgagcttgattacctctgtggggagtgaattccagccactctttcggcgggcgctgctcggttctgccattgttagtgcttgggtttcagtcgagggggaggcgccttagcggggatggaagagcggacaaagatggagaagtgaatatgtgctgcgggaagtggacaggtgatgatgacta

SEQ ID NO: 38075 - DNA, 427 bp, Triticum aestivum
  Clone ID: PAT_TA_38075
gggtcgacggcgttataacagtcaatggaaacacagaccgctccctccgtatggaagagcacactgcagccctcgtggcagaagtacaaagcagacttctttgacagacagccaatttggcaatgataaccccgaacaccgtcaagcgagtccggagcaccctgcaacatgatcgtcaggctcgacaagagctcaattagcaatccggcctcctccccagccccattcaggtggcatttgtgccacgcgtacacaactacgcactcaaaataccatgggcataggtggaggcaagtagacaatacggcctacattgcggttcagccgccacgaggcccgcatacccgttttctttctttcaggaccctacttttgggcagccccttcagagaactggaccatcggactaatcacaggagggaaacac

SEQ ID NO: 38076 - DNA, 416 bp, Triticum aestivum
  Clone ID: PAT_TA_38076
ggtcgacggcgatccacaggtctatctatcggacggtgtcactcgatctagtatcatgatgccctcactgggaagctaacgtcgcctgtggctaatggggtaatcagggatccgaaggttccggcatcgaaagccactgctactgatgtgctcccggccgttattaacccagcgaatgtggcctcaccagcagcggccgacatgacaccagtgcctaacgagaagaacccagttgtcgctaccagtactgtcacaattggagtagctgcttgatcgcattacccgatcctcggagctacccatggataacaacctgactgtgcttgcaaaccacgtgagacatcctcgttccaatgtactgatcatcattcgtggcgtctcgaaatcgggtctgataattaggtttccctagctct

SEQ ID NO: 38077 - DNA, 432 bp, Triticum aestivum
  Clone ID: PAT_TA_38077
acgttaaaaaaaggaacaacaagccaaggaaacttgggcaaaaacggttccaattaaacaacaacttaggggtaaattgaaaaataggaaaacaataaaaaaccatgcatacaaaaagcatcttcgataatgcatatgttctgagcatttcccttcaattccatccacaagacgagaaacactttctccattctcaaatgactcggtaaggattgttggatgcaaagtagtatcatttaaacgatcagacatatttgaattttgttcagcatgaatccaaaaacgtgggggtaaaaaacacatagaggcatatatgaccaactatcgatagcagaacttttaaaatgcaccatggcatagtatgtgttactttcggacattagaataaggtttgtcagtgtagcattacatgtagtcaagtacagactttac

SEQ ID NO: 38078 - DNA, 326 bp, Triticum aestivum
  Clone ID: PAT_TA_38078
gtcgacgtcaacacgaaagccggatcgcaggggctgctgcttctcctcgctctcttaattgaccctgtaaacagtgcagcagatatcgtcactgaagaccaccaagaaattatcaagcattttgccagaatcaaatccgagactgttcctgagaacactgatgcatggtctgatgacgatgattacgatgatgattattaagattatgaaactggtgatgctgatgatgatcattccaattctggataagacttctcgggtcaagattgctaggacgatgaccacgatgatcatccttaggctaacggcgataattctggctcagc

SEQ ID NO: 38079 - DNA, 433 bp, Triticum aestivum
  Clone ID: PAT_TA_38079
ctggtgtagagagaaccttgaactctcgccttcaggaagcggaagcaaaagctgctgcctcagaagaaaaggagcggtctataagtgagagactgtcacaaaatttatcccgcataactgttctggagacccagattacaattcttaggacagaacagacacagctgagccgatctcttgaaaaggagagacaaagagcatctgaaagtagacaggagtatctagcaattaaggaggaggcagcattacaagaaggacgcgcgaaacagcttgaagaagaaataaaggagcttagagctagacacaaaaaggagctgcaagatgcagcagaacacagggggctgcttgagacggaccttgaaagggaaaaagctgccagggcagaacttgagaaaacatcttcccgcgacttacctaaaattccatttccaga

SEQ ID NO: 38080 - DNA, 425 bp, Triticum aestivum
  Clone ID: PAT_TA_38080
actagcattagtaccctacggcaacgcaacgcccagggagctaggcgagcctagctactacctagaccagtgatctaatggcagctccactagccagctgcgcgcagcctcgcgacgcccgacgttatattcggtcccctcctctctctcctccgggttttcgggcgcgaaatatcactgctcatcgcccatacctctctctctgcctctactacgtgcgtacaacgagagatcctctgagatcatgaaattaggcgctgagatacgtacactgcttgctcgcatgcggtctcagctcgagaatcgagttattgccgtcgtatatttctcgagcttggtccgtcgcatgctcgcatgccaaattttacatgcctgattcgtgttctttctggcgtagccactagtaagctttcagctggtcgtgt

SEQ ID NO: 38081 - DNA, 173 bp, Triticum aestivum
  Clone ID: PAT_TA_38081
ttctcaacatttggtgtgcaaggcaaaccaatcaacaaggaactaagacaaaataataaagtaacgaaataaagataaaaaaaaagcccacgaccagggaggttgtatgtttccgtcggtgccgcttcgagctcctgcctctcctagagttgcatccatcttcatgggttttc

SEQ ID NO: 38082 - DNA, 439 bp, Triticum aestivum
  Clone ID: PAT_TA_38082
gggggagaggggatagaagacactgggaacagggcctcaccgcgtgcatgccagagtggtagaaaggactcccgaggcccaatggtgagcacatgtaccccgtctacggccgccggagcgaggtgccatgaggagggggatgtacgaagaggagctcatcagcgagttgtctggaagatccacgatgacatatggatctcaggaacggtaatttggcgtcaggggatctcggacgacggcgaatcgaagatggcggccgatggacagatccggcggagatggctttggtagagaagttgaagggcacccgacgtctcaatcttcggcgtggtgattcccagcttgacggcgggcatcagggacatggcggtgcggcctctcgacgacattggccacgggagcggtgactctcaggtgagcacgtgagcgacatgccctc

SEQ ID NO: 38083 - DNA, 425 bp, Triticum aestivum
  Clone ID: PAT_TA_38083
cggggaggaggctcaaatgttcttccacatcgtgctggcgcggtacatgcaactgaacccgcggcacttcggccctcacctcggcgacaagcatcttctccaagctcacgtgtgacatctagggctcctgtatcgggcgggatggcttcatcgtggcgataattggggtggatgacatcatcaatgggctcatcagggaggcgcacaggcttcatcacgttcctcgtcatgtagtaatacgtcgtcttcgtcgtcttcacacagcgacatcatcgacgccatcctcaccatggacaacaacatggggttcttcgcatatgcagggcctgtacagatctttgtgtcagatcacttgattcctgacgatatggaattccaatctgatgatgtgccacactacaggacttctgatgcatcggtgatca

SEQ ID NO: 38084 - DNA, 423 bp, Triticum aestivum
  Clone ID: PAT_TA_38084
gaagccacaatccggcggagcactacttggagcaggtaacagaaggtgcccgcttaataaaggcgcagttctcgaagaatgtcctgttggagtgacaaatcgaatcattgtaaaaacaatgttattttgattacggggctatatttatacttttttcttgaaagtattattgtgtctcctgcgcggctgtttctatgtatatgtgtaatccaaaagttaggagtcgttggcttcagcccccacgcatacaatgcgggggtgttcgcaaaaaaatatgcataatcacacttgatccaacgtcttggtccattaaggaggtgatcgcacgtcgaactaggcaaccggacgatatagctgtaacactttcgcttagccatgggattttaccggtggggctactatgtagcccctggtaccttcgcg

SEQ ID NO: 38085 - DNA, 233 bp, Triticum aestivum
  unsure (1)..(233): unsure at all n locations
  Clone ID: PAT_TA_38085
gggcactacagaaacagcagcttcncagtcgcagcgccccaaccaatggcgccctaaattcgccgggcatcagcgcgcccctcctgttcgcaacgagaatgcatcgtcggtgctcaaattcgccgggcgtgtggtccggcgattcatcccccaacggtcctgctgccggtcgcccatctccggttccggccggaacacccaactcaacaagtacgtcatctcatcctccggtc

SEQ ID NO: 38086 - DNA, 397 bp, Triticum aestivum
  Clone ID: PAT_TA_38086
cagtcagtagttctattgcagaggcggcaaacctgctgcctaataaaacgtgtccggggtaactgaaaacttaaggtgtggtgggtaatggtttgcctccgaattggccgaattaatccgttccaatttcaaccattcgtggaattggttaaagggtaataagtcccaagttcaagttaaataataagttggttggtaaaaaaataaatcaactcaaccacaggtcaacaaagtgagtaaggtgaattaggcgaactaagacgaccttattgaggacaagagcagagagctgactcatgtcgtacgtgaactgaaaaaggaatttaaagaactcgaattggtgtataaaaaggatgcttcacgtgccaccagctatgcataggccattcaagatgtt

SEQ ID NO: 38087 - DNA, 213 bp, Triticum aestivum
  Clone ID: PAT_TA_38087
aaaggaaggggttttccgaaaattttggaaatcccctttttaacgaattcgttcctggcaaaaccgcctccgtctcaaggaagtcacaatatgcaatataccaccaacaaggaaatagatgaacggttatgatgtctcaagtccaagtatagtagtaaattgttggttcaaaaaataaatcatctcatccacaggtccccaggtgagtcaagt

SEQ ID NO: 38088 - DNA, 438 bp, Triticum aestivum
  Clone ID: PAT_TA_38088
cgtcatgtcatttgcatgcgtgttgcatcctaaccaggtcaccaggtgaatggaaccaccaggttttccaaaacttgcatccgccggggttccccaatttctccccgtggtcaattctgagccaaacaaaacttgcaaatgcccgcgacatgtccgagatagtattttataagtggccggaaaatgttctcggattgggatgagagttggcgtgtggtctggttatggtgtaggtagaccgcctgccaagtttcatcgcaatcggagttcgtttgacgccccaacgattaactatagcgacattatagtcggtctaacgtcgggcgttttcggtctccggaaacagatgccgggccctctctctctcttctccccctcgcagtctcgccacagcccacctagtccatcctccttcccctcttcgtttccggagttgtc

SEQ ID NO: 38089 - DNA, 418 bp, Triticum aestivum
  Clone ID: PAT_TA_38089
ttatctgagttgacaatatgtgtaaaatagtgcacatttatctccagattcagcaattggaaggatgtccaacaaaatctcctgataatacaagagaacataaggtgcaacggagtagagtagatctcccatttataaaaagaaaaccatgtcaaactttaataacctttatagacgtgacatgtcttctctttttcaagaaaaaaagtgagcatgtctttgaggagagcaactaaaacgaagatcagggatacccggtgttaaagagagagtaaccgcacttaagaaaagctactaacagacctcaaaccatcactctggaaactgtgaatcccgtggaaactactttattttatcccaataagacagtttcaaacatgtgtagaaattattgctagtgtgtaagctggatgtcaac

SEQ ID NO: 38090 - DNA, 439 bp, Triticum aestivum
  Clone ID: PAT_TA_38090
cggggacacgcaaaaaccctagcagatcgctcgagccctccgccgccgccgcgacttcagctctctccttccttctccgatccaagatgatgttcattgctgcctatctgcttgcttacctctctggcaacgccagcccctctgcagaggacctgacatccattcttgagtcagttggttgtgaaattgacaatgagaatatggaactcatgctgtcccaagtgaagggcaaggacatcaccgagctcttggctgctggtagggagaagtttgctgcggttccatctggtggtggtggtgtagctgtttcagctgacgcccctgctgctggaggtgctgctgcacctgcagctgattcaaagaaagaagagaatgtcgtggagaaggatcagagtgatgatgacatgggcttcagtccgttcgactaagttgtggggca

SEQ ID NO: 38091 - DNA, 442 bp, Triticum aestivum
  Clone ID: PAT_TA_38091
cggggtgagccatagctatggaagggtgctaggtttctggttttgctagacgataggaagagacttggctctgtataccatgttagattggatcgatggaagcgttcctactcctccgtagaggagccgtgtgggtatttattgattgtggcagaaaacctgccttggagtacaagtacttgccgatcgctaggatacagcaggagagaagaccgaggtttacacgggagagaggaagagatagaattaggaggtagttaagattacatgacgtgaatatctctaactctaactctaacacaccgcatgtacggcggcgccgcctcttgcgctgacagtgtgacgacaacataacgcctggagcacggcagtatgctcccttggcttggacgcacactgtacttgttcttgttgatcaatatgttgaatgcgatgaagccac

SEQ ID NO: 38092 - DNA, 450 bp, Triticum aestivum
  unsure (1)..(450): unsure at all n locations
  Clone ID: PAT_TA_38092
ttcccggggtcacggggtcatgcatgtaattcatcattgcctttcgtaataacggagctaaaggaaacaacctctatatagttaattgtggtaagcatgaaacactaagtcttccctgcataaagtataaatcatgagcaccttggtaccaaaccaagcaattggatcgtacttctaacacgcttcagcattttcaacttcactcaatacatgagcgtgagccatagatatagcactatgggtggaacaaaatatggtcgtaaggatcaatangagaaggaagaaagtctcgcattaattgggcggatcaacgggttatggagatgccaatcaatcaatatcaatgagaggagtacggatttccatgcaacaaatgcactaagagctataagtgtatgaaagatcaaactgaaaactaagtgggtgttcatccaacttgcttgctaatgt

SEQ ID NO: 38093 - DNA, 402 bp, Triticum aestivum
  Clone ID: PAT_TA_38093
gtaacctatgttgattcacactgccttccttcacaactgaaccatgggaaacaaactcaatatagttaactgtggtacgcatgaaacactaagtcttccatgcaaaaagtataaagcaagaacaacttggatataaaccaagcatttggattatacttctaacactcatgagcattttcaaattcaatcaatacattagcgtgatccatagatatttcactatgggtataaccaattatggccttaaggatcactaggacaaggacgagagtcacgcattaattgggcggattatcaggttatggatatgctaatcaatcgatatcaatgagaggattatggatttccatgcaacatatgcactacgatctatacgtgtacgatagatcacacagaaaacta

SEQ ID NO: 38094 - DNA, 104 bp, Triticum aestivum
  Clone ID: PAT_TA_38094
cacgaagtaagaccttgttaagaagtatgacttcctaatgccgaataatgacttgtcagacgatttgctaagcaagtaatgttccggtaatgcaactgccaacg

SEQ ID NO: 38095 - DNA, 445 bp, Triticum aestivum
  Clone ID: PAT_TA_38095
cgggacagctgcaagaagagtaagaatggaatggaatgaacgaaggggaacacgatcttgagagagcacacttacaacaaatactataacggagttgttggaaaaccaacaacgaaaagaataagcttgatatggtcttatggaatacatctcaaataatgaggtgacaacctgccactcacagaaaaagattgtgttgataagaataaggagacgagaaacttattcaccggaaggataaaacaagaacttggatcatttataaccaccataaatagcaaaatccttagggaaagctttaggtgaaatataacccaagataactccaacgaagaggttgatggatttaaaatttctcattcttaacaacatgtgaatcatgaaacatgagctcaaattatcaataatgacataataccacctccaatgatacggtagaaagaat

SEQ ID NO: 38096 - DNA, 433 bp, Triticum aestivum
  Clone ID: PAT_TA_38096
tttccggtattgtaccgggatgcttctaaaaggttccggaggatttaggagggtccggaggtccggaaaatgttccaccacgatcaatacagcagaatgggctgtaggggggtgccctagccttaatgggccaggggcaccagccccgccaaggcccatgcccatgggagaggggaaaccctaaaggggagggcctccacttgactttggaggcactcctcccccctttggccgccgccccaaccctagatgggatctaaggggccggtccccctctctcccacctataattagtggaggcgtgggagggcagccgcaccaaagttctggcacagccctccccctctcccaagtcctcctcctctcccgcggtgcttggcgaagccctgcaggattgccacgctcctccatcaccaccacgccgttgtgctgc

SEQ ID NO: 38097 - DNA, 440 bp, Triticum aestivum
  Clone ID: PAT_TA_38097
ttataatagttcgagccaccattgtggtgtaataccctactccattgtgttggtggtggattgcctcttgggctaatgatgaacattacaagggcagaacggcctcctgaggttaaggcgttcttgtgcttggtgagcttgtgtgtgaggtggtctctctcaagctccgatcagtcctctcactccctttttctctctcccttttcactgtggtggctagtcctatttatagaggccctggtcctcttccgaaatatcgagcgggaagggagccaacaatggcgggctaatttgaaggggggtagctagtacaagctatcctgacaaaagtagtattcgcgtgcacaaagttctggtggtgatgttgttttgggctccacgatgacctccgtcttgcagtcctcggtcttggtcttgttgcaccgaaatggcaacctttg

SEQ ID NO: 38098 - DNA, 445 bp, Triticum aestivum
  unsure (1)..(445): unsure at all n locations
  Clone ID: PAT_TA_38098
ggggactcgcagagaccctagcagatcgctcgagccctccgcggcggcggcaacttcagctctctccttccttctcgattccaagataaatttcattgcggcctatctgcttgcttacctctctggcaacgccagcccctctgcagaggacctgacatccattcttgagtcagttggttgtgaaattgacaatgagaagatggaactcatgctgtcncaagtgaagggcaaggacatcaccgagctcttggctgctggtagggagaagtttgctgcggttccatctggtggtggtggtgtggctgtttcagctgccgcccctgctgctggaggtgctgctgcccctgcagctgagtcaaagaaagaagagaaagtcgtggagaaagaagagagtgatgatgacatgggcttcagtctgttcgactaagttgtggggcatcttgtg

SEQ ID NO: 38099 - DNA, 270 bp, Triticum aestivum
  Clone ID: PAT_TA_38099
cggggagattgccaacaccatcgcagcctccaacaacaaggtgttcctcgactcgggcgacctgctgcttgggctccagtcgctcaagatgttgaacaacaacaagaaatgagaccgtctctgtcacgcatgttgcggttgccgccagtcttgtctacattggaggaacgaacgcttagtttctagtattcccgatccgaaaacaagaaagacgccctttgctactgtgaattatttgtgcactttttcaagtgaacctgtcagctactg

SEQ ID NO: 38100 - DNA, 446 bp, Triticum aestivum
  unsure (1)..(446): unsure at all n locations
  Clone ID: PAT_TA_38100
gctgcagtgcaaagctcggtgttccaatggaacttgtcngcggctttcgaaaccaaatttcaaccccccgttgcccaatggaacctctccccggcggtaaccgttgctacttacaaagctcgccgacgggctcgaagttgcagtgcatcgttcagcgctccaatggagctctcactggtggctctcggtgctgcgttgcagcgcttgacgagcctcggagctgcgacgcaaggctcaatgttagtgctacagtgaagctctcgacagcggttctcgaagctgtgatgcagcggccggtggtggctcaagtcttgcgaggcagtgcttgtcggcggcaaccgttgcaaggcgcttcaatggagccctcattggtggctcccggtgctgcgttgcagcgcttgacgagccttggagctgcgaacgcaagctcgatgttagtgctacag

SEQ ID NO: 38101 - DNA, 352 bp, Triticum aestivum
  Clone ID: PAT_TA_38101
caaactgaatcagacgaccgccgtcatggctcttctggcatcggtgcggtattttttggattaataacttaaataagggagatggcagactacgtaacatcatgaagggacaaaactcgatagagccttatctacattgaagaagacaatatagtttgatgtctgatgttggttccttccccctgtcctaaaattgtatccagatcaaatcagtgattcgtttccctgtccagttttgtatttttctctaagtgattttgatgtcggaagttcaactgtatatgtacgtgaaaaaaactggtgttttgtctcagaaacaatgtatgtgacacacgtgaaacaagcgggcacg

SEQ ID NO: 38102 - DNA, 427 bp, Triticum aestivum
  Clone ID: PAT_TA_38102
aacgggtgtaggatggcagacagttctctctacaattccaatggcctcaggcaggcgatgagcaggtgccccggctggaccatgctgcagagtgcgccagggttgataagttaagggatcatgttgcctaatctctctaatgatgtggcacatctggcgacttcaaaatgaccacttttttgacagcgcaaccagaggttgcagacactggtggacacgatactcctggaggcaatactctggatgatcgctggtgcaaaggcgctgaggaggcagccacaacatgcttgcccaccagatggtttttgagtagtttagctgtacagctcatttgtttcttttgttctgattttttttctttgagcttttggctgtaagtactaatacaaaatgatgtgcactttaggtacatattccacagaaaatg

SEQ ID NO: 38103 - DNA, 227 bp, Triticum aestivum
  Clone ID: PAT_TA_38103
gggccacgggcgtggcggcagcgtgaggagagcctgtgcccccgaacctggccgccaacctcggcccaggccttggcaaaattcttcccgcatttgcaggcacattaatcaacggtccaaatgatcttcccaatccggtctgcaatccgtattgatgcatgctatctcgcatgatctgcccatgttccattaggctcaaattattggtgtttccagtccccccgatg

SEQ ID NO: 38104 - DNA, 433 bp, Triticum aestivum
  Clone ID: PAT_TA_38104
gtccacgggccatcatgaatattcattggtgtctctcaaattcatgttggcagatgtgctgcatctacgtcaacgacatgtaatctgcgccctgacatacctgtgccttgctcatgtatgtttgcggattcacatgttactgtctgtacttgtgagaatgatgtttgacgaaagtaacaacttgaacataacatagcccatatgaccaagctgttccaattcgggagctcactctgtattcaattactttctattactaaacatatacttgtatctccaaccaatccgagctgggcttggtgggcttaacctatgcatctgcattggatttataaaagtagtaaatgtacatttagagaacttgacagactaaactcatataacttcacacatggataacgcactattataagtactcaaaagatgaccattc

SEQ ID NO: 38105 - DNA, 444 bp, Triticum aestivum
  Clone ID: PAT_TA_38105
ccggggtcacgggaggtgcttgaggggcccacgagacagggggcgcgccctagagggggacaccctcctatctcttggcctcctcgagggtcttctgacgtgaactccaagtctctaggatgatattctcccaaaaaatcacgatgccgaaggtttcattccgtttggactccgtttgatattcctcttcttcgaaatactgaaacaggcaataaaacaacaatatgggctgggcctccggttaataggttagtcccaaaagtaatataaaagtgtataataaagcccgtaatcattcaaaacagataataaaatagcatgaatgcttcataaattatagatacgttagagacatatcagcaactccttcccctattccctggagatgcaacgcagggaaacaccgttcgaccgtttccggtagagctctccatcttggatgca

SEQ ID NO: 38106 - DNA, 262 bp, Triticum aestivum
  unsure (1)..(262): unsure at all n locations
  Clone ID: PAT_TA_38106
ccacgattcgcattgggcgcgtgacgtgggggtcgtgtgtgggatggcctgaacatgcttgcgtcatcctgtagttgatagtaaagaggcagccagtgcttcccttattattaaaaaagagggattcgcangggcgctacttatttactaagtggacttgggtcgcaacctgcatggcgccacaccccatgatcacggngtggaaaatggtcgccccacctgttctcatgcctctgactcgctcgccacatgtcncgcatgc

SEQ ID NO: 38107 - DNA, 434 bp, Triticum aestivum
  unsure (1)..(434): unsure at all n locations
  Clone ID: PAT_TA_38107
aaatgaatacgaaaaggatggcttcatattggatgatgcggataaaaacaaggaggaggaggaaaaggaggcaaaacctattgatgataaaagacccaggaagaaaaagaaaagaaagaaaaaaaaaaaaacggaggatttcaaccttgataaggatgactacatgttgctcaaggataataacattaccggcatcactcgtccgaagcctcctgaaaacaagtttaagcggttgaagaaggcaagacgggaatctgaaatggatgggcgttctggcttctctgatcatgacggagcaagaaaaagccggactgctgaggagacagttcgtagctccttgtttggtaatgaagaaccgtttgaggaagattttgtcgaggaagatcagcangtagatgaagatgaagttggtgaagatgatatggatgatgaaa

SEQ ID NO: 38108 - DNA, 395 bp, Triticum aestivum
  Clone ID: PAT_TA_38108
atcatcggactcatcaactattcatatttcacggtcaagatgttcaaaggagtcattgcatcatcttacaatgaaagtcataacttcttcattgatcccattaacccgctgctcctttcatgcttcctgccgcagtgaacgggctctactccatgaggtggttatctcggtggaagatgtgctggtcacggtggatttggtggccgtggtcgattccatagaagacgtgcaccaaagggtcgtggacctcccaagggtgaaaggcgttgtttcagacgacgagacagattcaatgatgtacatctaagttagctgtatgttgatccacgatattctacattatctgttcagctgcaaacattatgctaactcaactgtgatcacgcattcagttc

SEQ ID NO: 38109 - DNA, 318 bp, Triticum aestivum
  Clone ID: PAT_TA_38109
agcgggcgtcttgaacaaggcggcgctacagcttggagactaatgtcgtatggaatatgtacattggctccggcgggatgcagagggaggatgtcacgctccggacatacgcgccggtggttgttacttctggcggagtctagactacccctacagatgactactagtcttttctgtgcactttgtctccactcgtgcgcaactgtaagcaacttcccattcggtcacacatcttgaaactactctaagctgatcaagcttaactttggagttctatccgaatgggctctcggattatacggaattccttattgatat

SEQ ID NO: 38110 - DNA, 418 bp, Triticum aestivum
  Clone ID: PAT_TA_38110
tccgggtccacgggtaggatttcgaggatcgcgaaatgcaatgcaataaaatatgatatgcatgaatgatctatgtataacattccaaattgaaaatttgggatgttatatatgattgtgttttttatgttttaattagtgtttttgccaagtaaagcctttaggatcttcttgggtgattgttgtttgatcttgctgaaaaaaatagaaagtatgcgctcacgagaataaattttgtttttttaccagagagcgataaactaccaattccaactgaagtggatcaatatacaaattatttaagtcctcctaaatttttagaaattttggagttacacaagtattccaaacctgcagattgctataaactgttctgtttttgacaaaatctgtttttcctgtgttggttgcctaattt

SEQ ID NO: 38111 - DNA, 381 bp, Triticum aestivum
  Clone ID: PAT_TA_38111
ttgaaataaatctgcacgcattgatatataacgaattacaagaacaaacctccgacgccccaaaaagtatccaacgggtttgcgaataccgtgctacctgtatcactgaatgttgaatcctcatcatttcgtgctttacatttctttcgcctctctgccctatgtttcggtgtgatacgtcagtggtacggtatatggctgatataggggggatgcttttataatgttgatccgtacgaccacattaaattggttcaatgtaggatctcatgtcttgaacagcctgtaacaatcaacaacatacagatgctacatactgcagtagttggccagattcagtgtcggcacctgttgatataacttaatctgtatccacggttc

SEQ ID NO: 38112 - DNA, 428 bp, Triticum aestivum
  Clone ID: PAT_TA_38112
ccctcgagaaaccatttttgtctttttgatagttgcattgttgcagtaaactcggacaatagcaagagaacaaaattctgataacaattttttaaaaaaaaatctacaactagcaatactgctacaaatctggaccagtttagacctcggaccacaagttacggctaagtgctacagttatcttcggaaccttgtctgttcaaggaagtggcgggttggagccttatagaagcatcaccgcagatggccgtcaagacatcaaactctcctcacgttgtctccatggataaccaccgcgccttcagtcatcagggtgccaagagcaccgcggagttcgtgcatatgaatttccattgagctctgcttcctcagttcctccagcaactcaatcatgcgcatcgaggggcctccaagctgcattttccccg

SEQ ID NO: 38113 - DNA, 149 bp, Triticum aestivum
  Clone ID: PAT_TA_38113
cacctgggcatccattgtcaagtcagaactggggacatcaaaacgatcgggcacagcagatcgtgggcacacatcacatcttcgcaaggcttggaacaggatgctcaataatcatccaaacgacagagaaccagcagtgacaactttgt

SEQ ID NO: 38114 - DNA, 363 bp, Triticum aestivum
  Clone ID: PAT_TA_38114
acgttccactatcaaaaaatatataagagaaacatacagaccacgtagctctgaatcacttatatgcgtcttttacttgtttacatcatcatattatccctttggagttcgatatatggtcagttgccaatttttcatatcctaagtcgcttaaggtttcatgataaaaggcatgagagagcacatctgtaataggtgcatgcccaatatactgttttaaattcactatattgtttgtgttactttgtgtccacagcctatttaacaatggggctcttacttaaaagctactgtgatgtctacctatctcttgtctgatacaatcctgctttaaacaagtgccgagattttgcatcgtcacca

SEQ ID NO: 38115 - DNA, 371 bp, Triticum aestivum
  Clone ID: PAT_TA_38115
atctgcaacccttttgagatttaattgctgcatcgctacaatcgggtcagctacagatagattacactacaccggcagcttacacaccggagcggactcatgcacacaatacaacagcacatcctcgacgatatccgccatctctctcgcattcgagaatggcgcgcgctcgccattgccgtcccccaatcgggattttatctcgctattgctacggtacggccgccgctacccattaggtcgacgtcgccgcgatcgggctggcgaccacgtggtggtcgctggaccagactagccgcccgaacccgttggtgcccgacggcatcccgcccgccgtgaaacccaccgtgtagcgcatcctctcgctggac

SEQ ID NO: 38116 - DNA, 422 bp, Triticum aestivum
  Clone ID: PAT_TA_38116
cccctagagtattttttcttgtcttttttttattttatttttttttttttttttttttttttttttttttttttcagaaaagccggaagacaatagagtttttgaacattaccccgaacaatacacataaaaggatcgagtctccgttacacgaaatcctggaggacgaatgcagctatgcacgcaggcccatggatcttttattttatgagctaaaatggcttcgagccgacccaaggttaccatggagactctacttgttctgcagcaaggacaccgctgccttatcagtgaaccaggtgaattctccatcttgtagcacagccatctcaacaggcagcaggtctgacgaggtttgcttgtctgaaagcgccttctgcaccgctgccgcctttccagctccagtcaccaccatcgcaacg

SEQ ID NO: 38117 - DNA, 154 bp, Triticum aestivum
  Clone ID: PAT_TA_38117
cacttgcagattactactaccgcctgcaggtgtagcatatcggttgcacagaaatgacgccagtagatccaaacgggaaatcgctgctacaccccgtcggattcacaacgtcaccagcggacgccacacgctgaggaactccagctattgggca

SEQ ID NO: 38118 - DNA, 352 bp, Triticum aestivum
  Clone ID: PAT_TA_38118
atgcctggcctagcaattctctgaaaagctttattacatgttcatcgagtcgtaactcgtaacaccgtgtcgcaccagcaagcggagcgcccatacaaggtgaataacgtatggtcgccagatgaggttttcagagcctaagaccaggaccttttctgagcctagaaacatccagaggtacatgctcgaaatgtcatgagcagcatgtgtgttttgttacattgtaaaatcaagcctctgggagcttgaagatggctccgaaaggtttccagaactccacctcttcagcatctccagagcagccttcggttgatccataggtaccatgtgaccaacatcgtgaaccttcaag

SEQ ID NO: 38119 - DNA, 217 bp, Triticum aestivum
  Clone ID: PAT_TA_38119
ctcgtgtgctgaatcgctcgcgcatagctggatccatccgagcgggctcgcgggcgcagcgcgaggctatagcgagcgagagagcgatagcgcggtgcgcgggcgtggctcgctcagcgcgcgaatgcgctcgtcgcacggatgcaggggagagaaggttcgcttggtcggttgatcgataaatcgaaggaaatccggatgagcgatgaatgcgccg

SEQ ID NO: 38120 - DNA, 409 bp, Triticum aestivum
  Clone ID: PAT_TA_38120
ccctcgagtatttatttttgtctttttaaaacaaacatctattgtgatctgagatttaaaacaggcatcatagatgcttggggtaagtacagactgcaggctaaacatcccaatccaacaacggtcgagtgccgatgaagcgaagaaactacaaactaaactgcctcactccagggacgggacgacacttgcaaggaaactactcagagaagacggcactaatctactgcatctagaaagtccttcgagaaagcccggttaggccgacaacgacgaagatttttttccctgactgcaaacacttggacagagtttcatccgtcatacatcactcgtcaccctcctcgtcctcgtcgttcacctcggacttggacttgtcggaatcaccagacgccgtggggtctcctcg

SEQ ID NO: 38121 - DNA, 407 bp, Triticum aestivum
  Clone ID: PAT_TA_38121
ccccacgagtatttttttttgtcttttgggaaggacagtgacctctctctctatattggaagtatagaacaaggtgccaaacccattgtcgtcactccaaaccacccaagcacaacaggtggtcgcaaattacacgcgccattaatgcgcagcttggaccagcgggtttcaggtcaaggccaaactgaggaaaagatggcgtccggtccccgacagcgacgcaccccgccgccagaaaacaaatgcagtactgcccgagctcgaaggaggtttgaacggtgcggttttatttcgacttcctgcttggctgcttgctttactgaacgaagcacgaacccgggccgaccggcggcctccgagcgtagtagttcgtgacaggagccgcggcgaccccacggtggttcagc

SEQ ID NO: 38122 - DNA, 400 bp, Triticum aestivum
  Clone ID: PAT_TA_38122
tcgagtattttattttgtctttgtcaatgtgcaaatatctgcgtgcgcagaacagcaaatggcagctaaagctgaaagaaaacaagtgctcacaagtacacatcataggagaggtcacggaggggttatgcttactaggcagacggctagcatacgcaattgaggacaaaggattactggaaagctttcccgaattgcggcatcactttagagcatcgccgaggcccgcaagcattcccaggctctgcgccaactcagccaacctcactttcaaggcctggacgctccgtcggtgtacatccgtgtaggcatcgttgaccaaacccgaaagtctttcagcacataacaccatcgcagcttctgtgagttcaagactcacaggttgctggtatccaaaaag

SEQ ID NO: 38123 - DNA, 389 bp, Triticum aestivum
  Clone ID: PAT_TA_38123
acaactagtctcgagtattttttttttttttttttagtgccatcaccatatattcgatatataaaacgttaccacaatttgctttctgtacttaatagagcgacattagcacatagcagatctacaaagcggtaaaggactccaacacttgtgcaagctcaactgcagatatttcttgaagtttcaacctactaccaaagaattaatggaactatgcctcgcggtatgtacatcgctgcagatagaaaccataaaaactgggtttcaacgtcagaactcatttccttctcttcccacttcctatatttgctcacttgaaaaagaacttccatatcgccctgtcacacacctcagtcaagaagtggccaccaaggacaccttcctcttcc

SEQ ID NO: 38124 - DNA, 396 bp, Triticum aestivum
  Clone ID: PAT_TA_38124
tttggctgcataaacatacagctggttcgtctgaacatttacatacaacccaaaaggtcacatcgcttcccggaaagagaaacaatataaacaagagcaggaaaacccaaaaggtcggttcggttctttgatgatcccttctaagagaaagtagggaaaagaagaggaagaaaccacgaataaagatgatacaagctcagaagacgttttcttcttcacagcacaccaacatcactgcaaggaagtgtctaagaggtaaacactggacactcagttaccgtcctcttctggccagtaggtgctgttagagatgaacagaggtcagatgtcttcagaacgctcaacctcttcaccgaagaaacaaacatcccccagagggacatcgccaaacagcaa

SEQ ID NO: 38125 - DNA, 432 bp, Triticum aestivum
  Clone ID: PAT_TA_38125
gatcggccaacagtgtttcacattgctaccactacagctaaaatctcgataatgatacagttgatccatcttacaacaccagaagaaaacaatcctgaggatacacaaggcaaggatgtacaaacgtaaacagcagtacagcacacattgatagaccttcgaatcgaacgacaaatcctagtgcttgcctgacatgcagcgccagaaaaatagagaagatagagaaataattctgattattccaagttgaagcaactcctgcaacatttggtatccgacaagcacccactcatcacataggctaaactagttcgctacaataagctcatcttcaggattggcattttgaggtagcatcgtcaattcatcgtcagctgcactgaaatgatatttctctccaacaactcccaaaaacctggtaaacttcaaaca

SEQ ID NO: 38126 - DNA, 383 bp, Triticum aestivum
  Clone ID: PAT_TA_38126
tttaaattaacgaaatgcttacaacagatatggaatcctaatattgttacaaaataatcatgctactcatggaggacaaaaacagtgatgcacagttgtaatttgagcaacagcatcaccatatgtgagtacaagacattaaccacaaatggagaatccatggtagcatcttcacaagttcagaagagcagaagctgcagtataacaggctacaaggatacatatcatttatcactttgctgctccttcaaacaagtgctggatgtgggctacaacatcctctggggtgtatttgatgtacaaatcacgcccagtttcaggagaagactttaacttggcaattaaagaggcgtaaactggcatcactgtctcctccaccgctg

SEQ ID NO: 38127 - DNA, 385 bp, Triticum aestivum
  Clone ID: PAT_TA_38127
tcgagtacttttttttgttctgttttttttttatttttatttttttttttggcacatctcaataacaaggtgcatgttgaggaaccaggtaacatgaaaaccacctgctgcttccaatttgtttgtgctatcaacagccaaaaatcacgattagcagttggcattttgatgatcataggaaaagctaaaaagcattctaacccgatacaacaattggcatctacatatgctaagcagcataacaatttcactggactaacatccccacaaactaacaccaagcttgtggcaaaagctagttacttgttactgatccccgaacaggcactaacccccaagaaaataaggatttatgccaccaaaatgttatcgccacgtgttggaa

SEQ ID NO: 38128 - DNA, 424 bp, Triticum aestivum
  Clone ID: PAT_TA_38128
gtactgccccgcctcgagtattttattttgtctttttttttttttttttttttttttttttttggcacatcgcaataagaatgtgcatgttgaagaagcaactaaaacgacaaccagctgctgcttccaatttgtttgtgctatcaacagccaagaatcaagattagcagttggcaatttgattagcataggaaaagctaaaaagcattctaaccctatacatcaattggcatccaactatgctaagcagcagaacaatttcactggcctatcaccctcacaaactaacaccaagcttgtggcaaaagctagttactttgtgctgatgcccgagcaggcaataagccccaacaaaatagggatgtacgccaccaaaatgttatcgccacttgttggagagcttggctccaaacggattgctccc

SEQ ID NO: 38129 - DNA, 385 bp, Triticum aestivum
  Clone ID: PAT_TA_38129
catatcataacgcttgatcagataggcacagacatgaacataagacaagatttgccatcaacaaactaaatatttctctcatatgtgtcctcacaggatcgcaagagcaacagaaacactgggaatcctttttacatgcatcagacccaaaaacaaagtctgaaagtcttaatgccatcacaagatttttctgcttaaccacctagtgggacttgggacttaacatggaccataaaagaggccatccacaacgaagtcttttaccaaagagccatccctggctccatggaccacaaaagcttggagattttcgggaagccacgactcaaaagcttggagatctccagcatcccaaccttgtccctcccaccaaacaagcttttga

SEQ ID NO: 38130 - DNA, 402 bp, Triticum aestivum
  Clone ID: PAT_TA_38130
ttgtcttttcaaatcaatcactatcatcatggacagatgtcaagttaggctattacaatgaccacagaacatcattcagcatggcacataagccacgccatgacattcagtattcgacacagtaaggacatcatcagtaactaacggtttcacattattagcaacaaggcaactgcaatcacactggatttacattgtacaggaagcacagaaacctaaatcaggatctaacgagtcacaagcaagcatacaggttcctagtatatgccagcagtagtctctaactgtcaatgccaggtccggtttgcccctgtgtctgcagctgacctggcagttggggctgcagctgcgcttgtgagccccccctgtgattgtagagatgtacctgaggttggggttggg

SEQ ID NO: 38131 - DNA, 368 bp, Triticum aestivum
  Clone ID: PAT_TA_38131
ttgtcttgtctttttttttatttaatatgattcatgtaaatactcttaacttgggagcccccacgatctaattcgtcatgaaaaggctccaggcacgcatactcgatatagagagataaacactgctggagctggactcatcgttccggctttgtggtggcctagtcttgtgctgtgacattctgcccctcctttgtttgtgatatgccataattttgacgtgagtacagtttcactggcatgttgattctggaactacgactggacatgtgggaaaaactagtatactttggtttgggaccgcaacaggcattaagccccatccgtatacggatgttcgctacctaaatgttctcgccacttgttgc

SEQ ID NO: 38132 - DNA, 451 bp, Triticum aestivum
  Clone ID: PAT_TA_38132
tttttcttgtcttttcaacttcaccagtatgctacgtgcaagttgaccgcatatcagccagcacatcttcactgcatcatgtaactagaaaggtgcaagtcaccatgaatagtaagtactaaatactgataagatggtgataactgataataggataatgctaaaacgaaggttaaaagtggaatggaactggtgtacataaagtttttgataaccagttcaggtgccaaacagaagtagtattccaaggttgaagcagcaactgaaagacggcactacacaactttagctgagaagaggccaccatcgagcaaatgcgtacacataggatcagagcaagtccattcatcctgagctactcaagatgctttgcaagtgaattgcgcttatgtcgatgggctccgagaaccttgaaattggtcaaatgttgcccctgacggaacatctccca

SEQ ID NO: 38133 - DNA, 281 bp, Triticum aestivum
  Clone ID: PAT_TA_38133
tttgtttttattgtttttttatctgttatcgtgtcgacactagtaaacgtcattttcgcaaaaagcatggatttactgaaatgggaatagtgaaacaagtgaccttcatgccccaaccagacaaacgctttccagttcatccgacgggatggatcaggctgggaaatgcccaatacagtgtcaccatggagggtttcatctgagcggatgacgggagagctatcccagcacaggtcgacggattgcccaaccaaccgtagtatatgcacgacggggggatg

SEQ ID NO: 38134 - DNA, 405 bp, Triticum aestivum
  Clone ID: PAT_TA_38134
cctcgagtattatttttgtcttttttttttttttattttttttttataatccaagcacaagcagttgtttacacgattgtatcacatgttaaacctacatcccatcagaaaaagtaacggctaggcccataacatacactccatgcaacgccatcaagtggccaaatacaccagttatcataattaacaaccagcatgatctgacttcaaacttcatgccgtacgaaggggtggagaaaccaatatgacaccatcacctcggacaaaaagaaaggggatagtgcgtttcgtggtgcgcacaatttcttcatatgtttcatcatctatctcaacagttgtcacgacctctcaacatctccaagtatcatgtttaaatgttgatcatacgcatggagcttgccgcgc

SEQ ID NO: 38135 - DNA, 311 bp, Triticum aestivum
  Clone ID: PAT_TA_38135
attattgatctcggtgacagaatgcagcagtgaacatggaagaagcgtaaactcaacaccatccgctgctgacaatactttcaaattttagtacacgagatatgacacaaatcatgtgggatgcacacgatgggtagcccatgtaaatgaaatgacgattggatttaactgcattgcagttcataagatcctgttcaatggctcccgtgttgatgaacttctcaatggcatggaccgcttcgaaggcgaccgggatggagaaagttatggggccaaccaataggtcgagagatttggcgacgacctcatct

SEQ ID NO: 38136 - DNA, 288 bp, Triticum aestivum
  Clone ID: PAT_TA_38136
tcgagtattttattttgtcttgttgaactgtcaaagacgaatctttgtttttctttttgcatcttgaacgataaacaaagaagtgtttttttcctcgtcttcatagatagatgctactcatcattccatgcacaggtacgcttcgtagtcgtcgtcgttcgtaatggtcacttcacgtattaattggcgccatatcggtcgtaagggcggaagccgtgggcgagcgcggcgcgccaggacttgtctatcccggtgaacctggcgcagcactcgtgcgcgtcccagcgt

SEQ ID NO: 38137 - DNA, 403 bp, Triticum aestivum
  Clone ID: PAT_TA_38137
tcgagtattttattttgtcttgtcttttggcagggaaggagaagacttggaagaggggaagaagataggcagtagtgttttctgttctttttttcgatgtcccagtttacagactgaagccatacatatggcacaacgactgggccacactattacagtcaacgaacccactctaggccggacaccttgctattgggcttaagcttcctttttaatcttggctgtagcagcacaccatcttcgcttccagtctctggcgcaggttcacttgtcttggcatccttgtgtgtgctaacagagtccgataatgtgatcttgattcccaacaagacaacaatagaaatgcttaattagaaacggacaatacattatcataaccagcgtccaaaacttggatgcaaca

SEQ ID NO: 38138 - DNA, 415 bp, Triticum aestivum
  Clone ID: PAT_TA_38138
cccacgagtattttttcttgtcttttttttttgagtatcgaacagcagaataatcagttggaaatacagacagttgactttcaccgctccctcaatattgtcctaataatattaaccaacagcctaagaaatacagtacaaaagagtcacgcctatcatacatcgaatgttctcaatatagacgaagctgctggccagcctacaacaatttcagagtttaacgtgactactgggaagggcaaaatcatctgcgcgatgaaacccagctgcgcccaccagcactggctgtagtcttcgggggaggaaacatgcttatgtcggttggggcagcgggttggtcttcaaccacaaggaccgccctagcatggctctaccatgaacagccatgtatgaagcattcaacttgtcaacatca

SEQ ID NO: 38139 - DNA, 426 bp, Triticum aestivum
  Clone ID: PAT_TA_38139
ttgtgtatgggctgccctcgagtatttatttttgtcttttttttgcttcactgaccaagaaacacttttaggtttcagaagcaacattgtcttgtctcacgaaacaatacaatacttgaatcaaacacctacttcttaaattatttacatgccaaggctcagaatgcttatcactttggaacacataaaacgaacgactctctcaccgttcgttcgttcattcattcattcattcattcattcacaggccagcttggtgtcgaagctcgtcagacatatggcgaaggcctggaaggccgacagcgggtaccggtagtccatggtgaacatgtccctcccgaccttgccgaactgcaggatcaccgggtcatggtacgacgacgacgacggcggcggcggcggcggggggccggaggcctgcggctg

SEQ ID NO: 38140 - DNA, 399 bp, Triticum aestivum
  Clone ID: PAT_TA_38140
gctcgagtatttttttttgttcttgtcttttttgcgaacacaatttagaagttggatagaaattagtacgcagacagcaatcagcaggtatggaacatgtttcacatgatgtttagatttgcaggtatctctcttatttggcggttcacggttcaccgccgagttgatttccgatatcgcccttagctcaccggacactcagttgttgcaagtggcaactacgaaggaggagcagcagaggcagatgcctcagccggagccgcctcgtcatccttgtgcttcaccatgcccgagtcgaccagaatcgggacttccgccgcgagccacggcgcgaggccgaggcacagcgcgtgcgccaggccgaacctcgggcagttcttggcccacagcggcttgaag

SEQ ID NO: 38141 - DNA, 423 bp, Triticum aestivum
  Clone ID: PAT_TA_38141
ccccacgagtatttttttttgtctttttttttttttattttttttttttttagattggatgtatacgtacatttacatcgcaaaaaaaaagtatgtacaatttcgagggacgtggcaaaattcatcaatcactcggccaaaaattggtttgtgcaaacatctctgatgatggatactagtctgaaagaatctgttctaactcaggatccccggccaatacatcgtcaaccatttcagcgtcaacaacctctttgtcagcagggacatcttcgtcatcatcaggttcgcccgcctcttcatccgtatgattgggaacagctggctcgccaatgcctttgccttggtcagcaacactattcaatacttgatcatcttgagatttggctctggctactgctttgccatcagtcctttcacaaatgc

SEQ ID NO: 38142 - DNA, 244 bp, Triticum aestivum
  Clone ID: PAT_TA_38142
tgccaggaaattggatttgtgaaaacgtctcagatgctggatcatattcagaaggactctgttctaaatccggatccccggccactacatcatcaaccatttcagcatcaacaacctctttgtcatcagggacatcttcttcatcaacaggttcgcccgcctcttcatccatatgattggaaacagctggctcgccaatgcctttgccttggtcaccaacactattcaatacttgatgatcttg

SEQ ID NO: 38143 - DNA, 342 bp, Triticum aestivum
  Clone ID: PAT_TA_38143
tttgtcttgtcttttcaatgcacaaatagtaacatatgagagggtaatagtttattacatcaagacgtccgagacatccacataatcatctacgatatatcaacatgcataaacgaatcgtagctaaactaagccttcacatgcagcccactgggggtttaccgctaatccacacctacaactcatcgtactcatggaacccatgaaaatcatccaacaggacatcatcatctcctgatcagtaattgcattatggagaccacgtggatgtgccaccgcaaggttacgtttttggctcgttgtcatggcatggaaatggcactgatgctcgcgtgacgatgc

SEQ ID NO: 38144 - DNA, 412 bp, Triticum aestivum
  Clone ID: PAT_TA_38144
gttctgtcttttttttttctttttcttttgcaatgcaaataatatcagtaatgaatatacgacaacaatgtatctgtttccgcagacccctccagcgaaaatcgacccactgatatctgcaaaatcccagttccagctttccctcgtacaatatgtgaaaaagaaaacaaaggtaaaagtgggcaagccaaaaacaaccacacccaagcagccccactgtatagaaaaaggactattaccaaactggttatcggccctgacaaaaagtgtcaggtgatatcaaccaggaccacgccctcgacatcaagaccgccctaagccactcccacatgtcttgcctgcttggggctatagaatttactggagcgcacacgtaaaaaacagctgatggaccacaactgaactccaagca

SEQ ID NO: 38145 - DNA, 377 bp, Triticum aestivum
  Clone ID: PAT_TA_38145
cggagatgacatcccggagcatgagctgccgtatccatttactcaagcaaaatcaagtgtggctcagagcacaccaagagttgttactgaagttgtatttgccgcgccatcaccaagcctggctgaacagccggctgttgcactgtcgcacatgtcgcagtctttcaagaggaggttctcacaaagatcttcaacctactctgcaactgccagcacaaccggtctgccgccgaaggctgagtctactgctccatctccactgggcagggagttgatgctcagttctacttctggtggcatagatcatgagtcccaagtgcaagagaaaagtagcaaggatgttgcactcaggtttggtgttacagaagggactcctg

SEQ ID NO: 38146 - DNA, 152 bp, Triticum aestivum
  Clone ID: PAT_TA_38146
ggtcgacgggtaatgcccagtgggacggatatatgcctgcatgaaacctatgaggatgatcctcaagttccggacccagtccgtatagttgctaccatcgtctttcaacttggttttctctaggaacgcgttgaaattgaggttgacatgcc

SEQ ID NO: 38147 - DNA, 401 bp, Triticum aestivum
  Clone ID: PAT_TA_38147
cttcacaaagcagagtggattccgatcataaaaagtatgctctgcagaaaagccttagacctcccgatggcatccttgaagatcttttcacggagccagatcttgaattcagcagattctcattcgtgttctcctccatgacacccgacgatccacagtctatgggcttgctcaggattacacttgagaatccccatttggaaggggaccaaaaggatcaggagcctgcagccgagaaggaggctcaccagaaagctttccacttatatgccgccatctctcgagagcaggccaatcagctgcaactggcaggcgacgacgatcgaggtaggttagagttgctatgcaaggatcttactgtaaagctgatggggtacgacagtacatgtgatacaggcaac

SEQ ID NO: 38148 - DNA, 373 bp, Triticum aestivum
  Clone ID: PAT_TA_38148
cggggacagcgaaaagtagaatgggatggaagtggagcctgcggcgttcgcatctgggtgaggatgaaatgaagatgcaaaggagaaggggccgacgaggaggacgaggacgaggatgaggacgacgaagaagacgactccgacgacgaagaagacgaggattcggaggatgaaggggacgaggacgaggacgaagactccgacgaggagggctacgacgacgacgacgaagacgaagacgaggactccgatgaagaccatgaccacgaggaggacgaggacgacgaagacgacgactaggacgacgacgagtataatgggatggaagtggagcctgcggcgttcgcatctgggtgaggattaaatgaagatg

SEQ ID NO: 38149 - DNA, 432 bp, Triticum aestivum
  unsure (1)..(432): unsure at all n locations
  Clone ID: PAT_TA_38149
cgatcttaaatgatcaaagacctagatgaggaagaagagcaagatgcatctcctgcaaaatctcaaaagctaatgggggatgcaatcagaccatgggctgctccatcaaagcccaagtctgcccccaaggttgctgttcaagcccccaagagatccaccagaaacattgcaccagctgagaagaacaaggccccagtgcctgaagtggaagaagaagaagaagggcaagtgcttagaaagttgaagcccaagattcctgaccatgatgacacccatccagtggcataaaacactacanaaaaagacacatccgtgacattttgggctgaacgaaatttttttctgtcatacatatgacacttctatgaagataattgtgacaaaacccggtatcatcatagatgtggtgggctcctacttctatgacaaaaa

SEQ ID NO: 38150 - DNA, 218 bp, Triticum aestivum
  Clone ID: PAT_TA_38150
cggtccacgggggtgccccatgcctcctacgctcgcgccaccgactgcccgagccaacgccccgagccctctttctctgtaaataatttgtagaagtattttgtaatttgatctctgtaaataagttgtagaagtattttgtaagttgatctataaagaaattgttgatgttcagatctgtaagttttttgcgtgataatgttgtagtaggattttac

SEQ ID NO: 38151 - DNA, 182 bp, Triticum aestivum
  Clone ID: PAT_TA_38151
cggtccactgggactactaaaagtagaatgggatggaagtggagcctgcggcgttcgcatctcgttgaggatgaaatgaacatgcaaaggataatgtgccgactaggacgacacgacatgataagactacacaagttactctacaccaaaaacttgattccaagattaagggacaagacaag

SEQ ID NO: 38152 - DNA, 423 bp, Triticum aestivum
  Clone ID: PAT_TA_38152
ggtacggctgataacaagacgccatttttccacttcgtgatctttccgatccttgaagtactcggctgcgtcagcagcactggcagccaaatccacgtaggcgttcgcagaactccatagccggtccagatgcgcatacttcggatccccgaacttcgtccgcaacaagaagggcttcccagacacgatatctgcaacttgattcagctcctcctttatcgctctaattttggagcgggcttacttggcagccacccgggccttctccaggtccgtcaccttcgcccgattttcctcttcaagaagccgttaacggtcaggagcatcttttaactccacggccatcttggcaactttttccttgctctcgcaatgtgcggcctgttcggcccttaactcttcagccgcctgtaaaacgggcgc

SEQ ID NO: 38153 - DNA, 429 bp, Triticum aestivum
  Clone ID: PAT_TA_38153
tcgacggggcccctgcagtgtgcaattggcaggaatcctgttagtttgattttcaaaccctttgagagcgatccgtcagagttaaccttctctttttacacctgcttagttaaaaacagactttcattaatattagttgcacaaacgagagtacatcacacggcttaaactcgatcattacaaaagtacgccatcagcaacaccctagctgcgcctacaccattacatacttggctgctaacctatgatacaaatgtcataatacaccctagcaccttgattcagatttgctatcttttctgcggctgctatttcttgctccgatttagggatctattgaggaacagtgtgcaactaggatttgtttcttcgatttggggatggattattatagactgagccgccaccaattgaagagttataatgaaa

SEQ ID NO: 38154 - DNA, 269 bp, Triticum aestivum
  Clone ID: PAT_TA_38154
tgtgtgagcaaggcatgtacattagtatcgatttcgcgagtgaggatcctatgatgttgggcatcctcacatggctggaagacttggatgctcttatgagacaagcatctgatttcggaaaatttcggcctgtctaccatcacaggtcgatgggccatcatattacgtttacgaggatgaagtcctactttgatgcaggcaaccttcttcatgcctcctgtaaccagaatggcttctgcattaacgcagcttaacttgctaatctacaa

SEQ ID NO: 38155 - DNA, 268 bp, Triticum aestivum
  Clone ID: PAT_TA_38155
cgggtccacgggggtgagggaggtgacgagggcgatgagtactagagcctgcctcctggtgctttcccaaggcatgctgctgcaatcctatgatctgcccgagtggctttatctgttttctgtctgtttgaattgaatgtttgctgtggggtgtttggtttacaacctgttgtgttgtatgaacctgcttcgcaccttggtcaatatgcatgttatccggtttgcctacaccatagatctactgctccgtcaccatttcccagtttcg

SEQ ID NO: 38156 - DNA, 254 bp, Triticum aestivum
  Clone ID: PAT_TA_38156
agctcggtcaaaaaatgaaggagatgaacacggaggcaccggtgcaggcggaggcggtagcagccaagaactgaacggcgacggcggcacgtcatgatcggttacccagtcataaatttgtgtcagaataacgcattgcattagcatgtcatcaaccatccacacatatgtatcacctgatccatcgatgagagttcagttcgacaacgatgtaatttgcctttttctggttttaatgtgatgaaatttaatgg

SEQ ID NO: 38157 - DNA, 446 bp, Triticum aestivum
  Clone ID: PAT_TA_38157
attcgcccggtccacgggttatattaagagtgatgagatccacattataatccaacaactagatacccagaacgtccataaccggggacacaactaaccatgattagtttatacactctgcagaggtttgtgcacttttccccacaagactctaatacatccatggtcaaagaaacgagacacagtgtttctgagacaataactctttactctgggtggacagctacacctactttcccctacatctgctagcccacctctaatagaggtctcaaaatgtactcaactatgctagagcccataatagcttgtggatgctcacggaagtttctagcatgaacaatcttatgatccgtttgagcctgggttgcggtccatatgagaatcacacagtattccaggatttccacaggcacaggcatcactgggttccccaagtgccccaa

SEQ ID NO: 38158 - DNA, 436 bp, Triticum aestivum
  Clone ID: PAT_TA_38158
tcgacgggcgcagattacttcatggagacgtctgtcaaggagtgtggacatgcctggaagtacctgcagaaggagttggaccttctgtcacttgatcttgatctctctgcttgtcgaaaccaggaggcttggtgacatttaatgggggtagcctctgcataaacacctcctcacaacgtctgatttttgaacatcctccactgctactgacatgagatcttgcttctgcccaatggtacgtacctcagtttggagtactgtcatgtcagatcgaagggattcagtctccttctgattgtcaaggacctcggatctcatagctaggagatcctgaatatcagattcttccatggtgcccttgctgcgacccatcgtgaaggaaactgggcagagatttgcttggttgttacctaacacagatgccgctggaaagtga

SEQ ID NO: 38159 - DNA, 425 bp, Triticum aestivum
  Clone ID: PAT_TA_38159
aacccagaaaattcaatatcttccatgctacacacattatagacggttcccaagcagaatggtaaagtttatactcccccccaccaacaagcatcaatccatggcttgcccgaaacaacgagtgcctccaactaacaacaatcctaggggagtttttttgcaattattttgatttgatttgagcatggggctgggcatcccagtgaccagccattttctcgtgagtgaggagcggagtccactcctcttgagaataacccgcctagcatggaagatacagacaaccctagttgatacatgagctgttcgagcataagaaacagaatgtttatttgaaggtttagagtttggcacatacaaatttacttggaatggcaggtagataccatatataggaaggtatggtggactcatatggaataact

SEQ ID NO: 38160 - DNA, 373 bp, Triticum aestivum
  Clone ID: PAT_TA_38160
ggtttaaacattgagagatttctccatgtgagttgtatgtaatggcttacgcccggctttcgactaattagcagttcaactctctccttctgagtaaaactatgatgcaaatcatttgcttccgtatgatcgggaggctcgtcgccagggtcgccctccagagcgacgatgtcgagctcgtcgccgtcaacgacccctttatcaccacctagtagatgacctatatgttcacgtacgacacagttcacagccattggaagcagactgacatcttccttacagaggacatgattttacactttggtgagaggcaaattactgtcttcagcatcatgaaccctgaggagatcacgtcccgttaggcaggtgccga

SEQ ID NO: 38161 - DNA, 411 bp, Triticum aestivum
  Clone ID: PAT_TA_38161
cgggtcacgggaatggttgcaatacaccaccacatggggcaacgttcaacacgtataacgcaaaaagtcgggactccgaattacgaattctgggagcatcctagataattatgtcatcaaaatggcgtaacaaaaggactgtcttggacgcacagactagatactcagtaagctcctatatgcaatccattcccatcatgagataaatgctccaggacttcactacgatgggagagacacggaaatcaagtcccccagattctacagatacgtcgtgtcaactcagggaggttcgacattggcccacacgggtgtgcactaatatataagcgtacatgtcatcacttttaatgccatgcattattgcaaaatcttctgacatgaatgaatgcgatgcgcctgtctcaaaga

SEQ ID NO: 38162 - DNA, 406 bp, Triticum aestivum
  Clone ID: PAT_TA_38162
ttcgtcggtcgacgggcggtattgacaccgacactcatcgttatctttgcaagctaatatagccgtaaaagcttctttatcaataatataaccttcaggaatatcaggcatgttttcatcatcaatttcatcaacatgatgagtttcaataatttctttctctctagccctagcaatttgttcatcaaaaaattcactaatgggcacagtagtatcaagcatagaagtagtttcatcataagtatcatgcatagcagaagtggcatcatcaataacatgcgacatatcagaacgaatagctgaagcaggtttaggtgtcgcaagcttactcataacaggagtgaatcaagtgcagagctagatggcagttccttacctcccctcgtagttgagggaaaaatttttt

SEQ ID NO: 38163 - DNA, 400 bp, Triticum aestivum
  Clone ID: PAT_TA_38163
cacataatacctatttgcaacaataagaacatcattaatccttcccgtaggtttcttaatagtggaatccgcaagatgcaagtttagagagcaatcaacaaaattgcggaaatctcgcaaatcacacaaagttttgggaatagtggagacactagcacccaaatcacacaaagcataaaactcttgatctttaattttgattttaatagttggttcccactcatcatagagttttctagggatagaagctttcaaatcaagtttttcttcataagattgcatcaaggcatcaacaatacgttcggtaaaggctttattttgactataagcacgtggagaatttagcacggattgcaacaaggaaatacaatcaattaaagagcgactttaataattaaat

SEQ ID NO: 38164 - DNA, 400 bp, Triticum aestivum
  Clone ID: PAT_TA_38164
cgggcatgctcaagatcaaaagaggatagggcggcaactatcctcaccgaaggaacccacaagacccccggcaggatccttgccggggaagcccgcacaccgtggaaagacccttgccgggccacccggcaagaccctcgccaagcgcaccggcagggccactgccaggcccgagccaaccaagtctttgctgccgttcgcatgcagctgccaccccagacagctgggcaggcacctgcgtggcaacatgcaaccttcatggaggctccaccactgcgccacctcagctgcctgcctgccaacagggcaccgcatgcagcgctggccagggcgtgtgtcgaaacgagaacgggcggagacggacgggacagggctcgcacacgtcccccaggccgcgaga

SEQ ID NO: 38165 - DNA, 420 bp, Triticum aestivum
  unsure (1)..(420): unsure at all n locations
  Clone ID: PAT_TA_38165
gacccgaaagagttcccggcgtcaggtgttatcagactcatcgtccgatgactctaangcgaactcctgccgcgaagacgaggaagagaaaaaagaggcttctcccccagcggggggagagaagaaaagaaaggcctccccaactggggaggccggagggtccaagaagggaaggacccttcctccggactactccaccaacaccgacgacagtgaagaggagtggccaccgagggctaagcccctggcgacatcgtaagtgtccagataccagaataattcatggcgttttgtttgtcgcatagaatcttctaacgccgaatacaaccctgcagcccgcccaaggacgggctcgacatttcaacgagcggctccctggctccatcggacgttaatagcacttcacttctgggcgcctcc

SEQ ID NO: 38166 - DNA, 398 bp, Triticum aestivum
  unsure (1)..(398): unsure at all n locations
  Clone ID: PAT_TA_38166
cggtcgaccatccgggtcgactcttaggcgatactcagccagtcccctgggaacacctggcatgtcagcgggcttccatgcaaaaatgtcncagttctcacggaggaactggatgagcgcttcttcctattttaggtcgagtgttgtggagatgcgggtcggagctgcatcggggtcggtcgggtgaatgtgaacaggtttcgtctcgccggacgactggaatgcagactctgtggcgggtttcttcgatcgcagcaagtcactcggatctgcgttttgcttgtattcttcgaactcgaccgctgtcacctgggaatcggcaatcttggggcccttctgatagcactcttctgcctttttccgatcaccggggacagtgattactcctttggggccgg

SEQ ID NO: 38167 - DNA, 387 bp, Triticum aestivum
  Clone ID: PAT_TA_38167
gtcgacggggaacaaacatggtctctgtttgctttgagaactgtaagcgtgtttaacctgacagcgcctgtaattgtaggccctttccgcatacttcacagcttgttgtcttatgaggtgctgcagggcagcaggctggcttgtgccgcctcggtcattattatcatttgtaacttgttagagtgcacattaatctcaggaggacatagacataatacttatgctgctgttgttgtaacctgaaaaaaaaaaaaaaaaaaaaaaaaaaaaaaaaaaaaaaaaaaaaaaaaaaaaaaaaaaaaaaaaaaaaaaaaaaaaaatttataaaaaaaaaaaaaaagaaaaaaaaaaaaaaaaaaaaaaaaaaaaaagggggccccccaaagg

SEQ ID NO: 38168 - DNA, 380 bp, Triticum aestivum
  Clone ID: PAT_TA_38168
aaccacatagaactgtttaatgatgcggccgtgaaggactggaggttcaagagatatgcgacgtgcagcaccttgaggttgtaccggaggaggaggaggcttgaatgtgggctgacgagttccaggcttgggtgtactggtgcgaacagcaacataagcgggttcctcaatttcttccaattcatcctcgtaatcggattcttccatcgaagaggcgctagtggagctgcgagggtgagcgacacgcttccgaggacgagcgcgctcctgcgaatcatcggacccaccacgacgagatggacgagagcccccagcggtgacctgcttgcgagcagagcgcctttgtccatggcattgctacctagggaaggagaagactc

SEQ ID NO: 38169 - DNA, 356 bp, Triticum aestivum
  Clone ID: PAT_TA_38169
cgggcttgagatagacccaagaagccgtacttatcattcgtgatgcatagggttctcctgtccagactgccgtcgtcacgcatgaggagaacgctaatgtgcaggaccttgtcctcctggatgtcatcccaatgtctcttggtcttaaaactgctggaggagtcatgactgtgctcatcatcaggaacaccaccatccccactacgaaggagcaggtcttctcaacctactccgacaaccagcctggtgtgctcagccaggtgtttgagggtgagaggactacgaccagggatatcagcctgctcggcaagttatacctcttctggcatcgcgcctgcacccaagggttttcccca

SEQ ID NO: 38170 - DNA, 383 bp, Triticum aestivum
  unsure (1)..(383): unsure at all n locations
  Clone ID: PAT_TA_38170
gggtccagacggccaccatagttcaaagggtgggtgctcttggcatggtgatgcagctgccgggggaagatgccgagtttgaactctcgaggaagcagatgctggcgactctggatgtcatgatgggcgggctggtggccgaggagcttatagccggagaaggcggggtcaccactggtccctcaactgatctaagcgaggcgactcagctggcgaccgacatggtcaccaagtatggcatgggcaagcgggtgggctttgttacctatagcaatggcggtgatgctagcagtggcaaggcgaccaacatgagcgagcggatgtcagaactggttgacgangaggtgaaagatttactggacaacgcttacangaacgccaaa

SEQ ID NO: 38171 - DNA, 242 bp, Triticum aestivum
  Clone ID: PAT_TA_38171
cgcattgtgcttcaagcgttttacgatacgctttgctccatggcgcgggtgcaatccatggatacaaaattagtatactgtatactatttgaaagtcgaaggcggggcttttcctgcgcagtaggtggcagggcagttccacctagtcggttctacatagatacgagaagaccagtgagtacgttgtttcaaacgcacggctgtgtgatttgacaacgagttactgctggacaggtggggtc

SEQ ID NO: 38172 - DNA, 382 bp, Triticum aestivum
  Clone ID: PAT_TA_38172
attcgccggtcgacgggattcacggaaaccccacaacaacatcttgttttcgtgctcgctgttcgcgcttgaaaatggatgtagcaaaaacttcgccgatattagcaaaatccaactatggttgcagcaaagatcatcatcgccgccgtcgcgaggtcatagctctgccttgatggaggtagcacaatatttcgctggtagtaccacaacacatctacggttacagcaaaacttgttatcgccggtgccccacgtccatcctctttgtataaaaaatgaagccggttgtagcaaacaacggagttggttgcagcttttcggcgtcgtccatggcttctgtagtctatggttgaagctttttttgccgccggttgaatctttt

SEQ ID NO: 38173 - DNA, 390 bp, Triticum aestivum
  unsure (1)..(390): unsure at all n locations
  Clone ID: PAT_TA_38173
gggtccacggcggaggaggaaggaaggagatggacttctttgtgacgtgtttaaaactatgtggtttttttgcaaaaaaacaaatacactgccccatggacaacttttcccggacggagggagtactagttaaatctgagctatgggtgtgaagcactgatatgccagtacatttgattgtgacctattctaattttgtacctgaactttttttagaaagggttgtacgtaaacttaatgtgctagcagaacttattgtgttgtctatctgttttctttgcacaacattcaagatatttccccatcattgataaagacgatgaaccgttatgtacgacttcgttggtttcaacatagcccttcncgtagtgatccgctgcttccatcctg

SEQ ID NO: 38174 - DNA, 391 bp, Triticum aestivum
  Clone ID: PAT_TA_38174
cggctgtagtggaggaggcggtgccggctggccagcaggcggaggaggaagcaatccttcacccttggagattcaggttagccagtgacacttcagggtggtgtggttggacggcttcgcgccactatggaacttgtagggagcatcaagggttttctcataggagaaggcgggcagccaagcaggcttgccacccttctgacgcttggggccgggttgaccctctggctgctgatcttccactgacgccacttgccagctggtggaagccggctgcggggccttgcgcttgttgtccttctgttgctggcaccgactgttatcaccaacctgcgtctggggagccatagggagcactttcccagatgcgtccactcggagctccgacttc

SEQ ID NO: 38175 - DNA, 310 bp, Triticum aestivum
  Clone ID: PAT_TA_38175
tagctgcaaagtattcgcaggaagactgtaaattagacagtcttatagatggcctagataaggaataggttaatgattgattgtattaaccaaccggtaccttaacccgacaatgtaaaaagttggcaaccgcaggcttttggattaaacccccaaacccaaaaaatggtgaattgctcccgagaatttgaaaagaaccatccataatgtccggaaactaggaaacccggacattacgcacatatacacaaaaggttttatttcgggctatatgttatatcacatatgtaaaacacatttcccagggaaa

SEQ ID NO: 38176 - DNA, 429 bp, Triticum aestivum
  Clone ID: PAT_TA_38176
gcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaactagtttatccttcaag

SEQ ID NO: 38177 - DNA, 379 bp, Triticum aestivum
  unsure (1)..(379): unsure at all n locations
  Clone ID: PAT_TA_38177
cgggtcgacggcaacataaaaaggaaaatcaagagatctaatggaggacaaggtggaagaaccaaaagacatgaaaggaagccatagaatccagaacccacggggatgtaccttattgtgtaatggtggtagctcagcgccataagacaacacacatcgaagaagaacctgaagcggcgattgtacgttttaagtctcacaatatccccctcagttgaggagacaattgatgatgtcaaagaggtgtgtantgtgctccatgttgcgcatgtggcgcttcttcttgaagcaaccagattcacgtgaccatccctgttgcagtagctgcagtgactgcgggagtgacccttgccaacagaaggagaaggcaagaatggtg

SEQ ID NO: 38178 - DNA, 326 bp, Triticum aestivum
  unsure (1)..(326): unsure at all n locations
  Clone ID: PAT_TA_38178
accctcagacttaggagccgaagcctggcaagatggccgagctccggcggtatccgaccggcgaggtggttgtcgcggaggtgaagctccctgagaaaggagaggttgcccaagaatggggagatgcgtcccgacaggttgaaggaggccatgcgcagcgagacaaccctgtcggggtgccgcccgccgcccgcaagcaacgcctggccagctgcagtggtgggtggaggtgttccatgaagccagcaaccctctcgggggcgcaatggtggacttgaaggaaaggancgcgagttggtcgctccccctccccgccgggaccgggg

SEQ ID NO: 38179 - DNA, 299 bp, Triticum aestivum
  Clone ID: PAT_TA_38179
accctatcaccagctcactgaagtttgttttgcagctagcttgcttgtacagtgcatttacagtgcatgcattacgtctggcgagcgcgtgcgcttcggcggcgcagaccatttgcattcttgctatgttaatgcgtgcgattcagtgcatttcagaaaaaaaatgaagttgggttgtactttgtgtgtgattgtaatgtggagacataaaaagggactatttgtgtggattactcagtttgtaaaatcgtttctttgtaaaagcagtgcgctcggtgaaccgaagaagtacatttttc

SEQ ID NO: 38180 - DNA, 400 bp, Triticum aestivum
  Clone ID: PAT_TA_38180
ggaacgggaggattggaaatacaacgcctctcaacaagtagggaacgaagcacactcgttccccctggatggattggggaaattctccgcctgagccttgtcactgaaggaagtcaattttgctcgaacggggactagatccacagggggaagaaatccctatgtctgtagcttcactagctgactgtgggatgcggaacaatttctccccatcgccttttccggggccgtggggacgggaggaagagctgggagcactagccatgttggaatggtttctcctagaaagctctgaggattcctcacttggtgtggaatggatctgaagatcccaatctctttaaatagacgcctttcttaaatggtcagggtggtatatgcaaaaataacccaacctctc

SEQ ID NO: 38181 - DNA, 429 bp, Triticum aestivum
  Clone ID: PAT_TA_38181
acacatcaaagttatttagtacgtactctctccaaaaaagggctgatcatgtcatggctaccatcctgtgctccatcgttgagtacatgcactattcacgtgccattgaggagaaaaaatattgtgtactatgtgccatcgaagtacatgactcacttacacactgcttatctgattatctccattttcttgcatgacacctcctccttgatgctaaatgtcacgcgtgttggcaaaaggatgaacacagctcacgtacaagataagagttgaagaacataggttcccggcgaccgagaaggagcaaggaacctcgcggtggagcgtctgcaaggaaccttgcatgttttcccctgtttttgccgccttcccacctataaacaaatataagaacatgaactctttgctaaccactacaaatgatacatc

SEQ ID NO: 38182 - DNA, 410 bp, Triticum aestivum
  Clone ID: PAT_TA_38182
acacggctaaccatgattagattgtacactctgcaaaggttggcgaactttccccaaaagaatcgatttcctccgttggatttcccgcacttcatgctgtttgagaaacagatgaccgagacacagtctttcagaagcattaactctaactccgggtagacagtaccaacctacatccctctacatctgcgagcctaccacttgaagaggtcatgcaacttactcaactatgttagagcccataatagcttgtggctgcacacggaagtttctagcatgaaatatcttagatccctttgagcctgggtggcggaccgtaggattgtcacacgggtactccgggatatcctaggacaacactggattctccaggtgcccaaacaagcaatccacctagatgtgtattaaag

SEQ ID NO: 38183 - DNA, 396 bp, Triticum aestivum
  Clone ID: PAT_TA_38183
accccattattatttaccatggagatctacatgtgccaaacatgtgtatcaaagaaaatttggaaaatatatattttacaatgccccattgaggtgtagactgatgttttgatcagttagtctagagggcaatataaactcaaaaaaattcaaaaaattataaaaccttggaaacctatctgtgtttgtgcaagagatcatgtgtgcaaattttgaggtaatttagaggtggtcgaaaaaatgacctcgttatggagggaccatttggtaacttaagccagtttttgaacaaatgtgatttttaccacaacctccaaatgaccccatttttcttttacatggtgacctacatgtgccaaacatggctatcatagaaagtttgaaaaaactttaatt

SEQ ID NO: 38184 - DNA, 392 bp, Triticum aestivum
  Clone ID: PAT_TA_38184
cggccaagaccccatctcacgaatcaggcccaacttggcccaggagataattcaaacgtaacttcctggtcgcccagatctcatcgagacccagtgccggcgctggcgccgccgtcagccgtttcttcttccggcgatcttcgacgaccttccaagatcccacaaagtcaccgagagtaagagcagtgagacgcaccttaggtaatggtcccttccatggcctgatcgctgtcgtcgccgttctctgatgaacaactcgccggaccatctcgtttttctctcctgcatgtaaaccgatccttgtcggatcatcaaggggaatcaccttgtcgacagttaatgacacgccgtcctcatcgtaactgaatggaaaaactcgcagatcaagtcag

SEQ ID NO: 38185 - DNA, 431 bp, Triticum aestivum
  Clone ID: PAT_TA_38185
gagggggtatgacaacaaggggtggctgcgtggtaacgcaaagctaccaaagcaagttcctgctactgaggagcagaagtggctcattgagcccacggggaaagagtaagtgccactttataataatttcattattttgcttgtcacatgctcattctggttgttatttattttgcttgtcacatgctaatagttcattcttttgcagcaactggatatattctaaaggggtccgtattcccaacggcctcatcaccgtcttgctgaagttacactggccggggttgtactgtccggatccagtcaggcacccgaaccatcgggtcttggccacgagctgggagcactgggaagcggccctccacgcggaccatgggacccatgccaaggccgtgatcaccactctctgggtgaattctcttcagaagcac

SEQ ID NO: 38186 - DNA, 426 bp, Triticum aestivum
  Clone ID: PAT_TA_38186
aatcactcatctgtaaaatatgacagctaatctcgtgagcacaaagtttctgtttttttacagcaagatcacattaactttcacccaagtattcccaaaggtcttacttggcactttattgaaacaaaagctataaaacatgattactagagtagcttaatcatgtgtacacacaaaaacaataaagataaatattgggttgtctcccaacaaacgctttactttaatgccttttagctaggcatgatgatttcaatgaggctcacataaaagacaagaattgaaacataaagagagcatcatgaagaatatgactagcaaatttaaacttaatccacttcctatgcctagggattttgtgagcacacaatttaagggaacaagaatcaactagcataggaaggcaaaacaagtataacttcgaaa

SEQ ID NO: 38187 - DNA, 425 bp, Triticum aestivum
  Clone ID: PAT_TA_38187
ccacacgcactataacatacatactacgccatgtcaccgcatgcatgcatgtggaaatctttttggattttcagtttttaaaatgttttatctcttaaatgaaaaatccaattgaagatccgttttcaccattaaatccctcgcgacgagatcttcgaaactagatctcatatcaatatatttcaacgaaattttttttggttaaaagttgccatgtctattgcacatgaattaccatgatgtttacactaaagttgtcatgttatgtttcagctattttcttccatattaaaaagtaaattttgacatattataaaacggagaattaagaaactagacttgccatgcaccataaactaaaattgccatgatacatgcacctaaaattgtcatggctcatgcaaaaaatattttcattgtcaaaa

SEQ ID NO: 38188 - DNA, 371 bp, Triticum aestivum
  unsure (1)..(371): unsure at all n locations
  Clone ID: PAT_TA_38188
gggtcgacgggtcaacacaaatgttctcttaacattgtgccctcaaggttgctgacatagacatgcccatgatcaggaaaacataaccatcatgcaacacttgagctagtcttagaggccagactangaatacattttaccgtttattattccacatgtgcatatgagtccttcctccgagcctcgtggttattgcagactcgagaaccataacagttatagcatggaacataaacataattatgaactcggagataaataatatcatttattattgcctctagggcatatctcctacagaaaacacacaaaaaagtataagaatacaacacagcacatttagggcatcactaacaaaaaggaagctgttg

SEQ ID NO: 38189 - DNA, 422 bp, Triticum aestivum
  Clone ID: PAT_TA_38189
gtaaccgaaggatgattgctataatgattgctatgatgattgttatgatcccgttgattctcttgaaatacccctttttgatgatgcttgctgcttatggccaagatgccaatatgaatgatgcttatggagatgaacttgctatagttccttatgttaaacatgaaattgttgctattgcacccacgcatgatagtcctattatctttttgaattctcccaactacactatatcggagaagtttgcacttattaaggattatattgatgggttgccttttaccattgcacatgatgatttttatgaatgtgatatgcatgtgctagctgctcctacttgcaattattatgagagaggaaccatatctccgcctctctatgtttcccatacgctgagattgtgagaaactgcttatactatg

SEQ ID NO: 38190 - DNA, 401 bp, Triticum aestivum
  Clone ID: PAT_TA_38190
cggctcgacggggatataatcccatcagagccacttatggagtgcctaccaaagatgacaatacctagatctatccttgcttttatgcctacctaggggcgttaaatgatagcgcttgttgggaggcaacccaattttatttttagtttctttgtttttgcttctatttaggaataagtaatccatctaccttctgtttagatgtggttttatcttttaactagtgtttgtgccaagttaaacctataggatcttcttggatgatagttatttgatcttgctataatttccagaaactttctgtgtcacgaaaaaaattgttaaaaatcaccagaatgtgattccaatgctactgattaataaaaaatttggctaagtattcctaatttggctgaattttt

SEQ ID NO: 38191 - DNA, 264 bp, Triticum aestivum
  Clone ID: PAT_TA_38191
acaaggaagaaaacaaattccggcgaccgagaagtagtagtatttccatgcaaatggatcttacgatgcatgttgtttgttgcgttaacgactaaaataaccctaagtgcatgtttgtttcactcctatgtggcctaactgctccaacatccatcaattcagcaagggaaaatgtcgtctaaaactatgtccacagagtagattatgggattttggctaaaagcttatgtgcactataaaacgggataaagggagtttttttgc

SEQ ID NO: 38192 - DNA, 299 bp, Triticum aestivum
  Clone ID: PAT_TA_38192
gattctaactcggtctgagattggatcacatacgaattgtagcaaggtttacggtggttcataggattctcgccggcgagctcatctcctagctaggtctctcacggtctcactctcacctactcctttgccacacacttctgtcagggtgttgaacgtgacatatgtgtattaatctttctatagtctctagcctagttgacttctagaaatacgatagaattagttggcttgtcacgcagaacatatcgtgtatatattgtgaacaactctcaggaatacaattgagttgcatcttg

SEQ ID NO: 38193 - DNA, 418 bp, Triticum aestivum
  Clone ID: PAT_TA_38193
tacggtcgaaaatacggggccaagtcctactggcaacggtagaggcgctgacatcactctcaaccccaaggttccccatttcgctaaccggaatccggacttgttgttcctgcaattcaactagaagaagcacaattccatgtgctacagcctcaatgtcaatgtcctccctttcttcaggttctacaggggagctcagggcagggtcagcagcttcagctgcaccaatgcaaccatcaagaagttcaaggacgccctcgcaaagcactcgccggacaggtgcagcctcggcccggcacgggggctcgaggaggcggagctcttggctctggctgcaaacagggacctggaattcacctacaacgagaagccgacgctggtgccgatcgccgaggccatccaaatggaagctgcctcc

SEQ ID NO: 38194 - DNA, 410 bp, Triticum aestivum
  Clone ID: PAT_TA_38194
tccacgccaccaacaactaccaatagaccacggctggcgttttctgcgtttctgagtccaatttgtttttttaggggtggttctgagtcgagttattgctaaaataacttcaggatgctgccaataattgtattgttgttcgttaaagtacacttttttcctcaggaattacttcaggggcagattatggttacctccggccggcccctcaccggtgaggtgtaatgcatcaccatatgcttagccctgtgtactgcaaaactgctcatattacgtgcgtataaggtcattgagtcatcgacattggtgaatctgccgaacgtccaaaggtagatcatgagttgacatgtccggcatacaatacatactggaaagagaatgtgcacaaatttagataaaaagaatttgtc

SEQ ID NO: 38195 - DNA, 399 bp, Triticum aestivum
  Clone ID: PAT_TA_38195
ctttgggacaaatctaaaacttggaaccctggtaaaatatgattcgatccgcaggcacttgaagcaaagcacacggcacctaagctagtaattgggaaagcaaaattagtccaaacaagtatacgatccggaacagtaccatgcgcagatcaggctaggatcggaggggaccacgaactcctcagctccggtagagggatcccgccgcccgagtgggtcggcggccgtcaggtctgccaattggactggctccgcccggccgcctccccgcttcgtcacctacccctttgctagctggtggctgtaacttgtcggcttcctccgccccttatcccttctcttgtatgcgattcacgcagttggcttcgtgattgctaggaccgcgagtggcttcgccct

SEQ ID NO: 38196 - DNA, 379 bp, Triticum aestivum
  unsure (1)..(379): unsure at all n locations
  Clone ID: PAT_TA_38196
ggccgcacacctaagggagttcttgatgcagcgggtggctccgcttcaggcgcactcatgccccttacggatgcttggggtgtagacgacaagcttcacctgaatctggtggctttgactgatgaggacctggccgcatctctcctcctcttggtcggggatgactaggagtatccgccgagtgccactgtccccttgttactccgcaaggacagggcgcaggtggtggctactatgcccacatttgatgggcgcgtcctggtgccactggcaccccttgtggtccgggagcaacggcgccggtggacgcgtcttcgggcgactccctcagangaggaggtgaggaggaagacgaggagcgtgactcggaggtgacccc

SEQ ID NO: 38197 - DNA, 426 bp, Triticum aestivum
  Clone ID: PAT_TA_38197
gggtcgacgggactgtgcaaagaaagaggaggaagaagcgcgacgtgggccaagcggatcacgtcatcaccaacttgaaacagaggcagctccacaggatgcaagctaagatttgcgtgcatgcaacgtcaaaacactactaaatgttcacctagctgcatgtcattggccgatgatgaacaacttcatgactgggaaatctcgggcgttacacaagttaatgccctagtatcacaccggcatttggacatatggcgtactagtgaaaatgcactcatagatggcatttcccaagatgtgcgcattcggaagtgagactggaatgctcctggtctcggcgcatgaaccgtcggtggagtcgtggttagtcccagcgtgactctacatttgccagatgctgatagcccggtcctttcactttcctcc

SEQ ID NO: 38198 - DNA, 399 bp, Triticum aestivum
  Clone ID: PAT_TA_38198
cgggtacggttacgaaatcaaattagtctctttcagtctagtagtaaaattaatcattgtttatatatcaatgcatgaatgacagtacaagtttgttatagggcttaaagaatagatggtttacattcaattcctcgtcggaccggcactcagtacttatcattacatggtaaaactatcaattgcacttggtggttatcacagagttgagatcaagatactaacacaaaatcatagtttggtggtggattacttcatattcatcatggaggcagcggagaagttaatggagaggtcggagatgtgaccaagagagtttctggttgcagtttccggtctaatcttcgttcggcggcagccttctaggttttttgtctcatattacccaacctaatttgc

SEQ ID NO: 38199 - DNA, 430 bp, Triticum aestivum
  Clone ID: PAT_TA_38199
gggtccacgcgacatgcacaattgatactcttgcattcaaaatcattagtcttggatgatttaaggttctattatgaagtaaaatatgtaatattcataaatgaatacaacgggtacgcaatttttgaaatggaggctatgtaatcatatgaggtaacacttttaagtagcggactacaatatccatttctttttgtgcgcctctacactaacacgtcaatgcattatgtttaaagtaaataaccaattgcactaaattatctatttacacgagaaatacataggctgagcgtttgatcccttttttgtgatcgcgccactacacccgtacgattggccgcgcccgcgtgaatgtccaagttatcggtgcatcatcccgagttattgtctttttttctggggtggacttcacaccagttattaactgctg

SEQ ID NO: 38200 - DNA, 425 bp, Triticum aestivum
  Clone ID: PAT_TA_38200
ggtcgagatatccgggtcgacggggggacaaaattgataatagcgacaagaaggaaggggcttccgattctgtggaggaatcggggaaagcttctgaagagaaggcccctgagaacactgatgccaaggaagagaagtcagatgatgctgaggagttgaaagggtcagatgcacaatctgttaaaaaggatgataaaagcccttcagaaaatgacaaggagccagtttcaagggaggacttcaaagaatattttgccaaatttggcacagtgcggtatgtggacttcagtaagggggatgattcaggataccttaagtttgaggaatcgacggccgcggaaaaggcccgtgcatttgcagctcttgcggatgaaggtggtttggttatgaagggccaccttgtcactttggaacctgtgtctgga

SEQ ID NO: 38201 - DNA, 287 bp, Triticum aestivum
  Clone ID: PAT_TA_38201
tactccgaagggtatctggcgttacatcctgacacacctgaccccattgcggcggatctggacaaatgggtggtgttgggcatggggccaaaggaccacggtcgggaggcggttctcgatacggtgatcactccgtcaatcccttaaacacagctccttcggatcaacccgaccctaatccagcccactatcacgcgcataagcattgcaccgtcactgtccccctttgattaccaccaacctgtacctatttcccctttgagctccattgttccctttagtttccg

SEQ ID NO: 38202 - DNA, 242 bp, Triticum aestivum
  Clone ID: PAT_TA_38202
ggtcgacgcgccgggaagacagcgacgagcctgaggaggagcggctgctacggaggctgctagcgctctaccgtgcccgccaagcaaagctggagtcctgggaagcgctcgtcgcgaaggcgagcgtggacatagagaattgcgcggaggagcttcggggtcttcgccaggaaactcttcgggccttggcagacgagcgggagcagcttgcggaggagcggaaaggcttcctccttgagaaa

SEQ ID NO: 38203 - DNA, 392 bp, Triticum aestivum
  Clone ID: PAT_TA_38203
agagcttacccgggccaaggagcaagccaggagaagtgatgcggctaccatgaaggcagctgaggaattaaaagccgaacaggctgctcatcaccgaagtgaggataaaatagccaacatggctcttgagctgcaaaacaccgcgagccgatatgagcttctcgaaagggaaaaccaaatgaaaacggctgacctagagaaggccttacaagcagcaaaggaaactcgctctaaaatcagaatggctcgggagaagcttcagcaagccggtgatatcgtggctgggaagccctttttattgtgaatgaaattcggcgatccgaagtatgccccccttgaccaattgtggagttctctagatgcgtacttggatttagcaaagagtgatgctg

SEQ ID NO: 38204 - DNA, 377 bp, Triticum aestivum
  Clone ID: PAT_TA_38204
tgggggcagatgggcaagagatacctgtaagtctggtatatgaccaagtagcgttagcagcaaagtattcccaacaggattgtaagctagacagcctgttgtatggtatagaggaagagtatagccaatctaagtgactatgtaatttaaatggacctatgtagtccctagccggattgaaaatcatttgtcatggcggaccttttcgcttcagcccccggacctgatagtccggagtgtatccgaatacccgcacagttataaaaaaccggggtatgcatggaaaccaggcgtatgggtcacaagtgcctgaatataccagtatccaactagttatgtgatattacatggatagtttgaaacatctttcagagaga

SEQ ID NO: 38205 - DNA, 431 bp, Triticum aestivum
  Clone ID: PAT_TA_38205
gggtcgaggccaagctgcagtcccagtgtaaacggttgaacttgcggatgggcggtgaggcccgtagggagttgctgtataacatcgaatacagtgccgagtactgaagcagtgagtactgggcaaccttccctgatttcaacatctacctgttatcagtacctcagccgcagtcatttttactgattatgccttgtttgctgattttgtttcttccagtttgattttgatgatgccggtgttctttcaatcaagtaggcacgtgtagtgtttgccggtactcgaagagcacagaggctgtagtctgtaaattatactttgtaacagttttcctaatcattcttcagtatcccaggcttccttttttcgctggagagacaggatgagattttatttgttaggatttcagaataaggtcctaatacatttgt

SEQ ID NO: 38206 - DNA, 415 bp, Triticum aestivum
  Clone ID: PAT_TA_38206
tcggggatatgccctactggcacacacgctcggcaaaatggggtcgtgtgcgaccggcgagcgctcaaatatagaaatacgtgcagtagagctaaaaatacaattatacaggcgaaattgattccggtcgcaagtacatcccacacagtcagtccccgctaaacatttccgttcgtatgtacatcccacacagtcgctccaaggaaaatgtttccattcataggtacatcacacaaaaaatttcccgttaaatcgtttgcgttattgaatgtatcagacatggtccgtataagaaactgtgtggcaaaggatgtccatcacacacagtttttatgtggtaaacgtttgcgcaaggtggcctaactcaaacagttttcaagagaaagtcatgtatgattacacattgatccaacac

SEQ ID NO: 38207 - DNA, 420 bp, Triticum aestivum
  Clone ID: PAT_TA_38207
ggtaaggacggtgacgagggcgatgagtactagagcctgcctcctggtgctttcccaaggcatgctgctgcaatcctatgatctgcccgagtggctttatctgttatctgtctgtttgaacatttgctttgtggtgtttgttttacaacctgttgtgttgtaagaaccttgtatgtttgaacctgttatgcaccttggttaataaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaattaaaataaaaaagggggccccccaaaggtttcaagcttaatttacccttaatggaaatttaaaccccttccaaagtttcccccaaattcaatttcctggcccttttttt

SEQ ID NO: 38208 - DNA, 369 bp, Triticum aestivum
  Clone ID: PAT_TA_38208
gacgcgtacggctactccagttattcacttctgctcattaggttgagttgaagatgaacctctatctcaaagacgccagtagtagctactaggtcggcgctattgcatattctgcaaaaatgtatctcggctaccaatttgttggcacgactcatttagctattttcgacaaatgaattggataaaatactgagcatctcagcccggtgccaatcaacatcctctgtccatcatgggacagatatctaacagtttgttagccagagttagcaggcacttgatttttggtttgacgtcgatgatcgtgtccgcttcttgcctgtttgccctcatgtccgccagtacgtggtgtatattccgcctagctga

SEQ ID NO: 38209 - DNA, 306 bp, Triticum aestivum
  Clone ID: PAT_TA_38209
cagccgaatcgacgatgtcgccggcaggatcaccacacagctggctaccatggggatgtccaacatgaagtacgtcccagagccgaatgtgagtcctaatgccaggctaactttgtttttcgagggtgttctaggggcccctggcggggatccgatccaacagggtggtctctctggcccaagaggtccggccgcattgccggcgtgtgaagaccatggccctcatggaactggtgttccccagattttacgtcttggtcacatcttagttggatggtggagggtagggggtaacccccgtggcgc

SEQ ID NO: 38210 - DNA, 462 bp, Triticum aestivum
  Clone ID: PAT_TA_38210
cggtccagaataacgggccgacgggcaggctaacccaaacgaataggcgacagacggatacttggaggacgataactatatgcctacctccgaagatgaggcgagcctcggtgatgacaaattcggcgtaccagaggatcccatagagcaggatcgctttaagcgcaggcttatagccactacaagaagcctgaaaaagaagcagcagcagctccaagcggaccaagatctgcttgcagacagatggaccgaagtcctggcggccgaagaatatggactcgaagccccaagcaggggatacccaaagcataaaccgctagaagaagaggccgaagagcttgaacttccagcacaagatgaggctgaccgaccaccacgtggccgggatgaaacggcatgtcaggccggacaccagcccgcacccccacgccggttcaccatggcctgcggcaatacgcaaga

SEQ ID NO: 38211 - DNA, 419 bp, Triticum aestivum
  unsure (1)..(419): unsure at all n locations
  Clone ID: PAT_TA_38211
gggtcgacgggtttgctatagatgatgtggcaagaccatatagccagcaaccggctctactactattaactatgctcttagggcatcttcaatggctataagatagttgttggtccacataggattttgatgatgtgtcataaaataaatgaggaaagagagtaagattgtatgtacatgaaccaacaccctgtgcacaagcttcaatgtagaataagagagcaccttatttattatttcacatcttattggacacactagatacaatctattggagtagttttatgttaaggcgttggttgatgacatgccatattttacgaacaagctaacaaacaaactgttggagatgctcttaagcagtttcatgtactcgggactagcanacatgctgatgtggcagacaaaaagaagagaga

SEQ ID NO: 38212 - DNA, 261 bp, Triticum aestivum
  Clone ID: PAT_TA_38212
gacggggggaatcaaagcgagggcttcgctctacaccgtgagctcccgtgggcgcgccaaacacctcgagcttaacatggcgtgaacaattgtctcgatagatttgctcgtcactcgcttttatgcacgggaggtcagttggttcgcagggtgcagcccgagcgacccaactgtattcggaaactacggatggaacccgtaagccgcgactccactaggagcatcgctggactaaggcctagattccgatcagctatggga

SEQ ID NO: 38213 - DNA, 185 bp, Triticum aestivum
  Clone ID: PAT_TA_38213
gacgggtggagcgaaccagcagaggctcattcctgtgataaggccggcctgtttgacttggtcccacggtggcgggccggcccatggaatgcctgtgatcgacctgttcgtatctcgcctatttgcagcccgcgacccctcggtctgttagaccctctccgagttaggccctgtatcgtcctcta

SEQ ID NO: 38214 - DNA, 402 bp, Triticum aestivum
  Clone ID: PAT_TA_38214
gggtcgaggccgagtcataattataggtgacaccgggtcatgattgttgcaaacactgggtcaatctgacctgctcaaaactgagaatttgaagattttttccctttatatgtatatcacctgtagcccccaagtgtcgggttgtcatgctagcagcaacctgggatttgtaattgccttatgctcataaaacttcaaccagtgtagcccccaagggccggtttagtaagatattactgagctgggactttgtatataattcattgataataatatcatatgatgtaatatccaccatggggcttgaacccacgtccaaaaggttaagagctttgtgctttacaaactgagcaatgggtccttcaatataatggattaagacttgtgtaccttgaactgttg

SEQ ID NO: 38215 - DNA, 434 bp, Triticum aestivum
  Clone ID: PAT_TA_38215
gggtccacgggggcggagaacagagcgcgtaattaaactcgaatacctttccgcggcggcggtagagcactgctattaagcgattttggagaagacagatgaattcgagttcctttcagatctagtccatagatttgcaccgctgactttgagtgtgggggacgaacttcttgacaaggaggcttccggtggatctgtcggattaagccggtggttgcaccgatgacagggatgtgagcgccgcggtagccgtgaggcctatggacctgaacgacaatggtacttgcgagactgcctttgcggcggactcgggtcagttggtgctgagagatgatccacaaacgcctggctggacaaaagacgttcaacgatttagctgctactcagtcgtctaattattgtgtgttggccttttagtgctgtggcaagtctgt

SEQ ID NO: 38216 - DNA, 400 bp, Triticum aestivum
  Clone ID: PAT_TA_38216
cgggtccacgggatgcacacaggatgtcgtcgctaagcatgctagctgttgtggtatgtgaggggctcgctgggatccggctcgtacagctccatgagcctctggctcccattggtcgatctgcgtggaccggcttcatggacgaggttgatggcgaggtggacgaggttgacggcgaggtagatgaggttgacgacggacagggccagctccggctcgccgacatggtggaagggtgcggccatagaagagcagatcgaaaaaaaattgagccttctcctcacccgaggaaacaatgcgacaaaggagggtgaatcaacgcggccgaggcgtggggcgggggagctccgacgaagccccgggaagctgcacgagtgagtcgagcaggggagctccggcg

SEQ ID NO: 38217 - DNA, 422 bp, Triticum aestivum
  Clone ID: PAT_TA_38217
cggatggagcaggaagatcagagattgaagaagcacgtcggctgttggatggacatccaacagtcactgctgctataatcgtgtgttcactgacaaagccttgcgtaaacaagtctgcctcgaaatctgtggtatgtacagcccatttgctattatttttataatgtttactcattttctaattcatatggaatttattgcagcccgttttccattttgagaattgctggccattttctggtcagtaccagggtcaaaaaattaactaaatatgtgggaaattgcgaaaattcgcaaatttttgctggggaacgaaatattcttaatccaaaaattaatagccatactaaaacaaatttaaaaataaattagtactatgtcatgttaaatccaatgaaatacgtataagatatcagttaaaa

SEQ ID NO: 38218 - DNA, 256 bp, Triticum aestivum
  unsure (1)..(256): unsure at all n locations
  Clone ID: PAT_TA_38218
actacaaaaaaaccaaaagcccactacagggcgtggaaccgtattggagggatggctcaatgggccatgcanaattcacacgatatgggataccataccaacacacagccttagaggatgttggatacttcggcaggtggccaagacggcgaggatctcctcattaacaataccgcggagcatcatcccgcagaaacgacaatacagtgttgacagtcttcgagactttcacctcaaataacaggcgcaagagagc

SEQ ID NO: 38219 - DNA, 396 bp, Triticum aestivum
  Clone ID: PAT_TA_38219
aagaagggcagcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgtcggcgagtccgccaagctggcccgctacaacaagaagcccaccatcacgtcccgggagatccagacctccgtccgcctcgtcctccccggggagctcgccaagcacgccgtctccgagggcaccaaggccgtcaccaagttcacctcatcctagacagcttaggcttgatcctcgtcgctccatgccttctgtgtgtacctagtcggcagtatgatgttacaatctttgtaaggattctgctgcttg

SEQ ID NO: 38220 - DNA, 284 bp, Triticum aestivum
  Clone ID: PAT_TA_38220
ggtggcgtggaggttttctcggtgtgggtcttcgctgggccggggcaggtgcacccgcgtggtccggatcttctcaaccgagctgtatgtcttcggctccttcaatgtggaggtcatcgtgaatgtcgtcgggaatcttatcgtgctaggtgtcatggcttgggcggccaacatcgagtcttgggagattcagatcttcgtgtttcgcttgctctttcgtgagctggccaggccacctttctgcttttggaccactgtcgtctccaacttcaatgcagcctttg

SEQ ID NO: 38221 - DNA, 414 bp, Triticum aestivum
  Clone ID: PAT_TA_38221
gtaaaaacaattgtcagcatacttaaccagagcttccatcggctcccccatgtcactgaagtggcggttgagccgccctagcttctgcttaaggggcaaaaaatgacaattcttctctaacatcaagactactgagccgacattgatacgatccggtgagtgcaggatagttgagacgcggcgcacccaatgggttgttgactcgccctcttcttggacacaagagtccaaatccacaatcgacataggatgtttgcatgtatctttaaattctggataaaccgggcttttaacttggcccatgatccaatggagttggcaggcagcccttttaaccaagtacgggtcgtcccatccagcatcatggtgaaatatttggcacacgcagcattgctaacatccaacagctccatg

SEQ ID NO: 38222 - DNA, 432 bp, Triticum aestivum
  Clone ID: PAT_TA_38222
gttcgtgactcaaaccgggactaaaggtgtaatcattagtcccggtttgagatacaaaccgggactaagggcatcacaccctttagtcctggttcgtgtcttaaaccgggactaaaaggctcatttgaaccgggaccaatgcctttagccgcacgaaccaggaccaatgctcacattaatcccggttcgtgactgaaccgggactaatgggcttatctggcccgaacgaaagccgtgttttctagtagtgaagatggagtattgggaagggccttataggtctcaaatctgaaatctcatcaaccaagacatatggtgagtggaggaatgtatctcgtactttacaaaactactcaaattaaatagatgcattaattggattaattatggtgcatgcatgtttgaccactagatgagtaggaacattacatg

SEQ ID NO: 38223 - DNA, 332 bp, Triticum aestivum
  Clone ID: PAT_TA_38223
acgggataggggaggggggtggagacgggaatgctagggggtgtggtcttggcaggctgtgagggatcaagagacgcaattgtggcctgcagattgagttctcgccaggaattcgtctaggagggccatacggatatgatctctcttgatgggttgcttgatggtagtcgtgggaatcgaagtgatgagaagctgcttagcctgatgaagattgtcatgcagctacgtaaggtctggaatcatccagagctgttcgagcgcattgagggaagctattacttttattttgcggaggtcccatgttcgcctcttcttctcccatttggggagtt

SEQ ID NO: 38224 - DNA, 391 bp, Triticum aestivum
  unsure (1)..(391): unsure at all n locations
  Clone ID: PAT_TA_38224
acggtcaagacatcccgggccgaccgggttgtcaaatacctcgatggcaagcacggccttgcccttgcgctttatgttgcggcgccggcacttcttcttcggggcggtggtgtcttcgtctgtggagtcggtttccgcaccagcgtcctcactggggtacttcctcccctcctcagctcgagcgcacctatcggccagaacataaagctcggccacatctttgaccttgttcatcgtcggctttcacgcatcttacggttgcacacattctgatagaatgcgctgatcacggtggcgggatgaacatctcggacgttgtactacacccggctgaacctctgtatgtacctgcgccggttttcaccttccttctggangatgatatggaaat

SEQ ID NO: 38225 - DNA, 392 bp, Triticum aestivum
  Clone ID: PAT_TA_38225
cgggaaacaccagacttttggtggtacctctaattgccataacttgttccaagcatttagataaccattgcccaaaccagttgcttcagtcaacagtttgtatgctgagtgaactgaaaatagacctcggttatttggctgccatgcccaaaaatcttcccccacactaattgggattcgtacaattgcctccgcatcaatacctatgaagtttgctttcaccttttgcacatcccattcttcataattctcaacaagtagttcagaagcatgattggcagtagcatacatgggctttaacatagccttgtaagaattattggaagggattcatggattctcccacacatttatagtatccccatcgcccatccttttgataagaccaattt

SEQ ID NO: 38226 - DNA, 381 bp, Triticum aestivum
  Clone ID: PAT_TA_38226
aaacactagggctgttgccgacgaaggggaagctccaccgacctaccattcatgcataaatgtacactgtaggtgctttactccttgctttggagtcgatctcctctctcctggcttcattggcttgattcttgcctgtcttttgcattctacgattgttcattgtagtcttcaggtttgttggtcttcccgacggctgtcaactatcatctacaagttcagtcatttcatgctggagcccctacagtttcgaagtgaccatgtcggccactgcgtctactacacaaatactgctactccccactattttttcagtgtagtttgttccataaatgtgttgtgtcaccgtctgggtgtgactgattttttgagatgtacctt

SEQ ID NO: 38227 - DNA, 389 bp, Triticum aestivum
  Clone ID: PAT_TA_38227
tagaggaacgacagcgcgaggaagaagaaggagagtgtgagaagagagtgccgggccggcctgtttataaggtaattcataagtgggcacgagattcaaggagaccacggcgtggttatctccccctcacggtgcctcgattttcggaaagacagtaacagcagagatccgttgcggatctggcggagtaaaaaatggacttaatggaggatgacgtcacggcggattatccggagtccggagaatgacgtcacaccgggttatggccttcacacgaacggtaagccggagattttttctgtcggcagagttgaaaattgacacgagccggctcaagtcaatctggccaaaaaaaaaaaaaaaaaaaaaaaaaaaaaagcggccgctct

SEQ ID NO: 38228 - DNA, 422 bp, Triticum aestivum
  Clone ID: PAT_TA_38228
cggtctagatatcccgggtcgaccgggagaatgagaagagacctagtcgggtctatttataaggaaaagactgttaagtgggcgcaaaaaatgaggagcccaaaaaacatagttatccaactataaggacgcctcgattttcggacggtcactaagacaaagatccgttgagatacattggaagaaccgcgtatttatagcaggtgacatcatggcgggttagcacaaattcaagggatgatgtcatggcaggttacaaaaagcttcataagcaaggagcagaagatttttcttaaagtatcgaagattgacatgaaccagttcaaatcaatctggggcctaatgttggggatataactataaggtatgaccctccctggaggggccgggttatatctatgagtattctgaagcccaagacc

SEQ ID NO: 38229 - DNA, 374 bp, Triticum aestivum
  Clone ID: PAT_TA_38229
cgggccgacggggaatgaacggtgagcaggtgagctctgctctgcctctgcccagctcctctgcatcagctgtaacgttattctgcttgcgaattttcttagatcatcaatcagggagccggagcttgaatgaaacctgagtaggcttgcgaattttgtatgcctgcaacatcatttggtcatgaattatatccctggtgtagaagttaagttgctgcaatggttgacattcgattaaaaaaaaaaaaaaaaaaaaaaaaaaaaaaaaaaaaaaaaaaaaaaaaaaaaaaaaaaaaaaaaaaaaaaaaaaaaaaaaaaattgaaaaaaaaaaaaaaaaaaaaaaaaaaaaaacgggccccccaaaaggttcaag

SEQ ID NO: 38230 - DNA, 424 bp, Triticum aestivum
  Clone ID: PAT_TA_38230
cacatcgaggcattgggtcaggcgaaccacttggttttgagcacagttggccatctgaaagcacaaccacaatgcaaagacattaggatttctagggaaaattggacagcataacagttgtaaatgctcagaaaaagatttgagagatccacaaaagtttgcaataccactcaacaacatcatatcaaggttctgattcaattagcaacatactagaaatagtagaaactgaattggggcttgaaacaacaatcctataagctactacggattagtaacatgtgaacctgacagaagaagagagcctagtccttaacccacgttaaatgagaagagaatgactcagatcagagggcataaggtaaaggagtaaaagagccttacgttccctcccacaatcaattcccctacatataactaaagc

SEQ ID NO: 38231 - DNA, 107 bp, Triticum aestivum
  Clone ID: PAT_TA_38231
caggttgatatacattataatgacaacactttggctcccgcgggctgacaaacatgacacgcagaccatgtataatttacacacatgcatcacatacacatgagccc

SEQ ID NO: 38232 - DNA, 236 bp, Triticum aestivum
  Clone ID: PAT_TA_38232
tctcacctccatggcctccactttcgacggtcgtacgctcagtggtgagcagacccctgatcagcctgagatgtatgaacgcgaccacattggcaccatgcttcaacacaccggagaggggcgtaccactcgcttacgaagggtcatgctgcatcctgactgtcctaagtcctatgccacccttacacatacagtgccatatggcacgtgacagaccctacgacgctcacactctg

SEQ ID NO: 38233 - DNA, 220 bp, Triticum aestivum
  Clone ID: PAT_TA_38233
gacgggctatcccactatgtgcatgcgcgcactcctttcgtgtttgatggcttcttgatttatgcactgcctagtgtaatgcattaccattccggttgagttgatagaccctgtccacgatcaaactgcaatttgggtgcccccatttggtcatttacctcatgtcatcgcattgtttaaagttggagcaaacttcgccggtgcattcaaaccccgtgca

SEQ ID NO: 38234 - DNA, 407 bp, Triticum aestivum
  Clone ID: PAT_TA_38234
gacggggtaagggttgccttgggtaggcggcacggcatgggcatgtcacgccgtccagcggtcggcgttggtcgttgggtcgccgtacatggatgcgacaaagtggtgggatgcagactagcggagaaaagattccggcgcacccctacctggtgcgccaaatgtcggatatcgggttcctgcaaaacccttaaggttcaaactctggggtgcgcgcgaagatcttctccctactgatccacgcccacaacctcgccgcgattctaagctaacaagatgaacaacacaaggaacacgagatttatactggtttaggccaccattgtggtgtaataccctactccagtgtgtggtgtgtggattaactcttgggctgatgaggaacagtacaaggggaagaacagcct

SEQ ID NO: 38235 - DNA, 393 bp, Triticum aestivum
  Clone ID: PAT_TA_38235
gcggctcagaaatgctctacagggcaccattcaaggcgccgttgtgctctacgggtagctggcgcaacgacgcgtccgttggtggccgtggttgggcctggggtggccggtgtggacagcggtgagctcggttgcggccatcggagttcgggcgtgagcggagacgcggttgcggtggccgtggcgatgtgtgtttagcacctacggcgtctacgtggtgcggtgagtttgatgggcgcatgtccgggaccaaatggtcaccggagcatcaccggagacgaacgccggcggtggcgcattcggttgcaggcgaggcgacggctatggagcatgagggaaaaacagagatggggagcaggagcaggggctcacgatgggtgcgacgagctgctc

SEQ ID NO: 38236 - DNA, 426 bp, Triticum aestivum
  Clone ID: PAT_TA_38236
tcagttcatgtatatctgggtatttcgtgtgatttgtttcacattccaccagaaccattacgaggttcccctgatcttgcttcccaccggaggaacgaactgtaacgacccgaagactcaaatgctgggtctgcatgcggtcagcggctcggggaagagggacctgagaaagcacgagacagactctgccggcgtcggaaatcatcaccgactacgtcggcgcagtccacatacagagtcaatccctaggccccatgatggacgaacaggttggactgaacctgctgatggttgggagacggagctatctagcctgcttggatgcgcaggtgcacatggtgccggacgacttgctgctgagcacggactacctgctgagtgctcatcctcctcagatatgatcgatgatagttgaagaagcgacac

SEQ ID NO: 38237 - DNA, 420 bp, Triticum aestivum
  Clone ID: PAT_TA_38237
tagtctaaatctgatatatcaggacactatccgcacctgtcaagaatcaaccaaagtagtactacctttaaaggagtaataccaggcgtagaggcccgatgcacggtctctctaacattagaggttgtattcggttctcccgacaacttttgaagcgaataactaatcttcaacatcgctctgttccaaagcgtctatcatgcactactcggaagaatggccttcgctcgtttcaatgcagtaccgcattaggcttatctcaaacttaagatgcccggtccacgtggcgtcatcacaatcagcggaaacacagagcgttctcttcgtacggaagaatatatgggagctctagcagccgaaccactgaatggcctctccaacccaagtaacccattggtctttcgagacacggacgcggat

SEQ ID NO: 38238 - DNA, 220 bp, Triticum aestivum
  Clone ID: PAT_TA_38238
gggccgacgggtatagcgaataccacgcgctatttaacccaagttcagagctctccgttcagataacacccctaggcctgcatgtccgaatagatctggtaagtatatcagggagagattgctccgggagctgtatctaatctcagtgcaatacgcatctggctttgcacatttcagttcgggagtcctgtgggtacatgtctggctaacgtcggcaacg

SEQ ID NO: 38239 - DNA, 429 bp, Triticum aestivum
  Clone ID: PAT_TA_38239
ttgtactcatttgtcaagtttgactacgtattagctagtaagatggacgttgccattgaactggtatttgaaccaagaactgtggcaggtaaaccattattatatctccatttggtgctgcattgcacagacgctcaccattgccagatcattagcattgatcttcaagattttgcatggtttcctctctcagaaaaatctcccgttaacgaaaaagcgaagggaaacctcaaagccttccatcttagaagtgtgcatcgctcgatgcagaggctgggggctgggggttatcctcctttttgaaaaacaagacaaattcctacaattttttgcagtaacctgtccggatctgatcagctctacctatctataagcagctaattgactgcaggaagtagactgagtttagaagacaattgttctactcta

SEQ ID NO: 38240 - DNA, 426 bp, Triticum aestivum
  Clone ID: PAT_TA_38240
gcgacgaagaccggcgaggggggagacggagaccagatgcggtggtggttgtcagaggaggatgcgagtgtggatgtgggctttggttgggtcgtcgggggttggtgagtgtgaagagtgtgcctcttgttgggctcaaatctcaatactgactacgctagtgggctgggctacgaacttcctcgcccgcatttttttccggctacaaacatggaaaaacatcccctcagaggggaaaaaacaaatttaaaaaaatagtgtagatactccctccgtttttatttactccgcgtattagttttggtccaagtcaagctttgtaaactttgacaaagtttatagacaaaagtattaacatatacaataacaaattaataccattagattcattactgaatgcactttcacataacatagatttgttgc

SEQ ID NO: 38241 - DNA, 398 bp, Triticum aestivum
  Clone ID: PAT_TA_38241
atatttgatagagcgtgggcatatcttttgtagaaagaattaaactctcctatttcacttatatctatttagacagatgacaggaattggtcattcacatggttagtcataaaatgctacataaaacttgtagatcactgaatatgatatgtttgattccttgcaatagttttgcgatataaagatggtgatattgtagtcatgctagtgggtagttgtggattattagaaatacttgtgttgaggtttgtgattcctgcagcatgcacgtatggtgaaccattatgtaatgaagtcggagcatgatgtatttatttattgtcttccttatgagcgatggtcttttcctaccaatctatccccctaggagcatgcgcgcagtactttgtttcgatagc

SEQ ID NO: 38242 - DNA, 375 bp, Triticum aestivum
  Clone ID: PAT_TA_38242
gcggcgtagcaaactggctttgtgaagcagatcatccaggcatcgccgatgctggagcgcgcccacctgttggtcgggcatgtcgtggaggacgaacatcgggagctcgtcggcctgaagatagtccggcgccgccgggattggcatgagtgtgagagatcggaggtgctcaaagacctgtcatacgggatcagttcgccgcatcttgaaatagttttggaatgacttttggtaaaagtctgctgtgccggtagaccttccgtttgtagggcttgtagctgtatgccagggcctaatgattatgttatgctggctctaaatatagaacaacatgtgtttgtacgtggtatcttgtaccttacttttgcttgatta

SEQ ID NO: 38243 - DNA, 428 bp, Triticum aestivum
  Clone ID: PAT_TA_38243
ccttcagatggctgaaatgtagaccgggcctttttgggcccgttatatcacgggcagttaccaggccgaaacatatctcgggccttagttggcccactaatatcatgggcctttaataggccgaaagcttagtacagacatcaacgggccgaattgtgcgacaagcctttaacaagcccaaagtcacgttgggcttaactgttgccacctttatcacgggccattagtgggcccaatgtcctgtcaggccatatatggcccatgggaagcacgggccattcctaagacgaaagtcacaccggactgaaatgggcccatgtctacatcaggcctctaacaagccgaaagtcactcggctataattggccccaaatattcaacgaacaattaatgggccagatctggctttgggccgtaaatgggcccaa

SEQ ID NO: 38244 - DNA, 213 bp, Triticum aestivum
  Clone ID: PAT_TA_38244
gtgacgagggcgacgagtactagagcctgcctcctggtgcttttccaaggcgtgctgctgctatcccatgatctgcccgagtggctttatctgtaatctgtctgtttgaatctttgcttttggtgtttgttttacaacctgttgtgttgtaagacccttgtatctttgaacctgttatgcaccttggttaatatgcatgctatctggttatct

SEQ ID NO: 38245 - DNA, 389 bp, Triticum aestivum
  unsure (1)..(389): unsure at all n locations
  Clone ID: PAT_TA_38245
caaaacgataaacattttgatcgtcaagcgtcaggcagcgagaggcagcaggataggcccgacagcaggcagagtggctgggatggctgggataacactgggaaggctgataggtcagaatcaaaagagaggcagtagaaccatggcggcttcttctggtccgttgtcctgttttgttgtatatgcagtagctagcccgcgtgtttccgaacctacctacctacctgatgcgctgtagcgattagcatcctgctcgaactgtgtcatgtggtagaagaattgtagcttaaagcatcatgtgcatcctactcttgtgttttctttcttgccttggaaccaaactaatacattttctgaataaatcctgatgtcggagatgcaaaanaaaa

SEQ ID NO: 38246 - DNA, 333 bp, Triticum aestivum
  Clone ID: PAT_TA_38246
catcatgaaattggtgatggaggatggttggtgatgacgatggcgaccgattcccctctccggagccccgaacggactccagattagccctcccgagaggttttagggcttggcggcggttccgcatcgtaaaacgtgatgatttcttctctctgattttttctccctgaaactcaatatatggaagtggagttggagtcggagaggcaacagggggcccacgaggtaggggcacgccctaagggggcaggcgcaccccccaccctcgtggcaaggtggtggccccctggccttcatctttggcaggtttttttcttattttctgaaaagtgt

SEQ ID NO: 38247 - DNA, 373 bp, Triticum aestivum
  Clone ID: PAT_TA_38247
gtcggaatcacgggtcgaccctggatggacctcaccgacgccggggactccgacgacatctcccacaccgtcagctacagcgacatctacaggtgcagtaccccgcccccgccccgtctcagtctcatcatggtgctgtataaattcagtccaccttgtcactgctcatcgatcgacctgcttggcgtcgcggtacagttagctcaccatccgttccgtatcagagaatgctgccatgcgtacgttcacagtgattccttgccgaacgtttcgattgctatgcacctcagaactaactctgcggttggtaccctcgacctgtaattagtccattatatatgtatatgttgcatttccagagccaaaatattgt

SEQ ID NO: 38248 - DNA, 326 bp, Triticum aestivum
  Clone ID: PAT_TA_38248
gaagcgggcgccggcgtctaatgaagccggcggccaaggcattactaggggcaggaagaagggcaccacggccaagacgggcgtgcagacgtacaagatttacatcttcaatgtgtatgatcacgtgcacccggacctaggcatctcctctaacgccatgtccatcatgaactccttcatcaacgacatcttcgagaagctcgccggggagtcggccaagctggcgccgtacagctagaagcccaccatcacgtcccgggagatccagacctccgtccgcctcgtcctccctgtggagctcgccaagcacgccgtctccgatggca

SEQ ID NO: 38249 - DNA, 406 bp, Triticum aestivum
  Clone ID: PAT_TA_38249
gtctggccagcagattgtactgctatggaatacattgaacagtttgatcgtgatggtgattgtatgattgagaatgatggttttcctgatcaaacttatgatgcttggactgttcttggagtaagtgcctattgtggttgtctttggcttgctgcccttcaagctgcagccgcaatggcccgcagccttgggcatgatgactatgctgacaggtgcatggtgaaatttgcaaaggctaagcacgtgtttgaagccaagttatggaatggttcatatttcaattatgatagtggaacaagttacagtagccactccatccaggcagatcaattgggcggacaatgggacactgcatcatctgggtttgcacctctgtttgatgaggacagaataaaatgcacgcttc

SEQ ID NO: 38250 - DNA, 420 bp, Triticum aestivum
  Clone ID: PAT_TA_38250
ttgccaaaggagaatacatgtttgcctattcccaaagcaagagtccttgcaaaccaaagaatggattttgttttttgggatgtggctaacaaatcaaaaggaaaaacatgttgatgcagcagcaggtacctgttggtgctttgtgcgtgatgtacaagaacatgcctatatgctgttatcctgtaaaacatcggaatgacaatgctatattatttataatatgcaattcatagttttgttggcactagtaactgactccgcgaagacacttccattgatatgatttttagggacatgtattgccaattagtctgctgctatatgctggagtaattttctgggaatgcacttgatggtatattactaatgtgcattcagcgataacactctcctgcacaatctgcagggtcttttgtgcac

SEQ ID NO: 38251 - DNA, 425 bp, Triticum aestivum
  Clone ID: PAT_TA_38251
cggggccgacgggaaacggaagaaaaacccaaggaatccgaatttaacaagaagttacgggaagttaggaacaacaaggacttgaagggaattaccaggagccacaaccttttaaaacccttaaattggaacctggggtcccaagaccaacccgggaaggaaaccccgggccggcggcttaacgggggtaacaaaacccccttcctaaccaccttgtcacaaggtcaggataacctttgcttaactctgtcgtaaaccatgcaaactaagccttgcctaaactgtcatagacaacactaaccaacgaagcgatgggctagctgatcaaagccgagcccagtcggagtcggatcaagagtgtgctgggaacgcaaaggccgcctcgccttgccaccgaaaaggacaacagcgagatacctttgtgt

SEQ ID NO: 38252 - DNA, 358 bp, Triticum aestivum
  Clone ID: PAT_TA_38252
ggtcggaatcacgggtcgaccgggcttggtatgtgagatacatgaaagttgcgagtgatataataattaagggtaaccttaaggtggcaacattaacacacatctgggtggattggtaaggggcaccctgaagaaaccagtggacttgtccgggaaccctggagaaaccagtggacttgcccagtggatcccggagtacctgtgtgatcaccctatggactgccaaccaagatcaaagggattcatcaatttttcatgactagaagcttacgtgcacagccacaagctattatgggctctggcttagttgagtaagttgtgtgacctcttacggtggtagactagcagatgtagttat

SEQ ID NO: 38253 - DNA, 367 bp, Triticum aestivum
  Clone ID: PAT_TA_38253
gcatgtcgttccaagggtttattgctacaacttggcagacttcagcgaggcacggagtgcccttttgtgcctattgtttgaggcaaaagtctcgaagactgtcagcactgtatggttgttgtcttccatgggatgttgctctgcggtatttttgatgaggagatccttgctgctcttggctacccgccggagtatccaacatgctctaaggctgtgggttcgtatggtatccggtattgtgtgtatcttgcatggcctatcgagccatccctgtaggacggttccgtgccctgtaatgggctttgattttttggttactggatcgggcgaaaaacaagggtgcaacctttttgtccggacgaggggt

SEQ ID NO: 38254 - DNA, 211 bp, Triticum aestivum
  Clone ID: PAT_TA_38254
ggggccgtagtgcgtgaataagagcaaggcttgaggtgggtcttcatactctagagcatatgcacctatgtagtcgtgaactgctcatcaagtatttctagtccaaatttcatttcggccctcttcacgatcctatcttaatttctcgtggattcaagttccaatctcttctatggtgtctgcgaaatgttgttcaatgccccgtcgtttt

SEQ ID NO: 38255 - DNA, 393 bp, Triticum aestivum
  Clone ID: PAT_TA_38255
cgatctaaaggatatacgcctttcttcatggtttacagaccaaaggcggtactccccattgatattcgtcatgactcccccttgggttgcaaacaatgttgaagcagacaacaagcaagcacgtcaataagcactggacctgttagatgagaagggagatatggctttggctcatttggcggtttaccaacaagacccgtagcgttatcacaaccgtcgggttaaaacaataacctttcaagaaggtgacttaatgccccggctcatccaggatcagaccgatatgcacaagttatccccaccttgggaagggccctttgtggtcagcaagaatctgcacaatggatcatactacctcattgacattccgagaagactcacgcacttctgagg

SEQ ID NO: 38256 - DNA, 246 bp, Triticum aestivum
  Clone ID: PAT_TA_38256
ggtcgaccgggcctacatcaaagagaatgaggatcactatccaggtgtacatgacagttacagggcttgtggagtcgatgagtttgtggctcagaagctcacaaaatggaatgataacctcatcacttatttcaatccaaaagtcaatttcaaccaaattggaaggatggccggaatttcgaaaggtataaggtacaatccaacggtgccgaattggaaaaatttgttaatggcccaaaagaaaat

SEQ ID NO: 38257 - DNA, 338 bp, Triticum aestivum
  Clone ID: PAT_TA_38257
accggtcaggtactcgtcgaccggcaagaagcccaaaacgaagaagccggcccccggcttcaaaggaggccggcggcaaggggaaccaccggggcaggaagaagggcagcaaggccaaaaagggcttggaaacttccaaaatcaacacctccaaggtgctcaaccaggtgcaccccaacttggcaatctcctcaaaggcaatttcaaccatgaatcccttcatcaacaacatcttcaaaaacctcgccggcaattcgcccaacctggcaaggtacaacaggaaccccaccatcacttcccggaagatcaagacttccttcggcctcttcttccccggc

SEQ ID NO: 38258 - DNA, 488 bp, Triticum aestivum
  unsure (1)..(488): unsure at all n locations
  Clone ID: PAT_TA_38258
ccctctggtagtatcttttctccaatatttattatatatttcaaagtaattctccgtaaaatttcagctcatttggagatgtgcagaataggtatctctgacatagctttttcgggtctagaatttcagctgccggtattctccctctttgtgtaaaccttgcatattatgagagaaaaggcattagaattactccataaagtgttataaaggataaaaacattataaataacattatgaaaacatgatgcaaaatggacgtatcaatgaacaatctgatcataaacacacaattcataggatcccaacaagcacactgcaaaagaaaattacatggaatagaactccaagaatatcgaagagaacattgtattgaagatgaaagagagagaagaagccatctagctactagctatggacccgtaggtctgtggtgaactactcacgcatcattggaaggcagcaaggatgatgtanaagccctccgt

SEQ ID NO: 38259 - DNA, 240 bp, Triticum aestivum
  Clone ID: PAT_TA_38259
gggccgacgggaagccatagcaatgctgtagtgactgatttgtctgtaactttgtttgtttgtagtaggggtttggttgctgtagtgtatttgtactttatacttggtagagtaagaagatggattggaggctcaactttgagctgagccacccttccttacacaagaacaaaagacgatcatatatgtgtgttgcttgcagtgaatgcagtaataatcagtaagaagtattgtagccgg

SEQ ID NO: 38260 - DNA, 390 bp, Triticum aestivum
  Clone ID: PAT_TA_38260
ggatggcagaggagggaaagccgagggtggtggtggtcggcggcggcatcggcggcgccctcctcgccaagaccatggagcccgacgccgacgtcgtcctcctcgacccgaaggactacttggagatcacctgggctgaattgagatcaacggttgaaccatcctttgctgagagatcaataatatatcacacggattacctccacacaggcaacaatggtaacatcttcggcattcagtatcactgacacatgctgttctgactgctgatggtcaatcacttgcatatgattacctcgttgtagctattggccatgtttttgcttctgctggaagcagaacagagaggcttacggaattccagagagataacgagaagataaaatcttc

SEQ ID NO: 38261 - DNA, 361 bp, Triticum aestivum
  Clone ID: PAT_TA_38261
gtgaagaacgctattgtccaccccagtgtatccttgcaacgtgcgtttttgttaaagtccggaaccctgcacaatgaccggttcctttgagttttgtttgtcttgctggagttatagattgtgttatctcgattatgtgccgtgctggcatttggatcttaatcttaatccgttcgtctggcaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttattaaaaaaaaaaaaaaaaaataaataaaaaataaataaaaaatatatttt

SEQ ID NO: 38262 - DNA, 461 bp, Triticum aestivum
  Clone ID: PAT_TA_38262
ggtcgaccgtgtttgtacattcatctactcttcctgtgcatcagccatttgagtcggtgatggaaaattctagagtgaaaatagtgtctttagatcagtcagtggtacccgtcgaagcggatatgttgctggttacagatagtttctcaaaagagtattcagagataaatgaccagtcctatccccccagaggtgtacgctctaacttggtagggttatattgctcatatcaatcatatggtgtcttgcattgctgtgccatcttcttagtttagacatgctttgtgtgaatgctacttgtttagtttctatattatatatgtgaattatgcaatgccatcttgtttagctgggcaacatatatgtgaattatgcaatgccatcatgtttagccaagaatcatatatgtgaattatgtcatgccatccttttttccattacgtattccatttatcgacaat

SEQ ID NO: 38263 - DNA, 212 bp, Triticum aestivum
  Clone ID: PAT_TA_38263
acggtcaggatctccgggccgacgggaacactaaagaaacaaagagatcactgagacgctttcatgaaattcaaggaatcagaattagctcaggaacggtccagaataaacaagatcaatgcctcgaaaaagatatggcaccataagttggggtcaggtggctacgaggtggcccagcctaagtgggatctcgctgagcaacagatgagggg

SEQ ID NO: 38264 - DNA, 479 bp, Triticum aestivum
  unsure (1)..(479): unsure at all n locations
  Clone ID: PAT_TA_38264
ccgggccgaccggggcagcaacagcatcatgggcagcatcgcctcgtccatcggcaagatgggccggcgcaaaaccgacagcagcgagctgcaggtgcaggtcgacgacaagccatagccatggaatgaatgccgagcctctcagcattcattcattcactcaccgtgttatcacgaagcatcataatacgtcatcgccaatgatggagctggctgctactatttttgtagattatttttcttataattttggggagattggcaattgttccatctgtgtagattcgatcccaagctataggctagatccagtcagtccaaataagtgaagagtgcggtcgttgcttggtagcccccatccacacccctcctggagttgctgaaaggttgtacatgtccggattgagaggggttgttggccccgacatgatgataatgagaacccagtacaaatacaanaacggaaacggccccgtaac

SEQ ID NO: 38265 - DNA, 385 bp, Triticum aestivum
  Clone ID: PAT_TA_38265
ggtcgacgggatgaaaatgattagaatgccatctttatgaaagcagggtttagcgactacaaaattgtcaagaagcttggagctcgtggtgtcatggaagtctatccataagtttgtgatgcaaatgttgtgatggtgaccgtttggtataaataaagtacgtagtggtgtgctataagaaataaataagggagtctggtgccttgctttttaatggaaaacacaatggaactcaaattagtagttcagcccgtgccttgtcacaacataaccggagcgtgtatttaaattagttttgagaagtattgagtcactcagtgtgtgtctgtgtacacggtatgtctgtatgctccaacatgctgaaatatcaagtttatattatgtt

SEQ ID NO: 38266 - DNA, 265 bp, Triticum aestivum
  Clone ID: PAT_TA_38266
ggtcgacaggctcttcaagctgacggagggtgcaaaacccaaaggagaaaattgacaaaatgtttaaaggcgaaaagataaataccacggagaaacagttaattgctcaaggtggctttgaaacccccagaaaatgcatccataacaattgacggtgtgaacttggcccccgaatttggggcggtaaaggataaaatcaggcagtttccaaaaactttcaggattggcccatgggttggggcaaccgggaaaccgttgacaaatg

SEQ ID NO: 38267 - DNA, 483 bp, Triticum aestivum
  unsure (1)..(483): unsure at all n locations
  Clone ID: PAT_TA_38267
acggtcaagatctccgggtcgacgggtgggtaataaagggatatgatcaaagtgttacttgccttgctgacgatttgaaaaccctagagagtaatagtagcaagcctcgcacttcggaaactctatcgtgaacaaacaatggcatacataagcactcaagcataagatgcaagggtaaaactcaaaagaaaagatccaaactgaacgttcaactgaagagctttgatttgcaaaaagaatcaatcgaatcggacctacgaacacaaactgcgatcaaacgaagttcaaattcaaatctgcttgaaaccaaattttaatttgttaaaaccatgttcaagttgattatctggaaagagggtaacaagacgaagattttggcgttggtttcactggatttggacgaacgagcaaaaagtagcgagggtttgaagatcanggactaatctgtgatagaagtattcgtggataggtccctgnccgctc

SEQ ID NO: 38268 - DNA, 407 bp, Triticum aestivum
  Clone ID: PAT_TA_38268
ccaaggaaacaaaggccccggccttggaaaccccccccctcctcctccggcccccggcgttggcggaactaacaaccacgccaaccaacaaccccaacaccaccaccaccagcaacatgaagggaactacccaaattgttaaatttgctataagtttcatcctggaggtgcaagggcctgttggcatcggtatgatgatgaacatgaagagaagaagaaggccaacctcgtcaccaactcctacgggattgatacaaattggtacgcagattctggagctaccgagcacataacgggggaactagacaaattgacaatgcgagaaagataccacggaggtgaccaaaaagcaatccaattccccaccagccccctcgcaccttccggcgaatcaccgcacctctccc

SEQ ID NO: 38269 - DNA, 380 bp, Triticum aestivum
  unsure (1)..(380): unsure at all n locations
  Clone ID: PAT_TA_38269
ggtcgaccggcccaaattgctcattcagattgaaggatccacgtggcattcaaggtctggaaggtagattccgtgtccgcacctagtttgcgggctcgacatgtgcacgaccggattccaccgcgacagccaccatgcgcacctcctccgcacgggcggagacggtaatgacacgctagttcctcctcgccggcgtgctagagcatgcgctcgtcctcctcttcgtatgttgtgtgcatagactcggctccaccagctgctcacgtgtttggcatcgcagcggcatcgcanggagggactgcagacggcgtgagcgggcgagccttcggcttcatggcacagggatggcggcgacacgggggtgatgggtgagaaatttt

SEQ ID NO: 38270 - DNA, 498 bp, Triticum aestivum
  Clone ID: PAT_TA_38270
tcagaatacaactaaaaagggacaactcagggaacatataactatctgagttgcagatgcatagattagtatgtcgaactaagttcaacatatttcttctggataacccatgcagaaaggtagaactggcagagtcacaacatagaggcgagaactcatcaagaacactttggctgtgatctttcggttcaacaaggaacttctgccataagaagctcatggtatttggaagaaataaataccacacaccttgaggactatcgcaaaggttattaataacctaaaggaatgagcaaacactaacaacatgaggtaagtagggtgaatctcgggttcaagaacccaggagtagaatacctactactaaatggcataacgggatgcttaggagaatgatggccagaatcatcacattgggatcacaaataataactagattactaagtgatactctagacacctagggtcatagtaatagctccaacctatataacgagg

SEQ ID NO: 38271 - DNA, 406 bp, Triticum aestivum
  unsure (1)..(406): unsure at all n locations
  Clone ID: PAT_TA_38271
ggcataatgacgaaattgcaaagattcccaagtggatgactaaggcctaggaggatatcaacgctgaaaactcaaggatggccgatttgcaagctcacatcaatataaaggcggagcgtctgaaaacacgggcttggcgtctaaaccttgagcagaatgcttccaacgcagttcatgagcggaggtacctaatgcggcttgaaactacgtcggtatttccccaaagaggaagggatgatgcagtacagctatggtaggtatttccctcagttatgaaaccaaggtatcaatccggtaggagaaccaagcaacactatgtacacagtacctatgcacaaagaacaaacccttgcaacccaacatgtaaggtatcaatctggtangagaaccaagcaacactaaaccg

SEQ ID NO: 38272 - DNA, 132 bp, Triticum aestivum
  Clone ID: PAT_TA_38272
gggtcgaccgggcaaagcttgtcaaagatgcctttgatccggcaaaagaaaaaggcccctggcaccattttaattgaggaattggagccaattggcgcaaaccgttttgccatccagttattgggggccacc

SEQ ID NO: 38273 - DNA, 394 bp, Triticum aestivum
  Clone ID: PAT_TA_38273
accggtcagtactccgggtcgacgggcagtaaactcacatcacgtgacaaaagggaaaaatagagcggtgcccatagaggtacgtgccatacggcctatcccagaggagtcccgccactggttgttaaaaccaatcaccttcgaccatcaggattactctagaagtatccggtatgcaggatggactgccttgatattagatctgataattgacggactccaatttacacaagtcctaatggacggcggcagtgatctaaacctgctataccaggacacaagccgcaaaatggggatagacccaaccaaaattcaccatagcaacacttcctttcaaggggtaatgccaggcccacatgcccattgtacgggctctctactgctagaagttgtg

SEQ ID NO: 38274 - DNA, 414 bp, Triticum aestivum
  Clone ID: PAT_TA_38274
gaccgggaggaggccaagtcgcgaggaggcggagaagccggcaggcaggctgcgccgctgccaggtccaggtctagcgcctcaggcaagggagagggagggggaggagcaggaggaggaggttgcccgccatggggatgaaatttctgaacaagaaggggtggcacacggggagcctccgcaacgtggagaaggtgtgggtggcggagcagaaggagaaggaggagcagcacgagatcgaggagtacaagaagcagctcaaggaggagcgggagaaggccgagttccgcgccatccaggagcaggccggattcaagccgaggcaagagaggttggaattcctctatgagtcagggctgggtgttggcaaggggagttcggatggattccaagcactgcagcaacctggcccagc

SEQ ID NO: 38275 - DNA, 397 bp, Triticum aestivum
  Clone ID: PAT_TA_38275
ggggatctcacacaggacggcgtaaaagggcaaattgccaacaacaatggccaaaaaaactgggaaatgcaccccctgatgaaattggaccaccaccccctgctgaacctggaaatgctgcttcaactggattcaaaaaaccgcttgggaggccgaaaaaggagaaacaacctgcatcaatctctgctgaaactggagatgcaacccctgctgggactggtgatgctgaaactggagatgcaacccctgctgggactggtgatgctgaaactggagatgtaacccctactgaaactggagcagcaacgcctgctgaaggtggaaatgctgcatcgacagggatcaagagaccgcttggaaggcctagaaaggtgaagaagtttgggaggccaagaaa

SEQ ID NO: 38276 - DNA, 193 bp, Triticum aestivum
  Clone ID: PAT_TA_38276
ggtcgaccggtccctgcccacggagcaacaactagcattagtaccctactgcaacgcaacgcccagggagctaggcaagccaacctacaacctaaacaattgttcaatgggaactccaataaccaactgggcggaaccttgccaaggccgaaggtaaaatccggcccctcctccctctcctccggggtttccg

SEQ ID NO: 38277 - DNA, 297 bp, Triticum aestivum
  Clone ID: PAT_TA_38277
accagctcacgaaccaaagttcactgcaaatggagttgattgggaagaagttaagtaccccaggatgaatttggtcccccaacaggagaggtaggatccaacttctttcaagggaacacaggctcaagaggttctcccaccacaggaccacaggctaaaagcaagggacaagcttcaagaggagattgatgcatttgaagaagctcccaaagccttggtcaatttggttcccaagactacatcaagttctacttcatcatgtacgactacaactccagggatttccatcaaaagggg

SEQ ID NO: 38278 - DNA, 143 bp, Triticum aestivum
  Clone ID: PAT_TA_38278
tccgggtcgacggggctgccaacaagaggaggcaggacgagcaagaaccgcaagcgactccagcaggcttagacttcatcagcagcctccctgatgatatgttgacagtcatcatctccctcctaccaatcaaatatggggac

SEQ ID NO: 38279 - DNA, 112 bp, Triticum aestivum
  Clone ID: PAT_TA_38279
cagataaatcggaatagtctgacaaatcggttttgctcttccccttattcataaaggcaaattcatccttggtggtatgcttggataaaacaactgggttgcctggggcggt

SEQ ID NO: 38280 - DNA, 387 bp, Triticum aestivum
  Clone ID: PAT_TA_38280
agctcgtgatgtttctgcctcaccatgtccatgtattgggaacgggctcgccgatggtcacggtgcaatgcaccagcgaggatggcgcagaggagggggttggcgccggatcatcgaccaccgcattctccattgggacgtcggcgtcctctggatgcctgccggccagccagtcggtagcaatggctgccatctccttttggtccgtcgtccggccatccggaagagtgctggagcgcgaggaaaccatcgtgggagtggtgtggacaggagaaagggaacggaggcaaatgactacggctacggccggcgcagcagtttatatagcaatggtgggcggcagagggacggacgggtagcgccggagtagctgccttggcaatcgtg

SEQ ID NO: 38281 - DNA, 372 bp, Triticum aestivum
  Clone ID: PAT_TA_38281
cggaaggactacataagaattgggtcaagttggagcgtgattgagctgtactcgtctatggtgcgtgatttacccgcttccagtgcgtctgaactcgacggactagcagtaatgcaaactgaaaaatggagcgtgatattacagctctatgattatatacctctcagctcacgtctaaccgagattatgacaagtatgaaagggcatattctataataagttcgacatagtcacagtagcatcaggatattctttagcgagaatactatgagagggcacattcgaatcgaactaagacgagcgagagcaacgagcacaatcttggaaccgtacatccaatacagctggtcagcgtgaacaatcgagtcggat

SEQ ID NO: 38282 - DNA, 453 bp, Triticum aestivum
  Clone ID: PAT_TA_38282
ggggctccaatgcttccagacggcaccagtggacctccaaggatgcacctgccgggtggattgagctcgaggggctttggaacgtggtggaggggctgcgggggtcaccggcaagctcgggtcggggacggcgactagaggcctgcccgatcgggctgcagctaagctacggggtcgtggtggttgtgcggtgaggtttgaggcttcggagcagaggaaggggctctatatatagccggaggatgagggggtacgtggctccgtcagagttctctagaagtcggcgagcgacgacgaagggtgccagcgagggggggagagctcagcgatcatgcgggagctgttgcagctcgcggacgagcacaggaagcaaaggggggagaagacacgggcacgggcgcactatggcttttggccgcgacgtacccgtgatcgctatggcatctccggcat

SEQ ID NO: 38283 - DNA, 402 bp, Triticum aestivum
  Clone ID: PAT_TA_38283
gacaatagacacacccaagtcgctaagcattttcatccggttttggcgcttcacattaagattcttccttatctatatgagtctgtttgcatggtatcgacgtttggctggaattaaaggttctcagcattggctccaacgcttcaagctcttatctaaattatcatcgagggccatttaccattcaacttgctcaacagtgtttttccactgggatgcacaatttgtgtttgactaataggatatccttggtgctgatctacgtagtgatttcaacatcatagcagtataatgtccaagctgtgtgtctcatcaacctcctctgccacggcttcatcctcaccctgagcatcctcttcctctggtccaacggctctgccatcggatccaagtttacttcca

SEQ ID NO: 38284 - DNA, 414 bp, Triticum aestivum
  Clone ID: PAT_TA_38284
ggacggagacgacgcaggccagctgttggacaggctcacgagcgcgaaggcgacgagagggagaggggcccgagcaagaagacgccctggacgcggccaacgctagcggagcgcgcgcattgcatgtcaaagctcgtgttcaccgtgtgcactggtgcacacagtggcacacggcgggccaaacaatgtctgggggcttgtccttcctggggaggttgcaactgcggtggtagtttggttaaaagtgacatggttaaatgacagttaacacctgaagtttactgcagtaaacttgatcgtgtactgctgctcaacagggaggtgatttggtcaaatggagttgtctgggaggttgaggtaaagaaggacttacatcctggtaactatggaggggtttggatcaagatttaacag

SEQ ID NO: 38285 - DNA, 451 bp, Triticum aestivum
  Clone ID: PAT_TA_38285
cggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccagacgtgggcatctcctccaaggccatgtccatcatgaactccttcatcaacgacatcttcgagaagctcgccggggagtcggccaagctcgcccgctacaacaagaagcccaccatcacgtcccgggagatccagacctctgtgcgcctcgtcctccccggggagctcgccaagcacgccgtctccgagggcaccaaggccgtcaccaagttcacctcctcctagacaacttaggcttgatcctcgtcgcttcatgcgttctgtatgtacgtagttggcagtatgatgttacaatctttgtaaggattgtgttg

SEQ ID NO: 38286 - DNA, 232 bp, Triticum aestivum
  Clone ID: PAT_TA_38286
tgacaagctgacggcggccgttgatgactatatccgctggtgtatggcaagcactgacagggcgcaaggttggtggttcggagctgctacgacgtaccgtgtatgcatgctggttctgtgggcgctatacgccgcgcatacgtacatttggacaacgccatttgtatgttgtgtttgtcgctcaattacgtcgttaggtcgatctctgtcgatccgtcctgttaagttcttg

SEQ ID NO: 38287 - DNA, 476 bp, Triticum aestivum
  Clone ID: PAT_TA_38287
gcatgtgtagttagcttattttgatgaatctatggctagtaaaataaccatatagaagttggaatacagtaggtataacaccaatataaataaagaatgagttcattatagtaccttgaagtggtcttttattttctttcgctaacggagctcatgaggttttctactttaagttttgtgtcatgaagttttcaagttttgggtaaagatttgatggattatggaacaaggagtggcaagagcccaagcttggggatgcccatggcacccccaagataatccaaggacacctaaaagccaaagcttgggggagccccggaaggcatcccctctttcgtctacttctatcggtaactttacttggagctatatttttattcgccacatgatatgtcttttgcttggagtgtcttgtattatttgagtctttgcttgttagtttaccacaatcatacttgccgtacacaacttttgag

SEQ ID NO: 38288 - DNA, 253 bp, Triticum aestivum
  Clone ID: PAT_TA_38288
catgttaggaccctgtagtgttgtttgttagcagcatgtaaatatatgatgcaaccgtgtatgtgttggacacaggcacacagtttacacatccccatgagttgtgatgagctctatccaaggtatagtatcaggcagtaggctaatcgtctggttctatgttgcgaccggttacagagctggtgttttaaaaaaaaaaaaaaaaaaaaaaaaataagaaaaaagaaaaaaaaaaaaaaaaaaaaaacaaaaa

SEQ ID NO: 38289 - DNA, 145 bp, Triticum aestivum
  Clone ID: PAT_TA_38289
gtcgaccggtcgacgagctgcagtcaattctactacatggagccaagacaattgtggacaaaaagaagatcaatgctgtatcaattcattatgatgacaaggccatcgacattctccccaatttaaacccttcaatggggaaaat

SEQ ID NO: 38290 - DNA, 413 bp, Triticum aestivum
  Clone ID: PAT_TA_38290
tgttccatcttcatgcatgctcaactcaacacccctcttcatgcatgcttctagtgtatttgtgctaaactagtgtggactcatgcaccctccatacactctaccaaacacccaaaaggaggtcgagaagggaactcttgggcggcatttgtctcttactacgtactaccactaaatgttgtaggtgcaatgcacggtgatgttatggagtacgtgcctaagtactctactactacggtattagttggaggcacatattaacttttatatttgtttacgtgtatgccccgagaccttccaactagacgtgtctttctctccatgtcgcactttgtatcgttcatacctctaagtactactacgtgtggtctccgacccagaagtggaagaagtggagatgctctaccatgctg

SEQ ID NO: 38291 - DNA, 441 bp, Triticum aestivum
  Clone ID: PAT_TA_38291
ggtattctaaaaagaatggtaggaagaaaattactgcagcaaagaaaagtgacaagagagctcaaataaaggcaccacctgcaggaagagtcgtcgtgctcgatgagaatggagtgccacttggacacaggaaatctagtctgtgcaaccaggttgcgggacacaacaagctgacatgtccaacactcttggaaagaaacaatgatgaggaggtcaagcaacccaaatctcaaaaatagcagcccaaagttatggaacaaaagaagggaccacacccaaagaaagcaagtagtagactttgtagcatatgcaaggagtatgaaccacataatgcaagaacatgcccgaagcacgctgatgctgaaaagacaagcaaaaagatagagaagaaacataaagcaaaacctagagccatcaacaagaaagtggtggaagatgaag

SEQ ID NO: 38292 - DNA, 395 bp, Triticum aestivum
  unsure (1)..(395): unsure at all n locations
  Clone ID: PAT_TA_38292
gtcgaccggtcctaggctggaactaaagttttaccgtcgtagtctccatggcttgtgcagacttgggtttcatcggcaacttttcacactgaccacctttgtttgtaggcttgttgaacgtcgtttttgttcgatgagcgacaagctgcataaaattttctatatccatggattttgaagctaactcttcaaacgtgaggggcctcactccttgtaactggacagccacttccgancggagattgttcatgcacatgcgcactgcttccggctcattgattggctgtgggcaatgaagacttaggtttctccatctgtttatgaaatcagccgccctctcgttgaacccttgttcagtttgggtcaactcagttatgcccaccgtcctctgtgtg

SEQ ID NO: 38293 - DNA, 428 bp, Triticum aestivum
  Clone ID: PAT_TA_38293
gtgtcattattgatttgcttgccatttgcaaaccgtgcatccgtttcttgtgttctttatatcgatttcgaccgaaatcatctcatctttccagtggcatgcttggtttgccaagttactgccttgttcatcttttcccttccggaccacgcatacgcatcgcatatcatatctcgcatatcatacatgttttgcatcatgttgcttgtgcatttctcgtgattgattgtggttcgttgcttgtgttcttgtcttgggtagagccaggagacgagttcgtgaacgaggaacctgtttagtacgcttacgaggatcaagctttcgacaactctgagaaccttgcaggcaagataaccacccctcgaaatcacttctatctttgctttgccaattgttccgctcaattgccatgttgcgctacctaacac

SEQ ID NO: 38294 - DNA, 447 bp, Triticum aestivum
  Clone ID: PAT_TA_38294
gggggtgtacacttagtgtcgaggaagagtgatatccatgggaatcagttgtactagtagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaacgaaaaaataaaaaaaaaaaaaaaaaaaaaaggggccgcccaaaaggttcaaacttaacttacccttgaaggcaacttcaaacccctccaaaagtgcccccaaatttcattccaggggccttctttttaaaacttcttaacgggaaaacccttgggtttaccaaattaaacccccttgaaaaaaatccccttttcccaactgggcttaaaaccaaaagggccccaacgtttcccctttccaaaaatttgcccaccctaaagggcaattggaaccccccttttaccggc

SEQ ID NO: 38295 - DNA, 184 bp, Triticum aestivum
  Clone ID: PAT_TA_38295
tgctatgtgcttcggtatgctggctcagggtcatatgtccttggtctcgcgcttgaggctgctgctgcagcattctcttagacatgggtggtttgacaagcttgtgccatgctggacgataccctgcgggtgcgcgcagccggtgggctcccaggatctccggcgtccactctgtttgcctttc

SEQ ID NO: 38296 - DNA, 403 bp, Triticum aestivum
  unsure (1)..(403): unsure at all n locations
  Clone ID: PAT_TA_38296
ggtcggtatctagggtcgaccgggccaacattgaaatgaagagcaggcaccagcgcaagatcctggagcgcgcaaggaagatgtcagagaagattgggaggctggaggtggaaatgcagaaggtccaacangccctggtgaagtatgaggaggagcagacgacgtcgaaaaccgtggtccagcggtccaaagtgcagctggtggactatctctacggtcgaatgcgggaaagccggaagccgcggttctcgccctgccgttgcatgaaagcgaaaaccattgatgactgactctgccttcgttcgcgccgctccttttttttgaaggcggaatgtgnaaaggttggggttttcagtttcagatggagcgactcattagttcatgtttttctacgtanatacag

SEQ ID NO: 38297 - DNA, 399 bp, Triticum aestivum
  unsure (1)..(399): unsure at all n locations
  Clone ID: PAT_TA_38297
gacagagctagcaaaagctcttgccgagcagctatttgacaatgaaaatatgttggttcgctttgacatgtccgaatacggtacgaagggatctgtgttgcgcctcatcggagcacctccaagctattttggttatgacgatggaggacaactgactgaaaaagtcaagagtcacccgtacagtgtcaccctgtttgatgaggtggaaaaggcgcatcgcgaggtgtaaaatgttttccttcaacttctcgatgatggtttgttgaccgatggcaaaggccgaacagtagatttcanaaacaccatcatcattatgacctcaaatcttgggtcaaagcaccttgcagcaggaatggttgggaagaacacantgcaagaaacacacaagcttgtcatgaa

SEQ ID NO: 38298 - DNA, 394 bp, Triticum aestivum
  Clone ID: PAT_TA_38298
acgggggtagcgagtggagggctgggccggccagctacagtgctgggccggtttggctaccaggtgagcgccaggtaggcttctgctccctttttttttatttctgttttctattttctgtagtttgttttgatttagtttagcaactaaatcatttaaataaattcagtagaattttatgtggcttgctaaaatatatataaagccactcacaaacttccagaattattggagtcatatttaatatatattaaatataaatccaaagcaaatagttattggattaattcaaatggccaaaataattatctctgtgactccaaaaatattggtttgaattttacctctcaccaatatttccatggaataacaggaacattttcttggacacatt

SEQ ID NO: 38299 - DNA, 478 bp, Triticum aestivum
  Clone ID: PAT_TA_38299
gggggagattctaagacacgattgtgtttgtccactattagcgtgacatgaaaattcctactaacgcaggatcgcatcgcattttctggaaggacttcgaagtggagttctggtttgcctttcctgatgatccttttagccttatgtaccttgagaccaacaactcttggccacgaaaacccatgatatttgtacacatttgaactatttgctctccataatgttcgttttgcctcacctggaacctgcatagattgagtagaactttggcattatgttaaaaattggagatcttaaatgttttctaatgttgttaccaacgttcgcatgatagagcatataaattaggtccgtagctgtaaatgtatctaaaattctagacaagcaaacacatcattttttgttttttctgatgttaaaccatggcattccttcttatgatggtgatatatgtaccttgggcatgtattccgcaacc

SEQ ID NO: 38300 - DNA, 416 bp, Triticum aestivum
  Clone ID: PAT_TA_38300
ggaagtaggagctgcgccgctgggcctagggaagagggggagggtctttcctttttcattttatattcgtttttctttttagttgttttctgttttctatttctttttaaaataaattcttttataaaatataaaacttgcacctaaactagtataataaattagaccaccaccacaattagtttagcatttaaataaattagtttagaatttttataaattaaaaagcatttaaataattgttttagcccctattttaaatatttatgggcacttagacacattataaaaatgttggttcaccaccataattagttatgggttattttccacgtgatgaatattttagtattcatgtttgtgtatttctttatttcacttacaatttgaatttgaattcaagtggaatttgaaat

SEQ ID NO: 38301 - DNA, 415 bp, Triticum aestivum
  Clone ID: PAT_TA_38301
gaccaaaagggagagttgtataaaaaagcactactggagtccttcaaaggtgcatctccgaagaggaagggcggaagcttttggcagaaattcacgccggactcggcggccaccacgccgcagcccgggccattgtaagcaaggccttcgtacaggtttttatttgttgacggcccgggtagatgcacatgacatggtccaatgatgtgtcggttgccagcttttttcaaaccaaagccacatgccacccaccgccctccaaacaatccccattatctggcccttcacggtctgggggcttgacatggttggaccccttaaagggggaacccataagaaaaaaatacttactggtcatggtggataaattcaccaaatggatagaagacaaacctgttaaaacggccgaatcggg

SEQ ID NO: 38302 - DNA, 424 bp, Triticum aestivum
  Clone ID: PAT_TA_38302
gtcccgggccgacgggaaacacaaaactgcggtggttatctgtaaaccagcctgaccgggagctcgaaatgcttctgagtagaagaagcaacctttcccacttccacaacgctcgttcgctatctatatccggtgcggtggacgacctactattccctcttgataagtttatctatctggtggtgttggaccttgaaggttggcagtgcttcaaggacgaagacatgttgttgatatgcagcagcaggatgctccttctccgttatctgagcgtgaagaatacaagagtccgcaagctcccggccaagatcaaggagctgcgcagtctggaaacgttggacatgagccacacagaggtcagtgagctcccatcagaagcgtgcgagttgtcacggttggagacgctggacctaaggagcacact

SEQ ID NO: 38303 - DNA, 407 bp, Triticum aestivum
  unsure (1)..(407): unsure at all n locations
  Clone ID: PAT_TA_38303
gaggttaaggaggacggtgccaatggaggaaatggtggggcatgcactgaggaggaccgagacctcagcaccactgtgctacgaagacatgcatttgcatacttgacaaaagggggcggtaccatatctgagggtcttgttgctgcatcgtcacctgtggacttgcaaaataaactgcaggagcttatcgaatcagagcatcctggtgctggttggaactacgccatcttctggcagctttcgcgcacaaagtctggtgatcttgtccttgggtggggtgatggctcttgccgtgaacccaatgatgctgagttggcagctgctgcttctgcacgcaatgatgatgccaaacatcggatgctgaagcgtgtactgcancagttgcacaaagcatttggtggtgctga

SEQ ID NO: 38304 - DNA, 175 bp, Triticum aestivum
  Clone ID: PAT_TA_38304
ggccatgattgaccatgaattcatggtgcagcacgtggctcccctccagtcgcgaccgcgcccgctgtggaagcttggagacgaaggggacgacctccgcttgcgcttagagcccctttccgatgaggaatagcgctcgaatcttctttccttgctcggggatgaccaagggtac

SEQ ID NO: 38305 - DNA, 113 bp, Triticum aestivum
  Clone ID: PAT_TA_38305
ccgggccgacggggacgatacaccaagcagaggagatccggcgaggaggcattccagcaacgtggtgccggcaacatcgggccatagcatggcgtcggtgacaaggcgaggga

SEQ ID NO: 38306 - DNA, 318 bp, Triticum aestivum
  Clone ID: PAT_TA_38306
attggaaaataaattcaaagggctttgaatttaattctttgaaactcccaactcatatttcatataatttgaagaagtcattttatcttctctcgtgaaaatcattgagtcgcataaagtttcagaattggaatatttccaaatgaaattcaattattctcagaaccccttgtcatttaaataaatggaagaagtcaggtcatcttctctccggggttttgtgttgaaaagaatttgaattcacggggatcagaaagccattatgaaagtttgggaaagtcgttttattccctctcatttacctttcaaaaggttttg

SEQ ID NO: 38307 - DNA, 413 bp, Triticum aestivum
  Clone ID: PAT_TA_38307
gacggggatattgaagctggtgaatacgaggaaatcagttttcagcttaattagttttactccttttgcttcttcttttttgagggattactccctttaatttttgtttcagaggcctgatatatccatgttccatgtatactccccttatatataaagtcattttcactctgtgggatactagatgttgcagtaattagataagtgaagtaaagtaaaacctcatgtgcacttcatcttagtctaatcaatgtggtcaatctcaagatcatggtggaacatggtgcaatgaaagtatgcgccatgaatggacagaaacggtacagcaactagggttctcggaacatgcaaagcagccgaaaacggaaagccagccggcctggagctgggggttgcatcgattccaaatctcc

SEQ ID NO: 38308 - DNA, 412 bp, Triticum aestivum
  Clone ID: PAT_TA_38308
tcattcaaccttgcaggtatgccgagtggatttctaacattgtcccagtatagaataaaggatctggcaagttgagggtgtgcattgatttcagagatttgaatagggctacacccaaagatgagtatcctatgccaatagccgatatgcttattaatgatgcttctggacataaggttattagctttctagatggtaatgccggatacactcaaatttttatggccgaacaggacatgtacaagacagctttttgatgccctgatttccttggtttattcgagtggacaatgatgacattcagattaaaaaatgctggcgccacatatcacagcgctatgaatttgatttttcatgatttactcggtgtcatacttgaagtctatattgatgatactgatgtcaaatcgga

SEQ ID NO: 38309 - DNA, 182 bp, Triticum aestivum
  Clone ID: PAT_TA_38309
tgtagcaccctcaccaccctcatcgtgctgctctacagctgaacgattttttaggaatagaaaaataatgactttgcgagctagacctcgttaccttctttcaggtcatgttatgagttagcaggtcattaggcaatctaattctccccccgtttagcacagctagtcttgttttacaagag

SEQ ID NO: 38310 - DNA, 475 bp, Triticum aestivum
  Clone ID: PAT_TA_38310
gggccgacggggaggtggagaaatcgcaggcggagggggtgcacacgtcgacgcagatgggcagcgggcacttcccggaggaggggttcggcaaggcgagctacttcaagaacatccaggtggtggacagcaccaacaacctcaaggcgccccatgggatgggcaccttcacggagcagtccaactgctacgacgtgcagaacggcaacaacgccgactggggctcctacttctactacggcggccccggccggagcgccaactaccagtgatgacaagaacaccaccatgactgacgagtgagtgaagtgtagtgtggtgcaccatctgcattgttaggcctagatgatgataggtgtcatgtgaatgggtcctggtgttgtctcctgatttttttcttttttgattttctcccgtgtgtcaatcaagccttctgaagagaagcatggcatgtggtgtggtctgtggtggtgca

SEQ ID NO: 38311 - DNA, 417 bp, Triticum aestivum
  unsure (1)..(417): unsure at all n locations
  Clone ID: PAT_TA_38311
gactaacacatataaatggccatttgtattccaggtaacagtcctgaaaagaaagaggacgatggacctgagggggaacggaggcangagagcattctggatggctatgctgaggcggctgtttatttgatccatggtgtangaagcgccggtcaacacggtggagctgcgccgtgggagggtgctggtttggagatccgcgtgactatccgagcgctagtccacctcagaatggaagcaagtggtgccttgcgggtgcctcgccatgccatggcagtgccctgtacgaaaccaatgcacattacgtttttcatgaccatgaaaagataaacgtgaaggtcgggcatacgctataacttgatgatgcatataaaatatgatgtctaagaaagattcggtacacatgtttctgaatgt

SEQ ID NO: 38312 - DNA, 118 bp, Triticum aestivum
  Clone ID: PAT_TA_38312
ctacaaaacgttgtcaagccatgtgttccttgctctcagcaaggaaattgagttggtggacgttgtgtagcaaaacgatgctttctgcctggggcagttaaacaataagattgccaac

SEQ ID NO: 38313 - DNA, 476 bp, Triticum aestivum
  Clone ID: PAT_TA_38313
ttgcaggaaccgtcgtcggattttgctacgactgatgagatttttgctacatccatcatgatggagcttcgaccgatgacgatggtgatggagtttttgctgcaaccgccgtcaagttttgctacgactgggcgagaaatttgttacatccattctttttttacggcaaagaccggtggccgtcgttcatggcgaaacccgtgcgacgagcgtcaatggcgagggatggtaggcggtgcactgggaccatagcgcgtccaccgcgggggttggaacagatcggcggggttggattgaaaccagcgatgtcggagctgcaaccgaaattaatggtgaccggggaagaggtctttggcaaacatcggggaagagcagcgcagcaaggcggcgagatgcgagcagccggcggtcgttcgcctcgccggagccgcggacatggacggaatcatgcggataaggagggaagggcctctttt

SEQ ID NO: 38314 - DNA, 485 bp, Triticum aestivum
  Clone ID: PAT_TA_38314
ccgggtcgacgtacatcatttccctagacatcaatccgatcacaatcgcccgaaacttcttggcaggtatgtactgggtcggcatgaactcccattggatggctgccttcagagaagacggtaaaaagttggtgctcatgaacttccagacctcccatgagattatccttcctccgttggattatatagagtattaccatcgcggtccaagtcatctagattactacgtcagttggacggaccttgttttgcagaagattgtaatctgccaagtacccacacgatatgcgaattacatagacttcaagctaattgccttgttcaaccgcggactcgcctatctttataccggtgccttttttagccggagacaactcggctcacaatggatcatcgtcaaggccgatacacacttctgtgatgctattgaacacaatggcatcatctacgcgatcgacaaagcagatggcaccatgtattgctgg

SEQ ID NO: 38315 - DNA, 430 bp, Triticum aestivum
  Clone ID: PAT_TA_38315
cggaacggctacatgcaagtctgatcaatcgatgatcgtcggaagcaagtgcagtgcagtgcagtcagccagaggaagacgaaggcgtttcgatcagtccgatcccctgttcttttcatccagacaagtcgggagggggtttcttgtcagctagtcggtttctggcttgtcagtagctgcggtgcgtgtcgtgtggatcgagttagttgtactaccagaaattcggaatgacatggaacccatgcgtatcatagcagatggtacgggctgcctgcccttttcctgggtgttcggttgggtttggttcatggtggagtgacagtgtgacaatgtatgcctggcgatgccactacagggcgtgtatctgtaggcatattccgagctggctttatccctgtggatctgttttgtccgcttattttgacactgc

SEQ ID NO: 38316 - DNA, 458 bp, Triticum aestivum
  Clone ID: PAT_TA_38316
tagtgcaacatctcagcaatgctaatataattggatcatacaaccacccctcaaagtgcgatgaagaatcactccaaagttactatctagcggagaacataagaataaattgtttgtagggtacgaaaccacctcacaactattctttctgttcgatctattcaagagttcatattaaaataacacaaagctattttttccgttcgatctatcctagagttcgtactaagataccacgaaagaaaattcatattcataatactcaatccaacacaaagaactttaaagagttccccaagatttctaccggataaacaaagacaagaacgtgcatcaacccctatgcatagattaccccaatgtcacctcgggaatccacgagttgagtgtcaaaacatatatcaagtgaatccatacgatgccccattgtcaacacgagtattcaattgcaagacatg

SEQ ID NO: 38317 - DNA, 464 bp, Triticum aestivum
  Clone ID: PAT_TA_38317
ccgggtcgacctggctgttcttgaaattgtagtatataggtttacctatgcctcatgagtgatgttcaaatcatgtcaaataaaaatgatggttcagatgataataactattattgttgttgttgtaataaacttgccattttgtaacagaagcatattgttatgtacaggttgccttggtggtgagagccgcaaaggaagtttgagatgtacaggtgaagttgatgattaagagggcctgtgcaatgttgtatacttgttgatgtaatctggtgtagttgttattgaggtcaggtgaattgatgttggatgtgttctttgacacattttaaaaggcctttactcaatgaaacaattgaatagaaatttgtgaaatggaatagaatatggtctattcaatggaaactgtgaaagcatgtttgattatctgtaatgggtcgtgccacaactgtttggatgaatat

SEQ ID NO: 38318 - DNA, 361 bp, Triticum aestivum
  Clone ID: PAT_TA_38318
aaaatctagctagtcgatctgacggacgctcagcggctactgcggtcgaactcagcggacgaagtgcatcgcatgatggcggagatcgacatcgacggtgacggcatcagcaacgtcaccgagatcatctccttctgcaacgccaaagccgggcgcatgaaagacgtcgccaaggtcgtctgaatcagttcatgtcacctcagccgtccgatccatgagccgatccatctacgctcagcttcgaatatcaatttcatgcaactacctactccggtcacaattcagcctcagcttcacctgaggccggccctaattttgttcgatcatgttatatgccaccactattgcctagtgatgatca

SEQ ID NO: 38319 - DNA, 414 bp, Triticum aestivum
  Clone ID: PAT_TA_38319
ggtcgaccggtcacctttgaaagacaccgttggtacttttcttataaagtcctccctcatggaccttgtaggccttcgatcgccagactatgcagcgggcctcattttggtcttcgggaagttcctgcctaagtaagtaggctaggaaaggttctgtcaacgcggcgattactgcaattatgacgtgggcggaggatgttatgtcgtctgccgaatcaccggttggtgcggttttctccggtttgtcgctaccgggctcctcttcccatagtacggatggcttgaagagccgttccaggaagatatttggagggacagcatcacgtttcgcaccgatgcgtgccaggacgtcggccgcttggttattatctcgggctatgtgatggaattcgagtccttcaaaccgagctgaca

SEQ ID NO: 38320 - DNA, 467 bp, Triticum aestivum
  Clone ID: PAT_TA_38320
acttgttagtgaaccatttgctgtttggggccttgcttctctgggaccttttccttcgtctactgggtatacacatattctagttgttgttgattatgttactaagtgggtacaagctattccaactagtactgttggtcataacacttctattaagatgcttaaagaagttatttttccgatgtttggagtccctagatatttaatgactgatggtggttcacattttattcatggtgcttttcgtaaaatgcttgctaagtatgatgttaaccatataattgcatctccatatcatcctcaatctagtcgtcaagtaaaattgtttattatagagattaaattgatattgcaccagactgttaatagatctatacagaattggtccacgaaacttgatgatgcactatgggcatttataactgcttattaaaatcctatgtgtatgtctccgtgtaaactggttt

SEQ ID NO: 38321 - DNA, 367 bp, Triticum aestivum
  Clone ID: PAT_TA_38321
gtttatcctttgcgctatggcttcacatttatcttttagagcacggtggtggttctatctttattgatgtttctaatctctcatacttcacatcttccaatttgctcgtctttggactcatcgggtatatttactttgcatgcatcggtttaaagcatgtcgcatcattgcgtcacttcttcttgtgttgcaatagcctggtcgacctctatcaggtgtgcacattgagtactttcccctatttcctctcgattgtcttcagcttgggttctagattatcattggcggtcgatcacctctgtgtcggaccttcgattcttggggtgttgcacctgtgctttgattacagttgttcgccattggcttt

SEQ ID NO: 38322 - DNA, 369 bp, Triticum aestivum
  Clone ID: PAT_TA_38322
aagatcggccatgcccccaagttgcactctttgggatatttggattcagaaaatcatgtccaagagttcggcaacactgtcatcaatgttgggacaaaggtgagcccacgcaccatggcgccaagtgtgacgatcctggctttggatgtgcgttgtggaatccgcagttatgccaagatgatccctactgtcatcagatgctttccaaacgttgagacgctccacatcatgtctggagaaactggtcaaccctctggcaagcacaaccttgatttccggaatgagtctggtaccatagcatgcatctgctcgtgcatcattctgctggttttccatgatttccgaagggatcgacatgagcttgctttc

SEQ ID NO: 38323 - DNA, 395 bp, Triticum aestivum
  Clone ID: PAT_TA_38323
aagccagagcaagacgcgcagacagggcacggcggcgcggagaacgtggaggagtacctgagcctggagagccactcgaacaaggcgaggaggatggagagcacccagagcgccaagttcaagaggagcttcacgttgccggcgaggatgagctcgtccaactcgccgtccccgtcggtgtcagcctcgacggggccggcgccgtcgcagcagcagcagcagcaagggatggagtaccgagcgcagcacgagggcagcgtctactcagacctcatggagacgttcttggagtagcaacgcatgcatgcgtcgacggtcgatcgatcatccttacgacgacaagcgtacggactctatgttttcttgttcccactttttgttttgttccaaccaag

SEQ ID NO: 38324 - DNA, 343 bp, Triticum aestivum
  Clone ID: PAT_TA_38324
acaacgaaggatggatctgcgtcgccgaatccctggaacaacctggcagggttatacggatgaacagtgtctcattttttattcaagcatgctgcatgaccgatcgacaccgtgagcgcgtacctcagtgtttaaatgccctggtaaacggtgatatagtagtatagtactccctccatttcataatgtagtgcttcctttatctccgtacttcaaatttgaccgtaaatttaactatcaagatcgattgtggcgggagcaaaaattatatatatcagaatttttggaataccaaaaataaggtttctctttaaattactaaaaaaagtcctgtctaagaaaa

SEQ ID NO: 38325 - DNA, 321 bp, Triticum aestivum
  Clone ID: PAT_TA_38325
cgagattcactgttgcatctccagggtaatgatttgggtgcgggagggctggttcacaatgcaacttaatcctaatcatccccctgccaatagggaagggtaatcctggttaccttgcctgggttgaccaatggcgattcagaccttggttaagccttaaaatgggccaagtaatttttcctccttgtaccaggaagtttttgccaaatcgtccgttaaacggtgaggattaacccagacccatttcctgcatggtaaaccataaatggttcgacaccatgggctatctttttttgtttagtactggggccagacccatca

SEQ ID NO: 38326 - DNA, 340 bp, Triticum aestivum
  Clone ID: PAT_TA_38326
ggtcggaaacacgggtcgaccgcgttttaacagacagtccacctaccgcatcaggagccatagtgtgcatggcacataccaagggcaatgcatttgtttttcctattgctaaagctggagctcctccaggaggaggagaaaacaccaggccactgatcataacccacaatggtgcaattggcgtcttctcagacagcacggaccttgcctaccaacaagcggtgaaagatggcgcggatataataaattgctgggtccggatgtcgaaagacggggtcgccttctgcctgggctctacagatctcaacagcagcacgacaagcagccacaacttcttggg

SEQ ID NO: 38327 - DNA, 247 bp, Triticum aestivum
  Clone ID: PAT_TA_38327
gtaccgatctatcactggccgaccggcatatggaagcagttgaattgggggaaccttaagcaaaccgggattctggtgtgggttaccgttaggaccgactggaacaaagaagtggcccaagccaagaaaagattgaacaaatgggaaaggaacaagatgcctccaataacaaggcaagaatgaaacaatggattctggaaaagattaaccggaatgttggccgttcccaaattgattcccccaaaat

SEQ ID NO: 38328 - DNA, 388 bp, Triticum aestivum
  unsure (1)..(388): unsure at all n locations
  Clone ID: PAT_TA_38328
ttgtggtgagttgatcttagcctgtaaatgcattttcagaacctctgatggatgtgatgcggcttcataatgacctgacagtaaaccacagtttcagttcctcggttttctttctttcttctgtctttctttcttgaaacttaaatatgtatttctttctttctttcttgaaacataaatatgtacatatttctttctttctaaatgtcgaaggaattatttctaacctgcatcatgtgcattcaatcttcggctgttctggctgtgcattgccattgtaaattatcgccatttatcctgngagctcatagcttcccacatgcggtgaaccgatgaaatccatccagcaaatggtctggttttcagaagaactcgtttcaagatttgt

SEQ ID NO: 38329 - DNA, 356 bp, Triticum aestivum
  Clone ID: PAT_TA_38329
tccgggtcgacgggccagggggacgcagccgcgaccgtcgttaataggatgctcgtcggcgccaacgggctcaacctttacagggagatgtgaaaaaggaagatatatatatatacaaccgacctcgtcgtcatagtggtcttgtacataatagtcacccgaaggtgtgctgactattttgcctgcgtgctggaagctgttccggccatcagattagaatctgatggcgcgacttgtttcgcccttttgttttcgtcggtcggtgtgataggatatatttttgcgtctgttgttattgtcggtattgtaatgaaacaaatatgacttcgattctcttgctgctagctgggttttct

SEQ ID NO: 38330 - DNA, 401 bp, Triticum aestivum
  unsure (1)..(401): unsure at all n locations
  Clone ID: PAT_TA_38330
catccctaaaaccattcaccggtgtcatgcaccggtgaccaatcccgtcatgttcattcagactcagtacttcattgaaatcaccgaaacacacccatggcagaccgtcatcctcagcgagagatctcaacacgtcccaagtcttgcctctatcactgacttgtgcttcaccgtacatcactgtgagccgccatggagaagcaccaggcaaagtaacatgagcatctatgtgataagcagagtaaccaaaattttcaatctttatttcattattccaaaaaataccgagaccaccactcctaccagagctactaacagcanatgaattatcataacctagggtgcttgctaagttttccactctatctctcgggagttgagtttcaacantacaaagcacc

SEQ ID NO: 38331 - DNA, 262 bp, Triticum aestivum
  Clone ID: PAT_TA_38331
tacatacgcttttcacgaacaaggtttccatccagcttacacaggatgaagcattacatagcagttgggagcaacaagtggcttgtgatgttgaaacccataaagctggagtctacatcggtagcaatcggacgtttttgaatcgcattgcaatcgaatggactgaccttgatgcaatactcactacagatcagtcactgactaatggaaatgtgggcaagattgtcgggtacgctgtcaatgatcatcttaaggaaaaata

SEQ ID NO: 38332 - DNA, 394 bp, Triticum aestivum
  Clone ID: PAT_TA_38332
ggtgcggagtcgacggcaacacggaggtgaaaggagttccatgtccgagtcggcgacaacgtgcgtcatcgtcggcaacatggaggcgagtcaacggcaaggtgcggcaccggtgacgaacatggaggcgagtcaccgacgagttgcggcaccggtggcaaacaggcggcagcgagcgtgccacggcagtgcactcatggtgaaggcgcacgaggtgcggctctcactgaagctagcggcgacggcggcaatcgatgtgacaagatggcattggcggccatctccgtgttgcaccgacgacatcgacgaccacgggcttcaagagagaaataagttaacaagattatggaggtgaatgttagaactaatcttgttattagcgctagttttagat

SEQ ID NO: 38333 - DNA, 458 bp, Triticum aestivum
  unsure (1)..(458): unsure at all n locations
  Clone ID: PAT_TA_38333
cgggacagaaaggataatgcatatgtcacaaaactcagtaagtggtatttgatggttttcagcatataaatcaaagctcactttagggggattatttgtaggcaagaaagtaaagctctgaacagagatgtttgtgaggatttggtgctggccacactcatctgcgatgaagttggtgaggccggcattagaaatatattgcatgaactcctcatgaattccagcctcttgcaggaatggggtgtgcggccatccgcacggacgtacctccgccaacccccgagggtggagatcactgtcagaagactccccgataacacccttggagttcttcttcgagccaaacttcctgaagatattcatgttcgcgtacaattttttgaaaataaaaaaatttggggtgatgaaaaatcgtcaacnaaactttataagattgatagcaactactcatagggata

SEQ ID NO: 38334 - DNA, 373 bp, Triticum aestivum
  Clone ID: PAT_TA_38334
tacggcaaattattagcaacgggagatagccggagatgaaacggcgagtattaagtcagcttcgtcggtcaggtcggtccttgtttatcccgtgtcctgctggccctgaacaaacccaacagctcgagtaacgtgactttgtactctaataaatagtgtcacggtctctggaaacaaaacttctatttagatggctcagcatttttttttttgcgaagaatggctcagcattcatgacgaatggataacaacttgactgtcaatttctgtcacaaactcacaacccttggatgaataaaaatatcttaaatgaaatagaaaaatagggggcgcctacttttcgcgcaactgaaaaaggttgacctcagccgat

SEQ ID NO: 38335 - DNA, 433 bp, Triticum aestivum
  unsure (1)..(433): unsure at all n locations
  Clone ID: PAT_TA_38335
gcagatcagtaagagggtgtcctcggccactctcgcgtcgatctgctatggggttgttgtcgtccgccgtgaggaaatgtaacagcaagatgctcctcggcggcggctcttcatctccgtgtggtgtgcgcggcaaggaacaaccattgacgcccagcaagcacaagcggtcgaggaagaagcgcttctggaggaagaagaagtccagcaagaagttcggctgcgtcccctgcgtcagcctcaccgagctcaccaggcgcgccgagtgcgaggccatcgccgacctcgtcaacaacatctcggccaagtcagacgttaccagccacatgtacgcggccgaggagatcctgcggatcaccaaccataacatccccagtagagtgctcaccttccgtgagttgtccgcggcgnacaacaacttcagctgcgataa

SEQ ID NO: 38336 - DNA, 349 bp, Triticum aestivum
  Clone ID: PAT_TA_38336
aaggatggaggtaaaggcggttcacatcgggctcaggcttcaagcttcggcgggttccaaccaagcaaaagtcccaaaggccacaaaaaccaaggacaatccccggcaaacaatcaatgccgaaaagccaactctcaaccaaccctcgagtaaaaacgatcggagctcttgtctcgagccaaggtaatggaggaggcgatgcaactatacagggaagcttgcgccggccgcgggaccgaaggcttcctgtaggttgcagctttgaactctcctgcctgtggctgcgtggtaagtcgctcggtggcggtgcctggcacggaaacatgtcctttgttacctgcacggtgac

SEQ ID NO: 38337 - DNA, 351 bp, Triticum aestivum
  Clone ID: PAT_TA_38337
gttgggaggcaacccaattttatttttgttccttactttttgattatgtttagtaataaataattcatctatcctgtgttaaaatgtggtttaaggctttaaattagggttggtgccaattaaaaccttttggaggacttggggaaattctttgcaatttggcggtaaaaaacagaaactttacggcccacaaaatttgctgccgttttttacgggaaattgcaattaggttgatcctttttgcagatgattaatagataaattcctcacgtcaaaaaatttatttcagaatttttggggtacgaaagtattcgaaacctacagattactacagactgttctgtttttgac

SEQ ID NO: 38338 - DNA, 463 bp, Triticum aestivum
  Clone ID: PAT_TA_38338
gatggcgaacggataaggaggccagcagcgtcgcccacatcgagcacttgtttgccgagctctcctcggtcggtcagaaggtgcttcaattcaatatgctgtccacgtctggtgggcaggatgccctcaaggaatccgtggacaagcatggcggctgccccggcaacaagacggtctatctatattctgcccaatgcagcgcggactgcaacgaggcatgctctaaccactgcgacatggactgcccctacatagccgcaagatttggctacatcatggctacacctgccaataagaaagccatcgaccaagacatggaatgcttcaagcgttgctcaaaggaaaaggatgccacaaatgacaaatgccgcgttgcatgcaagctggctgcctcgctcccttgaaaatgcatactctctctttttttaacccatgcttcattcaactctcctttttttttttt

SEQ ID NO: 38339 - DNA, 481 bp, Triticum aestivum
  Clone ID: PAT_TA_38339
tccgggtcgacgggtagacgattctgatggtgtatacctcgtccatttgaaagagcttgaactccggatctggctccataagggggacgattggttgctggtccacaacatttgtctgcgtggcaagtttgctggtttgagtatgctagatggcaatgcttttctccaaataaaacaggtgggggacaatgccgagtatgtgttgctggagatgatgtgtcaatgcgcactctacttggatatcaagtgcaggacactgcatacagtgtatgaggtgacaaacgaggatcgatatttgggcgatatacatcctttcatgatgatatggcctccaaagttccctgcgctcaaggatgatcctgcaacggcaagaaatgccatgtgaagaacaagcctataactgggagttgctggatggtatgtacatatgtcagtggtaagctttggcgggtgcaatcaaagatgagctgagctgcatttc

SEQ ID NO: 38340 - DNA, 486 bp, Triticum aestivum
  Clone ID: PAT_TA_38340
ggggcgaaaaaaaactagcctcccttggcctcgcgagagacacatgggaacgggtacgggaacgggtgtgtatttactgaaaatacaaatacgtaaaatgtggggtatatggcccttctttttctcgtcgcaaacattttccagaccgggaacttgtgggcggggggcgcagagatagagtaccacacgcatcacatgcccctgtggaaattgcaagtagcaaaaaaggaaaaaagaagataagagccgagccccgcccggtcaagaaaaaaagagcctgccggatgcagcaaccgacccgaggctggccgactattttgccccggcatatgtcgtcggtctgatgctctcgaatctctggattatttgcggaatatcctttgccatcattaaacaccgtcgaaagagacaagcaagcgagctcgtctctgatcacaaccagctcgcccaaggggcgaaacgcactactagtctgctacagtacat

SEQ ID NO: 38341 - DNA, 492 bp, Triticum aestivum
  unsure (1)..(492): unsure at all n locations
  Clone ID: PAT_TA_38341
gggccgacctttcgcataaacttagggatcgatcgatgccctaggccggcccattaatgggttgcagcgttttcggctttgggaaccttctagagtttcccagcaggtttttctggtattgggaaccttctagaaggttccaaccggttttcctgtttctttttttttcctttttagtgtttctgtttattctcttgtttcttttttatttatttttccttatgctgtttcttcatttcctcttttcttttatttttgccttttttcctttttcatgttgatttcatgttgatatttgtcttttttctaaaattaaaaaaatcagattttaaaataagctccactctattaaatatgttcataaatccgaaaaattgttaatgtaaatttgttcacaaatttagaaaatgttcatatttcanaaatacttctggaattttaaaaaatgttcacggttgcaaaatttggtccgtgattcaaaaaatgttcccg

SEQ ID NO: 38342 - DNA, 396 bp, Triticum aestivum
  Clone ID: PAT_TA_38342
cttaaaaatcttgcagcaaaatatagatgtgtttataactgcacatgaggaacaacaagagcgggagaagaaggaaagagaggcagcagctgaagaagaagaaggatagagttttagatgctgccgttgagagcgagggcgctgccggacatgctatcgcggaaggaagcaagaagattgtattggtgaagcaaaagaagaaaattaagcatgccaaagtaacaagctgttgtaccaaggctcataatttggtgactctcaatgaggatgaggcaacacctaagctgaagaagaagaagagcaaaaaacagctaaaggaaagcaaaagtcctgttgaggtacaaagtccattggacagtaatgatgctggaacacttaagctgaagaagaagaaaa

SEQ ID NO: 38343 - DNA, 239 bp, Triticum aestivum
  Clone ID: PAT_TA_38343
ggtcgaccgggctcggaggctgatcaagctgaagccccccgtggagccatgatttttgcagttgaaaaatggttccttgcggtgtaggtaccccttggtaaaacccttgatgataccccacaacaacggggaacttgtgtgatcctccggtcctgccggtacggtgtacaaaaatttctttgatggaaatgtgatttggccaaatggtttcagtttcaaaaaagaaaatgaaccggaaa

SEQ ID NO: 38344 - DNA, 421 bp, Triticum aestivum
  Clone ID: PAT_TA_38344
ggaaattgaagctgggaaatcctttatgttgcggaggaagttcggagatccacggtatgcctctctagatcggctatggagtttggaggatgtgtatatggatttggcggcgagcgctgccgatgcggccaagtacttccagggtcagacggaccatgaagtggaccatctattttggacacaattccattctcccgagcgtccgctttcattgattgaccaattatccgaatgggccgaactgaataggttgtccggacttgccatgaggtctgttgtggatcagctatggccggaaaggccaaaactgaacagctattttagcttggtgcatcagctccttgacgtggtgccgcgcattaatgcgatgaagaggttggcgtgcatagagggctcacggatggcctttgcccgtgttaaa

SEQ ID NO: 38345 - DNA, 238 bp, Triticum aestivum
  Clone ID: PAT_TA_38345
tgtggtgaaaatccctggtacttcaattatttcgtttgaccttgccggattctgcgcaagtgtctcgattctatctatttgttcacggtggatgatgtggtttgtggatactgctctgatcgcaaggttccgctcttggattcactgagtgtttgccaaccacatcggatttgcaacctccacggaaatcatcctagtcgggagatcacccaaatagattgattctacgatgaatgcc

SEQ ID NO: 38346 - DNA, 435 bp, Triticum aestivum
  Clone ID: PAT_TA_38346
attcgccggtcgacgggcaggcttagaggtacgtttttagataacgaacatttagtgtttattacgcataataacatgcatcctatgtagatagtagcccctgagactctgtgtggcgcaaagatgtgcgacatgtagaggatcttaatcccaggtacctaagatggtgccctgtatatacaggcggctgattgtccggggtcaagccggacttatgaatatgccgaaatgaaacagcaacttgacgaggcagaaaccgacatcgcgctggttaaccaacggcttgatgaggctcaaggtattcatacttcttggcgagtattagtaagaggagttataggttaatatcttaccttgtgtatgcttgatgcagatggtgcggcagccgttgaaggacttaaggccgaacttgccaaggcgaagagccaagcagag

SEQ ID NO: 38347 - DNA, 306 bp, Triticum aestivum
  Clone ID: PAT_TA_38347
agcccaaagcggagaagcgggcgccggcgtccaaggaggccggcggcaaggcgaagcagcggggcacgaagaaggcagcagggcaaaaaaaaccttgaaaacttacagattcaaaacctccacggtgttgaagcaggtgcacccggacttgggaatctcctcaaaggcaatgtcaatcatgaaccccttcatcaacaacatcttcaaaaacctcgccggggattcggccaatctggcccgctacaaaatgaagcccaccatcacgtcccgggagatcaagacctccgtccgcctcgtcctccccgg

SEQ ID NO: 38348 - DNA, 341 bp, Triticum aestivum
  Clone ID: PAT_TA_38348
cctcctcgacaaaatggaggacaccgaccccaagtccagtgcctctgctccggctgctgtccagtacgtgttcttgtttttcctgttagaggtctttccacagttccttgttctagtgtttgccctacacatgttaggatctacctcatatatgcatcttgatctactgtgtgctcgatagatgatcggttctagctcctatatgcacatgttatttaccttcactttgtcagatcgcatgacttgttttatcactgctatactagtcatgatttatctagtaattctgttatcatgatcactcgataaaattgctcatatttccaacatactcactccgt

SEQ ID NO: 38349 - DNA, 170 bp, Triticum aestivum
  Clone ID: PAT_TA_38349
ggggcatcaattaatctttgggttttgtttagattgaatgttcgctatagctgcatcttcgcgtacttcggttgggttcatcgagtatacagccgtgtcacagaacccgatcctgatcattgctgctttcatcttatgttcgcaatatccagattgcactcctacattct

SEQ ID NO: 38350 - DNA, 409 bp, Triticum aestivum
  Clone ID: PAT_TA_38350
gccgacgggaaaattgatcctcttgatgtggacgcctgccctcgtccctctcttcgatcgcactgtgctgataatgcgatcgagggcctcgatcaactgcacaaacactatgcttcccttgtactagtacactacagtctcagatgatgataacgcgacagatatggactgtgcttgtagtaacaaaatatgggtgctggggctgcacttaagctttacgagagtacgactgaccctatatgatgcaggtgtgctctcttcgaaaatatcttgtctcctccaatgcttttgggatggatgggaacatccggggccagtggtgctgcctcatcgcgtttggctgcttcccacacttggctatctccatgaccctgtttcaagaatggggatgtacctagtcagaagtcac

SEQ ID NO: 38351 - DNA, 127 bp, Triticum aestivum
  Clone ID: PAT_TA_38351
attcgccggccgacggggttaagaattgtaaatatgcattgttgtatcccaacctgaatgaatggaataaacgagctaacgctgttgttcaatcgtgagaagaaaaaccccggactttgaaaattaa

SEQ ID NO: 38352 - DNA, 431 bp, Triticum aestivum
  Clone ID: PAT_TA_38352
tttgaggaggtcatgcacaagctactgcagcttcgccagactgccacggtcgccgagtatcgcgcggcgttcgacgagcaaatgtaccatctgcttgcgctggatccatccatcaacaccaagtttttcgtcacccagttcatcatgggcttgaaggacgagctacgcgccccggttcggctccaagcgccctcgagcatcacccgagcatcggtattggcgcgcattcaagaggaggaactaggcacgatgcgcgcacgcccacgcatcacgccagcgggacggcctccactggcgacgcctcctccacaaccacgggcagccgctgatacgtctaaatgtatctataattttttattgttccatgctatattaaattctgttttggatgtttaatgggctttattatacacttttatattacttttggg

SEQ ID NO: 38353 - DNA, 369 bp, Triticum aestivum
  Clone ID: PAT_TA_38353
ggtcgaccggtcgagctttataaacaagacgaagcagagcaagcccggcaagacgcagtcgacctcctagaggaggagagggaaatggcgatgatcagatcgaccatctatcagcaagacttgcgtcaattcaatgctaaaaatgtgaaaagccgagccttcaagaaaggaaatttggccctccgagtggttcaacagaaaccacacaaacttgccccaacttgggaaggtcccttcatcgtcaccagagtcctccacaatggagcatatcacctctacaaggttgatcgccagatcgacgagccacgagcttggaatgcggaactattccgccccttttaaacttgagttctcccttggacgggatgt

SEQ ID NO: 38354 - DNA, 428 bp, Triticum aestivum
  Clone ID: PAT_TA_38354
actaacaatttatcagttaaatctttggtcaaaatttaccacaaattacaatagtgaggaataaactaggacggaggtactccctccatttttgtatacaaggcaactataaaaaatacattttgcatctatacaaggccaccaacagtaatcgagacaaatattaatgatgtttcctcgtactagtaacccatggcttaattactagcatgcatgtagtggatgatagtgacaaactcatctacttcctctctcacgcccactcaatttcttctaatgtgcatgcaccctattaattaacccagtaaacgagaaaataaattgatttgtaaagcacacattgatttttatcttggtacctgcaattttagtttgtggtcgtgtatataaaaatgaagggagtactagtagtagtttagaaacccaaa

SEQ ID NO: 38355 - DNA, 213 bp, Triticum aestivum
  Clone ID: PAT_TA_38355
gtcgaccggcccccaggatcaagacagcctccccgatgccggcgcgccggtcgcccaggttaaaaaccttgaaccaattaaaaaaggtgaaaatttccaaaaaaaaggaaaaggtccttaaggtggaaaggccttccccaatgaagaaaggtgcaaaggaaaaatttaaaccgaaaaacaataaaaacctttaaggacaagttggaaaacccg

SEQ ID NO: 38356 - DNA, 478 bp, Triticum aestivum
  Clone ID: PAT_TA_38356
ccgggccgacgggattgcttaaatagggctaaagataatggttatgtttggagagttaaacaaccgaaacaaaatccagaaaaatctccactgttgattcccacgcccaccacgagtcagcatcctactccctcgcctagggactcctcgggtatagagacgacccacgcatcggtgcagacgagtcccatcacgtcttcacctcttcccgtgcaacaccagcctgctccacctccaccagagcaagacatggcaaactttcccctagatcctctcgagtttcttccgccggggttcgagatcatcgatggaggtccaacccgtctgcctcggaccttctactctccggccattgcacctgagcgccgacacgagtagttcgccattggctttgtcgagcctccgccgccacctggacagattcatcccttctattaactggttagtgattttgtgatgacccagctgcaccgtgacg

SEQ ID NO: 38357 - DNA, 422 bp, Triticum aestivum
  Clone ID: PAT_TA_38357
gtaagggaaccggctccggcaaggtggaggatggggtggtggacggacgaggctggccacagtgcggcggttgtcatgccgccgacggtgtctgaatggggaaatggacgggagggggatctcaaactttgggatgcgcttctctgaaatgggggaaagttactaacttatcccccatttaaaatttcggacatagcatcggttggggatacgacagtaatctcgcatctcccaaatatttgccggtaactatttcgagccagtgttgctgttctcgcgcggcctcggtggcagccatggatgaggtgactgatgcggtgaacaaccttaccataggggaatgagcagcggcgacggcgggagcggatgggcacaagaagaaccgcatccaggtctccaacaccaagaatccgctcttcttc

SEQ ID NO: 38358 - DNA, 431 bp, Triticum aestivum
  Clone ID: PAT_TA_38358
ggccgacgggtcaaaaaatcatccccctagcatttacattatttgccatttgcctctcgttttcctctcccccacttcacccttgtcgttttattttccctctccttcccaatctcctctcttttccatttgccttcccgttgccatggctgagtcaaaaagaactaagggatctctccctagttttagtgccttggatagcccctctgtcctctctaatctcttaaataatgatgctatgggaagacctaccggggttatcaatgagatttttaattaattgtgatgaagatgactccataatttttcgttatttgcttgatgagtctttaaaagatgcttgggataggttattaaggattcgggctagctatgtgccacaatatcaaattgaagtttacttaaagagtttttatgttggcttgcccgct

SEQ ID NO: 38359 - DNA, 417 bp, Triticum aestivum
  Clone ID: PAT_TA_38359
ggtcgaccggacttcagatctaagtccatggttgcatgcttaggtcccatgcaataaatgagaatgaatgtcaaacaccctgccaccgtcactcggccgcaaacattgagatacctggttttaaattctagtagatcgaaagctcgtctgaaattcatgaaacttggcatgttgtcatggagcaccatcaaccggggtaaattttttgtcccatttgaggcaggtttgggatatgcttctcacaaaccagagcttctcacaaaaagcccgatggtttcggtagggaaggtttcacctttctggacgaaacgatatccattgcctcttctcgatttcaattttttcctaatgtcaacatagaacaacatgagtgttgtgtcaatttttgtgatttttgggggttcgcttggacatttt

SEQ ID NO: 38360 - DNA, 382 bp, Triticum aestivum
  unsure (1)..(382): unsure at all n locations
  Clone ID: PAT_TA_38360
ggtcgaccggccaagaggaagcagncaatgtgcttagaaaaattgcatacatcagtacatgacagtttagtaaaactgaaaaaagataacagaggaagacagatgttgtagtaaggtgcccaaccaaccaaaaggcaccaaaagaccttttaattttttgcaaaaaggcaccaaaggaattattacaggagaaaccatggaatatagaccaaatgttatacctaaccaaaccaaatggtaaaagccccaggatgtgtacgggtaatgaaatcaagggccctcaatgcaattatcaccatcccaatatggcaccactgtattcaagccaaaggtgagttgaaaatacaaaaagggaattccaaaaaaaaaaaaattaattttt

SEQ ID NO: 38361 - DNA, 392 bp, Triticum aestivum
  Clone ID: PAT_TA_38361
gacggggatagggagcaggcaagtttacagcaagctgttgatcggggttggcctgcatctctacacctgataggaaaggacatattgcggtttcatgcaatttattggccaacaatgttaatgtcagcagggataagcgttcctgatgcagtttttggccatggaatcttgacagaggatggcatgattctgggaaactcattaagcaacatacttgttacatatgatctggtaggcaaatttgatccggatgcgattcaggactacttcctgcaagcatcataccatgtgaatgatggggacgattcaaaacaattttgcatccatacagtcaatgcacatctttgctccacaattggaaaccttctgaatcgattacttggactcctaca

SEQ ID NO: 38362 - DNA, 171 bp, Triticum aestivum
  Clone ID: PAT_TA_38362
gtcgaccggctgtcccaacagattccaagccaggaggaggtggtccttggaggcaccgcaaggcgacctcccggactccaggcgcaaaggggataaaacccccaagggctccgagtccggccttgacccggaaaccttgccggaacctcaaagggtcccggatccaattag

SEQ ID NO: 38363 - DNA, 382 bp, Triticum aestivum
  Clone ID: PAT_TA_38363
gtcgaccgggcgaagtattggaccttattgggccatacgggaatagaggagagaggccaaaaggaaggaggcgcgcaccccccctctggtccgaattggacaaggggtgcagcccccttttccttctccctctccccctccttccttctctcctactcaaacaaggaaaggaggagtcctactcccggtgggattaggactccccccttggcgtgccctcctccttggtcggccgcctccccccttgctcctttatatacgggggcaagggagcaccccatagacacaacaattgatcattgatctcttaaccgtgtgcggtgcccccctccgccatattacacctcgataatatcgtaacggtgcttaagcgaaaaccctg

SEQ ID NO: 38364 - DNA, 482 bp, Triticum aestivum
  Clone ID: PAT_TA_38364
ccggctcgacgggggaggagtgtaaaaagatcgcggaaggaatcgccggaaaagtttctctcctgaagggggctgatttggggcaagggcaataaggtcattttaagtatgtcaaaccatagtgaaaatgttaccaatatttagggcttgatgagacgaagaagtgggctttggattcaccttaaaccgagttgcgcgcaagaagttgtgatagtttttctgccagggacctatctgtgaaatgttttctgcaaacaagcccctgactgagaaaactgaaaacgcattcgggaataatacgctttctgcgtaagaaaacatactttctgccgtagtacatcaaaaatatgcttttcagtgaggaaaacacatttgttcctgaagaacaactgaaatgcgcttttaggagggagagacgtatcttacggagtacgcttccacttaaatgacgtggcagtggcggggccgtctcctgtctggct

SEQ ID NO: 38365 - DNA, 482 bp, Triticum aestivum
  Clone ID: PAT_TA_38365
ggctggacgggactaatcaataaaagattcttcacaaacaggcccctggctagaaaaacaaaaaacacattatctgagaatacgctttcagaactgagaaatcatattttgggctgaagtgtaaagaaaatacgctttctccaaatgactacgtatttgaccaaaaaccatcttgatcttggcaatctccagcaagccttggccagtagggacgctaccactgtctgtgcataagtgagggtataaaatacccatgttttgtacactgacaggagccccatacacattgtcgaagcatcgttgggctaggcccaaacaatgacacaaatgtggcaggaaactaatgttgcaattttagtcatgatgatttttctgacgcacgtccagtccactcattaaatgtgggtcgttggaacttggactattgtggttattccacggtagtgcgcctgtaaaagagcttgccgaggtaagtgatacat

SEQ ID NO: 38366 - DNA, 429 bp, Triticum aestivum
  Clone ID: PAT_TA_38366
aagcaggagatcatgaacaaaaagccgctttctaccagcaacaccgaaaatcaagatgttgatgcaaagcaggggctgcaggaactcaaggtccatggagagaaaaaccctgtggtggaaaacggtgtggcggcaggggctgtaaatggtgttgccccaacagacgcaagcccggcagcggtcgcagttggctgttgatttccgctgctcaagtcatttgatcatccattcgaggaggacagcttatatacagggtgaggaagagttgccgtggctgtaggaattcaagattctgctagttggatatatgcttgtgggttgcagaaaggtgcaagtctgaggcgattcaggattcaatgaaaggctttttttttggggtggttctgctcttctgtagtatcttcgccgttgctggagtctggtggttgg

SEQ ID NO: 38367 - DNA, 354 bp, Triticum aestivum
  Clone ID: PAT_TA_38367
cgggtcgacgggatatccgcattagatcggtgtgcaaaatatagctgttacatctgaacagagaactgtgctatccattatgcctataatcaaatattagttcttatgtagttccatcacatcatatacaccaggtttctcaagctctacagttagtgctttatgaaagattgccagtgacactaaggtcagggatttgaggtccctgcagacatctactcgatctacttcaagtttcgattgtacacattcgttgagtcattcatcggaattatcatgctcttctctaatatcactacgatctaccatatcttctaagactactccagaactgtttagcactgagactgaata

SEQ ID NO: 38368 - DNA, 486 bp, Triticum aestivum
  Clone ID: PAT_TA_38368
gggccgacgggcacttactatttacaatgagatgcaggctaccgaggtgaacccgaatgacgtaaccatggtcagtgtgctctctgcctgtgctgtcctgggtgcacttgagatgggcaagtgggtgcattcatacataaggagaaaggccttgccccttacagttgttctcggcactgcgctggtggacttctatgcaaagtgtggatgcattgaagatgcagtcaaggcatttgagtcgatgcctgtgaggaattcttggacgtggacagccttgataaagggcatggcaagcaacggaagaggcagagaagcgctggagctcttctcttccatgcgggaggccaatattgagcctacagatgtcacattcattggtgttctcctagcttgcagccacaactgcttagttgaggaaggtcgccggcattttgatagtatgacccaggattatggcatccatccaaggattgagcactatggctg

SEQ ID NO: 38369 - DNA, 480 bp, Triticum aestivum
  Clone ID: PAT_TA_38369
gcctcaaaagacgaagccaagccagggaaagagggtatctcatccacaccaggatattttgagcccatccccgtttcagaaaccggttcctcgtcgtcgcacgaagaagccggacgaaacccgctcgaagagaaacgaggaccgtaccgctaagaggagcaggagcaagtgaccactcgtgttggtgatgtcgtttagtgcaactagttgtgagcaagaacttgtatgctatgctagtgatgtctatttggtactttcaagctttgttggtgatgtcgaattgctactttcaaactatgttcaaattatttgaaatgttaatttgctatctacaatgtatgcgatcatcctattttgaattacaaacaatatttgttgtgatgttttttttttgattgataagaccaagaaccaatttagaagttaactggcacataccctactgccggacggcacggaggtaggtgtagacagcctacc

SEQ ID NO: 38370 - DNA, 445 bp, Triticum aestivum
  Clone ID: PAT_TA_38370
attcgcgggtcgacttaattttgaatcacaacgttgataaacacatagtaagtattcttgatgctggtaaaccggaattgagatcttcatctcattattcgggttacataaaccagaagcatacttgaaggcttgtaagtatgcaatcatggttacatcaaagacataattgagggccagtctttagtgactttggttcatattccgggttatatatataaggtctatgattcccggtgcggtaagccgcctagaggcttgtgacttgttttctatgcaggatggttaaagacagctattcgagcttaaggaaaataactaatcaattataacccggaggaataagaagaagaagcttcaatggagttaagcattcaacacgtgcacgacggcacgaaaaaattaagtgtttatcctactgtattacaagactccctgagtccaa

SEQ ID NO: 38371 - DNA, 425 bp, Triticum aestivum
  Clone ID: PAT_TA_38371
catggctctcgaaaaagtgaaaaacgtttttttttcatccacaagaggcatagatttaggccccgtttggattctctcctactcccagcttctttgtttcagcgcatggagttgtcctgaacgcgacatctcctagaagccagcttcgcggagcaaacaacccctgtagtgcaaaaacgagaggcaggtcgaatgcaacttcaaaaatcgaaagaggcggagttggacgtaattacttgatatgccactgccaagtgactctagggcaccgtacccgttcaatcaatgtgtttatctccccgatacattctctcccatacgagaaaccactctaatgggcttcatgcttgcttactgggctgccggccgacgcagacgagagcaggagcagccgccgttgccgaacgcatcactagctccaacaa

SEQ ID NO: 38372 - DNA, 412 bp, Triticum aestivum
  Clone ID: PAT_TA_38372
ggtcgaccggactgcggatgacaatcgatgttggttcacgtgtgggggaagcgcatggaaatccggttgttcgacgtttgtgattgatgtcaatattcttaaaagggaactcttgggttgcatatggaatagttgtcatgtctttctcggactattcttttgcttgataagggatctgtccgaattcagctgactgtctaaaaattgcactggtttatcacatattaatgtcgatctttaccaaaatattagtccttagaagttaagggggagttttcggtgaaacattgtggaaagtccgatttgattatatggctgagactgttcagggttgtggccactcaagataactcacacctgtgcaatgccatccccgtaatggacagagctttgggggaataattcggaattc

SEQ ID NO: 38373 - DNA, 491 bp, Triticum aestivum
  Clone ID: PAT_TA_38373
ccgggtcgacgggtccttcaaggtaacataccacgcccgtggggcctgcttgaggccatagagggccttgttgagtctgaagactttgtcaggattctttggatcttcaaaacctgggggttgagcaacatatacttcttcctcaagcttaccattgaggaatgcacttttcacatccatttgatataaagtgatatcatgatggttagtataagcaagtaatatgcgaatagcctcaagtctagcaacaggtgcaaaagtttcatcgaaatcaattccttcaacctgtgtgtagccttgagctacaagccatgccttattcctcaccacaaggccgttttcatattgcttgttgcggtagaatcaactttgtgccaatgatattgtgcttgagaagatctggacgtttgaccagttcccagacattgttgagctcaaactgatgtaattcttcttgcatggcctgaatccactcaagctccagaaatgct

SEQ ID NO: 38374 - DNA, 467 bp, Triticum aestivum
  Clone ID: PAT_TA_38374
ttaagatgtctgacgctggttagagattaatcatgtgttccgtaagtgttagtttgtagtttctactactattttctcgcggttgatgagagagactcggaagtgaatttgtataccggaagatttttgtcagccgtgcaactcgttgcgcctcttgatagaaaaagtagaaattttgtcaaagtcattctatatgcttagcagcagagatgatgtacgataccattaaaaacccttctgaatgtttgttgatgctgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccgcccaaagggttcaaagttaaaaaaaaacgggggggcccctaaagggtccccctaaaggttccccgaaattcaattcaa

SEQ ID NO: 38375 - DNA, 370 bp, Triticum aestivum
  Clone ID: PAT_TA_38375
accggtcaggtcagtccgggtcgaccggatccagtacgtcggcgcgcagaggctgctgattctcctcgctctcgtgattgaacctgtaaacaacggcgcaattatcttcactgaataccaccatgaaattatcaagcaatttggcataatcatatccgatactgttcctgataacaaagacgcagggtctgatgacgatcatgacgatgatgaagatgaggatgatgaaactggtgatgctcatgatgatgatgccgatgctggagaggacttctcgggtgaacactgcgatgacgatgacgaggatgatgaccctgacgctaactgtgatgatgctggagcggggagccatgatgatgatggtgactac

SEQ ID NO: 38376 - DNA, 420 bp, Triticum aestivum
  Clone ID: PAT_TA_38376
ccctctaatggaaacggttcccgccgccggtacccctttcgggtccggaggaacgcagcggggcagcagagataagctggtaatgctgcgcactaagttgacccccctatggggttgacgggcattacggatacttggggcctgtttggagtcccccccgctctgtgactctgctcccggagtagccgtagccgcagttcaatatcatggagcgaggaaacaggtactccgcggatccttgggtttggtggagctagtggtttcccgaacagctccttagtgatataccacatagctctagatacatcgaggaaatggtcgatcgctgtctttgcggaatcggccacataggcacgtgacatttctgatgagagtatctggggtgtgatccattgactgattgttactgtacttggtaaa

SEQ ID NO: 38377 - DNA, 148 bp, Triticum aestivum
  Clone ID: PAT_TA_38377
tgtacgtgtgaaatgtcatgtagtggccacataagccaaccactggctgtgggtttcaaggatttttgcagtgggatttgtagggtaccatgctgcgctgtgtttgggagttgacatcggtccatgggatatgtgccacgctcttaaa

SEQ ID NO: 38378 - DNA, 145 bp, Triticum aestivum
  Clone ID: PAT_TA_38378
gcatggagcctacattactcgaaagatacttcagatacatgaactagctagctatgaatggtatacgacacacggggaaaggacgaaagatagaggggggacgcaataactctgaggactcaacaatcgggggagatataaaata

SEQ ID NO: 38379 - DNA, 396 bp, Triticum aestivum
  Clone ID: PAT_TA_38379
gggtcgacgggtgtgatgtgcttaagatgcagatcctcaacaggaaccctacgacagatggtattgcagttaagaggaaactcaatgctgatggatcctactataaacctgagtagtatcccaaaacctcatgggttactgcaaaaggacctcccgtagatccatcgactttatctggttttacatgtgaatcctcatattcatctgatgagtcatctactctaactagaaattgttcaaaaataatcatggtgaggtatttgccagatatgttggaactaattgcaggaacggtcctcctatgaagaaaatctgggttcccaaaatatgccttgaaagtcttcaggtgaatgtcctcatgacaccacctgtgaagaataggaaccccacatcaaa

SEQ ID NO: 38380 - DNA, 304 bp, Triticum aestivum
  Clone ID: PAT_TA_38380
atttaaacatgtccatggattcatgtctgtacaaagtgtttaactgatgattacatcccaaagtagatgcacagtcaggaggcgatttaagtttttataaaatacccattgttcatgctccaagtgtacgctaagatgaccaactatggtcagtcagtcgtttgagggcctagcctccaggtgcattgtacctcaacatcaattatggcacagatattcaccttcctcttcaagattgatccagatgagacgcaacgatctgtataccatctcgtatgcgaatttctgaaggttgtaaatattt

SEQ ID NO: 38381 - DNA, 125 bp, Triticum aestivum
  Clone ID: PAT_TA_38381
aacgctaaattgagtcgtattatgtcatgtagtggccaattaaccgacacacaggatgtggttttcaaggatttttgcagtgggaattgtatggtactatgctgcgctgtgtttgggagttgaaa

SEQ ID NO: 38382 - DNA, 157 bp, Triticum aestivum
  Clone ID: PAT_TA_38382
acggtccgactattccgggtcgaccggaagatcgcactaactgagctgacagacgctcactcgaaacgggggtctcaacccgcatgataagttcagcgcaatacgacagatatcaaaaccgatggctactgctgcattgaggtcaacaagtgaagtt

SEQ ID NO: 38383 - DNA, 407 bp, Triticum aestivum
  Clone ID: PAT_TA_38383
cggtcgtacattccgggtccacggggtttctgcattggaatttttcatttatcattctgacgttataacactttggttttctttcatttccatatttggtttcattgatgtcattgtttatttaacttttctttttgttctttgtaagtttgtaacagttttgtaattttttacacatgtttacttttttctcagtatagaatgtaaatttttaaagcacacatgaaatattttgggtacccattgaacatttttcagatacattatgtacatgttttaaatacatgctttgaacactttttcaaatgcatattatcagtatatattttctaaactatgcaaatatttgtctgcattgtacataccatttcagaataatcacgaacatctactggaaatatatgatt

SEQ ID NO: 38384 - DNA, 147 bp, Triticum aestivum
  Clone ID: PAT_TA_38384
acggtcgtatttcacgggtcgacgggatttctgcagtagaaattgtccttgatcatgacgacattattacacggtggttcacttgacatttccattattagtactatgatttcaatgttttgaaaactaggccttcagttctatgta

SEQ ID NO: 38385 - DNA, 201 bp, Triticum aestivum
  Clone ID: PAT_TA_38385
aagtgagtcgtattagtggacaatcctgtataagtcttgtgccgccatggcgttttatcacgcagttgtcgctcatgctcaaggtatatgtcatgtggctgcggactcccgtgctgcgaaaccgagactgacttggcctgaatttcgtccttgttccatgctcccggctatcctgcatcgtaggtagtgtcagcacacacg

SEQ ID NO: 38386 - DNA, 272 bp, Triticum aestivum
  Clone ID: PAT_TA_38386
cgggtcgaccgaaagcgacaacggacgataaacagggtgtcgtactctcctcccgagactccactgatgcttgctgatctccacaaccttacaggggtctacaaaacagactttcccacaatgccaaccaatgcgcgaccaaggaaggcttcatctgtgctgaatgcttcttacaagggcttcctctagatggtcctccataacactgagacggatgttcagacctagcatctggatggttagtcattctttgtagtcgggatgggaccatg

SEQ ID NO: 38387 - DNA, 172 bp, Triticum aestivum
  Clone ID: PAT_TA_38387
tcgacgggacggtaccaatgctgctgctgctgcagatggtgctgttgttggtggtaatgctgttgctgttgctgatagtcctgttgttgctggcgatcctgttgctattactgtcgtctctgcaccgacttatcaattcagtgatcagttatctcaactaacatgaccattt

SEQ ID NO: 38388 - DNA, 105 bp, Triticum aestivum
  Clone ID: PAT_TA_38388
gggtaaatccaactttcctcgtatgacgtgcatggagcactttccaagatataaagtcacagttacctgtacaatctatcatgcgggctacctctgagtcaagtg

SEQ ID NO: 38389 - DNA, 336 bp, Triticum aestivum
  Clone ID: PAT_TA_38389
taccatggtcattggcgaagataatactggggaggccaagtggatgatggataacgtaaagttttcagttgaagaaccgattgaggccgtggcaaaaagagaagagctggagcaccttgccatgatttgcagatctgaagctgatgcaatggggaggatcactgctggaattctccgtctgcttaaacttgataagtctcttgggcagggaaccatcgaacagctgaggaacctaggaagtggaagcctggacaacattttctcgcctagcaggttcagcaggcacaacagttttggcatcgtaagcacccctaggacccccaggagcccaatgtt

SEQ ID NO: 38390 - DNA, 337 bp, Triticum aestivum
  Clone ID: PAT_TA_38390
ggtaaagaaaaagatcaatgatgcaggaaggaggaccaaggccgagatgatgaagactaggataaggatcaccttgaggaagaagaggacgagtaagaggacgaagtcgatgacctcgagctgaacttgacatctacgacgactccgttgagacagctcagcgtgcgagacttgacgaggttgaagcaagccataaagagtgcgatcgttaggatcatctacgggagaaagcgtgaggaccagtcaaggcagagtagaagaagaatcggctgatgaagacgaagagtcttcaatagaagaggccgagtcgctataccggatgcaagaagatcaggtg

SEQ ID NO: 38391 - DNA, 429 bp, Triticum aestivum
  unsure (1)..(429): unsure at all n locations
  Clone ID: PAT_TA_38391
cgggtcgaccggagcgccatagtatctgtgacatttacaggcctgccccgaagaagggaaaggcatgttcaaccaataatataacaagggaaatcaattttttccgggtaaaactaaaacaataatgccaagaaggtaaaaagttaagggaagggttttatccgaaaaaattgcaaattttccccaatataactgcaaccaaaagctgctgccgttgtttggtgttaaaatcaaagttactgccagaatggaattgtatcgcctggaaatcaatcttttttgtttctccaaaaaaaaaanaanaaaaaaaaaaaaaaaaaaaaaaaaaataaaaaaaaaaaaaataaaaaacaaattaaatttatataaaataaattaatataaaaaatatcctaaaattaaaattaaaaaaaaaaaaaaaaggggccc

SEQ ID NO: 38392 - DNA, 347 bp, Triticum aestivum
  Clone ID: PAT_TA_38392
aattcgccggtcgacgaggatacggtcctctcagccgcagaggcccagggcttcaggctcgtggacaaatggataaatggagtgcacgagagcaatggtatcattagctcttggttccgtggcaatgacgtttgcggtgctttccggaatgtaacgctttccatattgtactttgaagtgtgatacattggtgtttacctgcatctcatggttaacttgcaggttttgttttaccttcctgcattggtgtaccgaatgaatgtttttgtatactaaaaggaatgaatgtggcagttgtatactaaaagaatgttatttttttaaaaaaaaaaaaaaaccaacaaaaa

SEQ ID NO: 38393 - DNA, 427 bp, Triticum aestivum
  Clone ID: PAT_TA_38393
ttccgggtcgacggggtgtgccgacggcgggcgcccctggtccaatggtgccgccgccggcatctcctgtcccatgccgctgacggttcctcctcccactttgctcaaaatcgctagggagcacatcgccgccgtccggcccttttccattgcacaacgacatattttttttcactgcaccgcccagccatctcatcttccctcaagatcttgtatgtcgtgttgcgagatcaagtaacgtctccccaccaaaggaattgagtatggaggaggcgaggacgtgttcatctcccgctccggcgagattcagttctgctcttgggtttccacgacatcatgaagttcctttgtgtagacaagcacctcagcactctagatcgataatcctaatacttcaaagccaaggagtagaaaaactgaaacgacg

SEQ ID NO: 38394 - DNA, 404 bp, Triticum aestivum
  Clone ID: PAT_TA_38394
atcatgcgtaagcacgggatgcacgccaccgtcagttcgattcacgtcaacggctggttcggcaagcacgacaagctgagcgccagcgtgtcgctcgcgcgccgcgcattcggtctcgacctgcatgccgagcgcgaacgctgggtgttcgtgggagactccgccaacgatgcggcaatgttcgagttcttcccgctctcggtgggtgtggccaatgtgctggacgtgatcgatacgctgcccgtgccccccgcgtacctcaccgaggccgaaggcggcggcggttttgccgaagtcgccgagcgcatcctggaagcgcgttccctagccctccccgcgccgcgcgactgacacggcattcctgcaccgcaacacgcgctggagacccagcgtcgcttgccgca

SEQ ID NO: 38395 - DNA, 363 bp, Triticum aestivum
  Clone ID: PAT_TA_38395
ttctgggctctcccccctctcttcgggtaacccccaggtttggcaaccgggtaaccggttaaaatccccgcccccttgtttcgcggtcctctcgttggttgtaatctccaggcaaacgttcggtttgggttgtgctgccccttataacgttgatgtccatcgaggccaatttccggtggtttgtcctcctcggttccgttgacgttgggaccgtcttctgaacctccctgctttggtttaagtcccggctaatctattttgctttgacttctgatcctgattgggtccaggctaaacccatcatgctctgattgccaatatgttttatggtcctgggctaaccatttttaacccaaatgccga

SEQ ID NO: 38396 - DNA, 265 bp, Triticum aestivum
  Clone ID: PAT_TA_38396
gggccaacgggaaggacaccttgtggccccggtgaacaagttaaaccgacgttaccaacaagccaactcaacttcggggtcctgtaatgcaagcatgcatgcacaaataaatccttcaagttcaagggccaagatttggaccaataattcaactccttggttccaaataacccaatggataattaaatccaatacaaccaaaatccaataacctttaaattgccccattatacccaaaatgatgttttccacgagcacatatgat

SEQ ID NO: 38397 - DNA, 334 bp, Triticum aestivum
  Clone ID: PAT_TA_38397
gggccggcccgagcagttacgaaagcgaatgaagctgcggttgcacggacaagcttatggaggtgtcagtatgcacgcacacgtccctgatttggagcacgcctctggcctggtaggattctcgctctgcctcgacctcaagggcgttcgtctatctgtgtcatgctcgggacgatgcactaatgcagggtgtggttcttcagattttctttgtctttttcttggtatgtatatctctgaatcttgtgagccgtgattttcatgctgcccattgtgtcatgtataatgattcttcttattatttttgaatggcataattattcttattgaggcg

SEQ ID NO: 38398 - DNA, 358 bp, Triticum aestivum
  Clone ID: PAT_TA_38398
cccccgttctccgactgggcaacctccccgtggtcctgggggtccccaacccgcaacaattccaaccccacaaaaccggacccggcaaccccgaacctgccttaaggcttaaaaggccaaccaccggatgaaggagaactttttcaaggaaaccttaaaattgaaaaaaatggacttttagggtggatcaaaaaggtaggaacctccggcaaaattgctactgcaatttggcagctttggggtttgcggcttacttacactgctgtttgtgtctctgactttttctgctctgagtttaacacaaaaaatatgggtgcgtctagtgctcactggactcgcagctagcgtccgttgccat

SEQ ID NO: 38399 - DNA, 238 bp, Triticum aestivum
  Clone ID: PAT_TA_38399
ccggccgacggggaaaacaatgaccgtccgtacgacgacgaaggatagcactacagcggccaccgggatgaccatgaggagagatccatagatcagcaccgtcagtgctgtaatcaccggatgcctgtcacgctgatgtccgattcaccttgaggtacagggtcgcactctcctggctgttcctatcactgcctgatggattctcatggggcaacgctcaaagacacgaccggttgtg

SEQ ID NO: 38400 - DNA, 362 bp, Triticum aestivum
  unsure (1)..(362): unsure at all n locations
  Clone ID: PAT_TA_38400
aaggaggttttggggttggaaatggaatggcttaccattaccgccctataaaaaaaggccctactgctaaatgacctaccattaccgcctttcacaaagaacccactactgctaggtgtcagcatgtaaaattagacatcanaaatacattcatcatcaatgatccttttgtgtagaatctgaattgtcaatatgaatcctcactggtttaagaaccggtgaggattcctattgcgggcacagatcctacacatagagttcaatgaacactactangaaaaggcctgctagtggcgcacctgttttggctactaatggcgcactacangtgcgccactagcatcacgccattagaattttta

SEQ ID NO: 38401 - DNA, 198 bp, Triticum aestivum
  unsure (1)..(198): unsure at all n locations
  Clone ID: PAT_TA_38401
caaagatatcatctgttcctgtctatccagagaccaattcnggctcattatgcatctttgcaatgcaaaacttatctgggaccgaatctccgacgtctatgaaggttatccaaacagtcatgatccttggtttgaagacttcaangaatctctcaaaacgatgactttcgaaccagaatcatcatcttctgcatcatg

SEQ ID NO: 38402 - DNA, 286 bp, Triticum aestivum
  Clone ID: PAT_TA_38402
cgggagcgccgagccggcgccggcgcccggcccgtcttgaactcgcggcgagaaataatactaatacccattcgcacgtgttgcagtaacgtagtttttttcgacgcagagtaacgtacttcttgatgttctttttttctgatcgacaagcttttctatggtagctatatgttcatcttgatctgtgcttcttttactttacatcatttattagctttgtgatctccttttgtcattgttgagatattgtttagtgctaaaaacaaaaggaaatttgaggaagacc

SEQ ID NO: 38403 - DNA, 309 bp, Triticum aestivum
  Clone ID: PAT_TA_38403
caaggtgattggtttgcggtctttttcacatttactggtttttccagctctgctgccgcctgccacactttgtaatgcaattttttttgtcacatcggtcatataatcaggattctagccaaaaaaaaaaaaaaaaaaaaaaaaaaaaaaaaaaaaaaaaaaaaaaaaaaaaaaaaaacaaaaaaaaaaaaaaaaaaaaaaaaaaaaaaaagaaaaaaaaaaaaaataggcggtacaaaaagattaaaactaaactttcacgtgcatcaaaggtcaaagcccatacaaaatggtgccatactttcattt

SEQ ID NO: 38404 - DNA, 383 bp, Triticum aestivum
  Clone ID: PAT_TA_38404
gcaacgcaagaaggggaaatcccaaatggaatttggcaaccggtaataaccggggcgggccaagtggacaataaccgggaaatggggacaagttttcaaaatccaggacaattttttaacccctggacggaattggaatccgggaaaattttcaaattcggaaacaaatttaaggcaattcaaacattttccaaaaacaaggacaattactgaatttaagaacaatttaaaccgattggtaacactttttaaacaatgtcacaagaataacatatttattaaatgaaaaaaaatagaatagatgaacatttttttagaagtttctggaacaaaattttaaattctcaaacatttttttatttaatacaaattttttgaaatgc

SEQ ID NO: 38405 - DNA, 264 bp, Triticum aestivum
  Clone ID: PAT_TA_38405
acacactccttgtgtctttgtcacacatgcactctgtcctcctccactcaccctctctctctcacacacatgggctttttgcaacatctagcaagatgcccatgcgttgcacggcacatcaagatgcatttgtctgaataatttatcttgtaggggaaatagtctacttgtggcatgtccatctttcaaaagttggcttagggtgtgaggtagcttcttagccatttgccttcccagcagttgtaccgcatgaatgtcgattgg

SEQ ID NO: 38406 - DNA, 424 bp, Triticum aestivum
  Clone ID: PAT_TA_38406
cccgggccgacgggggcctgcatgacctaagggctagggcgagggacgtgacggcgtcacaactcaaggcggcgactgccatcggtcaagtgtggctcatcgaggctgctcgctgtgtttcgtcgcagctgcaggccgcgagatcaggtcgggaaggcgccgcgcattgacgagtgagccaattttcggattggaccataacaacgtgtttcggtctccgacgtctagaagtagtggtaaagttttgaatttgtatggcaagaaccacttacgtaggtagctgacacgcacgacagtgtgtttacactcttacttatgtaaaagatatgaattatacatgagttgcctccacaatgaggaattgcgatagtagatatggcaattatgtgatagaaaaaaaaccaaaccggggaaccggcgccac

SEQ ID NO: 38407 - DNA, 390 bp, Triticum aestivum
  Clone ID: PAT_TA_38407
gggtcgagcgccataatttatgaaacttgctccataaatgacctcatagccccatatttccacgtgggatagaggtcccacttgccaaatgtgggaagtctcagcttcttcacggccgtcacgccatgactggattttaaagccgcgtggcgcaggtacatgcacaatcgtgcgccggtaaacaccgatgaaccatggtcacggcaaggctaaccacgcatccattaatagcatccatcgctccctcccaattaccaatgcagtcatttgaatggcctcacgacttcatcccttcctagaaaagccctatggcgaggtgtccccatcaccgaagtcagtgctggagcccgacgacccgattgatgccgtgtcacggatatccgctatcga

SEQ ID NO: 38408 - DNA, 311 bp, Triticum aestivum
  Clone ID: PAT_TA_38408
gggtcgacgcgggatgactaggtgacttatgtccatccgtgacatgaatatctgattttgcggtgagtcagtcactttgctcaatttagttttgcttgatgtttgaataaagtaccttgatccgaaattattaagtgttagagagtcttcacatggtcgtcacaaatgttcgactactcattgatcgtcacttagactctcatcggactactttattgtcgctcaaatgcaacacatagatcgtcgtatatcatggtcgtaactggaatatgccgagatttatcaactgtaatgtctcagctacatatccc

SEQ ID NO: 38409 - DNA, 377 bp, Triticum aestivum
  Clone ID: PAT_TA_38409
ggtgaaattttagtgccataaaaatgtctctcttctttgaaacaatatactctggcatggattatatcaaggatcactatgtcaattcgtgctgtcattcattccacatcgataattaagacgatcatactgacatgatgcacgaattctttatagatgtttctcatattctgtacaaaatgtattcacatttaatgggtcgatcaagggttgtcatgtaatgaatcgtccaaggaaacagtgcatttgatgcttatagacgacaattttgctccattaatcctatttgaggatatcttttgctggtatttcgagatgtgaaaaattgtgtatgatcgactctacaatggtatccagccgtatgatgactatttcat

SEQ ID NO: 38410 - DNA, 363 bp, Triticum aestivum
  Clone ID: PAT_TA_38410
gggtcgacggcgatgggaagaaggacggcgacgggaagaaggacggcgagaagaaggagggcggcgacgccaagaaggaaggcggcgacggcggcgacggcaagaaggacggcgatgggaagaaggacggcgacgggaagaaggacggcgagaagaaggaggagggcgacggcaagaaggacggcggcgggaagaaggacggcgacaagaaagaggagggcgacggcaagaaggacgaccagaagaagcccgccgccgtggccccgctgccgttcccgcaccacatgccgctgccgcaccacatgccgccgccctacatgttcaacgccgactacatgatgaaccagtaccggccggcgccgc

SEQ ID NO: 38411 - DNA, 421 bp, Triticum aestivum
  Clone ID: PAT_TA_38411
cggtcgacgggtgattgtattgtatatgagtacaaaatctacacttattgcttcctttcaagttgcgtcgagcgagattgtctttagttagcataactcctcttcaaagataccacatgaaaatcttaactttagtggcatcttcgatttccagatttgtttataattgtccatttgaaaatgttgaataagtattatatatgttgaagaagtatttgaaaatgttgaataaatattaaaaatgttgaacaagtatttgaaaaatgttgaataagcattaaaatgttgaacaagtatgtaaaaattgttgaatatgtgttcggacaatgtcgaacgtgtatacaaaaaatgtttgatcacttattaaaaaatgttttttgacatataagaaaaatgcagcgaaaacgaaaacaagcataag

SEQ ID NO: 38412 - DNA, 315 bp, Triticum aestivum
  Clone ID: PAT_TA_38412
gtcgtgttaccagtcgtgcacggtgcgcgtggtgggcacgctcaagcgtgcctggaagcgctccgccatcatctaaatcgtcgtcctcgtcttcagcgtcatcgtggacgccgtcggctgctgtgccttcaggaacaagcgccgctagctatacaacggtggcggatagtgggatcaaggcgcgtacgcgtgatcgcgcgcttgtctcggttatttaatgcttggtttggatggatgcgatggtctcttcgtgtcattcatcttcgttggcgttgtttctcttacgatggtctggtctagctttgtgcatgcgag

SEQ ID NO: 38413 - DNA, 411 bp, Triticum aestivum
  Clone ID: PAT_TA_38413
ggtcgacgggctatgatagatacactgccgcatacaacttttgtgaaattatcagttacactatgggcaatatggtggtttagaagaaaagctattcacgaggagatcttccagagccctgcttccacgcatcagcttatctgtagcttcataagggagctagaatacatgccgggcaaccagcatggttttatgaagatccatgtagacgctagcattgcaaggaatcagaacaagggcgctgctgcagccgtctgcagagatggcgatggaaatttcatgggaaattcttcattagtgatttatggaattaatgatgctgcaacaacggaagctatcgcatgtcgtgaggccctttcattggtggatgatttgatgttacaaagcttcgtaatagcatcggactcgaag

SEQ ID NO: 38414 - DNA, 425 bp, Triticum aestivum
  unsure (1)..(425): unsure at all n locations
  Clone ID: PAT_TA_38414
gggtcgaggcgacagccaaagccatggacctcatcagcaagggcaccaactagctcgtctcggtgtcgcgacgtccgggtggaatcttaggagagtttagctccatttttattagggatgagttaagtttagttcgtgtgccagtcttaataaaaatcaagcatctgtataattaaggaggctactgattgttgtagccttcacctgcaatttatccgagccttgaatgaatggacttgtgttcggaaaaagaaaaatacagtgctgctggcttagagtagagtttgttttctagtcgtataatgcaatgtttacttatctcttgctcttagtttcatcatcagtaatgattttattcctcttggcggtcgcatcaggcatgtnttaataagatcgtattttatgggaaggagggagtacttttt

SEQ ID NO: 38415 - DNA, 233 bp, Triticum aestivum
  Clone ID: PAT_TA_38415
cgggccgacgggatagcctagtatcctaggatctatcgtttgataatgggatccaaggtgtactatatggatttatgtggcattttagcaagaccacacttggtcatgtattccgtagtccagtttaggttcatcgactcaaatgtgggttctcaaggaagattctcttaacggtggttatctatcatggtgtcacgcatgtcgaagtaaacttgctcattgatgttgcacat

SEQ ID NO: 38416 - DNA, 416 bp, Triticum aestivum
  Clone ID: PAT_TA_38416
gacgggccagtcgagcgccacgccacgaaattgtcgatgggatccaccttcctctctccacctcccactgacagtgccgccaatccatgagatccagtcctggcgccctcctctattcatcgccttgccttgggacccgtcaagatccatggcataggatcctgaccaccagcgccacgagtcatggggagatcctccctcggcttctgcggcaccggcgagatcctccccagcttatacggcagtggccttctcctcccatggtggcctgaggaggaggctccacctaccctggttccgctccaccaccacgacttgcatagctagatcaccgcacgggctgccatcaggcgaccacctctctgctccagcgcatgggctcaccgttccccatgtgtgtgctccctgttgaccat

SEQ ID NO: 38417 - DNA, 409 bp, Triticum aestivum
  Clone ID: PAT_TA_38417
cgggtcgagccgaaggagcaactcctccacgaggtcatgcgtcgttcgcttacctcggcggagacggacgctaggcgactccagcacaagaatgtgatggcgctttggctcgggatcgaggtgtcgaagcgccttgcgagggagaatgagattgctaagaccagggcagagcaccacacgaaggagtgggaccgcgccatccagcgcctctccggctacatctcctcgacgtcggacatcagcagcaccggcacgaaaaatgacgatgaggatcctccctccgcggacgcctacacacagcagatgtaccaccgctccggatactgcaaaggcaagggcccagacaagaaatggtgatctctgccccctctagctaatatagtttgtatccagtaatctatcctgcaaa

SEQ ID NO: 38418 - DNA, 380 bp, Triticum aestivum
  Clone ID: PAT_TA_38418
gccataatgcatggcaaattaagacaatctaaaggaggaagaatggagatccattttgaggcacgtttaaaaaggtcacatgatgctacatagtcagccaagttagtatcagaagcagccagtgttgttacgtgtcaagcacgtatcctcccatcatggttctactacagggatgagaaacatactagccagtttaacaccttccttgacgatttaaccgtaactacagttattccacacactttgtaatcttgtcttgcacagtaccataccttcaatacttgtcatgtgatcactcatattcatttttcatcaaatgatgttcaagttggatccactagatgctgcacctatcaatgcatgcactcatgtttttcagt

SEQ ID NO: 38419 - DNA, 335 bp, Triticum aestivum
  Clone ID: PAT_TA_38419
ttattgggctttatgggaaagagagcatagcatgccactcactcccaaggcctagtccgaagtggactagggggaacggatgcgcccctctttccttctcttcacgtttccctttccttctcacgtactcctacgaggtggaacggctcctagttctacgaggaaagggggaatccgattcccggttggacttgcactctcctgttgctcaccatagatcgggcccagccctcttgaccactacacccttatatacctggtcaatgggcatcccatacactcattaattgatctcctgatctcttaaccatgtgcggtgcccccctccaccatat

SEQ ID NO: 38420 - DNA, 423 bp, Triticum aestivum
  Clone ID: PAT_TA_38420
acgggtcacttcaaacaaacatgtatcttttttttttctttcgattctgcctctggcaccggaatagttctatgtcacaaaaatcaagcccaatcaagcgtggcacaggtcctagatacacgggacacacgcacctagtggagcggtcctatatggcgccttaggcggcaaatctcttccctggcgctctcgcgaagctcgcctgagcctagcccaacaaaggctagtcgatcggggcgcagttctcctacgttcgctgggacaatggttgatcggtcaaccgttggccatttggacttctgtaaaaaatgaatctgaaaaattgtacaaaaacatgaaatttgaaaagaacatggatttgaaaaaagtacatatatttgcaaaaaaaatgcaaatatgaactaataaattttgataaaattc

SEQ ID NO: 38421 - DNA, 229 bp, Triticum aestivum
  Clone ID: PAT_TA_38421
acgggggcccaaaagagccacatagcattaagtacaagcaagggtcacatgacccatcattcggaccatacaagcaacaagcggaagaattacatgtctgagtacagacaactacaaatgaaaaaggcctaggagcccgactatctacaacatccgatcaagatcgtagctgaggtacaagctacttgtcgaagtccacgtaaactagtaagaccgaagtctccgctac

SEQ ID NO: 38422 - DNA, 389 bp, Triticum aestivum
  Clone ID: PAT_TA_38422
caatggaagatgtaggcgtgatatgtcaagtagtggacagataagccaaccactggatgtggttttgagggatttttgcagtggggtttgtagggtgctatgccgcgctgggtttgggatttgaaataaaacgaagggagatgtgccacgctcttaaatgccagtcttctgctctaatcttgctaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaagaagaggaaaaaaattcaaagaataaattaaaaaaaataaaaaaaaaaaaaagaaatagagataaaaaaaaaaaggggggcccccaaaaggtttacagcctctttttc

SEQ ID NO: 38423 - DNA, 437 bp, Triticum aestivum
  Clone ID: PAT_TA_38423
gggtcgaccggcaatgttgaataataattttagtgatttgttatagtagaaaatgataagtttttgcgttggtttatactaacctatctcacgagttcttgttgagtttgtagtgaatgaagcttttttgagaaatagagaaaccatgatatgagaggaattaaggagacacaaaagttcaagcttgtggatgcccaaggcaccccaagataatatttcaagaagtctcaagaatctaagcttggggatgccccagtaggcatcccacctttcttcttcaacaactatcggttagtatctgttgagcctaatttttccttattcacatgagttgtgctatccttgcaatgtcattttattttgttttgcttgatgtttgaatacaataccaagatctaaaattccttaaagttagagagtcttcacatagttgcaca

SEQ ID NO: 38424 - DNA, 437 bp, Triticum aestivum
  Clone ID: PAT_TA_38424
cgggtcgaccgggatgaaggaggagaaaagaaaatgacccttcggtcctatttatgaagcaaaagacaagtgtcaggcgcgcgaatccaggagccacaaatttcggaagcggagttgtcgcctcgattattgcggatctgttaaacaaagaaggcatcataaatgttagcttcatgatgatgtcatgccggtttacagtaaccaggaaagatgatgacacgacggttcaacgactacaagaagattttgaagacaaagatttttgctaaggattgacatgaacccgttcaaatcaatctggggcctaatgtcggggatattactactgggcgtaaaccggcctacctgggccgggttaacttcatcagtagttcaatggtgttaaagcccaaagaggcagataagggcccaaggcctaaaatcggtttagaacctat

SEQ ID NO: 38425 - DNA, 431 bp, Triticum aestivum
  Clone ID: PAT_TA_38425
tccgggtcgacggggacatcgacgatgagttgccgtcgttcagcacccacaagaccatcctcggtcactgggaggatccggtgctcgaagtctgacatctaagtgtatggttgtgtcttctcgcattcgcgttgatagtgtagttgtgatgttgcccagaagaaaatatgagacacaggaagagccgatgagatgagatagtgatcgtccctgttaatatcgtggacgttcgggaagaagttgtagattctagtaaccgatctggcctagttttggtcatcctagtgttggccttgggatttttgcagtgggaggtaccgactcactgtttcgccttggaccttcatttcttcacttttagttacattctttttagcttttacttggctttttcgtatgtacctttttattcaacacatgtccaagttttt

SEQ ID NO: 38426 - DNA, 374 bp, Triticum aestivum
  Clone ID: PAT_TA_38426
ggcagttccagcttaaaagactcattgcgtccggcggtcctccgccggggaggccgccgttctcgcgtccgagctctctcccgtactagggatcttcttccccactccaccgcttggtttttctgactgcgaagtttttggcctcttcgggtcttgttttggaggagggctgattggggtagcagatccgttcttgccggagagcaccacttccagccccgtatttcctttgtggttttgcaaaccctgcacctcatcagaaggacgtttgcgattggcatcagaatcctccgtctccatcttctcttgcttaggatcatcatcctccttcgtagcttgctggcccgacccttgttggtttgaagtcctgttcc

SEQ ID NO: 38427 - DNA, 396 bp, Triticum aestivum
  Clone ID: PAT_TA_38427
cggggagcagaaggaagagatggactggaagggctcgtgtcgtcccgtacatatagccgagggaggccaaccgtcggcctccatgatcacaggtaatcatgacccgttttgcatgcagggacttgtcaattcgtgcagttgccgaggcatcgtggggagccaggatgcccacgtccaatcaaccgccacgcgtctcccaaggccgcaggctattgggcccgtggcgcttcgtacttgccccttcgcttccctgctaagccaagtctgggcgcgccttgggcccgggggctactgtcagcattctgggaacggggttacctagacttgcctgcctgcggcctgcagcgtggctcagggagcggcccagtacggcccatcttcatcagcgcatgccca

SEQ ID NO: 38428 - DNA, 384 bp, Triticum aestivum
  Clone ID: PAT_TA_38428
cgggtcgacgcggaagactcgacaatggttgcccacgcggtggggagtacgagggtttactggtccggctgccgtcgctggaaaataataggaggtgtgggtgagtagaggaatggcctggccagcaatgaagtagggtagggcggtgcggcccgtgcggcagcacagccggccacgggaggcgggagcaggcagtcccaccagagctggtttgggcggctggagcaagaagatcagatattgaagaagcagcacggtcgttagattaacatccaacgatcactgctgctacaatcgtttgtggactaacttgataagaccaaagtacacgtcaacctagtatacccacaaatcagcctccaaatctgtcccaaacaacataca

SEQ ID NO: 38429 - DNA, 171 bp, Triticum aestivum
  Clone ID: PAT_TA_38429
gaggtgttcccttggggtatgttcgcccgcattcatggcctgcccaaagccattacctctgcaatttgtaggtcaaccactacgcttggtatctgtatgtgtaatgtgatcttggtactatacaacttgccacttcccgcagtataagtaatattgagcttctgaatgttt

SEQ ID NO: 38430 - DNA, 411 bp, Triticum aestivum
  Clone ID: PAT_TA_38430
cgggtcgacacggcgtcgcaactgggtatatgtcacgtcagtacccccattcctatccaggagtgggaataggccctcagcgccttaattgcaccagatgcctgccgcgtcgtacttgcatcagacgcccgccacgccattcgccttgtccgcggaccgataggctcaaccgcctccttggcccaagtgtccaccgggcccagtggaggaacatgcccgtcgcattctcgagctggtgatctccgatgaaatagccaacttggatgaacgcctgcaaacacgagttcaggcagagccaagagctactgtacgcaacggctgctggtcatggtctcatggacgcgtttcattttgttgagtcgtttcgacgtggatagcaatgtatttacagcaattatagtattgctctgt

SEQ ID NO: 38431 - DNA, 327 bp, Triticum aestivum
  Clone ID: PAT_TA_38431
gtatgacagagaatatcgatatacgttattctacagtattactctacagatccatcagctctaagtaaactgcgtataaatcatgtatgtataacgtatgtgttactgatgttacaagttgagtccatgtgtgacggtgcggctgtaacacaacatgtgattcataatatccacatgcctcaccatgtaagaaatatgccctaaaaaacaaataataaagttgttaattaaaattccataataacatgataaatgtttaataaatcaatgctaaaattgtaaataaccgaaaacttaataaaatgtgtgaatacggccccccaaaag

SEQ ID NO: 38432 - DNA, 335 bp, Triticum aestivum
  Clone ID: PAT_TA_38432
agctagataaaaaatcgcttccatttttgaagacgatggctgaggtttcagggtggcctttgaatagatatgaaacacttgctttgctaatcttttcttcggttcttgcagtggatctatggttttgggagtttctcgtggaaagcagtctgaattgggcatctttggctggttcctggatcgatcaatttagtgctccattttgacaaagagtttacaaaaccatttactgttgcagttagtttcagatattagttggagtgctgtctatgcaaacttgtagataacaatttattgaatcaacttggaatgagattagtgagaaagttgaagcc

SEQ ID NO: 38433 - DNA, 275 bp, Triticum aestivum
  Clone ID: PAT_TA_38433
aacaaaaaaaatagaaaaaaaaaaaaaaaaaaataaaaaaaaaaaaaaaaaaattaaaaaaaaaaagaaaaaaataaaaaaaaaacgggcggcccaaaagattcaaacttaacttacccttaaagtcaagttaaaacccctcaaaaattttcaccaaatttaaattaatgggctttcttttaaaaagttcttaacgggaaaaaccttgggttaaccaaatttaacccctttgaagaaaatccccttttcgcaatttggcgtaataccaaaaaggc

SEQ ID NO: 38434 - DNA, 105 bp, Triticum aestivum
  Clone ID: PAT_TA_38434
cgggtcgaccggagtgtgaaaatcatcattattagagcattgtcccagtgagaaaaggatgatggagactatgattcccccacaagtcaggatgagactttgggg

SEQ ID NO: 38435 - DNA, 426 bp, Triticum aestivum
  Clone ID: PAT_TA_38435
cgggtcgaccggtcctatggagccatagcacgacgacttcccgactatcttccaacttagtatgatagaagactttaaaattctcttttgggaaacaaagtgcaagtaagtgaataaaatttcctttgtcccaactgtttaagacaaacaaatgaaagctaaactcctctgagacctcttttagacacttcctatggatacgtagtagaaacaatcataactttctacaacaatatgtagaaagtgttactttctctattctcattaagaaacattagtaacaccaattttatttacactttttttgaacatgtcatttacactttaattagatgtatatgttccttttttattgctaaccggtccgaccgatgggtgatgactagtaaaattcattaagtaaaattcgttttgtcaaatcaagaa

SEQ ID NO: 38436 - DNA, 378 bp, Triticum aestivum
  unsure (1)..(378): unsure at all n locations
  Clone ID: PAT_TA_38436
gggtcgaccggaacactgaagaagcanagagaacactggcccgctttcgtgagaattcaaggaacaaaattaccaaaggaacggccaaaaaaaaaaaaggcaattgccgaaaaaattaccaatttcaaaaggctggttcaaggtggcaacccggtggcaatgccaaattggaataagtctgagcaagagatggaggatgcaggggtcactccggttactaagagctggccccccaggtgcagaacttggttctatgcgcatggggggacgttggacccgaagacaagcctagtttcgaagaangcaagtctaaaangagcagaacaaaagttacttgacgcaatagaagatgctcgaaagggggtgttcacgcccaac

SEQ ID NO: 38437 - DNA, 379 bp, Triticum aestivum
  Clone ID: PAT_TA_38437
ggtcaagaattaccgggccgactatcacaatgaccggggtcttgtcgcgaatgatccgcatctccatactcagcgaaaatagccgaacgaaggtgtagtgcagcggatgaaggttaaacatagcaaagatgtcatcaaaccgcaggacgatcgtacccccgatgtcgccatccacaaagcccttgccctctggcaccttggccacgaaaaccgggtatgccacatccttctctctgagacgccgcttctccaaagaaagaacactgtcgtgcagactcctcctcgagatatcctgcggtgaaggtggcccgtcctgagcacggatcgtactcggtgccggctggctcgcacccttcttagtctttcttttgtgtgcctt

SEQ ID NO: 38438 - DNA, 344 bp, Triticum aestivum
  Clone ID: PAT_TA_38438
ttccgttcaaaaaataactctcccgaaggtttcattctgtttggactctgtttgatattccttttctttgaaacactgaaaaaggcaagaaaacaacaatttgggctgggcctccggttaataggttagtcccaaaaataatataaaagtgtttaataaagcccataaacatccaaaacagataatataatagcatgaatacttcataaattatagatacgttggagatgtatcactttccttctgattagattgcttttccatctcttctcaagtacttgtagcacaaagacctgttttgaagcgttgtttttctagttttgcttgctagtaaccggcttgat

SEQ ID NO: 38439 - DNA, 439 bp, Triticum aestivum
  unsure (1)..(439): unsure at all n locations
  Clone ID: PAT_TA_38439
gactataaacttacaagataggatcaagaactcacatatattcatgaaaacataatagattcagatctgatatcatggcactcgggccctagtgacaagcattaagcatagcaaaattatagcaacatcaatcttagaacataatggatactagggatcaaaccctaccaaaactaactcgattacatgataaatctcatccaacccatcaccgtccagcaagcctacgatggaattactcacacacggcggcgagcatcatgaaattgttgatggaggaaggttgatgatgacgatggcgacggattcccctctctggagccccgaacgaactccagatcagccctctcaagagagatttgggcttggcggcggctccgtgtcgtnaaacatgatgaatccttctctctgatttttttctccccgaacgtgaatatat

SEQ ID NO: 38440 - DNA, 194 bp, Triticum aestivum
  Clone ID: PAT_TA_38440
gacgcggagttgttatacacgggcatcaaaaaggaagatattattgcgttgcgcgtgttgttaaatttgtatcgacgagcgtacaaataatggaacatatcaaagattttttgtttaaaaaaaaaaaaaaaaaaaaaaaaaaaaaaaaaaaaaaaaaaaaaaaaaaaaaaaaaaaaaacaaaaagataaaaaca

SEQ ID NO: 38441 - DNA, 329 bp, Triticum aestivum
  Clone ID: PAT_TA_38441
tttgacacgggcaatggccatccgcgagccttctatgaacgacgacctcttcatcgcattgatgcgcgacaccgcaccaaggaactgctgcactaagctgaaatagctgttcggcttcggcttttccggtcacagatgatctacgacgaacctcatggcaagtccggacaatctattgagttcggcccattcggcaagctaatcagttagtggaagtggatgctctggaacgttaaactgcgaccagaatagcttgtccacttcacgacctgtttgatctcggaagtattcggccgcatcgatagcactcgccgtcaaatccggatatg

SEQ ID NO: 38442 - DNA, 239 bp, Triticum aestivum
  Clone ID: PAT_TA_38442
ggcatcgatttctagatggttgggaggataagatatgcagcagcacagttcttttgtacgctcttggtatttcttcagttctttcgtcttcagattttctgctcaaaatcgccggcgcctctgcgcgctgctagtgtgatatggtaatgtacatatgagttttaacatgatatattgtggaactttttgtcgcaaaaaataaaagcaagatttcagattcaatgttcaattctcaagat

SEQ ID NO: 38443 - DNA, 385 bp, Triticum aestivum
  Clone ID: PAT_TA_38443
ctggaatacaaaaagtgtccacggagccgactgcttagcaagaggtggtacagcgggaaggtacctaaccagaggtggcgatgctgacagttagcagtctgcctatgctggtggaagctgcagtctaatgcgacaagatatcagcacgccgaccccgcgcaaaggctacatcacagccttctgatccgatcgagatgaccaattcactcaccggcgcaagccttcaggagatgcatcaggatctaacgattggcaaaccgctcgccagaacagatacgtttatatagttcataacttcactcgcacgcatgaaatggactgcacgaatagcacattccagtgagtgttgacgtcccatggactgatatagcgggcagccgggcaa

SEQ ID NO: 38444 - DNA, 363 bp, Triticum aestivum
  Clone ID: PAT_TA_38444
tttgctatggattttttacttctcaaacaaaaaaatacttgttaaaaacgtagtcaatggagtaatgagtactcacattattagcatggctgaatgtgaatgatttaatttgcgctgagcagtttccatgattaactctggtcaaaagctgcttgttgaccgcagctccttgctgtaacctgacaggcatgtgcacacattttgatgattctttctcccctttgcaagcaatttatatgtttatttaatccgtagttactagtgcaacctgtaaccatcaatgtacctaccgattcctttcacgttaatggtgacagtttaattttcctgtaatgccttgctttgttagtaacgtctgaacaa

SEQ ID NO: 38445 - DNA, 365 bp, Triticum aestivum
  unsure (1)..(365): unsure at all n locations
  Clone ID: PAT_TA_38445
ggtcgacgcgtacaacacaaaaatatataaatagttcataataatgacaatgaaactatatttagttcattgcaagaacaaggagacaatcctattataatttattacattgtaaaaacatcttggaccagtacgttgggatggcatggtgtgtaaacagggaaaggtatactaaggcgagaggcatagatgcgaccaacgagccggccaaaaaaaaccattgccaaccgtgcacgcgaagagcagtgatttaattgatgtaccaacaatcactcagatagaaatggaacatacacacacaaatagatgtgaaacatgcgtcacccncaaaagtgccaccgaaatgaaaaaaagagccttgaaaa

SEQ ID NO: 38446 - DNA, 213 bp, Triticum aestivum
  Clone ID: PAT_TA_38446
acgggaaatggaagatagtatcgacatatgttattctacaaaattactctatagatgcaacagctctaagtaaactgcgtataaatcatgtatgtagaaagtacgtgtaacagttgttagaagttgagtccttgtgtgatggtgcggatgtaacacagcatgtgattctaatcatccacatgcctcatcaatcagtctgtacggataacccac

SEQ ID NO: 38447 - DNA, 315 bp, Triticum aestivum
  Clone ID: PAT_TA_38447
gggtcgaggcgaaaatatagtccatgcattggaagatttactggctcaagcagaagttgctctatgcttctgctgtgtcaagcattagcttagttgcagccttgctggaaggatggattcaggtgtgcaagattgatgatgtacctgcaaacggcttcgttaattttaggaaggatggagtcgtgcatggactggatcctaaccgactgacatgaaaacttgaggctattacacggattcagctttgaaacacggctttgaagtccgaggcgtgccttatgattttttgtgggctgggacgataggttgtactgt

SEQ ID NO: 38448 - DNA, 271 bp, Triticum aestivum
  unsure (1)..(271): unsure at all n locations
  Clone ID: PAT_TA_38448
gggtcgagcgcgaagctccaacggaggcagccctgcttccaagaatcacaaggtcactctgtccgggctgctcaacatggtggacggcctctggtccagcagcggccatgagcggatcctcatcttcaccaccaaccacagggaccggctcgacccggcgctgctccggcctggccggatggacatgcacgtccacatgggctactgtggcttcgtcgccttcagggagctcgcggccaactaccacggcatccanngacacccgctcttc

SEQ ID NO: 38449 - DNA, 379 bp, Triticum aestivum
  Clone ID: PAT_TA_38449
agctggcatagattcatcggccttgacctccatggggacggcatcaaaatcttcctctgatgccttgtttttgcttttggatttcttattgtcatcgtcgtcctcgtaggactcgctcttgcttttagatttcttctcggcatcatcatcctcggacgagtcgcttttttctttggatttcttctcatcatcgtcatcatccttgttttccaatttcttttcgttcttctcatcatcatcgtcatcatccttgtttttcaatttcttctctttcttctcatcatcatcatcattgtcgtcgtcgtcgtccttgcatttagacttgttagctttcttctcatcatcatcatcatcatcatcatccttgtttttggatttc

SEQ ID NO: 38450 - DNA, 142 bp, Triticum aestivum
  Clone ID: PAT_TA_38450
acgacgtgatgtcgcacgtaaagatctcggtctggattatcgaggaagtcatctcatgttcggatacctatagtgcctacttccacacagacgccattcatctacttccacgctcactcatcttgacgcatccttcaggttc

SEQ ID NO: 38451 - DNA, 317 bp, Triticum aestivum
  Clone ID: PAT_TA_38451
ccgggtcgacgggggcctacagctgaacatcctcatgacaattcaacatacccctgccctttcggaaagggaaggtttcccactcatggacacctagctgaatgcctgaacctgaacctcgtttttcttcttcttcttcttcttcttctccttggtaattccttgttgattccttctgggcatgctatattattgggtgcaacaacaaattattgtccttgttttgatttccttcctgtcaagttcatcctttagtgctagtactagtggtacatcagtttgatttaggaaaaacacaagcctctgcttaacattaa

SEQ ID NO: 38452 - DNA, 155 bp, Triticum aestivum
  unsure (1)..(155): unsure at all n locations
  Clone ID: PAT_TA_38452
actccctatagtacgtcgtattaagcctcgtcncagtggggtacttggtcctgctgatgtagacttctgtgactcgctcgggtgcgaggctggagggcgtctgcagctccagcaccgtgggggtgtgccaaggtgccggagtttacttggggggt

SEQ ID NO: 38453 - DNA, 279 bp, Triticum aestivum
  unsure (1)..(279): unsure at all n locations
  Clone ID: PAT_TA_38453
ggtcgacgggtaccttgaagtgtcttttgttttctttcgctaacggagctcacgagtttcctatcttgagttttgtgttgtgaagttttctagttttgggtgaattcttttgatagatcatggtacaaggagtggcaagagcctatagcttcggattcncatggcgcccccaagataatccaaggacaccaaaaattcttgtattatttggggatgcnccgaaattatcncctctttttcgtcaacttccatcggtaatttactttggagctataattt

SEQ ID NO: 38454 - DNA, 273 bp, Triticum aestivum
  Clone ID: PAT_TA_38454
catcctcattttataaaaaaaaaaatctctcgttcatggttcatgaccacgaaccatgcaagtacaggggtgtggataagcttcggttttcgctccgcttgaagttggacgtgaaagacacccgatgagatagcctcatgtgccggcgagtaccacgcacgttgggtggagttgcataaaagaaaggcaatgtgctaaaggtcttctctattttttttaatactggccttcttctgtttttacattcttccctagtttgataatgcttctttt

SEQ ID NO: 38455 - DNA, 370 bp, Triticum aestivum
  Clone ID: PAT_TA_38455
gacggggaacctatgggtctgcacaattacttttcaggttctttatttttattttatatattatttttaccatttcaaaaaagaaatgtaaggacgaaatagaactgccataaactttaagaaattgttagtgtatttcaaaaatgttcaacatgtttttggaaaatgtttcacatgtgttaaaaaattataacgtgtttttgaaaaatgtttgtcttgcgcaaaaaaattttacaccaggtattttaaaacaagttcaacgtgtgtgaaaaagttcttttgtaaattaccctttcacttatacaaacatggttgtcatttttaatcctaaattttacacattaatttcaaatataggcgaaaatattta

SEQ ID NO: 38456 - DNA, 253 bp, Triticum aestivum
  Clone ID: PAT_TA_38456
gacgggggatataacgaacacaatcgttcgctagcttctaccgttctataaccaactactcttgctccaatctggtatctgtctctatccggttccgtaagactgctggataccagatcccccactcccagcgagtatcctggtctcatctcacattcatctcgcctaagccgtcttctctccatccactactgacgattactgcgggacagcgtggcagcaactcattcgatgtcgtccggcgctcatcctc

SEQ ID NO: 38457 - DNA, 374 bp, Triticum aestivum
  Clone ID: PAT_TA_38457
ggtcaaaaatatccgggtcgacggggttcttaagaacttaatactctagatgcatgctggatagcggttgatgtgtggagtaatagtagtagatgcagaatcgtttcggtttacttgtcgtagacacgatgcctatatacaagatcatgcctagatattctcataattatgcacttctctatcaattgctcaacagtaatttgttcacccaccataatacttatgctatcttgagagaagtcactagtgaaacctatggccccggggtctaatctccattatattaatctcccgtcaacaagctatttatgtcgccgtttattttgcaatctttactttcaatctatatcattaaaatacaaaaataattaacc

SEQ ID NO: 38458 - DNA, 298 bp, Triticum aestivum
  Clone ID: PAT_TA_38458
cgcatctcatctaattcctggatatgtttgcgtctatggcgttctccatggaatcacgagtcgtaagcagcaagtaggaatctatcatcaaagggcttaacagagactgattttaccacaggtgtatagacgttattagtcagtggacagggtctactaagtggtattggatcatgcttgcataggtatcacattactctcaacatagacagcatatgtattgatactaaaatgcacaggaacagtacgtgttaccttaaccttgctgctgttattgaaatattggatgtagtaaaga

SEQ ID NO: 38459 - DNA, 275 bp, Triticum aestivum
  Clone ID: PAT_TA_38459
ccgggccgacggggtccgtcaagaatggcggcgccatgaccgagaccagcagatgaattccagccggtcgatgccttacattgttcgtgatcggaattcagaggaggactctgttgctgagttgctgctgattacaattcagaagaggacactgttgctagctgttggcatcacagagccacaggcgtgcctgcactgtatatcgtcatcggctaggaataggatggccgggaaaatatctggtgataccggagctaaaatgctcccatgatacg

SEQ ID NO: 38460 - DNA, 287 bp, Triticum aestivum
  Clone ID: PAT_TA_38460
tcgacggggatgaatacaaatatagaaaaaaagttctgtaataatgttggaacaatgaaagtatttaatgattgtcttccttatgaatggtggactgagacgaacgatggtcttttcctaaaaatctatccccctagggggtatgcgcgtactactttgtttcaatgactaggagatttttggagttaagtatgtcagttctttatcactaatgtttagtccacggattatacgcactcacactcttccatcagtgctattctttcaagttccgggcaaggtaaaac

SEQ ID NO: 38461 - DNA, 189 bp, Triticum aestivum
  Clone ID: PAT_TA_38461
ttgctagtcgtgtagacaggatgggttttgttttcttatgttactacttttggttacagcgggagcggggtgagagagacgatgaagatgccttcagttcttgatcaatgtgaacctctagaatttattaaacatatacatatttgatattttgattaaaaaatgcatgctgcagctgttggtaatgtt

SEQ ID NO: 38462 - DNA, 388 bp, Triticum aestivum
  Clone ID: PAT_TA_38462
gaggggaggtaagcgagctgcgtccgccacgccgccaactcgctctccggcggctcgctcgtcccggcgtccttggccactcccttgcctctgctggtcttgggtgccatggcggctgcgggcagcaagggacagaagacatcgaagacacagcggcggtgagcaaaggcgaagacttacgaaggaaggagaatgggatggcggttccgagattggggaaggcacggagggtaaatgagcagcgtgcccgcggttattcctctttacggggaaggcgcgggccgcctcttttcccattaactgcgacatgacgcatgcgtgtgagaaccgccccacgcatgacccccacatcatgctcaaccctccacgtcgcgcgttcaacgcgggt

SEQ ID NO: 38463 - DNA, 386 bp, Triticum aestivum
  Clone ID: PAT_TA_38463
aaccatattttaatctctcataataattacatgtaggaccataataaaattcaacaatgtagccatcatataaaatcttctcttcatgatccacatgcataaaagttttataatcttccaaaatagtgggattaacatcaaacccactttcataaaaagtttcataagattgaacactctccaaatatgtgggattacttttacctaaagttgacgctcttccaaccccactttcaatattaatgcaaacattattatcaatagcatattcatcatgaggcataaacaatttttcaagatcataagaaacgtgatcacttcaatcatgatcattgcaataagtagtggacatatcaaaattagcatccccaagcttggggttttgc

SEQ ID NO: 38464 - DNA, 413 bp, Triticum aestivum
  unsure (1)..(413): unsure at all n locations
  Clone ID: PAT_TA_38464
gtcgacgggcaaggcggagcagggatggccggcggtcgatgaagatggccgggaccagacggatctgactggagatggtggccggcaggctggagctccttgcagcttccatggcatactcttgcgaagaatagagagggcgggagatactagagtgagaaagaaaagaggaaccaagggaggaaggggacaggaagagaagggaggcgaggccggcctgggggagctggtcgccggcacgacgtccggttgagggagaggcggcgggatcgacgcgcgggcgcagaagctcatgtgcgtgctcgcacacgagcgtgaggctctttcctcggttggttcctagaggcagcgcaaggacgaggtangggattgcgcgagggacttggcggcggggctgggctgaaactgctgct

SEQ ID NO: 38465 - DNA, 394 bp, Triticum aestivum
  Clone ID: PAT_TA_38465
cggcgtcggccaacgcttacgacttgatgacggtgcggggctgatagtagatggtgtaaggggccaaatatatggcccatttggccactcggcccgaagcatctcggcttccaatgatctcggcaagcggtgcattgcagacaacagtgattgggtgctcctgaaaagagtaaaatgcatccgtgggcatcgaacttgtgtcgaaagctcactttggtcattgtacttaagaatacgatcaatatggtcattatatacgacttggggtgattatacagtcactgcctcactgtatagctctgtattttgctctgttgactggtcaaacatcacaattcacaacaccctctctctatcctatgagggtcccacttgtcagttgacctctggcata

SEQ ID NO: 38466 - DNA, 410 bp, Triticum aestivum
  Clone ID: PAT_TA_38466
gggtcgacgcgggagtggagttgagacttgttgagttttgatgtttggagtgggcttgacccttgatagatgtattgggttttgcttggttttctgtaattaactgggcaacaatcttcttaattaatagaactggtaaagcttttgcccgtgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggcgccccccaaaaggatcaaaactttatagcggctaaacaaaaataaaaacccttctaaaagagccccc

SEQ ID NO: 38467 - DNA, 410 bp, Triticum aestivum
  Clone ID: PAT_TA_38467
gggtcgacgggggaacccggacgaatgcaagttttgaaaacatgatgatgcaatgcaaatgatgacatgataagatgcaacacgcaagtagaatgacaaggcaacaacagcgaataactggaggacacctggcacatcggtctcggggcgttacattcaagtacaagttccagaaggccgttcttgccaacttctaaacccatagagttttcttttgaagcacccacctggagtctaggcaagaccatggcagcccacattaccatgggacgcattggagaggtctacaacagggagcttaaggacattatctaccaagtatgtgggcgccgagacgagcaatgggaagtaatcagcaccaggaaggatagatccattgtagctttcatccaggagttaaaccagcacat

SEQ ID NO: 38468 - DNA, 383 bp, Triticum aestivum
  unsure (1)..(383): unsure at all n locations
  Clone ID: PAT_TA_38468
taagcacatagaaagctggtcatatgtacttctggggtgtagaagaattcacgtgtaatttacgctccgataccctgtttgtttaaatggtttgttgttatcacctgtagcattagtaatgtttgcatgttcatagatagacaactgtcaggtttatatganggacatcgtctttttaacttatatatgtgttggaatcattttgcttacatcaaagaaattttcagaattttaaattatgttaacacaataaaacaaattgttaaggtcaatataaaaaatgttgatggcattcaaaaaatgtttgtgacatttaaaatgtttaacacctattaaaaaaatggtcaaacacatatatttgcaaattgttagtcttgtatttt

SEQ ID NO: 38469 - DNA, 204 bp, Triticum aestivum
  Clone ID: PAT_TA_38469
ctccagttatattaccattctcatcgggattaggtagaagatctgccagcccctctgttcatatcacgaatatgtatggctagataggatctccctgccgcaaacctcaatttagtttaaaactctcagtctcttcagtattaaagtgattcctgtactttagcgatggtacacattgcatagttaactttacccatttctctt

SEQ ID NO: 38470 - DNA, 401 bp, Triticum aestivum
  Clone ID: PAT_TA_38470
gggtcgacgggtctgcaacattcaaatctgtatgtatcttgcaaatctctatgtctccctcctacacttgatgacagatggaattgaagcgtctcttgatgtgtttggttctcttgtgaaatctggattcctttgccaaggcaagtgcaccaatattgtcacaaaagattttcattggacccgatgcactaggtataacacctagatcggatatgaactccttcatccagactccttcatttgctgcttctaaagaagctatgtactccgcttcacacgttaatcccaccacgacgctctgcttggaactacaccaactgacagctccaccgttcaatataaatacatatccggattgtgacttagagtcatccggattagtgtcaaagcttgcatcgacg

SEQ ID NO: 38471 - DNA, 254 bp, Triticum aestivum
  Clone ID: PAT_TA_38471
cggcgacggcgaccacctcctcctagtctcagatcagtgggttcccgacactaccagcgggcataggaaacaataatgaaagcaccgatgcattggttgtaatattggatctttcaaaaaaatgaaataatacgatacttataggaagataacatggattccacagctttggccggaaaaaaaaaaaaaaaaaaaaaaaaaaaaaaaaaggacgcacaaaaagataaaaccttaacataaacgtaaataccact

SEQ ID NO: 38472 - DNA, 340 bp, Triticum aestivum
  Clone ID: PAT_TA_38472
acgggttaccctagaatgccacctccaagtacctttacaggaacatgatcacccagcaaatttcataggtaagtatcaacaaaattgtaactgcacatgtactgccaactgaatcaatacagacattaccaggctacgacgataacgatggtcgccgtagcctctgtgagccatggacggcaactcgagtcagctcattatctacgactgtggtacttctgcgcttggcgtcaacttctgggaagcggatccgagaccgtggaatactatgcccgggaagaggctccgtgtacgactactactgtggaccggctccattgcatcatacaaggtcgtcgat

SEQ ID NO: 38473 - DNA, 413 bp, Triticum aestivum
  Clone ID: PAT_TA_38473
ggtcgacggccatgcgatacttccaccttgggtacacacatgcgtacacacctacatcgagagaaaattatggacttgattgcggttaccacgccctaattaattgagcattaaaccaaacacgtctaaaacctctcttgtggtggaaatgcatgagaatgaagcgcaccctgtaaactatgacggagggaggagtagtatgaacgtgcaaaaccaagtacgcgtatggctagtcggtcaacgcacttcctcttggcatatcactgacatgtgggaccggagtgtgagcaaaccggtcacagttgacggctaaatggccaacccgccgttccttgagagagatgaggagcaagaacacacagacgggctcgcacggaggccaagatatattcgagcatggttgattgatatca

SEQ ID NO: 38474 - DNA, 406 bp, Triticum aestivum
  Clone ID: PAT_TA_38474
agtcccgggtcgacgaatacgcagatatgatgtcactgtcaaaaacgtctactgggctgatagtggtgacctagttgcgatcgcaagtgatacatcattctacatcctgaagtacaatagagatgttgttgctgcctacttggaaggtggaaagcctgctgatgaggaaggcgctgaagatgcttttgagttgcttcatgaggtcaatgagcgagtgcgaactgggatttgggttggagactgttttatttacaacaactcatcatggcgcctaaattattgcgttggtggtgaggtcaccacaatgtatcacttggatcgccctatgtatttgatgggatatcttgcgaatcaaagtcgagtttgtcttattgacaaggagtttaatgtcattgggtatacatta

SEQ ID NO: 38475 - DNA, 391 bp, Triticum aestivum
  Clone ID: PAT_TA_38475
cgggccgacgggttacgaactgtaacgagagggctttcggtacatgcagctattaccgaaaacgattatcgacccttggtaccgagaaagcaacgacatcatatttacctttttatttttgtgtgtatctttgccactctcattttgtgtctgatatttcatgacttttaatgactcaattttcaaaatgacatgacttttcatgacttgtgttttgggctagattattacaaatctcaacttctaagaactataaagtaaaagaatgaatacaaagacccgtcgcaacacggagaagcatgtattcataaaccccgacccctctcggtgcatgtcaacatcgtagaccgtccgggcctccgtaagggcgcacggccggaaaaccccatct

SEQ ID NO: 38476 - DNA, 374 bp, Triticum aestivum
  unsure (1)..(374): unsure at all n locations
  Clone ID: PAT_TA_38476
cattcagtcctcatacgccacggcggcaggagtccgcacgcaacaacgaggcggtcgaggcacgcgcgagatcaagctcgctgcgagctagctgccacgtaganacaaccgttgaaccgcagcgtcgtcgagcgcccatcggagaccgtcatggacgacaccgatggccacgcgaccgctcgcaatccgcagctcaatctccacgcctgaactactagtacattccaacaccatgaagctcgatcacgtgcgcctcttcctgcaccgctgctactctctagtcactcatcaacccaatttgtcatcgtctcacacttatctataagtacggtatcgcataaactttgcacagacgcatactatttcggggttaa

SEQ ID NO: 38477 - DNA, 370 bp, Triticum aestivum
  Clone ID: PAT_TA_38477
gacgggtgatgcaagtatctaatgtatgttgtgactgtagatggagcttctgccgtggagacccttagggaggaacttgcccgagccaaggaacaagccaggagaagtgatgcggccgccctaaaggcggccgaagacttaagagccgaacaggctactcatggcaagagcaaagataaaatagccaagatggctgctgagctgaaagatgtcgccggccgatatgagcttcttgaaaaggaaagccaagtgagagcggctgacctgaagagagccatggaggcagacaaggaaacccgttctaaaatcagagcgggaggaggagctccgtcaagccagatatatcacggctgggaagccctttttgttg

SEQ ID NO: 38478 - DNA, 395 bp, Triticum aestivum
  Clone ID: PAT_TA_38478
ccgggccgacgggaagaacaaatctgaggctgcctcagagaagaaatccaaaaaaaagagcgagccctcccagccttccacaactgagaagaaacccaaagggaaaaacgaccatggtaccgagaagaagtccaaaggcaagaaggacgcctctggatacacaggtgcggagaagaaacgaaaagcaaaagtagattcgcccaagaaggctggggccaagaagaaaccagagatgctaaagaaggaagagcctaagaagaatgacaagcccaagtcgtcagcgccggccacaactgatgcttacgtcgcaccgaaggaagagacgaagaagccagaagctgccacgcccgatacctacaccgcaccaaaggtggaaccaaagaaggaagaaccaa

SEQ ID NO: 38479 - DNA, 268 bp, Triticum aestivum
  Clone ID: PAT_TA_38479
acgggtcataaatagggactcaggtctcaagtgaggactatagactgggaagatgacgatgcatgacagttatctctgggaatagagaattgtactacttagtactttaccgatgcagcgttcgtttcttttttgtgggtagatctgatgtctcgacgtactgagacatagcgagtgtctggtggtgggtcattccattcttttgggttcgtagttgccatgtacatgttggttgatcgattccttaggtttttgcgtcctgcggtaa

SEQ ID NO: 38480 - DNA, 375 bp, Triticum aestivum
  unsure (1)..(375): unsure at all n locations
  Clone ID: PAT_TA_38480
tcgacgggaaacccaagactgagtcttattagcagattactcacgatgcgaacgagttcatcatgtgagtcgtggcccttgcatctgactcaagatctgcgtcatgaggcgacagacagtctgaggcacatacatcacttcgttcacactgaattgagttcttgggactcgagctgtcttcaacagcttcatcagcacttacatgtattgctcggtctgctcacgttcaatgtatacgcagcatgcaacttctggggctgactgagaggcanatccctcacgtacatcagtttcaggtcacatagtttttgagtaccatcagatatccattcgatcacccatgctatcacatcttcagagtttccggtgatctgc

SEQ ID NO: 38481 - DNA, 382 bp, Triticum aestivum
  Clone ID: PAT_TA_38481
gggccgaccgggaggccacggacgtgcagcaggcacggcggtgatcggcgtcagcatgcaaggtcgagtctgtggcggtggcgaccggcctttggtgcgccaggtcaggtccgcgagctgggtcacggtcgtggcgacgacatcgacatgagctactccggcgatggcgaggccgtggcttagggggcgtgtgttggaataagccacggcgtttattgttgtcggacccgacgggcgcgtcggatgcgcgcgggacgtgtgggtcgcactggtgtagtcgggctcgtcgggctcgtcggatgcgcgcgggatgtgcgggatggaccgccgtggcgagtgtgcatgctggtgaaaatgggcaccggttcgtggccgtgcccag

SEQ ID NO: 38482 - DNA, 374 bp, Triticum aestivum
  Clone ID: PAT_TA_38482
gggccgacgggtcccggagtaatagtcgtactagcgcctgttacgccatggaatgcttctgttaattgggaatcaactggccagaaattaaaattcaggggggcgacggacctctagctaaggtgaaatagtatatcaggagaaaccttgtgcatcgcgagttactacgaacatctagtatcaagaagaagcggtcaagtagtgtcatctgtgggatgaataccatgcaagcagagacgtaagatttgcacgaataagggaagaggagtaccttcttcggttgtcggtgtggtcacctccacatgtcgcgccgatcttcttctttttatcggggaaaccgatgttctggatggtgcaagcttggacgaacccat

SEQ ID NO: 38483 - DNA, 299 bp, Triticum aestivum
  Clone ID: PAT_TA_38483
tcccgggccgacgggaatctaaaactgatcactttgttgtgtacatatggatgcacattcgaatgtgcagcctattaaatgatgacatagcctcagtgatgctgcggacatctttgcaaacgtcacataatattaccagaaaatccatgatcagcccaatggagtactacaatctcttataaaccgcaaacattctgctttgctcgtcaatcagattaaaataagttcccaatgaccgtgggatgttctgaatgtggggtagaggtatatccactgctatcatctatctagccaacact

SEQ ID NO: 38484 - DNA, 376 bp, Triticum aestivum
  Clone ID: PAT_TA_38484
atctactcctcatccagctccatccagtcggtgcagccacgtcaggcttaccgtgactccggttaatagaccagataagacgggactccggttagtagaccagataagacgggcagcagaagctcagactatatgatcatggtggtaaacggtggtagggttgcagatcagcaacgcagactgcaacccgcaagctgcagtggcagcgtccgaaagagatgcgcggaatgtacataagtagtgcgagcgcgtggaacttttgtctgaagagatgattttttcgtatgtaattgcagaatttgactctcttttttcgtttatctctgcttagccagcagttgatccgtgatctataacggtggcagtatatttatga

SEQ ID NO: 38485 - DNA, 341 bp, Triticum aestivum
  Clone ID: PAT_TA_38485
gcccgacggtaaaccgaatgccgaggcggcggtagctcaacagagatgagagagctccatccatggtgcacgtcaacttcgaccgcacctatgggaacacattcaggataccaaggtttccctattacaaggaccgtcttgatgcagaactaaagctgggcagtgaatatggactgaggtgcacgcgtgagctctgcaaggttcagtatgcagtgagcatgactcgtagtgctgcatgacacttgctcatactggatcagaaaaatccccgccgtatctttgagggcgcgggccttctccgttcgcatgaaccgctatggtccccttgctgagggccagga

SEQ ID NO: 38486 - DNA, 372 bp, Triticum aestivum
  Clone ID: PAT_TA_38486
tactcattgatcttcgcttatatcttttggagtagtttgtcatttgctctagtgcttaagcacggcggtggttttattttgaagaaatagatgaactctcatgcttcacttatattatttttgagagtcttaaacaacatggtaatttgctttggttataaatttagtcctaatatgaactttcatataaagtgcattgaatactatgagaagtttgattctttatgattgttttgagatatgaagatggtgatattagagtcatgctagtggtgtagttgtgaatttgagagatacttgtgttaaagtttgtgattccggtagcatgcacgtatggtgaatcgttatgtgatgaagtcggagcatgattta

SEQ ID NO: 38487 - DNA, 393 bp, Triticum aestivum
  Clone ID: PAT_TA_38487
gttcgtaaagagggaagttcaggcgcgtgtataaacaaaaatacgtcacagaagttcaacgtgagaatagcatgaagttcaactactacgttgaatgaatttcagatgaaaaacttttaaaatctttgcgagtatgaaaaagatgatcaacacgggaaagttgcgtgtttacagcagctttcgatcggatagatcacttgctcaattccggtgagtggatgtacagctaggatcagtgaatagagatatacgagaaagcaatcgcatgtgatcaacacagtgaagttcatggtttcataccgaggagttcaggtacttcacgcgatgcatttttggcgaatcagttttgcgataaacgcataacgaatgatctcgccatttttaaaaatacgt

SEQ ID NO: 38488 - DNA, 408 bp, Triticum aestivum
  Clone ID: PAT_TA_38488
gggccggccggggtgcctacagattcagctgtagatgagattgtgggttcaattcctcatttagctgcaggaaccaattcctcagaaggcttgcctgcctcatggcccataagtgggctggaaccaatgcttcgctgaagcaatttcacgggcccaggcgcaaaattagcacccccgggaagcccagccatgttgagacttctggcccagctgacctatgaaacgatttttaatgggttgcgtggattttcttataaatagtaccatcttgtttatatatcttaaatacaaaatcatctaagcgggacgaaactaagaatatcaccttgctttaatagtaggtatagatatagatatagatatgccattggcctttggttttgccccgtctcttggagaattagaact

SEQ ID NO: 38489 - DNA, 383 bp, Triticum aestivum
  Clone ID: PAT_TA_38489
gggtcgaccgggatgacaagcaatcataacacaatacactacatgtaaacagttacagaaacctacatagatgttcattcccaacgctgatgatgctcgtgtatagtgctgcaggagtgcatcgttattcgcatctcagagatgaacacagtgggtgtaatacatcttatttgtttggcagtcgcaatcgctcgttctatatctgaatggccgtgctatcctatcttcgaaggttcataaatgttgaacaatagggcgcatgcccaatggaattgcgataggtgtccccctgccaatgacaatgaagacacccgacgatgtctccaacaagaacgatgcccataaagccatggctgtcctcaaggtgctcgtcaacaaagtta

SEQ ID NO: 38490 - DNA, 329 bp, Triticum aestivum
  Clone ID: PAT_TA_38490
gggccgaccgggtgaagaaagcacctctacacacatgatggcatcgccgatttggaactagctgagccggatgctattgtgggcgaggatcaagcctggtcatcgcggctgactcacatgacaaacgttgcgtttatctaaatcgtagatgtgctcgcatgctgtagaacatgaggcacgcttgtgtacacgcagtgactgtgcttgccagcacacattgcaaatgacttagttacagatgctagctcatgttatcatactgtgtttggaacattaaatagataatggattccacgacgacgcagtctggtgtcgtggtgacgtccaaa

SEQ ID NO: 38491 - DNA, 426 bp, Triticum aestivum
  Clone ID: PAT_TA_38491
cgggcaacaacgagcggcgagagtggagaactggatttgggggaagtggccgtggggaaggacgaaccccgtggttaagtcagaagtagcagtagcgcgttacagaaagcgcgctactgctacattagctacagcgcgttctgggatacacgctactgctactactttctcttttccccctttatcatttagttttcttcacattttatttttttcctttcaccttaatatatttctttcattttcaattacctttctatttgctttccatttaattttatatcctttagcagtagcgagtttagattaaaacgcgctgctacaaagaaagtagcggtagcgtggttcgatataggtcgctactactatgtgtagcctatcggataagctgtgggaattttagtagtaacgtgtttagaacaagac

SEQ ID NO: 38492 - DNA, 346 bp, Triticum aestivum
  unsure (1)..(346): unsure at all n locations
  Clone ID: PAT_TA_38492
accgggcccaacaaggggaaaagggggaaacgatgcgggtgctcacagcgcgtccgatggcgtcgtcggcgaggtcggcggcggtcgggttgctgcgaatcgacgacgacggctgtcggtgcagaggacgaaggcaacaacgatgacggcactgcggggcgctccggcgtcgtttgtctcagcaaagatgaagggcaggtcatggcggagctcctggaccgctcgagaggacgagggggaggcgatagccgcggtggtgctcgtcggtagcgtcggcgcggtctggtgaggtggggaacagccagggagagagagccagggaaggggaaagagctccanggaagag

SEQ ID NO: 38493 - DNA, 277 bp, Triticum aestivum
  Clone ID: PAT_TA_38493
gaccgaaatgattagtgccagtgtttgaatttgttctgtttgtcatggtacgaggaaagatcacgaaatagataatgtctttacacacattttgtctgtatctaatcattatccgtatttcactcctaccaactggtagattcatgtttttccctcatttgtctgcccattgtttcagaataattcacattgacaacaattacaataaagcagccactctagacgattctagcattcgatatcttgaaagcaaattcatagcgcttctatattctca

SEQ ID NO: 38494 - DNA, 388 bp, Triticum aestivum
  Clone ID: PAT_TA_38494
gggttgtactaaaaaaaaattgcaaaacttcaggcccaataatcctgggaaaacctttcctaaaaacaattggggcaattattgaaatgaaagaaggaaacattagatttcaattccccccaaggaaaggcatggaacactttccaagaaataaaattaagttaccatatgaatctatcatgagggctacttatggattaaataccaaagatgacaatacctagatctttgtattatgcctagctaggggcataaaacaatagtgcttgttgggaggcaacccaattttattttgtgttttttgtttttgcttctgtttttcaataattacacagtataaattctatagtaattatgtgttagtgttttaattactgtttgtgccaag

SEQ ID NO: 38495 - DNA, 417 bp, Triticum aestivum
  Clone ID: PAT_TA_38495
ccgggtcgacgggtcccaacaccactcaataccttcgggggaaaccctagatcagctgatcggatgttggcggcaatcatatgtcgtaacccccttgggggcggcattcttggaggtgcactcggcttcgcgggaccagcggacggcttctttggtggagtggtgcttcatccatacattgatggcgacggatcttgacggcgtggcgtagtgcagattcggagttcgatgtgggaggatggactcgtgcaggaggacgacgctgtctggcgtcgtggtggcgtcaatggcagagagacctgacacggtagacgcaacagtacagctctgaagatggactcgtggcaggtagctgcggcggcctcatacccggcaggcatcctgattgaggagtgcgcccgactggtaggtgcccca

SEQ ID NO: 38496 - DNA, 339 bp, Triticum aestivum
  Clone ID: PAT_TA_38496
acaggagtacgaacgcaatgttcaggcaccacccagcaaacctcaggttcatcgctgacctcaatcctttctccttcccggtttcggcacgggaatcatgcaagtaccaccaggatcggacggtccacctatggcatgtctttcaggattggcacgtccactatggcatgttcatgacgtctcataacgacttcgtctgatacatctacagctgttataaatctgaatgtgagtctcattcataacgaccacactttcaggtcttctcatccagtcaataccacacataccagcaacaggcttctcaatacttgacatcatatcatcgggacgctccac

SEQ ID NO: 38497 - DNA, 406 bp, Triticum aestivum
  Clone ID: PAT_TA_38497
ggggccaagggaaggaacaaactgaaaggaccaatggattaagaatttggttttggaattgcctcaaggtgatcctcaaattctccgaattaatttcaaataaactactaaaataatttgggaaaatgcaaccgggaacctgggaattgggcatagaaggtcagttctgatgccagataatgtccacttgaaagagatgattattaggtgcgcgcaagtgcaattgtgcaatgatagtgtcaattcgttatttgttcaaagtgacatgaaaacgaatatcctacaactgagttggatcttcactccaacacaacatctttttttgtggaagaaatggtgacaacttcactgcatatgacatgagtgtaatatatattaaatctcatgtttcatatgttccaaaatc

SEQ ID NO: 38498 - DNA, 390 bp, Triticum aestivum
  Clone ID: PAT_TA_38498
gacgggcttcatgaatttgatgcatgttgattgtagtttttaaagcctagtattgaacattgtagatgagttcgtcgtatgattcttccgaaaaagaatttgatatggaagaggaggaggatcttgcgatgatcctagctatgcacatcaataaaaaaccgaagcacggtggttcggttattggtcggcaaaaaaattggagggataggatcgatgcccataatagattgatgaggtactattttgtggagaatcccacatacccggagtcgtactttcgtcgccggtttaggatgagcaccgagttgttcaggcgcattgcagagaaactagcgagccatgaccggtttttttcagcaaaggaagaacgcctccagagagctcgggcat

SEQ ID NO: 38499 - DNA, 352 bp, Triticum aestivum
  Clone ID: PAT_TA_38499
acctgctgaccggcggcgggcccacgcggaaggaaaataagggaagggcccacaaccgctcggttaggcaaggcaaggcaaggcgcaagcgtatgcgcgttccctttttcggacggttgtacagcgggcaagggaaaagccaggaaaaaagagagcggtggctcgttttggcacggcccgggtcggtcgcatcgctttcttccgcggcatgggcgggcagcggcagcgatcggtccgtccatcaatgcagtcggccttgtgcggtggtgcgttgaagggtgaggttgctaggaaatggaaatggtgctcgctggctggcccttgtcgcgttgcctgcttttgcgtccggttt

SEQ ID NO: 38500 - DNA, 393 bp, Triticum aestivum
  Clone ID: PAT_TA_38500
attgccgggccgacggggatgtatactggccgactggcaagattaacttatttaactatcaacatcttagcaaaaatacccgatacaaacgccatggtgctaacaccatgtgaaagagaattgaagacatataaattccttttctaagaaggggcgacctagccagccgccaggacgacggctccccttcaccggcgacctcagtcatcggcggaggggggtcaccggatccacgcatgtggatcatgtagctttaggtcttaggtagcttactttttcggtcgttcatcgtcttggcttgggcagcggcactaacgccgttgaatagataagatccccagctatcggtcctatggttgaatatccccgctatcggtccgattgaattgaaat

SEQ ID NO: 38501 - DNA, 418 bp, Triticum aestivum
  Clone ID: PAT_TA_38501
gacgggggtaggcggcagcgatacgcggcggctcggtgcacgcgcgtgcaaaacgtgcgctctgggcgcgcccagagcgtgcacgccaactgttcggcaaaatgccaatgcgtgccacagggcttgggtgaggctggcaattagcagacctaggttaggagtagctaggatcttagtggacaaggttactgggtcagtggattaagtacacagtgcaaactaagaatcatgtcaaaactgactatgcacaccaagtgttcgacagaatgtcatgggcatctaggcaactcttggggtggccaaactctccagatcatattctctttagatgataaagagggtggcaaggttacttggtcaagaccagaaactcgttagtgcaaaaatttgagaaaaccaattttgggcagaaactaaa

SEQ ID NO: 38502 - DNA, 133 bp, Triticum aestivum
  Clone ID: PAT_TA_38502
tcttaccatccggcgttaaaacttttgttcctaaggcgggcaccttaacatcaagcgttgctgaataagttcctgcggatgctgttgtatgtaatagccagacattataaatatatcggatgttccactgtct

SEQ ID NO: 38503 - DNA, 345 bp, Triticum aestivum
  Clone ID: PAT_TA_38503
tacggtgaaatgagcttctaggtcgtatgatcagtgatcagatggcacatgcatagtacttgtactttctgcgcatttcccaaactccctcaaccgtataatgccaaaacaatcaaacctcctaatggtggccgttaaatttcaatgaactcccatcaccatagaaactaaacagtgcgggagcacctcatattctcacatgcgagaaaacatagggtgctatcgcatcttggatgctacggtgatacaagctttgaggtcatttgatgtgagatccaatggcatcggagcactctttgtgcttgtaaacagtggcagaactcttttggggcttttctgcaaaaa

SEQ ID NO: 38504 - DNA, 437 bp, Triticum aestivum
  Clone ID: PAT_TA_38504
cggtcgaatattccgggtcgacgggccaccgcatgaatatgttgcttaccctttgcaataagcggttggattctttagatctaatgatttccgaatatgaagggaaatgtaaagaatctcctcccggattcgagcatgactccgctaaaaaatttaaaaccaaagatggcaatacctagatctattcttgcctttatgcctagctaggagcgttaaacgatagcgcttgttgggaggcaacccaattttatttttgtttcttgctttttatttatgtttagtaataaataattcatctagcttctatttagatgtgtttttatgttttaaattagtgtttgtgccaagtagaacctttgggaagacttgggtgaagtctttatgatcttgctgtaaaaaacagaaactttaacgctcacgagattagctgccatttt

SEQ ID NO: 38505 - DNA, 419 bp, Triticum aestivum
  Clone ID: PAT_TA_38505
ccgggtcgaccggcagggagaggtgaattggatacatctaaaatgtaccaattccttttgatgtttaattcctactccctccattccaaaatatagtgggctcgcgcttcccgaggtcaaactttgaccataaatttaaccaatgagactgactgcgatgggagaaaaaattatataattaaaaacttcttttgaatatgaattcattggtataacttttgctcccgccgcagtcgatctcgttggttaaatttatggtcaaagttgaagcacgggaatagaggaagcactatattttggatcggagagagtatgttttttaaaaaaaaatagactagcatactaataaaatgcaagaaggcatatttccctttttgaggtgctgcgggaaataactttgaaatattcataggacaata

SEQ ID NO: 38506 - DNA, 423 bp, Triticum aestivum
  Clone ID: PAT_TA_38506
gggccgacgggaccaaggaaaatacaagcactggaacgaggggacagtttgtgtggcatggtggacgcagtgttaggatagcaaaggctaccgaaaacgcaaataaatgaataggatggatgggtgatgtatagtgctaagtatgggaaggaatagaccacgcctgggcctttccattacgtcttaattgtatagacaagtatgtgcaatcctgtctaatcttaaccataaaagggagatcacaaatatatttcatggtcctcggtttagggaattaggagtatatcacaatcccgtgatatattagtctgacagatatgaataaagataatctaagatggatattaggtaatgattcatgttcagtacatatattatcttacagccaccttctttacttgttcaggcccgcagctgatgctc

SEQ ID NO: 38507 - DNA, 385 bp, Triticum aestivum
  unsure (1)..(385): unsure at all n locations
  Clone ID: PAT_TA_38507
cccgggtcgaccgggaaggttaaaccttattaccaagaaaaattgaaaaggaaaaaattgaaaagggcaaatctgaaccgaagattggcatccaagaactcccccttgccaacttcaagaaaatgttaaatatcaggaccagcaggggaaaattaggaggtcatccacaatggatctcctttgtgtctcaaaccagcttctccgtgtccttggttatttacttgaacgaaactgaaactgaaaactgtgaggatcgaacttcgatgtctttagagctactctgttttaaccttggtttaccatctcttcttctttcactgtatgctttgtttttcgccgtcaaagatgcgattgggccaacgcttctagtcctcangcaagacat

SEQ ID NO: 38508 - DNA, 391 bp, Triticum aestivum
  Clone ID: PAT_TA_38508
gacctccgcagacactgtggacctcaagccaacgaacaacgacactggcgaactcatcatgcaccttgagtgggttaacctccccccaagcatgtcacagtgaattgatttgacttgcaaagggagggcagctaatgtctgccttttgtgcttctaatgttgcctcctcgatatatgatctatgaagataattaagcgatgcctagctcattcgttacataacacccaccgtaatgatttgtggattacaacagcatggtgagtatagaataggagcatcttcgtgatgagatccgcacatcatcacagtgggtgctacgtaatgcatgtgatatacttatgctgctgggggtaatgcatgctttcagttttggttctgcatatattgtat

SEQ ID NO: 38509 - DNA, 342 bp, Triticum aestivum
  Clone ID: PAT_TA_38509
aatccttaaccctttaaaaaagctgttaataacaaacgcctccgcctaatccccaaagggcaatcaaacgggccggttggattaccatgtccgttttgatgaaaaccccaataagaggacacgatctctgctttgacaagacgtgcaaataaaactgcatcttgaaacatggagcaagaggcttaaaaatagttcgaaataatgaccgggcagcgacgtgatgtgacgctacaaaagttgtcagtagattggactcaagaaatattatactctctgcggatatatgtggtacttgttttgcagagccggacacgttttttatgttcgaaggctattttggag

SEQ ID NO: 38510 - DNA, 336 bp, Triticum aestivum
  unsure (1)..(336): unsure at all n locations
  Clone ID: PAT_TA_38510
acggtcctagaatcncgggtcgacgggcgctgcaaaaactccggcgacggcgacatcgtggtttagggagagtatgttaggataaaccacgtatatgggtgtcgtgcgcgcagccgtggctggctagctacatgcgtggccgggtgatctttcgtgtgcgcatgctagttggttagttggctttgtggccggtgcgctgtgtgtgcatgcacgatgctatgcaagtttgttagtcacggatagactcccgggaggtgagccagatgtgagtggccgggtgtgacggccaactaagtgggcgtgcatgcaagtcatggtgtgcgtgcgtgtgtgtaa

SEQ ID NO: 38511 - DNA, 378 bp, Triticum aestivum
  Clone ID: PAT_TA_38511
ccccgagcacgcttgtacgtgatacctttcaacttgccaaagagaaagctccgtgcattatcttcatagatgaaatcgatgccattggtacaaagcgtttcgacaggtacaaatctttttctgattccagttcatgtatttctgcactttctcagctatttgctcaaatcacattctttggttgagagtacagtgaagtcagcggagacagggaagtgcagaggactatgttggagttgctcaatcaacttgacggattcagtagcgatgaacgtattaaggtgagtgtctttatccattctaaggactaatcatactggtcttaaaaatcgttctcaaagaaacagtaacaaccatacctttctattttttcaggtg

SEQ ID NO: 38512 - DNA, 425 bp, Triticum aestivum
  Clone ID: PAT_TA_38512
acggagcacccagatgtatctatcacccctcacgctcactctatggcctgaaataacctccccgagcctggtaccagcggtttgccgacttccacaccaccattggtttcatcttcacatgttcgattcgtcgttgtttgccctctgccatgacactgacatgagctaccttttcttctatctcctccgacaccatgtttcaccgcatgatcagctctttccactaggcgctacattacatcccagatgttgaggtccgagacacctccaatggcttcttcctgtagcatgccaagtatgtcagccggctacttgatcgaggttgcatggccagtttccagccatcacatccctggtagacacccactccaaggtctctgccaccaccggctcagctgctgctgatgcaagcttctactggacta

SEQ ID NO: 38513 - DNA, 163 bp, Triticum aestivum
  Clone ID: PAT_TA_38513
aatcttagacgcctctcacttcatggaaccatccacacacctagttcggtctattccctcgcttcatcacggatgctcctcagttcggccgatgcgataatgaataagccgatgtgctttggtgtaactccaacttgtggaggatcataacgctcaaaactta

SEQ ID NO: 38514 - DNA, 420 bp, Triticum aestivum
  unsure (1)..(420): unsure at all n locations
  Clone ID: PAT_TA_38514
acggggatgagtagagcatcggagacggcttcgtcttgagtcccgtgagccggtccatgtcncatgtcctactctacctcgccggcgaccggagcaatagtttgagggccgcagccggccgctgtacatgggcacggtggagccggacgagcttcacttagattaggtttcatgttgcatgtaataatatgtatttggtgttttgaaattatgtttgtggttgtggaatcattttttataagatgtccgatcaatatccacggacgcaccgcggttgggggccggattttggtgtttgtggttgtacatgctttaagtgtgcatgcaatacttgatatagtggagacatagtcagatatttgtcaggaagtgtcagctgtatatagaaatgcattgcacaaacgaatcctttcccacctt

SEQ ID NO: 38515 - DNA, 273 bp, Triticum aestivum
  Clone ID: PAT_TA_38515
tcacggtcgaccgcgacggatacctcacatacggcggatactcgagcatggttgtggtgcacgagcgcttcgtggtccagttcccggacgccaagccgcttgacaaaggcgcgcccctgctgtgcaccggcaacaccggtgtacaaccccatcaagtaccacgggcgtaacgccccgggaatgcactcggcgtgctgagcctaggctggctcagtcacatcaccgtcaagttcggcaaggccttcgggattaatgtgacagtgatcagctcat

SEQ ID NO: 38516 - DNA, 316 bp, Triticum aestivum
  Clone ID: PAT_TA_38516
gtcttccacaagtacttcaggtataatgtgctcgcttcttgcaaacaatgatagatgcactgaggagaacggagccatatctatcagctcatcgcccgatttagaccatcaatccgttcggggtcgacacctatctcaacagcaaatcgacgtcgtatatgggaatgaccttcactcgctcccaagattacgcgctgcgcctaagccggcccatgaacatcagctttagtgcggaatccccgcatataaaactacacatctgattcgatatgatcatcctgtgtccatagattcacccatgatcgttgatgcaaaa

SEQ ID NO: 38517 - DNA, 350 bp, Triticum aestivum
  Clone ID: PAT_TA_38517
agcagtatttaatcgttgatgatggcttatgtgtgtataccctcaaatttacatggcgatatggtttattcccttcccttttatttccgggtctatggttttatattgagtgacgcggtacaaaatcatcatgctatttttatataacttactttactttagtaagatctacgcaccatgtttcactttggccgaaatcgatgtcaacagatgcctctcgaggtctgaatgcgaatgttattctctaattcggattcaaaactcgagagtacatgtatcttatatttacgtgcctcagacatatggcttggcgctggaagtgtatgcatgtcatatcaaaatagccgtct

SEQ ID NO: 38518 - DNA, 412 bp, Triticum aestivum
  Clone ID: PAT_TA_38518
ttcgccggtcgacgggtgatttcagagaaaaccggagtgccggaggggttaccggaaccccgcggggaagtattgggccttagtgggccttaggggagagagagggcagcatcccaggaggtgccccccaaggggagtctgaattggactaggggaggggggcgcggcccctcttttcctctccctcttcctctctttctttcccccttcccccttcctagtaggactaggaaaggctgaatcctactcctactaggaggaggattcctcctctccttgggcgcaccaagggctgaccggcctccccccttgctcctttatatacaggggcagggggcaccctagataacacaaattgattgttccaagccgtgtgcggtgcccccctccaccatattctacctcgttcata

SEQ ID NO: 38519 - DNA, 218 bp, Triticum aestivum
  Clone ID: PAT_TA_38519
acagggtccatctacgttattctacacgattactctatagatcaatcactcctaattcactgcgtattaaatcaagtacgtactacggtatttttaactgaagttaaaaggttggttcctgttttaagggtgcagatgtactataacacgtaagtcctactatccaaatgcctcaccatactcttttgaggtggcgcacacgaatcaacggccgcacc

SEQ ID NO: 38520 - DNA, 413 bp, Triticum aestivum
  Clone ID: PAT_TA_38520
attcgccggtcgacggggacagtgacggcgacgacgacgagacggactctatgtgatgcagaggacgtcggcgtgaggtggaggtcggcgcgatgccgctggtggccggttgcggtgtgatgccgcaagatgatgatggtgtggtggtcggcgtcgcgaggatgtcatccatgacaagatggtccatggtgaccggcgctgcgccggtgtcggctgtggcacaacggactccatgcgagatggagcccgactgtgcaagaagaaagatggtggccatgcagtgccactatgtgaagatggcggtgtgaagctgccacaagaagagtcggtgcgatgccgacgatggtggtgtgatgccatcgtcatcatggaaagttggtgtgaagccaacaaaagctgcggtgcgatgccac

SEQ ID NO: 38521 - DNA, 405 bp, Triticum aestivum
  Clone ID: PAT_TA_38521
ggtcgaccgggaaggtgaaaccatagagagatgtgtatttttaattgagatgttttcaggagtacctttgtgaagctgatatatctttcttttacaagatatgttgcacttgcttcatctacataggctgtctggaatgccatgaggccgggattggtgtatgaaatcttcaaagctattatattggtctcaagaaacttgcaatacatcaatatttttaatttttttgctgacaccacagctaccacctcttcactaaatgacagatgttgccagcaactgcacatggaaggatttaatgttatattatgtctactaatcaataacgagggagatcaaattactgctctcaaatattcacctgattgattttgaaaagagggttaaaaatggtgttatgaatga

SEQ ID NO: 38522 - DNA, 389 bp, Triticum aestivum
  Clone ID: PAT_TA_38522
actggatatattaacgggcgagccgttacggtgccccggtggccatcaacgcgcactatcacggattgctacctccttcagtgtcatgcagtggtaaaataccatatgctggggatgtacgttggcagagtctacacgtgcttaaggtgctaccgcctctgagcagactatgtcacgatgatccgtttctcaaacaccatgcagtgcgagaacatcaactgacgaggtcgagtcttgtcaggaatagtgctcatacctctgcagcgtgtatacactaatcatggttaccccagtcctcggttatggacatattgagtatctaatacctggattatcaagttaatcacaacatgttactctaagaataattttggtgggttctgtttaat

SEQ ID NO: 38523 - DNA, 363 bp, Triticum aestivum
  Clone ID: PAT_TA_38523
gataatgcaccactcaggtggagccatcaccaccccaagactcacacgcttccaaagatcatattgaacgctctcaacctcgtgcacaagaccagggtgcacgatcaatcgcaagattgtggtgaacctccaaatgatgcccacagtcattttctcacccacgagaatcttagatataagatgcaagctcaagatcagtatgaagctcaagatggcgcccattattttcagattaaccctcgtccgtccacataccaagacgacttgtcgcgtctaaccacaaagattgctttcaaactcaaaacgaaggtcgattcagtctaaatcgaagtggtagcctaagactcggggtaagtactcgta

SEQ ID NO: 38524 - DNA, 409 bp, Triticum aestivum
  Clone ID: PAT_TA_38524
gacgggacaatgcaccactcatctggagccatcaccaccccaagacccacacgcttccgaagaacaaagtgaaggctctcaacctcgtgaacaagaccaggggcaagatcaatctcaagatggtggtgaacctccaaatgatgcccaaggtcaagttctccccctcgagcaagttcaagaccatgagcaagctcaagatcaagaacaagctcaagacggcgctcaagataatcaagttaaccctcctccttccacatccgaagaggaattagagcgtcgtgccgcgaagattgcttccaagctcaccaccaaaggccatctcatggagaatgtggttggaagcctaagaaagggggtaatcactcgtagacaattaacaaactattgtgaacatcacgcctttgtcccc

SEQ ID NO: 38525 - DNA, 388 bp, Triticum aestivum
  Clone ID: PAT_TA_38525
gggtcggccgggatgtcctgtgacggataggtctcgttgtaggccagcccttcgatctccagaaggcaagcctagtgtcctcctctcaaccttcaatgctgaccctagcagcaaccatgattgatcctttgtacgctaaactgaagaaacctcctcacgagtttcatcatgcatgggagtcgaagatattagatgaacatcacatcctgtatgcagcaacggatgcctacctttgtttaaatatctacaagggttggatgaagaagcggagcccggtgtctagttcaagcaaagaagtgtcggcgaagaggaagaggaagagggattaggtcgaagtcgaggacgtggactcggactccgaataggtggtaattccgtcgctcatgct

SEQ ID NO: 38526 - DNA, 343 bp, Triticum aestivum
  Clone ID: PAT_TA_38526
ttcgccgtcgacgggggcaacaagtgggtcactgtgggtgtcatgctgcgcttcttcctcgtgtgcacgatcatgtgctgggctgtgctggtgaggagggcgtccaagaccactctctgatccttccttctttcccttgtttttgtttgtcagcttcattggattggatcatatatacaagccgcgttatttgtttgcttttgtcctgtagtttgctctttgtttagatgtgttgagtaacaagtgcaatgcaagtttgcactcgtgtgtaaaatgcttgatttgggttcatgaatagaaaatttcaacctgtcaatacagttcactcaacatatatgaaatc

SEQ ID NO: 38527 - DNA, 402 bp, Triticum aestivum
  Clone ID: PAT_TA_38527
cgggtcgacgcctacctgcattacatcctcggcgacgagtacgagccggagcacgtccgggagcaagaacttcatcggcccgttcaagcaccaatggccatccgcaaccatatccgcatcacagtcctttggagcacaattgacatatttgcagcggacgtgtgatgagcagttttccatccaccgtgcaaaagacccagagctgctcggcggcatgatcgatgacccacctgaagagccgccatcacagtgctcatcgagagcctgatgccccgcaatgaatgggcagaggacctccgcgattcagtcaagacaaaggcagcctgcggcttcatcattgcccgcaacggccatttcaacctcgattccgatgatgtggtggccaagattgagcgcatcctt

SEQ ID NO: 38528 - DNA, 406 bp, Triticum aestivum
  unsure (1)..(406): unsure at all n locations
  Clone ID: PAT_TA_38528
cgggtcgaccggggtttaggtgggctgcaggtgggctgagaagaggagttgggccgagaggagagaagagaagagaagcccggcggtagtttcggagaccgaaacgtccgacaattaaaccggcaacagtgccgctatgttaaacggttgggctatcaaacgaactccgaatgcgacgaaacttggcaggcggtctgtctacactataataagaccacacgacaagttgcaacccattccgagaacatttttatgccactaataaaataatattacggaggtgccgcgggcgcgtgcgagtgtagtcgggctcagaacggacaacggagagaaccggcggaacacgaacggatgcaagttttgaaaaacatgcagatganatacagatgaagtgcagatgatgaca

SEQ ID NO: 38529 - DNA, 283 bp, Triticum aestivum
  Clone ID: PAT_TA_38529
acgatgctaactataacgacacgtccgtcatctccctccaccccgacaccatattagaggctccagctcttcctcggcgagaccttccttctcaacggtaacacgacgaatgactccatctgcattgttcttgctgattacatctgtgatgagcctaaagtcataattatgagatctgtcaagagttaactttagattgaaagatgtgtcatgtggtgtctgttcatcactacgcctagtttcaatacattacacgagtgtatatacttacttttaacaatac

SEQ ID NO: 38530 - DNA, 157 bp, Triticum aestivum
  Clone ID: PAT_TA_38530
acttcaatcgcagccccttctccagctctgttcttatgcggcaataacttcgctggacgaggataattccttcatcatcaccgactttctgttaatggttttgttcggactcgttaactacggcattacagtgcataccggctcccggtgatacatg

SEQ ID NO: 38531 - DNA, 384 bp, Triticum aestivum
  Clone ID: PAT_TA_38531
gacgggagaagtaagacttcagacgccgccgcaaggcttgcacaccacaagatccaagatgtcaatatgactgtactccagtttcaacacgtcacatcacattgtcattgccagggctttccaaaaagccacattagtttgataggccaaatgcagacaaaatacattttgatatacatgtgcacaggctcatgtacatccaggagttagtagagtgcttcggacaacttacagcctgctcactcacctagattaccctcaaggcgatcatgacgctggtcgatgcacttgagctgttgcaggccaccaaaagggcaaccgatggcgtcaacggagtcggcaatctattggataaagtcctaaatgcgatttaatgcgacgtca

SEQ ID NO: 38532 - DNA, 112 bp, Triticum aestivum
  Clone ID: PAT_TA_38532
aagcgaccgagttagaagttgtcaatatgcattgtcgtatcgcgacctgaatgaaatagacgaaataatgctcatgttcgaaagaatgtgtgagagtagactttacgcaaaa

SEQ ID NO: 38533 - DNA, 360 bp, Triticum aestivum
  Clone ID: PAT_TA_38533
ggtgattatccatagactatacgggcacaatagatgtacatctacatcatccagggaacacaggggcacatcgtatcttaaagggtacggtggttaagatgagttcatacgtacgaattcggttgatgtaatctctcagcaatctgctgaaaagcattcaagtacgcaacattttatatagagattgctatttgactgttccgcttagtcacagtgtgctctgtaaatacattagctcatcagacactgtttaccgtctacacatagcgaacatcagattctaatctcaagtaatgagtgcgttgtttacttacgctcgcagcttcatatcctcgaactgattcaaacgccgaatttgct

SEQ ID NO: 38534 - DNA, 322 bp, Triticum aestivum
  Clone ID: PAT_TA_38534
agacgggacatcctccgcctctagtcatgtgagtatcactatttcctgagctgctcgagtgagattttacattctgttcgtggatttatatcgtagtctgttcttcatacctagaatccacgagaataccaatcaaaagatgttacggttagttcatcccatccgaatcaatctgagccttgcataaacttttctgtaatagccttgttgatcttgcggttgcatctacgtgttcaattgctggtcataacgtctagtcctctaaaattgctacttctgttcacatcttgtcacaccgtaactgcaccaacatcatctcacc

SEQ ID NO: 38535 - DNA, 327 bp, Triticum aestivum
  Clone ID: PAT_TA_38535
ggtcgacgggaaaaagtagtgctagggtttgagcgagatggcgaggtggaagaggagataatgaccaggtggggagaggtatttataaggagcgcggtgtagtgtaattacgcaggtgcccctagcggttcacatctggatgacatgtggaaagcatgcaacttactgaaaattgagccaatttccccccggccccctgtttggttggaaggtctttccggcttcatcggttttcaggaaaaagggataataccattaaaattggttttaatggtgtacccctaaatcttcacctaacagggacccattaaaaactttcaactggtt

SEQ ID NO: 38536 - DNA, 330 bp, Triticum aestivum
  Clone ID: PAT_TA_38536
tgtctggcaggatattgacatgtgttgtgcgcggtgggcatattttcatcagggtgtcgtgtctcggagaatctggggatcctgaaatgaaattggagatgaggcgctaccgggagcctcggttctacaccaaggtgtatacaggttgccaatcgtaaggtcatgatgggaactcctttgagctttctctggtatcttccagatgcattggagcttatgtgaattgcatgacgagccattgccacatatgttggctgtgggacaaggttatatgcacagtagatacaggctttcatgagattcctgaacattgtgcattacagatccact

SEQ ID NO: 38537 - DNA, 232 bp, Triticum aestivum
  Clone ID: PAT_TA_38537
attcgccgtcgacgggcaatgatactcctgacctggcagtccttcaccaatgccatcgtagcacaatccaatgccttgtcccgccacccgtctcccctccttgttactctccgggccacctatgtgcacccagattttccttttctttctagcttcccggggtcttttgtgtctcccccggtggcggcttggccgtcgcacctcgacgacattagccactgtgggatgaatc

SEQ ID NO: 38538 - DNA, 332 bp, Triticum aestivum
  unsure (1)..(332): unsure at all n locations
  Clone ID: PAT_TA_38538
gggtcgacgggggtggtcactatggtgcacggaatcggggcggtggcccctcttattcgacaacggtggactccatggttgtgtgggagattcgaagtctggatctcgaggtggtgatggcctttctgaggtangccgcggtatgggacatcccatccatcgatatatcaggttcaatgcggctcaataggtgacacatgcgtctctttcggagtcgtcaggcacttcctgtcgccgacaggtgaagcctcaggcggatgctacgcacgacgtctcatgcggaggcatcaagtcatgcctgctnacagcgcgtgctgcatggtgtttgtgat

SEQ ID NO: 38539 - DNA, 408 bp, Triticum aestivum
  Clone ID: PAT_TA_38539
gacattcttgatcatcgtgattcttacaaactcttatatgttctcttctccgaggtgacaatttgtttcacacgccgctcgaggcagcacatttctagaaactatatagatatatatttgattttgatttctacagaaattttcttgtaaattagactgagataaaatcatttgtttgcatttcgtcgagaatatagttttctccttttcccattttttatttttaaggcagactctcggccgacgacgtctcctagtctgcatcgatgattttttggctagtacttctacaaatcctatgtttcaaaaagtttgctttgccaagaggaagtcacggatacgacattgagctatgctcatgacgtgttgccgctggatgtaagacgaacaatacttcgacaccgccca

SEQ ID NO: 38540 - DNA, 326 bp, Triticum aestivum
  Clone ID: PAT_TA_38540
gctgcagatagacgacataagtccactgggagcaactagattcacgatatcttcgatgccaccgattccgacaataagctcaacctgcacgacgaggatgaggctgaagacgtgtcctagggcccccacttggggtttgtcaatccctacagcaagatgatgattcctgctctcacataaagtcctatcgcgatccctccctttgctctggttgctgcgaatatcagcctggccgggagcatcatccgcagcatgagggtcactcatgacattctccacttctgttccggccatgttgtgacagcggacatccacgttattgacgt

SEQ ID NO: 38541 - DNA, 147 bp, Triticum aestivum
  unsure (1)..(147): unsure at all n locations
  Clone ID: PAT_TA_38541
gacanacacatgtcagggtgaaatgaaaacacagccgacagatacagaaagaactgcataaattaagtattcacttgatatcatcgatgaacaaaanattaaactctaatggttgccccaaagtttaagcatctgaaagaggatagt

SEQ ID NO: 38542 - DNA, 214 bp, Triticum aestivum
  Clone ID: PAT_TA_38542
gggccgacggggttcacaagtggcggtccgtaaaagacaacgtttcaatttgcgtacaaggcgttcaaagttccctggcctcatgttatgaagcgcacaagctcagaaattccactgaatgatttccagtttacaatgaactggtaacgagttgcttggtgttacagataggctactggacagacgacaacattttgtggaacttcatcgtgac

SEQ ID NO: 38543 - DNA, 258 bp, Triticum aestivum
  Clone ID: PAT_TA_38543
cggggccatgtacgagagcatgctcactggaaacgtgtctagatcgaagatggaggtagtaaaccccccaccggtttatttcactttgtgagactgggaggggctggaagctttttatttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaaaggggcccccaaaaa

SEQ ID NO: 38544 - DNA, 342 bp, Triticum aestivum
  Clone ID: PAT_TA_38544
cggtccagctatcccgggccgacggggaccacaaggagaagaaggacaagaagaagaagaaggacaagaagcacggcgagggccacaaggacgacgacgaccaccacaacaccatcagcgcatcccattagcattctaccattttcctcggagagaagtagccagaaacagcagcgccatggccggcatcatgcacaagatcgaggagaagctccacatgggtggcggcagcgacgagcacaagaaggacgaggagcacaataaggcggaggagcacaagaagaaggacggggagcacaagaaggacggcgagcacaacgagggcatgatggtgaagatcaa

SEQ ID NO: 38545 - DNA, 439 bp, Triticum aestivum
  Clone ID: PAT_TA_38545
cgggtcgacgcggatattaatcaagcatttgaaaaatattaaatgtgcatagaaaaatgttgacgatgtattagaaaatattattctattatttgaaaatctttttgaagcatttgaaagaatttaaagtgtgtatagaaaaaatgttgaccatgtattcaagaaatgctgaccatgtatgtgaattgttttaatcatgtatttgaaaaatgtatatcaagaatatgaaatatgtttaagtatgtatagagaaactgttgaccatttatgaaaaaaaaaatgttaaactcgtattggaaaaaggaaaaagaaaccaaagaaaaaaaaaaaggaattgagaaaagaaaaaatgggttaaaacccatgaaaggaacaaaaagaaaccaaaaggaggacgaaagaagagacaaaaagatgtataatgaaaaaaataaaacca

SEQ ID NO: 38546 - DNA, 171 bp, Triticum aestivum
  Clone ID: PAT_TA_38546
gggccgaccggatgctgattgaagagttactaaatctttcgagaggcctgtaccgatcagacctcacacagtctgatctctgtgcatcagtgtcatccctgaatcagtcacgctgagatgcacagtacgtgaatgatttataacacagtagcaatcgtccacgtattacat

SEQ ID NO: 38547 - DNA, 421 bp, Triticum aestivum
  unsure (1)..(421): unsure at all n locations
  Clone ID: PAT_TA_38547
gggccgaccggggagctcactaaggtctcgatggacctcaccatgctccactaccccttgtgactctgccccttgacgcctccagtgtatgaggttcgaatacacctcgtccattcggccgattgagcaaggtgcaggtttcttgattgatgtgttgttcgattgatttctgcagtgcaagggagggcacctggcctgcgtggactgccacgtcgagcgcctcgagaaccagcggcagtgccagaagtgcgagcacgatggtggcttcgacatgcggaacacgacggtggatgccatcatttcgtcgctgaaggtggagtgcccgcacgaaggttgtgggctctgcatcacttaccacaagctcgccgatcaccagagcatgtgtctgctcgcgccctgcanatgccccgtgcctgtctgc

SEQ ID NO: 38548 - DNA, 229 bp, Triticum aestivum
  Clone ID: PAT_TA_38548
ccgggtcgaccgggatccgcaacaaagtcgcgatcgacgaggccatgctgcactcgccccaggaagacatcgcggagatggctccagtgctgtacgcttcgtaccacctcctcaacctgtagaggatggccacggcgcacgtttcttggttgatgtgttcttcacatgatttctgccctgcaagggatggcacctctgctgtcttcaatggcatgtctaactcctgcac

SEQ ID NO: 38549 - DNA, 360 bp, Triticum aestivum
  Clone ID: PAT_TA_38549
ggggacgctgcgaatgttcgacagaaggaccaacgtgatctggctaggtcgatgtcatggtagctgtctgctcggcatctgcatggctgtgagcatgccgtcccatcgaacatggtggtgcccaagggctcgggtacgcgccttcgcgttctgcgcactgcacccacggcgccacgatctacaccattgtcgtcgctgccaccgtcattgtacaccaccacagagtacagtcctgagaaggttctgcagtcaaagcgcttacgctcaggacgagcacatacgaacgccgtccatgaactgtgcagatgcaacaggttccgagctgtatcgaaacacgtcatgacatgaagacagcagtca

SEQ ID NO: 38550 - DNA, 469 bp, Triticum aestivum
  Clone ID: PAT_TA_38550
ggccatgcttgaaagatgacgaactgggttttagttgagttttattgtattttagaacctcggtgatgatggtgatgaaaatttgtaagagcagaacagaataaaaatgttttaggtgtttatcaacggctctgcagaatgcacgagttgcttgtcgaggttaaggcaccgctagataagtgcaacacataataatatcaagtatgtcatgatcttggagataagtgcaacataaaaatgtcaagtatatcatgaccttggagataagtgcaacataaaaatgtcaagtatgtcctgatctttccaggcagaattgctgggatttggttaactgcacaaacattcttgatcagcgcttgatcactagatttatacttaagcacttgataacaaggcactcattggttgtgtgaaaacatatacagctaaagaagaatattattattgacaatctaggtttaacaaccac

SEQ ID NO: 38551 - DNA, 432 bp, Triticum aestivum
  Clone ID: PAT_TA_38551
gggactgcttgagacttttcatccttcacgtggtctcaggcaaggggatccgctatcaccatacttattcctctttgtggccaaagctttgccgttgttacttaatgatgcttcggaaatgggggttatcctagatttccggctaaacagacatgctccaggtatatctcatctaatttttgctgactgatagactcctatttttctaaaggtaacttacagcatgctctaaatgttaaaggtattttgtcggcatatgacgatggaattggacaactattatgtccggataaatgtaccatcttaattggcaaaaaatgttcaaaggaggaccagttgtccatcctgattatccttaaaatcacgatcgatggttttgacgataaatatctgagcttgcctgcaccatcacttttgaaagctttatcttct

SEQ ID NO: 38552 - DNA, 454 bp, Triticum aestivum
  Clone ID: PAT_TA_38552
gggatcatcttatggcctcgccggactcagagaggccctccgcgacgacactttacggtcgcccgcgtccggagcggaggagtccggaggaggcgtttcgctctccatcatctctggaagaagatcccccaaagacaagctcatttgagaggggctaaggcccgaactgcaaagatacatgcagcgattatcttctcagaagaaaagacgacatatctgtactattaaggtattttgggtcacttacgactcgtgggagaattgatccccccaaggactttgtgcggcaaccgcgccccccggggtaggaccctctgtgggagacttcttctcccgtttcgaagcttcggcttccgaatccccaaacgcaatccttttcctcttctggtcgtcttccttcatgaagacgctcactccctcggctggagcagccagcgtttggggcccgcgactg

SEQ ID NO: 38553 - DNA, 461 bp, Triticum aestivum
  Clone ID: PAT_TA_38553
gcccgggtcacggtggcaatggtaaacgcaaggctgagggcggtttaaactttgtggccaacaccaatacgcaaaacaatagtcagtgtcagaaggaaaagccaccccgacttggcgggcccaagttcaaccttgaggcgatgatgaaccagccttgcccaaagcacggtatgcaagagaagccggtcagtcatctatggaaggattgcttcatcttgagggcgtatagaaactccaattttttccagaacaatcacggcccgaatggcggaccaggatccagctctcacgggcctggctttggtggaggcggctcaagttctggtttccagggccatggcaatcaaggtggtttaagtcagcagtatggttaagggaatcaacaggagcaatctggttattagagtaacctgaagcagctaaatagtggaccatatcatgtgttcaccacgagtttatgc

SEQ ID NO: 38554 - DNA, 449 bp, Triticum aestivum
  Clone ID: PAT_TA_38554
gacccagttatagccacgaccaaataacacgtagcactacggctatttaagccaccctctgcctctgccatccctcatccatctgcccttcttgctcttcgaccccttctccgtcttctgcatatccctcagccatgcagtacaccggaccaacctactgcttcccacccaccgtgccggagaggctctaccctaccggcgtgtacgttgatcgcatactatgtgtgtgggcgatatcaaggctgaggaccgcaaggaacttcgccgagttcttcctcgcgtccggctaccaccatctcccgaggggatctccaacgatgttccgcgtcgaggaggtcatccaaaaccgggtggtagttgctctccttgcccacttcaccaacacattcgacgccttctacctcctcggccgggtgttttggtgtggctccgagttcatcgctttcacc

SEQ ID NO: 38555 - DNA, 391 bp, Triticum aestivum
  Clone ID: PAT_TA_38555
ccggggcgccgggcaacggtgaaaagaatttgacaggtcttggagaaaatacataagactgatgataattcattcttacgtcaaactttaaaaagaatttgagaagctccgggaaaattagaagagtcaggtaagatcctgggaaagacctgtaggttagggtcaactcaaaagaaacaccgttgaacaatttaaaagcgaaattgcgccggttgaaataaatggcttgaatgaggtaacatccttaaaagaacttgattgaaatgagaatggaaacttgaaccttctgagatattttcgacactccgaaacaattgattaccaagaattggatgatttagaaggtgcaccgacatgagaaaccatttgaaccaaaaaaaagatatgatta

SEQ ID NO: 38556 - DNA, 236 bp, Triticum aestivum
  Clone ID: PAT_TA_38556
tcgacgggaacatgttgcactttgacccggtgcaaagcgacaagttcgtagcattgttacacttttttgcacaaagatagaacctgtagtactgatcaggtgaaacatatcgatgtggcactggtactgaactgaagcaacaatttgttcaacattgatatgatccaaatagagcgcatagtagtttctatcacatggaatcgtcgccggtcttgtgccatacagtcagtacaatt

SEQ ID NO: 38557 - DNA, 133 bp, Triticum aestivum
  Clone ID: PAT_TA_38557
aagcgacgtcggtcactgaagatcacaactcttgacatgcatcctggtgcagataaagcgtcacttgatgctcctagttctcaagtgaaatctgagttcctaaggaaaagcagttcctgaagtcgtggcattc

SEQ ID NO: 38558 - DNA, 294 bp, Triticum aestivum
  Clone ID: PAT_TA_38558
tccgagtggacggggacccagtcgattgaccaatcaatgtcatttgctttgcaggcgtcacgcgctcacatgccgatctctgaggggatgctcaatgtgagaacctcgtcacgatgtcctacatgccttagcactgttcgcttactgtgctcggagtctcatgggtcactcgcatgcctacggcaggttaatcatttcgatccttctcctgtgtggaccatgagttcacagactctgcacatcgcttgttaacgtgcaccatgcaccttgtagaagtacatctggtcacatcag

SEQ ID NO: 38559 - DNA, 465 bp, Triticum aestivum
  Clone ID: PAT_TA_38559
ccggggcacggggaaaaggaaaagacccttcagtcctatttataaagcaagggacatgggtcaggtgcgaaaatcaaggagctgcaagtttggaaacagagttgtcgcctcgattatcgtagatctattaaacaagaaggtatcacagatagtttttttatgatagatgacgtcacgccgatttacagcaatcagagaagataacatcacggcggttcatcaaactataagaagatgttgaagatgaagtttttgctaaggattgacatgaacctgttcaaatcaatctggggcctaatgttggggatattactactgggcgtaaaccggcctatctgggccggattaacttcatcagtagttaagcatgttaaagcccatgaaggtagatgagggctcaagacccataatcggttgagagcctgtagccgtaaaccggtgtcaatatataacttgtattgtaag

SEQ ID NO: 38560 - DNA, 209 bp, Triticum aestivum
  Clone ID: PAT_TA_38560
ttccggggcgacggggaaaatgacgagacacctcacacggtcatacaatgccaggtacccggttcatcgtacttccatcaaggaaccgcgcatctattaatctggggattcgcacgatcctgtgagctctcttacacaccggggataccacagttcaactctattgtgctaaatgaattccatccctatgatcacaatgagaaatcctt

SEQ ID NO: 38561 - DNA, 439 bp, Triticum aestivum
  Clone ID: PAT_TA_38561
ggggcacggggaggagaggaaggaagctgtgggtaagctcagggacacggtggttcagctcaggtctgccggtggccacgacgatgaggaacggcaacagcgatgactatattttctcggtccgctcggttggaccggttaaagaccggaccagaccgagaacttttcgggcctaatatggcagaccggaccgtccattttatgtagcgagctaggaccgagcgagccaagaccgaacgggccacgagcgggccgaaaagcccgcttggtacgtccagcctgacggacgacgatccaactgacttggttcctgccccaagtggctagatgtgcacgtacaaagctagcaccagtctccgatcgattcctttgtcagagacatatactagtactaactagtagagtgtccgtgcgttacaaaaatcacggaagaagaaag

SEQ ID NO: 38562 - DNA, 462 bp, Triticum aestivum
  Clone ID: PAT_TA_38562
ggggacctggagatacaacatttggagttgtatggtttgcaggagcaaggtgctgcagttagggagcttgagaaccaactgaagataaacaatgtcgagtcacagctatactccttgaagatcgaatccttgcaatctgaaaatcagaggttacaaacacagttgtctgaaagctcaaagttaacttcccagcttgagttgacaaaatcaaaatgcaagctgttgaaaaagaagttgagactggatgcggaacaagcaaaggagaaaatcacttcccttcagaacatagttgattcctttcagtgtaaggagattattgagggagaagttgacggcgaggctgagaagaaattaaagaggctagaggaattggaaaatgaggcaagagagcttagagctgcaaattcaaggctgcagcaggagaattcacaccttactaggcgattggagctcacacgccta

SEQ ID NO: 38563 - DNA, 455 bp, Triticum aestivum
  Clone ID: PAT_TA_38563
gggtctacttagaaagatgacaggaattggtcattcacatggttagtcataaaatcctacataagatttgtagatcactgaatatgatatgtttgattccttgcaatagttttgcgatatagagatgataatatgtgggaggttctagtagatggttgtgtttagtaagaatattggtgttaaggtttgtgattcccgaagcatgcacgtatggtctcctaactatgtaaccaaattggcgcacattgtattttgattgtttatctttacgtgaaggtcgggcgcacgcgatggttagctcctaccaacctcccccctaggagcatgcgtagtagtactttgcttcgagggctaataaacttttgcaataagtatatgagttctttatgactaatgtgagtccatggattatacgcactcttacccttccatcattgctagcctcttccgtaccg

SEQ ID NO: 38564 - DNA, 303 bp, Triticum aestivum
  Clone ID: PAT_TA_38564
tggactagggcgtacagggcgcggagctgcgcaggtccacgtctttcggggtaagaagcaggacgcatgatgcgacgaggcaggaggacatgtactcgtcgtggatgaacgacggtggcagcgacatgctggcggcgcggtggtcggacctggagcagatggtcgcctagttaattaattcacattttcgtttcagactccagtatataaggagaaaaagaaatatgtaatcgttctttgttttttttcaaacttgttgtgctcgaacactgataaaaagaaaatttcacgcccaaaacaaaa

SEQ ID NO: 38565 - DNA, 302 bp, Triticum aestivum
  Clone ID: PAT_TA_38565
gggggctacaccaaatccgaagacggtgagttggtggcacgtcacagcgatgggcggaggcgcgcggtggcgtgtgagcctgggttaggctgttggcgatagttgtgggaggccgttggcattctgttgagggaggcccacgacgtgcgcgtgtaagacgcgtcgagggcgtggaccggaccaagcggatcgtggcgtgcaagcagcgtcgtgcatgtatgggcaccggtgttggcctgggtataagaactctcccttgtgtacgcttgtaagttgagccgagatgaagaaatacaagagac

SEQ ID NO: 38566 - DNA, 458 bp, Triticum aestivum
  Clone ID: PAT_TA_38566
gggacgctgttgattggtgaacgtatggtgtgtttctttaagaccttgtgctctggtaagacagtcttcagaggtcctgtgaatgatcatgcattgcaaaatgtcatttccgagaatctccggttcccggccttcccggttgtcatcaaccatgcctaggatctcatcagaggattgctagtcaaggacctggtcaacaggctgggaacattgagaggagccaccgcgatcatccatcaccctttctttgaacggttgaactggtccttgatacgatctgctgccccaacatagacaccgtcgtgccatgtcctgactcttgcgacggtccgccatactacagaaagcaaatgtctggacttcatgatctccgagtagcagtactttgaacttttctagataagtctttagtacatttagcacaatttcagctgatagtctacaatttttctgttgac

SEQ ID NO: 38567 - DNA, 120 bp, Triticum aestivum
  Clone ID: PAT_TA_38567
ggggtactgtcgaagttccgcgttggttcgctctccggcgtccgttcttctgttccggcgcttggtttcgctgtggtgcctcttgctggtgttggtttcgggacgccgttgggtctctgc

SEQ ID NO: 38568 - DNA, 343 bp, Triticum aestivum
  Clone ID: PAT_TA_38568
ttaacccaaccctcccccaaaccgaacccaaccggaaggaatccccccgcccctgaacggtatttccaattataagggcctaattgccttcttccctggtaaatttgatttcttccagatccgagactgaagtttcgtgattttgaattatactcagtgattgtaataatcgggatactgaggatgtttaccactgctcaagaaatataaaaaaggatgacacatattcttggttctgaatttttgaacatgcctgagcattcataagatgcaggaaccctatttgggttggctttggcttatgtcagctattgaacttactagcttataaaccagatcatgc

SEQ ID NO: 38569 - DNA, 430 bp, Triticum aestivum
  unsure (1)..(430): unsure at all n locations
  Clone ID: PAT_TA_38569
gggtcgacggggaagtagacgtcagagtccatgatgaagaagccagtagtcgcgcagaacgctccccaaaaaccttattacccttctcccgtacaggactcaaagcggtgtggtttcggaggcctactatcctgactcgtggtgcatgctgcaagccgggatgangaagacaacagtagctcagagaatggaaccggtggcgagaggaaggagaagttctggtgcatctctctgggaggaccgacctcncttttataggcgcaagagaaggaggcgagaagctgcgccgggagctgagctgaagggatcgagggagacgaaacgaagaggcagcagccgaagggtgctgcgttcgtattcaatatccactacagcaaaaactttctagctcccgagtggcctttcgtatacccgtagtgcatggcaaaaa

SEQ ID NO: 38570 - DNA, 349 bp, Triticum aestivum
  Clone ID: PAT_TA_38570
ccgttggttatagataaacttctagtcatcacacgacagttgattcatctggtgcgtcatatgctaattgcatcattgcctgctactcatatatagtcatccttgctttagacaccttgcgtgatatccatctatcaactgtacattaatatacagctcatagagcttcccctacatcttcgaggcgtaacacatatgctcatactgcggcacttccacatttttatcgtcatagtttgtgcgctagttcatcccttatatattttaaagcattgatgtcgatcgactattgattgactgatgatgtctcacgcttcacttagattattttgagactcctgcacaacat

SEQ ID NO: 38571 - DNA, 431 bp, Triticum aestivum
  unsure (1)..(431): unsure at all n locations
  Clone ID: PAT_TA_38571
cgggtcgacgggttgctgtagattaccttgattaggttgctgattgaaaccgccttgattgccttggccctgaaatccagagtttgaaccgccacctccaaagtcgggcccgtgagagcggatcctgacccgccatgcggtccgtgattgtcctgataaaaaccggaatttctgtattccctcatgatgaagcaatcttcccatagatgagtggccggcttatcttgagaaccgtgctttgggcaaggctggttcattatcgcctcaaggttgaacttgggcccgccaaaccggggcattgacgatttccccttacgacgctgattattattctgcgtgttggtattggccacaaagtccgaatcgccgtcggcttgcttgcgcttaacattattaccttgacncgccgtattgtgccgctgcccctttgc

SEQ ID NO: 38572 - DNA, 292 bp, Triticum aestivum
  Clone ID: PAT_TA_38572
gggacccgctccataccaaccaagaagatcaaccgcttcttcgccaaagggacgacggcggtgagcttgagcttgttgaggtaggaatcagctgccgtacagatcaagcgaatatgaaaagggaatgtgagcactgagcagtactgtgatcagagttgtcggttaactggtgtagatacatagcatgtatgtgttgagcgtgggcgattcgatgtacactgtctcacatgaagtccgtccacaatttgggttccattgagaaagattaaatttacatacttgcattgttggg

SEQ ID NO: 38573 - DNA, 424 bp, Triticum aestivum
  Clone ID: PAT_TA_38573
gcgaaggtttgcagatcaccgacaaggatcgaccatgagtgaaatcaacccgagtcagatcagttctacgttgaaggagaatagggtgaagaagtttatcttccgtgttaagtcacagcccctccaaccagacgtagccctttggcagaagggtgaactggtctaccaaatatatctgtctccatcaagcaccattggttctatttactctactgcatttccatcagcagtttattttcgtgctctgtgccgatagttttttcgattatttcattcaggttgttatcaacttgtgtttcaatgttcaccctgtttcactgttttcgtctgtattcatgtgttatcatcttgtccctaagattcacctgtgaaatccttccatacattgctatgtctcattctactacatttttttgcatgttgc

SEQ ID NO: 38574 - DNA, 162 bp, Triticum aestivum
  Clone ID: PAT_TA_38574
gggtcgaggcggatggcgacctatatgattgctacatttttttcttacgacaaaggatgaattttatttactcgctccatccatatatatagggcctaatatgtttttcgagattgcctttgactatcgataagattaatagtatatgagatgtataatgtg

SEQ ID NO: 38575 - DNA, 383 bp, Triticum aestivum
  Clone ID: PAT_TA_38575
ggggtggtttatcagatggggtcagccaatgtgatagcaggacctgaatcacccaccttaaaggtggtcgtggtagactatgtgtattcattcttgaggaggaacttggcagagggtcacaaggtgttgtccattcctaaagatgagctgctcaaagttgggatcacatatgagatatagagatgttttttttttgtttttttttttttttgaaacggaacacagattgcattcctcctacatatcattgctgggcaaatccccagctacaaggttctgaacaaactctgggaattgtcccaaccaagtaatacatgcaccagagtttaatgttgctccgaaaaaataaaatccatttaaaacaaaaaaaaagcggccgctct

SEQ ID NO: 38576 - DNA, 361 bp, Triticum aestivum
  Clone ID: PAT_TA_38576
ggcgagcacttaggtgaaggcatacttcgttgactgaggaagtgtataaagatgttgtctgacggtggttgtatatcaatctttgcttgctaaacttccgagttccactgggtcacgtttcatgcacatgtagtcggtggggaattacttaccatcatctactagtgagccttgattacagcatatgtttcgcgacgtacggtctccaaatagatgcagctccctactatcaggtagcggcaactcagtttacatcaggcggtcagttacccatcagttattgggtgctgataacctgacatctggatctcacgcaggataataatgcgtagggtgaccctgagacaatattcccctggat

SEQ ID NO: 38577 - DNA, 454 bp, Triticum aestivum
  Clone ID: PAT_TA_38577
gggctactgacatatataatcatcaaattttctcacccgtatgtcttttacatattgctctgtggctctggctagaccattttgagcggcacggaggtacgcatctcccgtattgaaggcatccaatgcctcttgggagaaacaagcatcacgaagaattgtccggcgacgcctgtggttcatggaactctccacctcggaattggtggcagacagcccgtccgcatcctctgtcagaggagcgtccggtgcatgcctcgtgttcgtctccgcttctggacccggccttggagcctggctggtggaggcgcggttggcaacctctccggatgtagtccggcgagcgctctttttcctaaaaaaagcacgggcgttagcatgccttgaaggaataaaacctgggaataaaacggcacgccatactgttgtgtccgcatctcaatccggaccgcac

SEQ ID NO: 38578 - DNA, 397 bp, Triticum aestivum
  unsure (1)..(397): unsure at all n locations
  Clone ID: PAT_TA_38578
cgggtcgacggggttcaagacgaaagtgcggtctccggcgaggaagagtagaacatgggagacggaccagccagttggcacaccatgcccagccgcctcccatgccctactcatcctcgaaggagtccccaaccttagcagtgccggacattggacggcggcaagtaggacgcgtggctgacggtgctcctgtcctcggccgccatcgtgtccactgtttggcagtcgcgtccgcgtctggctacgctgctattgcatcgcgagcgacgacttgagcgagggcagcgtcctcgagcttcatccccgaagacaaagctctcctgtagagcgttcacgctcgcggtcatggcggatgtggtgccaggtagcaggacgatgcgctatgggggaaaaanaa

SEQ ID NO: 38579 - DNA, 303 bp, Triticum aestivum
  Clone ID: PAT_TA_38579
ggggacgtaaatgaagataaatggcagtggctgtacacacagatgaacgttcgtgcggtagggcgctcggagactcaagaactgctccgcgtccatcctcgacatcaccggttgtgtcaccagcaatgaccggctgattgtatcgctgactggaactgcatgcacccatgggatacgcaagcgagtatgacactgggaacacacgctaataataatctgctggaggtagctactcacatctgttacacgagacatgctagatgaccatgtaaacgtatccgtgggcaatatcctgatgctgga

SEQ ID NO: 38580 - DNA, 223 bp, Triticum aestivum
  Clone ID: PAT_TA_38580
gatgggcaacggtagaatgtgtcggcggccttcttaaggttttggcacttggtgatttggtgcagtcgattatgtggtcatcgatggcattaatttaagccccaagtttgtgtccctgaacggctagcgttccttggcctctcataattgaggttgcgaaacctttttcttgaatccggttgcccaatgggatcaaaactgatgtaagcttacgtgtcacata

SEQ ID NO: 38581 - DNA, 280 bp, Triticum aestivum
  Clone ID: PAT_TA_38581
agctaattgagatgagggagaagaagggcggacgcggcattaatctggggaagatagcaggagctgaagctggcgcgatgcagcgttggcatgaggcggagcgcggacggcggcagagagcgacatcgtccagcttcaaagctgagctcctcgagctgatctagggtgggggataagaaccactcgtcgaacttgggttggaccttgcagttggtactgaacatgcggatgtcaaggcctctggctggcccaggggaaaaacaaagaggcccgcaccgat

SEQ ID NO: 38582 - DNA, 421 bp, Triticum aestivum
  Clone ID: PAT_TA_38582
cgggtacctgcacaagtgtcaaaggctttgaggtcgttcctgatcgatcgaattctcagcaaaggatacctacaagcctacagcattactagtactagcatccatgtgatgcacatgcatgctgcatatatatgcatgaactttcaactggagataactcagatgacatgcatgcaggttgcatacatggaacttgagatagggaaaatgtttcgtgttttcttctgagtctatgtttttttcttctgcgtttatgtactcggtttccttacggccatgctcgaaactttttcaaggggagaccgggctcccataactcttttctggaccgtccttttcctgctgggctctttcggccgtctgaggacacttgctggacataaggccttcaagataatattctctgtgcagtgggcctggt

SEQ ID NO: 38583 - DNA, 399 bp, Triticum aestivum
  Clone ID: PAT_TA_38583
gggtaacactgttagacgacgatttgactgacgtacgtttcgatgctgaattttcagtatctctctgcatgctcactaaatacgtccacaacagcatgctgacacgcgctatgacgtgttacattatattacatgagtctcgattagtatcatctgtctagaggagtatgattcacttgtcatacactgccatcctgcccattaaggagtagttgatgcaaatatatatgacggcatatgctcgaacgaataaggatgctgacgctaagtaagatgattacacaacttcaaccaattagtactaaatgcagtaacatgcaccaatcatggccaattgatttggacacacacagtgacaaattggtcgaagttgaacatcgacttgactaaaccacatca

SEQ ID NO: 38584 - DNA, 374 bp, Triticum aestivum
  unsure (1)..(374): unsure at all n locations
  Clone ID: PAT_TA_38584
agctccctctacgacggggattgcaaatgcatggccgcagtctccaagatcctttcatcgtaccctgggccagccagacgccttgacatccgcatgttcattaccaactgcaaggtctaagccaagtacggcgagtggttcttatcgccctcccttgatcaactcgaggagctcagctttgaagctggatgatgtcgctctctgccgccatccgcgctccgcctcacgccaacgctgcaccgcgccagcttcagctcctgctatcttcnccagccgcgcctgtccttcttctccctcaactcaagcagctcgacctcttcgacattggcatctcgaagcaggctatggagcacctgctccgcaactgtactatg

SEQ ID NO: 38585 - DNA, 453 bp, Triticum aestivum
  Clone ID: PAT_TA_38585
cgggtcgaccggtcacggtaactgcgacgagctcattgtatgccaatctcacattgcatggtacgatctatgtaagataaaaacaaataacagacacaatacattagtggaaatagcataaaataacaaaaagaatgtactgtcagaaggttcatataaattgttaccgctgcaaaaacaaaagaaggctggaagtagatgccgaacagcgtggcagtagaaaggctggtccggcaccgtgagttgcagcatccacattgtgcttcctccattctacacagaacgtgttgaactctaagttgaattgtacatagtacaatacacagatcatacatataatacatcatagtgataacctatactggcaatacccaatcaatctattttctatcatctacgtaatacaacaatgccaatgacaatggcaatgcccgtctaatctaaacctgggaa

SEQ ID NO: 38586 - DNA, 242 bp, Triticum aestivum
  Clone ID: PAT_TA_38586
cgggtcgacgcggaggcgagagcgtaacctcagtcaatcgtgggttcgttctcgtggctcggtcaccacagtagtcgtgaaatacatcagctactactgatgtcatcggtgatgtgcatgactaattagtgacaaataatgtggcggaagtcactaatgaactcaatcgactttgataacttagtaccctattcatttacacctgttcatactgttcaagccatacccactaactgttcact

SEQ ID NO: 38587 - DNA, 239 bp, Triticum aestivum
  Clone ID: PAT_TA_38587
gacgggaaggttaacaagctgattggcctgatagtgaagtggctgaaacccggtgggcatatcttcaccagggagtcctgcttccaccactctggggattcgaagaggaatgtgaacccgactcactactaggagccacggttttacaacaacgtgtctatggaatgccactcctatgaacgtgatgggacttccttcgagccttacccggtactttccatgtgcatttgagtttatgt

SEQ ID NO: 38588 - DNA, 321 bp, Triticum aestivum
  Clone ID: PAT_TA_38588
acgggacaactagtgtctcggagggcacgttgcgcctcaagtgcttcagtatcacgtcgctgttgttgttgacggagagcatcagtgtcttgcccgtcttggtgttggcatgctcgctcttcctcttattggcatatgcatttccgttcttgtgcttgccaaacgtagcttgattttggcgatgtcgatgttctttctcttcaggttgctcttgtgtagcattgccatgtagagaagtgcactttggttgatggtcttggcatgctgctcgacgtatatgttggtgtgcttgatccagatatggtgttatcggacatgttg

SEQ ID NO: 38589 - DNA, 327 bp, Triticum aestivum
  Clone ID: PAT_TA_38589
cctgcattgcatcttccatgatgagaacgagtctgagcaggtcgaggagcaagatcttcatcggctggtgcacgcaccatggcccatcggtatcgatatcggtgtgacagtccttgggcgcacaatcgacatattggagaggaagtgtgatgagcattttgccatccatcaggcagaagactcaaagctgctcggctgcatgattgacgactcacccgaagagtcgccgtcactagtgctcattgagagcctgatgcccctcaaggaatgggcagaggacctctacgattcagtcatgacacagccagcctgcggcttcatcattgc

SEQ ID NO: 38590 - DNA, 336 bp, Triticum aestivum
  Clone ID: PAT_TA_38590
gactgaaactccagcaactcctcttaacacgacgcacctacggatgccttgacgcgtcatcgctagctgctccgtttgcatgttgccaccacgccggctcatcttcgcgaacattgattgagacgagagtcccttagtatgtgcttctccgtctacacaaggttgcacctgcatcgcctgtggtcatcatcgctgacaactacatcgcctcccagcattgtcgccgccaccaccgctcatggtcttggttaatgccaacgggttcttcttcgcagccactagcgctgccatgcgactacatgtggatgactcatgtttaatccgccacatcgagta

SEQ ID NO: 38591 - DNA, 417 bp, Triticum aestivum
  unsure (1)..(417): unsure at all n locations
  Clone ID: PAT_TA_38591
cgggtcgacgcggtcgtgatgtattagtgataatattcgacgatgtactgacgcatgagatgatttacttttgcttattgaatgcatgctaatttgagtcctataagatattgtgaaatgtatatcttgtgttgctcaatatccaagtggccgttcatgtttgcaggttacaccttcgagtggcctatgttttgccggagtgttgattcatttccgttccggcaaatttcaggcgctcgatatgtcctattttagcaaaggtcatgtcggatttttccatgaattttggcatgacttgtgtcagaatatgtaggaaatatcgagtgccctggatttgtttgagtatcttggtagttgtcttcgattgattttcaattaatgttttaactatgaacatangaaatgtctgacgacgag

SEQ ID NO: 38592 - DNA, 424 bp, Triticum aestivum
  unsure (1)..(424): unsure at all n locations
  Clone ID: PAT_TA_38592
cgggtcggccgggtgacggctcaagagcggacggacgcggtgcctccggcgacaagtccgacgacgacgaatgacctccgtaagatactgctgactgcaacatgaacacgaaccgtcggaggagccgtagtccagttgaagtccacgatgaccactctaaagggagtgacggttatggacggaaagagaacatgagagatctacagaatgatagtcatgccagaccaggcagaggtcatgaacttgtcaggcattctgatatgcatgcctatggggcttcacgtgaatccangatgcatgatgattataggacgtaccatgatgtacgtgctgatgatgaaaggagccctccttagaacttcccggccaaatcgggagtcaagggctgacacttactatgattcctcaaaccgtgatggcacat

SEQ ID NO: 38593 - DNA, 411 bp, Triticum aestivum
  Clone ID: PAT_TA_38593
cgggtcgaccggggtagagatcgcaacatagtctatcaattcaatgcccggggcagaaatacaaatggtagaggagggcagcgcactgggcgcggtcacaattcggtctaccgtcaggttgatgttggaggaggcaaaactttaaaccgcaagatactgagacagtgatcaagaagcgacagagtgaggagaatgattcttcagggtccaaagatgatagccgtgactcaaagaagaaacaggcagagaaggatgttgctaagactctggcggaggctgagcatcagccccgcggatcacaatgaatttcttttcatggaacaatcgcgggcttgggaacccggagacagttcgagaacttcatagccttatgaagatggaagggcccgccttggtcttcatgtgtgaaac

SEQ ID NO: 38594 - DNA, 181 bp, Triticum aestivum
  Clone ID: PAT_TA_38594
acaggctagattagcacatggtatagggggtcgtgtatagtttttgttgttctagcctttgatctgatttaacaactaggcttgggagtctagtgcgggatcatctgagttcgctcccgtgggaaatcaactccggagtcacgtctcggatgcatctgactgattttagatgggagagaat

SEQ ID NO: 38595 - DNA, 304 bp, Triticum aestivum
  Clone ID: PAT_TA_38595
gacgggaacatcaacttttctgaccgtttggagctgcggcctaaaccttcctgtaatccctggagcttcgtcagagccttttccttccccacaggccagagctcaatttaccttcgccagagctctaagataaggagaatcagctcaggataaaagggctcgcactcaattgatccgggtcaacacttcctgtatctggtttcggcttggttttgactccttgtaggggctcatgacagtcctgtaggggatacaaaagctttccgagcagtagcggcagctgggcgggagagttggttattca

SEQ ID NO: 38596 - DNA, 244 bp, Triticum aestivum
  Clone ID: PAT_TA_38596
gggctacgagaggacgacgagatcaacatagtgctgcggcgttgatggctgggctagctccatggtcaagcggctcgctgcattcttttccagaggttgtatatgtagaatatcagaaggagcacacatgggaagataggtcaacaggattgtggccgcccttccacagtccgatgctgattccttcttttaagactcgggaatctgaaataccaccgagaatgttttccgtttcctgtagttc

SEQ ID NO: 38597 - DNA, 316 bp, Triticum aestivum
  Clone ID: PAT_TA_38597
gacgggtcatactatattaagtctttcaagaattgcatcattgaccaatgctatgcttgtcaacttttaataaattttactatttgtacttttccgtatgtgatgtcattacttaccataagattagcctatgatatttctcattattttcttttagttggttgacataagaaagtatagaagcacaaactcatactaagccttattatataactctcactcgattacatagatagatagatcacgagactaagacttgacaatagatcagactaagcctttattcaacttgtgatgatcatcattattcattatt

SEQ ID NO: 38598 - DNA, 265 bp, Triticum aestivum
  Clone ID: PAT_TA_38598
acggggatgacaacggtgagagagagatagagcacggcagtgggaaactagctgtgtagggctcagccgtgggaagctatctatgtagggcacggtggcattgagatcccattcggcttcgtgctccatctctgcctcacgcttccgctaccattcgcagatgcagatcccggcgcgtgtgcacatgtccgtcgtcgtcggtctgctctgcccggcgggcgttgataggagcgttactcatccacggatgagccgtattcatccg

SEQ ID NO: 38599 - DNA, 384 bp, Triticum aestivum
  Clone ID: PAT_TA_38599
cgggcgtaatcagtatttccgggtgcactcatcgaccactgagttaggattgtgacaatcgctcgctccttgatcatatcgtattgccctgaaaagcaagattgttctcgagcttaataacagatcggtggtttgtgattttccggatatcttctctggaagtgttactatgttgtcagctgaccgctatgttgagttcgtgatcaagttggatttcctccaaaccacccttctccgtctgtcctgcttggtttgctcgtcgtcttagagggtgtgcgtgtgttcatgttggagtgtgatgtctgggcgcgtgcgtgtgtgtatgtataggtctcggtggtgtgggaggtgtccagtacgtgcgccagagtgccattccttgtg

SEQ ID NO: 38600 - DNA, 247 bp, Triticum aestivum
  Clone ID: PAT_TA_38600
gtgaattcagtcttaactgatgtatcagcagatagatcgactccacaattatcctatacttatgtatttcgaagttacattggtctggaccataagtaaggcaacgcagcatgtaagttaccgtgagaatgatctttatgtgagtggcatgttgatgatatgactatcttggatatgaccaataatattgcatttctgcctatttgtcaggtgatttctattgcgcacgattcgatactctatttat

SEQ ID NO: 38601 - DNA, 322 bp, Triticum aestivum
  Clone ID: PAT_TA_38601
ttcccgtcgacgggtgacatcactacagctattgacacccatgttgtacccactgaagaagtatccaatgatgactcattatctacacgcattctcaatgaaactacccttcaactatacacatttattgcaacatcaactcatataatcatctacatgtacataaaaacgatcaaaacacaattcataatgataataatgagaatgattagatctacattaaatattgctaatgctcatatatggacattgccacgatcagaaaagataataataccgatagcaaacataatgataaaaatacctccaacgagactggacc

SEQ ID NO: 38602 - DNA, 233 bp, Triticum aestivum
  Clone ID: PAT_TA_38602
acgggtaacactatcatctgactcgtatcagggttggtagattttttgttcctggaattcgccatcgaatttcggttttcttatgcaatgtgccaatgttgactatcccgttcaactgttcggcggtgacctgggaccgtagctcaattgcaagcggcactctgtttggtgattttgaagtaaatgctggtacaacagatgccggtttattaatcattcagtaggggtataca

SEQ ID NO: 38603 - DNA, 448 bp, Triticum aestivum
  Clone ID: PAT_TA_38603
cggtcctagaatcccgggtcgacccgagactccaacactgctcatttcatgtctttgccattgtagccggccatgaactacaacacattggcgggctcgctcacatgcaatgacggcggccgacccattgtacacaacaacgtctaggcatctccacgacacgtgcgaccgcctgtgttttgctttagacccgatggcacacctgataacaaattctttccaccacgacaagcaatcatacttggttttctccgatcgttttatgatgagacacaagtacatgggcttaagcaccttagattgattcttctcggtgtagttgtgtacgtatacaaaacctaatcacatatgtatacaaaacaccctgatcctttagattaaacatttcctttggctacacatcacgtccacatgagactatatttaatggcaataaggtgttggtcct

SEQ ID NO: 38604 - DNA, 363 bp, Triticum aestivum
  Clone ID: PAT_TA_38604
ttcgcgggtccacggggccttcgtagacgtgccgaccatgctccacaccaacgacatcaacatcggcgaccaactggaggttatcatcaacaggcggcatattaacatgatgcagcacatgctctagctcaagtattcgcaccttatctcgatctccgccttcaaaaacccctgcgccaattccatcatactccaggcacctgtctctctgacacagtctgcactcgatgatgattatctacgtagattaaggcatcgacgtatacccaaggatcgtattcgacgactacatgttcctgtacatgcgccaaatctacgaggccaaagttacactgttcacagccaagtacgtaaatgccgcat

SEQ ID NO: 38605 - DNA, 293 bp, Triticum aestivum
  Clone ID: PAT_TA_38605
acggggctaacgtagacgtgtcgaccaagttctacaccatcgtcatcaacatcggtaaccaactggaagttatcatcaacaggctgtatatataacatgttgcattacatgctctagctcaagtattccaaccttatctcgatctccgcattcaaaaaaccctgcgacaattccatcatattccaggcaccttgtgctcctgagcacttctgcactccagatatgatttacgtatattaaggcatcgacgtataaccaaggatcgtattcgccgaatacatgattcctgtaca

SEQ ID NO: 38606 - DNA, 317 bp, Triticum aestivum
  Clone ID: PAT_TA_38606
tcaatgtaacccgtgaagaacatgtgtgtcttaacttcactatgggagacagtatctagccatgcattttgatgacttgtatcggccattcactattgcatctccggcatatacattatcattcttcaccactgtcgtctctcttattgcgtttgtagagcacactttccacgttcaagctttccattaccatctacaccaataaatgtaacaccaatagtacttgaacagttaatccatgttcaatacgacttctaaattaactgtgcacatctttggggtatactgagaacctccttgtgaagcagcattatgta

SEQ ID NO: 38607 - DNA, 423 bp, Triticum aestivum
  unsure (1)..(423): unsure at all n locations
  Clone ID: PAT_TA_38607
aactaaccaaacgatgaagaaagaagacataccttcgagcatgtcgtcaatcaccgagtagccatttgataggtgcttctccctgtcgggccagctcgagtgctgggactcgaacttggccttgagctgctcctcctcggccttcagaagccagacctgctccatgtgccgggttgcttggtccgccagctccgtctcgagccggtcgcgcgccatggctgcctggctgcattccagctccttagcctggagttggctctcgagctcatgcacgcgggtcctcagccgggcggcgacctctgcaaaagcaagcaagaatcatcaacatctacatcagcgaaaacaagaagctttcagagaagattctgcctgactactcaacagtcggcccgaatctcggngggctacaccagttggtgcgct

SEQ ID NO: 38608 - DNA, 371 bp, Triticum aestivum
  Clone ID: PAT_TA_38608
attcgccggtcgacgggagacatgatcgcacgtagtgatgttgctataaccagtgacagtaagtagcagtttgctcgcggtacatctcaacagtagcaatttgaaccttgtcatgaatgtcacaaagtcagcgtcgagttgcgtcactgggacaatatcaactactcacatttgggaatcatagacttggaactaatgcagatcataaattacgatgtgtcgcgcatacgttgtgaatgtccatcagcttgaatatgatgctgtggaaggcctaccaagtgtgcctgacatcaaatcgactattggtgtgattaacatctatcccggctcatgtaccagcagtttataacatttagttaccatatgttttt

SEQ ID NO: 38609 - DNA, 286 bp, Triticum aestivum
  Clone ID: PAT_TA_38609
tcggtatgatgaatgctacaccaggatcaggacggtgaatgttagcgctattcgtgataattgtattagcatgtttggctttcgcatgtattctgatcgaatgtggtcttctcccgacggctgcttcacgtgtgctcaccaacgaagttcaatgctagcatgtcgtgtgaagtggctcgcacagcgacaatccgatggtgctgcataagactcggcaagacctatcatatgctgaagtctttcagtactgtcacagattgggtcaggtgaatcagccggtcgctct

SEQ ID NO: 38610 - DNA, 445 bp, Triticum aestivum
  unsure (1)..(445): unsure at all n locations
  Clone ID: PAT_TA_38610
cctgcctgtaccggcacgagattcncgagtccacttcggtacattgcgccaagggcgaatcaccgggcaccaccgcaataaaccggtccaggtataaaggcgtgaatgccagggacgaaccttcggatggctcgaacgccacgcccagctccacttggcgatcgcggaccatttccagcacctgttcattgatcaggtcatgcaccgtcacattcacctgcgggtaacgtgcgcggaatatcttaagaatcggtggcagcaggttgcccgcaaacgaaggcatcgccgccacggtgacgcggccacgctgcagggtgaaacgctgacgcagttcgtcttcggcattgtcncagtcggcaatcaaccggcgcgccaacggcagcagcgattcaccttcaggcgtcagtgcgacgttgcgggtattgcggctgaacaggcggccgct

SEQ ID NO: 38611 - DNA, 363 bp, Triticum aestivum
  Clone ID: PAT_TA_38611
tccgagtccacggggtaccgcgaatgattcatcatactgaggaaatttagtctggcatcaaattttatatggtctgatgctcagacaccaatggaattgttcaaatcttacccagtggtgatcattgtaggctccatttgttatcaaaatacgctaattagtgcgtgctcatacaccaaaggaacagttcaagtcttgtcgcctgctcagtcaatcgtgagttacagtaaaagctataaatgtctagctttgagctcagtttagttttgaaatgcataattagcttttacattacatgtttgaaaggtttctcttctaatttatacttaaataaaattggagaaattctcatctcgctaaaaa

SEQ ID NO: 38612 - DNA, 459 bp, Triticum aestivum
  unsure (1)..(459): unsure at all n locations
  Clone ID: PAT_TA_38612
cggtccgaanattccgggtccacgggtccggatatcttgtggagctcggcccactgggccatctgttcgttcagcaacagtggacactttggcgtgctgaattgcgaccagaaaagcttctctgttgcatgcccttctttcgcttggaaaaaccgcgcctcatcagagacactcttcggcaagtccaagaatgcatctggagaactccacttttgattaagcggggcatacttcggatcaacgaatttagtctgtaataagaaaggcttaccggccgctatctccccagcttgccggatcttctctcgagccgccctagacacggatcatgcttctctcgcctcttgtaaggccttgtcgagatcgacctttttggctttgttatccttctcgaggaattcgcaccggacagtggcttccttttgctcgcgcgccatggtagacattctctcctcgcac

SEQ ID NO: 38613 - DNA, 351 bp, Triticum aestivum
  Clone ID: PAT_TA_38613
gtcacgggatgaccgcaatgttctcctacacccttatcctgcagctgctagccacgctccaaatctacgcagtgccattcatgacttttgtcacaacaactaagatcttcacgtacatttgtcgctccttttagatcctgccaacaatcagttctgacatctattattctgacaattcttctataaatattattttcatgccacaattcaacttcgcgcttcgtagaagtggtgcgccattaaatagctcaactactaacgtcgcaccacaccaacggtgcgctataataacttgtgcaccacgttcctagtgtaacaccgtggatgtggtgcgccattccttttcgctca

SEQ ID NO: 38614 - DNA, 161 bp, Triticum aestivum
  Clone ID: PAT_TA_38614
ctgtaccctgcagtacggtcgaaagctccgggtcgacagggtatgacggctactggcaccttttaatagacactcacatgatttcaaaattattgacatactctaatgtacatcagcgtaataacttcatgatacgaaaaagtgtattgtgttactgatgt

SEQ ID NO: 38615 - DNA, 422 bp, Triticum aestivum
  Clone ID: PAT_TA_38615
gggtcgacggggatagtaaatgttatcgacacccgtacgaggagaattttgaggggagcagtgaggaagggacacctagtaagagcaaattccaattgaaactcagagatctccggagaagcacttcctcgtttgctttattggacaggaattatctcactcccatttttacctctcaacacgaggacgatgatgacgatgacgacaacgacgatgattcttgtgaagtgttggcgatacccaggcccagcgcctagatgttgggaaggctatagctaatgactgcaagcacaaagtgaccggtttttggcggatttacacgaagaagctctcagggctggtaccagttctgggttcgtcggagttttgacaaaaactgttctgtctgcgttgagataagctcttctgatttcttctgatgc

SEQ ID NO: 38616 - DNA, 288 bp, Triticum aestivum
  Clone ID: PAT_TA_38616
ttcccgaggtcacgggcaactgcgaattgtttaatccgatctattagaaaaaatagagagaagaccatgacccgaagagggacgtggacgttggcacgttttctatccgcggtttccatcctgggccaagctggccttggatcgcctccgctgtagaagagccgccgtagagattgatgtggtcagattgccccaacgaagttactggtgttacaactactaccatcagtactgctgctatgtgcaaagctccatgcatgatttccaaacttgaattaagcttttttc

SEQ ID NO: 38617 - DNA, 119 bp, Triticum aestivum
  Clone ID: PAT_TA_38617
gtgaggaagccggcgggaggttcacgtacgggagagaagcgacggagttaggagttgtaaatatgcattgttgtatcgcgacctgaatgaatggaataaacgaaataacgctgttgttc

SEQ ID NO: 38618 - DNA, 442 bp, Triticum aestivum
  Clone ID: PAT_TA_38618
gggtccacagggatggtccgcctacgcagctcggacggtcaggagctcgaggtgatggaggaggcgatcgccgccgcgtctaagacgatcaaggacgcgctggagaagggcggcgccgccgacgacgccatcccggtccccgacgtcaccggccgagtcctctcccgcgtcctcgagtacgtcagcaggcacttctccgacccggccgcggccgccgacccgttcgactacatccccaacttcgacaacccgctcaaggccttcgacgacgccttcgtccaggtcgaccaggacacgctcttcgacctcatccacgcggccgagtgcctcgacattgaggggctgatggacctggcgtgtaagacggtggcggaccagatgaggggcaagaccatcgaggagatccgcaaaaagttccacgtcgtcaacgactacaccgcac

SEQ ID NO: 38619 - DNA, 365 bp, Triticum aestivum
  unsure (1)..(365): unsure at all n locations
  Clone ID: PAT_TA_38619
ttcccgagtccacgacggtggtgttggtgagcatgccgatctcgagcggcatgcagccctcgagggtgttgttgaggaagatgatctcgtcgagcgtcttggccatgcggccgatgctcttggggatgcatccgacgaacttgttgtttgcgaagacgacgacggaggcggtggagttgccgatggtctccgggatggggccgacgaagcggttgctgttgacgaagatggcgtcgtatggcttgtcgaagagcgcgggcggcagctcgccctcgaactcgttgaagcggatgtcgatgtacttgagcgtgggcatctcgaggcagacgtangggacagggccgacgaagcggttgttgctgacg

SEQ ID NO: 38620 - DNA, 301 bp, Triticum aestivum
  Clone ID: PAT_TA_38620
tggatgcacaggcgctacgaatccatgcttaatcgatatggatcccattggttcagcacgtttcgtactacatcttgatgatatttggcaggaaacattttgcgcaggtttacaacgtgaggaaactcttcaacacatctagagtatggaccattcacacgccattggtccatcatgcagtatccgcgcttgggactggaacttcagctcacccgtgcattataggcccgaccagtcagtacaatatcctaccataacacgtgacgacaccaccgggtcattactctaaccctttggttaa

SEQ ID NO: 38621 - DNA, 388 bp, Triticum aestivum
  Clone ID: PAT_TA_38621
ttcccgagtccacggggaggaggaggaggtagggaaggaggcttctctcggagacatcatcaacctcaagttggtggagagcggcgagaaggagcggctgatggagcttctccgggagcggctcgtagagtgcggctggagggatgacatgaaggctctctgcagggcttatgcaaggaaaaagggaagaaataatgtaacattagatgatcttattcatgttattactccaaaaggaagagcctcggtgcccgatgcggtgaaggcagagctgctgcagcgcatccgatcctttctcatgtcttcctcgctttggtagcccatgaatcacgccgatcggaaggcacgtgtaggaagcttgaagcatcgatcttgaacgcgtgacact

SEQ ID NO: 38622 - DNA, 303 bp, Triticum aestivum
  Clone ID: PAT_TA_38622
atagaaaattaccgtgggcgagatgctcgggattcacctgccgagcgatcacttcaatctgcagagcatcatactcatcgagtacctacaggaacggatcgtgatgcaatgcgctttcgtcaatgatatgcatgatagccaaatgcacctctacctatgcgtctagacgagacatactaggtacttgggattccttttgcagtagtaaatatatcgtcgcagcgagcgtattccaaaatatattaacggtacctcgagtcgcagaccaatgagcagtgcactgatacaatcatctcaaatatc

SEQ ID NO: 38623 - DNA, 452 bp, Triticum aestivum
  Clone ID: PAT_TA_38623
ggtcgacaggtatgtttcctaaccatagacatgtgttgtcattggatgaacgggatcacatcattaggagaattaatgatgtgatggacatgacccatcccttagcttagcattaagatcactacagtttcattgctactgttttcttcatgcttatacatgttcctcggactatgagatcatgcaactcccgaataccggaggaacaccttgtgtgctatcaaacgtcgcaacgtaaatgggtgattataaagatgctccataggtgtctccgaaggtgtttgttgggttggcatagatcgagattaggatttgtcactccgtgtttcggagaggtatctctgggcccgctcgctaatactcatcactataagccttgcaagcattgtgactaatgagttagttttgggatgaagtattacggaccgagtaaagagacttgccggtaacga

SEQ ID NO: 38624 - DNA, 441 bp, Triticum aestivum
  Clone ID: PAT_TA_38624
gggtcgacaggtatatggagcaagcatcaagggatgagtaagagctcttcagaggtataagacgataaaataaccttgatgtccgtgagatggcagttgcaaatcaaattacgagcggctatgaacgcccgagtagcgattattaaatgagcaaaggtctaaggaatatgaagaaacttctatggattactacgatttgagagctgacaatggtgtaaatggacaaaaaataccagtgtaattcacaatttgacaagtggtgaagccaagtccaggtcaaagcaatcgaaaacagaaaatgttcagatttggttacaactatagatctggaaaatatttgaaaaagaaaagaaaaacctaggtatggtggagctgctaggtgaagaaacggcaatggagtccacttggtgcaacaagagggatctaaaacgtgatcaattt

SEQ ID NO: 38625 - DNA, 197 bp, Triticum aestivum
  Clone ID: PAT_TA_38625
acgggtcaacgaactcattggcgcaatgatgaaattgctacttgaaaattgttttagtatatggaagtaatgatattaatctcatgcaaattgggtgattatgacctgatacaaagcatgggttgaagtttgcacgtcccgttacaggcacgtgtcgataaagttgtgtcacataattagtgcatgaagtgctacca

SEQ ID NO: 38626 - DNA, 182 bp, Triticum aestivum
  Clone ID: PAT_TA_38626
ttcccgaggtcacctgaccctgataaacgcgacagttaacgctgcatacattgttgatttcacgtgtttttctacaaatttttcaagtgacgctcatcttgtttaccggtgagatgtctatattacacggtcttgggaatgggacgtgatttaaaatttgtatctaagttcaaggaaaatct

SEQ ID NO: 38627 - DNA, 387 bp, Triticum aestivum
  unsure (1)..(387): unsure at all n locations
  Clone ID: PAT_TA_38627
cgggtatcggcaaaggggtgcgagagtgagagtgtgagtgagggccggatgatacgccatgggacggaggcacgttcaagcttaccttgcagtttacagaagattaccccaacaagccgccaactgttcgttttgtctctaggatgtttcacccaaatatttatgcagatgggagcatctgcttggatattctacagaaccagtggagccctatatatgacgttgctgccatattgacttctattcagtccttgctgtgtgatccaaaccccaactctccagcaaattcggaagctgccagaatgttcagcgagaacaagcgagagtacaaccgcaaagtccgcgagatcgtggagcagagctggactgctgactaaggcanggcga

SEQ ID NO: 38628 - DNA, 343 bp, Triticum aestivum
  Clone ID: PAT_TA_38628
ccacgggactccgcaagaggagggatggcaggctcgacgaattcgtccaggtcgatcccgtcagcaatccgagtggcggcagcaatgaaagtctccatgaatgactggaagtcgtgcctcttggtcttagcaactttaatagcctcctcctccactcccgacccggcgaccaaccccgcgatccggcgagcccgagatggggttcctggcgacctccgccatcttcttcctcgccggcttcatcgcatgcctcttctcgctcctctgctgcaaccgcggcgcctccaccaacatattccatttgaccctggtcatttacgctacagtttgttgttggatgatg

SEQ ID NO: 38629 - DNA, 199 bp, Triticum aestivum
  Clone ID: PAT_TA_38629
cgggactcgagtaaagttgcgtggccaagttcttgttttcaaaaggtttccatataggcgttcagtgtcatgacgttgggaataaaagtctattgctgttcttattaatgcgacgacactagtgtagtatgttgtcaccacgctgcatcagagcgtggtgagtgttgtatgttgtcggtcaggcaaaaaggagatgggg

SEQ ID NO: 38630 - DNA, 449 bp, Triticum aestivum
  Clone ID: PAT_TA_38630
cccgggtccaaggcgatcacagtgttgaattttggatttagttcactattttgacctggtgaacgagctatttcattgaatcgagatatttcattttgtgtttgattcccattttttagtgggtcaactatttgtcatatagtaaattgctagcaacgagcatgtaaaaacacattactcccgagcatcatctctccgtctaaaaaagaagtggcaagctaatatttcaaaatttgattcacatcgacttggtaaggtatacatggatgctcgttctcccaaattttgaatgatctgttaaacatcctctgctcggtggaattcactcgagcaaataaatgggagacgcaaaattaccgtcctatgtgggacacgcatcaattggcccgttctacatcgagggtaggttcgtaacttcatccaaccgcgccttctcctcggccgaaatg

SEQ ID NO: 38631 - DNA, 396 bp, Triticum aestivum
  Clone ID: PAT_TA_38631
gggtcgacagggttcctggatctaggcgaaatggaacacttacgaagctgtcaataattctgcaacaaaacatcactggatatttcgtcgctcgagggggttcaagatgatcaaagcgtacatgccattccataccgcgtcagaaaacgtcaagcaggtcaattcactgcacgtcactggacaacgtattatacgctaaagacggggagatacctatcttaacccatctggaacacattgcaggttacccacctttcgtcatacggcttaacgccgaacaggtctccattgctaacatttccgaaaagttaatgaccaaaatgacccactgtgaagcgccccattaccggccatgaatctcatcggtattcacagttacaccaagggtcatcacaa

SEQ ID NO: 38632 - DNA, 446 bp, Triticum aestivum
  unsure (1)..(446): unsure at all n locations
  Clone ID: PAT_TA_38632
cgggtctccattcttctggggacatcagagacgtcaaaaacttatacacattgtgtacactcataaacacattagacccttaacctataagtcttcaatacaccaaaatcaccaaggggcactagatgcacttacaagtcacccggggattcatggatggatatacactttggaccagacacgatgaagagccagtcatggatggatatacccagggctgcgacatgccaaatcccgatcagagtcacatggatgttgaatctaacatcagggctgcggcatcaagctaccaatagaataccgaaaagacaaaaaccccactggaaaaccaagacggcgatgcagaaaatgacgacgacgaccttgatatgccagattttgttgctatgattgctgatttgcagggcccaaaaaaagatatggttgggtacaangacctgccatcc

SEQ ID NO: 38633 - DNA, 386 bp, Triticum aestivum
  Clone ID: PAT_TA_38633
gggtcgaccggaacgattaattaaatccagcacgcagacctgcatcacgacagacagcgagcataggaaggggacgcccatttacatttacatatatagccctgctgctcctggcccctttccccagttccatcccattattggttcttgcgaggatggggcggagaaacggaagcatgaagcggagaggagatcaggcagcccttcatgcacagagggcggcgagggagggcgcgatggcgtccaagaggatacagaaggtgctcaaggatctgcagtaggatccccccacctcatgcagtgcaggtcatgtgggtgaacatatgttccactggcacgcaacaataatgggcccatctgacagcccatattctggtggacttttc

SEQ ID NO: 38634 - DNA, 169 bp, Triticum aestivum
  Clone ID: PAT_TA_38634
taccggtcctaagatcgcgggacgtatgtgacatcacaagcaacgagctgggcacggtgatgctgtcgctggggcagcgcccgtcagaagaggagctgcgggagatgatcgcggacgtggacaccgacggcaacggcgtcgtggaattctccgagttcctgaacctcct

SEQ ID NO: 38635 - DNA, 429 bp, Triticum aestivum
  Clone ID: PAT_TA_38635
ggggccacgggtatttttaaatatcacatgatatgtgttttgcctggagcgtcaattgatttcctttgtgttgcttgttgtttgaataaagataccaagatctgaaattgttgaatgggagagtcttcacgggggttgcctacttaattgactactcattgatctttacttatcatctttcggaatagtttgttgtttgctcaaatgattcacttatatcttttacagcacggcgggggatttagtttaaggaaatggatgaactctcatgcttcacttatatatcttctagagtcctgaacagcatggtgatttgctttgggtatgaatttagtcccaatatgatgggcatcgaagatggatataataaacgactttcatatagagtgagttgaaaacgacagaagtttgattccttatgattgtttt

SEQ ID NO: 38636 - DNA, 138 bp, Triticum aestivum
  Clone ID: PAT_TA_38636
cataccgagaggttgctgtcatccgtagacatgaggtcttcttcatatgcttgagcttaaaattgattgaatcttaccaatgtactaacgtgcagcatgtcataccaaagtgattgtcttggaaataacaatttacat

SEQ ID NO: 38637 - DNA, 238 bp, Triticum aestivum
  unsure (1)..(238): unsure at all n locations
  Clone ID: PAT_TA_38637
cgcctgcaacgtacggtcgtaaattcncggggccaccgacggtaacacgacactgctccacttcgtggttcatgagatcatccggtcaggaggcttcaactccgacaagacagggaacgttcctgacactgtaaatcccagggtcgaacagttcaagaaggatagcctcaccgtgcttgcaaggctcagcaatgttccctcacacatggggaaagaatgtacacagagaatggcgaca

SEQ ID NO: 38638 - DNA, 323 bp, Triticum aestivum
  Clone ID: PAT_TA_38638
gataaagtatagtttaggatttaaagtcatctgatcagaaaatgtaggattcatatgctatcaaacggttcaatcttcatgttccaagtaaagtggtcataagacttttaaactgtgtttattgtcctattgatgtatatgggtaaatttaagtctagagttaaggatcataggttatgtaaatttatctattgtctcaaaagtgctaaactacagatgctagataagtagcgagctttggggcgtatctaatgtcgaggaacatagtaaagatgtcatttgcacaagaagacacacaccaatctcaagttcagtttgcacat

SEQ ID NO: 38639 - DNA, 203 bp, Triticum aestivum
  Clone ID: PAT_TA_38639
atgtaacctaagcgcgtccgtgaggatgagccgttatggatgggcttcaccaggatcagcatttgtgatgacaacatgtcctcgggggagcactttctgaacttccatgtgagccttcgccaactcttcagggtttttcatgagctccgacataggccacaccaaagtggtcgatgaggattcactaccaggctccaaagtat

SEQ ID NO: 38640 - DNA, 348 bp, Triticum aestivum
  Clone ID: PAT_TA_38640
cgacggggttgacgcaagtgcgacgtataatctgatgacatgcttgctcatcatcatgatcctgtttgacaactttacttcgtatagtacattgaaacatgaactcagcaagtgcaacaccacacagtgatcaaattcggcctggggcaaaggtatctcgggaagaattgtactcagctttcggtcataatcgatagccgctagtggcatggcaacattgacaaggacatcagcacttcaagttgagtgccatcaagtaaatgacagtgtacaattgcttcagtagatggtaaaactctgcgtctcagtgatgacggatttgggcacagtccatttggtaatttaagt

SEQ ID NO: 38641 - DNA, 120 bp, Triticum aestivum
  Clone ID: PAT_TA_38641
caaatcgacagtagcatccgttttccccacaaatacagtatatattatagaggattatgtttttaggagtcacgttcatttggtacacccaagttacacattcgtgacattttctacccc

SEQ ID NO: 38642 - DNA, 248 bp, Triticum aestivum
  Clone ID: PAT_TA_38642
ccggggtcgaccggcaagacgaacgactctacggagggcggcggcatacaagaggggccggaagaacggcaagaagagcgtggacacctacacgatctacatcttcaaggtgctgaatcatgtgcaccccgacatcggtatctcctccaaggccatgtccatcatgaactccttcatcaacgacatcttctataagccccccggctaagccgccaaactcgcccgctacatcatcaaccccaccatta

SEQ ID NO: 38643 - DNA, 159 bp, Triticum aestivum
  Clone ID: PAT_TA_38643
tcggcgagttgtagttcacgtgttgtgaatcaatagcagtgtgatgatttccattactacagcattgtcccatgtgacgaaaggatgatggagactatgattccccaccaagttgggatgagacgccgaaaaaagaatcatcgttattaaaattaaact

SEQ ID NO: 38644 - DNA, 367 bp, Triticum aestivum
  Clone ID: PAT_TA_38644
ggggagcacggccgaaatcccggcgaggctgcggcggcggttgaagtcctcctgcacggaccgggggacaaggaggcgctcgatgccgtggataacaccttcgggcctgagcacggcgtcggggcccttgacggcggcgtggccaacgcgcatggttccgttggcgccggcggcgacctcgacgtcctcgccggaaagcgtggggtgggaggccgcgggccaggaccccgccgggtggcgcgccgggaggacgtggtagaggagcagcgtctggaacgacttgaggttgcggggctcgagcaagaagcgcttgaactccgggtcgatgtcccgctccagcgcctcgttccggggccccaagattgtg

SEQ ID NO: 38645 - DNA, 476 bp, Triticum aestivum
  unsure (1)..(476): unsure at all n locations
  Clone ID: PAT_TA_38645
cctgcccgtacggtcgaaattcacgggtccacgggcacngctgcaagaaacgagctgaactgcataggttttgccatacgatgtcggaaaaaaacgtataatatatcaacggattcagcacgaaaatccgcatccgatggagacagcctacgacctgtttggaattttttagaatcgtcaaattcgaacaggaaaaaaagatatggtcaaatttcagttttttaaaaaaaaaattggttaaatttggtcaaactacttattcaagaagtattaatgtgactacataattattcaagaatatgagtgttactaaataattatttcaattttgtgaattttggtcaaactatggtcaaactatgcgtcaagcgtattcaagacatattagcgttactaaataactaacaattttttaaaataacagtttcaaactcacaacgtgaaatgtgtgacttcatgctcaagctaaactcctg

SEQ ID NO: 38646 - DNA, 216 bp, Triticum aestivum
  Clone ID: PAT_TA_38646
tcatgcaactacctactccggatcccgatccagcctcagcttcacctgacgccggccctaattttgtgtgatcaaatttttgctactagtactaactattgatgatcactgttgcaccatttatttagtttatagcgtcacaactttccactgtctcttttcattctctaccttgttatcgatcgtcggctccagctctatcgaacgatccatgca

SEQ ID NO: 38647 - DNA, 395 bp, Triticum aestivum
  Clone ID: PAT_TA_38647
cacgggaaattcattaaatggataaatgcatttgccatgttatgggtacttaaaagaaaaaaaaaaaaaaaaaaaaaaaaaataaaaaaaaacataaacaagaaaaaaaaaattgaaaaaaaaaaaaaaaaaaaaaaaaaaaaagggggccgcccaaaaggttcaaacctaagttacccttgaaggcaatgtaaaaccccttcaaaattgccaccaaatttaattcaatggccgttcttttaaaaactcctaaacgggaaaaaccttgggttaaccaaattaaacccctttgaagaaaatccccttttcacaattggggtaaataccaaaaaggcccaaacgaattgcctttccaacaatttgccaaccctaaatggcaaagggaacgccccctg

SEQ ID NO: 38648 - DNA, 365 bp, Triticum aestivum
  Clone ID: PAT_TA_38648
gggtgcacggcgacacatccagcgaatccggaaatgaatactgctcctccggtctgcgcatgacgttagtacatctgcgtactgccgtgatatttaccagtggacgaccaatcgatatgtttgcgcgatcaccatatgtggaaggattaactcaactaccaaatggccccgtgcgaatgggtgtacacgtactgtagtaattataacactgcagaatcaagtgtcgtatgcaacttgtatcaggaagttctccgtatcaatatcgtgtacgggtttgctaagactcgagtaaacatttgttttcttagtttgtagtgaacggacgcacttgatgatcctggcatacgtatgcatgcagccaacgt

SEQ ID NO: 38649 - DNA, 388 bp, Triticum aestivum
  Clone ID: PAT_TA_38649
gtccacgggatgatattaacttccgcccctgatgattggcaaagcttgcaacaatcatacggttagtatgcaatcatcattggatcaacgtttgtgccaagtataacagatgcgatggactaccatgataattgatttgagtctactgattgccagaaacattgcgagcacgaacagacattagttaagtcacatgatcgtaattatgccttgaacagacgctgtatcaaggacctcatagatgcgaatgatgattacagcaccaaaagtttgcataatgtacagactgccacagactgtactgtgcataacatattcagcttctcgtatgatggatgctcattctatcacgactatcgcaatgaaattatccgatccacctgcccga

SEQ ID NO: 38650 - DNA, 450 bp, Triticum aestivum
  Clone ID: PAT_TA_38650
ggtccacgggatcactgcagtgtgctgatgccgcatggggcgtcaaattaatgcaacccctccacaacgccgtccataaaggccatgtttcattggcagagcctttcccaccattttgctctctctctctctctctctctctctctctacccttggctagctcttcacagtgctatataaggggcctcacctggcgagccattcttcctaccacccacccaccatgatgtccatgcatacctccccacctctcctctcctctagcgtccagctgccgagcccgagccacacctgctctcggcacgccatcggcaaccggggcttctttgctgactgtctgccgaggctttcctccacagccaggcgttgtcgtccactccgttggctcaagggcggaacctcccagggcactgcgtcccgctgattcacggcctggctctaccctctctg

SEQ ID NO: 38651 - DNA, 385 bp, Triticum aestivum
  Clone ID: PAT_TA_38651
ggggataaggaaagtgacgtctcggagggcgaataggaaatctcggaaggagaggagtatgacaaccccaaggccagtgacgccaagaagaaacaaatatgcgagggtgaggagaatggcgaagatgatgaggaagaacaagaggagcacgacggtggaggatgtgacgacgatgatgatgatgacgacgatgatgacaatgaggacgacgacgatgatgacgacgatgtcgctgctgaatacgatgaggatggagtataagaggaggatgacgaccaggacaacgacgatgatgaggaggacgatgacgaggactcgctccaaccccccaagaagaagaagaagttaagcccttcgaagccgctgccttaatcaccatgccatt

SEQ ID NO: 38652 - DNA, 333 bp, Triticum aestivum
  Clone ID: PAT_TA_38652
ttttgttaagttaagcgagtcacgtagcatgcaagtatggtataagttgtgtgacaaatttgttgcatgacgtgctcttttgattgtcttccttatgactggcagtcggggaccaacgatggtcatttcctactattctatacctcttggggcatgcgtagtagtactttgcatcgagggctaagtcgacttttgcacttatctatatgagttctttttgactaatgtgagtccatggatacacgcacagtcatccttccactttgctatcctctattagtagagcgcagctttcacaggtctcatgaagcctttatttttcttctacaactc

SEQ ID NO: 38653 - DNA, 435 bp, Triticum aestivum
  unsure (1)..(435): unsure at all n locations
  Clone ID: PAT_TA_38653
gtcgggtacggaagangtttcggacgcgcacgacgggggtctatggttgtgcacaaaggctccggtttaggcagcagggaaaatcacgaccatggttggagatgacgaattaagataacaaaggcagtgggatattttgcaagtgtgtcatggtgaatgccatattaacgaaatatctatgatagctccatcaatattatgaggatatgttataaagagaaatcaccattgtgattatccctcgatttaaattgactgaggatccatacaattcaattacatgagttgcatacattaaatgagatgatggcatgatgacatgatgcaatgcaacaagcaactaaaacacatggcaaagctcggaataactggaagtcttctggggcgccgggctcggggcgttacaacactccactactacaggaggatctcgtc

SEQ ID NO: 38654 - DNA, 420 bp, Triticum aestivum
  Clone ID: PAT_TA_38654
atctgcaaggaaattgagagcatacaggctgatgaacacatcgacatttggcgaattagcctcactcccttttcaattttgacgacacaatatgatgaagaatagtcacagtctgaatatatgacacttacagtctccacgtctgtatcatccagcatcattggtgcaaggtccgagagccgaacctccttggcctccacctgagttggattggacgcctttgccacctgcacacgcatacacagaagagacatgataaccataccaaatcacttttttatttattgcatggatggcagggcaattctgaatatgaagtgactccagacacttaattctattgaaccatcaaaagagatgccacactttagtttctacaaaaggcccctagtcaacatattaacatcaccggcaatgttt

SEQ ID NO: 38655 - DNA, 391 bp, Triticum aestivum
  Clone ID: PAT_TA_38655
cgggtttcgccatgtgtttcatttgtgcccgcccttttatttgtgcattgcatcatgtcatcatgccatcatgtcatttcttttcttaactcgactaaataaattgcatggatgttcggtccatttaaatcgatggatattcacaatggtgatttctcattataacataccctcccaatattagggagctataatacatagtccatttaattggaagccaccgctagagacttgcattataaatccctctcatttctaaattattttgcatccatgatcttttctccgcatggctcctttcaagttgtggcacattggcattatgctgccaagtggctacttgttaattgtcagctcaattataaaatatttggaccctcaaatattttct

SEQ ID NO: 38656 - DNA, 375 bp, Triticum aestivum
  Clone ID: PAT_TA_38656
cggggccacgggcgggacgaactttgttgccgtccccaatacagcaagagggcacataggcggcgcattaaatacgtttgtcctacagtgtcaggtgatcaacttgtacactgtagatactttccacctcctgtgtgccactgtggcgaccgctttgacatataaaaggaggcccgaggcgtactgtggaaggattcggactttttggactgggcatgcatggcagctagttcaagagctcaagaacaccaaatatacacagacaagcaggactagggtattacacatcgtttgcggcccgaacctgggtaaaaattcccttgcgttactcgtctagacctgctctttgcgcagcccttcacccccgccaactgt

SEQ ID NO: 38657 - DNA, 347 bp, Triticum aestivum
  Clone ID: PAT_TA_38657
tgatcacgtttctgggacaaacttcgcgtgatcactgcacgacttcgactcatttgaaagacgtgtgaagagttaagtgacaatctggcacatgatcgtatctcgtcggacctaacttagaacattacgcaagctagatccgtcaatcagctcatatacgtacatcttgcacatctcatcagtgtcaagcaactggtcatctattagtacaagtcaggcaatgctttcttatcacgaatacatcattggtatcctcgaacatggatcatggtaccgtaccgtcacgtcttactcgaagctgcgtgtgtatctgacaagagtctacgatttcaatacagcttggctgg

SEQ ID NO: 38658 - DNA, 434 bp, Triticum aestivum
  Clone ID: PAT_TA_38658
ggtccacgacgtggccggtcagtaaggtgcaatacggtgctctacgatgagctagtgatcgtataatcaccgcaaaactatatatactgaccgtaaagagcgtattgttacatacgttgaccgccagtgtatttttctcatttcaaattaagccatattaaccggaaaggacgcagtatggactagtactagtactgctttgatgtgtcccatcaactcgccgaacgaggagaagcttgcttactacgcctctccctcgcccacgtgcgcggtggttcgcaggacgaggagatggttttgagtacagcgccctctccctctccctcgccctcacagtggacgtgcagcagttcaattggtgtcagattgccagaagcataatgtgtactgtagtatcatcattgttggaccttctgaagaggcgacgagccaag

SEQ ID NO: 38659 - DNA, 453 bp, Triticum aestivum
  unsure (1)..(453): unsure at all n locations
  Clone ID: PAT_TA_38659
gggtccacggcgggcgcataagtaaataagtgaaaaattatctttagttcaccgaccgaatattcccttaagaacgctagctttcgacttcacccagtctgaggtacacatccggctgacccagcagtaacaatcgcagagggctccccttatgccctagccgaattaacgggaacgtanggcataaatacaagagccaggcaacctagcttggccaaaacttaagtcatatcgatgcatataatggtgaataacgggtacatgccgaatgataacacatgtgttgggcataaagcccgtatgaataagcttctgttaaagaatcccccaggtataatgagcgcggatagcgcgtcagttgcgtgcaaacaaggcatgaatgggctcctaaaggctgtgagagaaaaagaaaaggagaaggagaaaaatataagacagatagtgtataaaaat

SEQ ID NO: 38660 - DNA, 412 bp, Triticum aestivum
  Clone ID: PAT_TA_38660
ggctatcctttgatgatcgtgacagcttttgatgggctaagttcggacacccctgcagggtatgaacttttgagaaccgtgcccacggttatgtggcagaagggaatttgttaatatctggttgtagagaacttggcacttgacttaattaaaatgcatcaatcgcgtgtgtagctgtgatggtctcttttcggcggagtccgggaagtgaacatgttttgggttatgtttgaacgtaagtagtttcaagatcacttcttgatctcttccagcttcacgaccgttgcgtagcttctcatcttactcttacttgcgtatgttagccaccatatgtgcttagcacttgctgcaactccacctcattaccttatcctaaccataagcttaaatagtcctgatctcgcgggttttg

SEQ ID NO: 38661 - DNA, 452 bp, Triticum aestivum
  unsure (1)..(452): unsure at all n locations
  Clone ID: PAT_TA_38661
ggtccacgggtctgcaacaatcaaatccgtatgtatcttgcaaatctctatgtctcccacctggacttgatcccggatggaattgaagcgtctctcttgatgtgcttggttctcttttgaaatctggattcctttgccaaggaaattgcaccagtattgtcacaaaagattttcattggacccgatgcactaggtatgacacctagatcggatatgaactccttcatccagactccttcatttgctgcttccgaagcagctatgtactccgcttaacatgtagataccgccacgacgctttgtttagaaatgcaacaactaacagctccaccattcaatataaacatgtatccggtttgcgatttagaatcgtcccggtcagtgtcaaagcttgcatcgacgtaaccatttacgatgagctctgtngtcacttcataaacgaagaacatatc

SEQ ID NO: 38662 - DNA, 105 bp, Triticum aestivum
  Clone ID: PAT_TA_38662
cgggtttaaactaatcatatcgatatgtgtcatgcaacgctataagtcgataaagtgaacttgatgtcggatggagcttatgcgtcacgcatgtagtgcgtgggt

SEQ ID NO: 38663 - DNA, 457 bp, Triticum aestivum
  unsure (1)..(457): unsure at all n locations
  Clone ID: PAT_TA_38663
cggggccacgggtttctgacatgacatgacggtggaaagtgaaccacattgcgcggcgcaacgctgtgcattgcacaggagcgagtgtctcgcgtaaaagttaactcgctaatgctagttgaccattagacgtgagcatgccacagttgcgtgattagggaagacttttgctctgtcacacaaagcacatgtggctaagctgttccgattttctagcatgtggagcagataaaactgaagtgccaggttagtggtgatggtttttaaacacaacgacagtgttgcatttgctggtcaaaacggacagacgaattancatgaaacagattaaacttgcttagtgaagtgatagctaatgtgaacaaacttgggtcttcgctggccgccaatgctccacgtcngcacttgacanactggttccgccagccaacgttgctccacggcatgcatgcacatg

SEQ ID NO: 38664 - DNA, 280 bp, Triticum aestivum
  Clone ID: PAT_TA_38664
acatggtcgagcagactcctgagatcccctgatagtgcctccagcggtttcggcggtagcatgggctcgcccgtgagatggaacatggccgcacctttcacgggtacacgctcttcagaatgcatcgtctggctgctatgttcctctggctgtttgggaggcaccaaccttccccatttcctcctggcccttttcctggggacaacctggcgaaccttccctaacccctggcccagtgttcccgaactaagttctgttcgacactcgcgccccgactagt

SEQ ID NO: 38665 - DNA, 120 bp, Triticum aestivum
  Clone ID: PAT_TA_38665
gcgtggaagggaaactagaactggatacttagtcaaatggataatagataatgcaagtgatagatgcgaacagtatactaccacaaaggagaaaaatcacgaaacttcgcaaataaaaat

SEQ ID NO: 38666 - DNA, 242 bp, Triticum aestivum
  Clone ID: PAT_TA_38666
gggtttaactgaaatgagtcgtagtaagctacaagaacagcagatgacaggatttccccttggaggattatcgtcaccgatttaaggcgagtccggccgagtcattgccctgagaacgagatttgacggttgcaggcctcctagagaaagttgtctcttgcgtggaggacagtagccgtccttgtggagtgcctcctgtgcgctggaagttacaccgtcactgcgtcggtactacactccaa

SEQ ID NO: 38667 - DNA, 392 bp, Triticum aestivum
  Clone ID: PAT_TA_38667
gtccacggggataaggatggtgacttcgcggagggcgaagaggaaatctcggaacgagaggagtatgacaaccccaaggccagtgacgccaagaagaaacaaataggcgagggttaggagaatggcgaggatgctgaggaagaccaggatgatcaggagggtggaggacgtgacgacgatgatgatgacgacgactacgacgatcacaatgacgacgacgactatgatgacgatgatgtcgctgctgaagacgattgatatggactacaacacgacgatgatgacgattacgatgatgaggacgatgatgacttgctccagcccccgattaagaggatgaagtgaagcccttcgactcggctgctttagtcaccatgcgatcagatgtgcct

SEQ ID NO: 38668 - DNA, 210 bp, Triticum aestivum
  unsure (1)..(210): unsure at all n locations
  Clone ID: PAT_TA_38668
gtggtgttccgcaggaagaagaacttggccaaaaactcccggccttccggtccggcttccaaaaaggaaggttttcaagccaattgattcccaattattgaaccacaacaaatccccaaccaatcccggttatccaaatgttcaaaattacaggatgaaactgtnggaaaaatgttgtggtccccttacaacaaagggatttttgctgct

SEQ ID NO: 38669 - DNA, 395 bp, Triticum aestivum
  Clone ID: PAT_TA_38669
cggggccacgggaaactgatggtccagttatgctgcgccgaagacttcccagccagagacaccagcggccgaaacaaccgatgcctatgctgcgccgagaccgaggccgtggaacaagaagattggccatttgcccccgccgcacgtgtaagttcaacagtttacctagtttctgagcgatcaaacaaaagaacttcccctctcatctcacttggggagctactatgaccggaaaaccggcccacactcattttataccccaattttcattgtgtaaccgcttacccacaatgtaccacttatgcaactctgtttccagttattgtactgttatgtaaagagaactcatgtacctgtcatgtaaacaaacgggtgttataccactttttattttg

SEQ ID NO: 38670 - DNA, 452 bp, Triticum aestivum
  Clone ID: PAT_TA_38670
ggtccacggggcaagatgaaaataatttttgaagggtatcccattgtttatttgttggtggctcttggtggaaatacctattgttgtgtaaattcaaacgatgtaacctattcttgtaatgtaaccaacatgcactcaatctctataggtgcaatcaaaacaatgaagcaaaaaaacagaggaaaaatagagcctatttctctaggcctctttaatctttgtgggccttcgacaatcaacgcaatgcgatggcccaactagagcttggtttcattttgggcccaataactacatttttttctcttgcacttggtgttgtctgacgaaactgaaagtgtcaaaaactaacacctatagagattcagagacgaagatagagacatagtttaagcaacacagagagcacatgatccacaaattgagcaacacaaagagcacatgattcactaacc

SEQ ID NO: 38671 - DNA, 462 bp, Triticum aestivum
  Clone ID: PAT_TA_38671
cggtccgagattaccggggccacgacgacaagatgatgcatggtggtgtccggcgctgcgacggcgtcgtccacgacaaggaggtcttcgccggtgtgatgccgcgcgaacaggtggttgcggtgtgatgccgctaggaggagatggcagtgcgacgctgccatgacgaccgtgcgatgccgacaagacggtgatgagatgccgctgagaagatcgatgtacagcgggtgaggccatcatgaggatcgatgtgaagctagccgcggaggtgttctgggtggtgtgacgccatccccaagatgaggtgttgcgacgacgacggcaagacgtacgtgaccagtggtgtgatgctgctgaagaacgttcaagtggagattgatgatgcaccatggtgaagctgcagcgtgaggcaaggtggtgtgatcttgccgctgcaaagtcttggcaagatgttgcgggtga

SEQ ID NO: 38672 - DNA, 309 bp, Triticum aestivum
  unsure (1)..(309): unsure at all n locations
  Clone ID: PAT_TA_38672
gggatactcgagatggcggcaagctttgcacaggccgctccgctgaggcagtacaaccaataaaccttctccccaaagggggtaaaaaggaacttctccttgaaccctttgtaaaccctaaggaacaaattcaaaacggtttacttcaaccttgcggcctgacgctgcaagatcacttgcgccttggtacaaacaaaaccggaataacacacgccctctttcttctcatgtataccgtagtttacaacaggcattanaagaggaaatgagtttgtttcttctggaatacttcgaaatttcaactaaata

SEQ ID NO: 38673 - DNA, 423 bp, Triticum aestivum
  Clone ID: PAT_TA_38673
cgattaatattaaaccctcctctgcggtgcctctttttctcccgtggatgacaatggcgacggctgcgcgtaagctcctgacggatggctcttcctcacgcacgtgactggcagcaactatggtggtgcgagagcctccccacgcgcgtcaccaccctcgagatcgcagactctggtagcgcacacacagcaaccgcacagagccgcagtggacatcacggtcctgtcgccacgcctagggtccgcagcgacagggtcggcggcaaatctaatccatatccactggtttcagcagtaagctgacgtctcatacatcaccccgttcatctcccatcttgctccttgacaaattagattgttctaccaatttttttttggtgattgtggacgaccaagataaggataagagaaagtaatcataaa

SEQ ID NO: 38674 - DNA, 333 bp, Triticum aestivum
  Clone ID: PAT_TA_38674
cgacggcacggacagcctctacgactgcgaggaggccctgacggacgacaccaacggcgccggcgctaaaacctccgccgaaaaaatcgccttcggcaacctggtccgcttcatctccaaaaaggtgtgggccgcctggacttgaccggcatcccccgcggccgcggctataacttctcgtaaattagggagacccagcaatggagactaccaaaagggtcaggtcaggtcaggtcaggtccgtgaaaccagtagtagtagtagtaccagttggttttgtcccagcaagcaagcaagcaagcaagagcatccgctctctctatgccccctttg

SEQ ID NO: 38675 - DNA, 211 bp, Triticum aestivum
  Clone ID: PAT_TA_38675
aattttgctggacatgtaccgaaagttcaccaacggtgatctatggcatcgacactagttcacttctgatgcgtggaagattccttctaagctgcacgatcaagcttgtcacactaggataactattgataatctgactgatcatcccttgttcaagaaagggttttaaactgtagtaattccgttaagatcaacaccacatgcttcaaag

SEQ ID NO: 38676 - DNA, 389 bp, Triticum aestivum
  Clone ID: PAT_TA_38676
ggaagaatggaatcgtcctccggaggatcagcggaatgtggatgatgtgacgctggtcgcccgtatctactgaggtcaagtagtgacatgtctcgatactccggaacgagttgcaccatcgtcctcgcctgcatcactgctaagccggctctcatcctgtgatcatatgcgaattacaccgtccacatcatcatgatgtaatttcaccgtcgttaacgccatgactggatgatatctgactgcgttcacccttcttgcaatcatgtacctcttgtctgctgtagtgcctgctgacatcgacgtacctcgaatcacttccacttgatgtggacatcctttttatcttggagatgtttgtcgcccagattctgccattatgacagacagga

SEQ ID NO: 38677 - DNA, 424 bp, Triticum aestivum
  Clone ID: PAT_TA_38677
cgggaggaaaaaaaaagagagggagacgaagcgagtggacttcagccaaagaggcgcctcgttcggattcagtgtccactacaaaaaaacgtttcagctcccgcgtgacctttcgtatacccatcgtgcgtggcaaaaatttatacatcggcttggctcattcccgcaacccgcgtcgcgtcgcgccgtgacgaggcgaggcgtggcgtggtgtggcgaggcgggcggcggaggaggagtgcgcgtggatgtccctcttgttctcatcctcacacatgtggggaaagaacctcccttataaagagatccaactccctctaaacaagcaatgtgggactaaactttagttccacctcttgccttgtacgaatgggttgtgtgggcctcaggatttattaggaatttttgaaactgctattgggct

SEQ ID NO: 38678 - DNA, 453 bp, Triticum aestivum
  Clone ID: PAT_TA_38678
gggtccacgggcatctttacatgacagaaataaggcaaccatcaaacaaaccttcttatcatctggaagatcatcaatgtgtatgaaatagtcttcaacaggcgatgcaacgaccaaatcactggaatgaaaaaggtggaagaatgcggcaccggcatttgtttcaggcagggagaaaaacaatgacagagtatatacgttcgtcaaaatgaaataggggaagtatatttacttacagattgttcagctcaaacatgccaattatatggccatacacctcaagggaaaacactagagcaagttaaggtaactcgaatgacaacgataactactcattgtatgaaagtttgaaacaagtctggtaactgccaaaaaaggatacatggtgcacactcagcatcgaagatcgcatccttgagaagctttagtgactgcaaatacagaagccatgat

SEQ ID NO: 38679 - DNA, 307 bp, Triticum aestivum
  Clone ID: PAT_TA_38679
gggatttttattagccacatgatatgtgttctgcttggagcgtaattttattttgttagtatttgcttgatgttatttataataatgctttgcatctttattttttcaatcaaatgtcaaggatagcctttaccatgcttattttgcaagtatacatgttgctgtttcaaaacagaaagtttaccgctgttgtaaaaatttcctagaaaagtcagagagtgatataatgttgaatctttttgaataatgagctctgataaatcttttatagcatagtatttttcttataatttttggagttaaggaa

SEQ ID NO: 38680 - DNA, 304 bp, Triticum aestivum
  Clone ID: PAT_TA_38680
aatatgatatgagcttcacttatatcgcttgagctaaatatttttgctctagtgcttcacttatatcttttataggcggtggattaattttgaagaacccgttcatctatcatagttcacctatatcattttgagactcctttagaacattatgctatttgctatcgttataaattcctcctacaatgatgatcccccaagttgggtataattgatactatcataagacgttaattggatgttaccatcaacctgatacttgatcattgttttgatataaggatgtattgatattaggatcttg

SEQ ID NO: 38681 - DNA, 146 bp, Triticum aestivum
  Clone ID: PAT_TA_38681
cgtgacgaagcacagtgcgattggcgtcagtgcgccagatcgggtccgtggcggtgcaaccggcttcaatcccccggttcgggtccttggcctgggtcacacccttaccaacaacattgacgggcgctccaaaaactccggcaacg

SEQ ID NO: 38682 - DNA, 425 bp, Triticum aestivum
  Clone ID: PAT_TA_38682
cgggcatcataaagaacttagtttgcttttgggttatgaagaaatgaaacgtcaaactaagcatattccagcatataaccttgagaaattcctcgatattgatctagaagaaatttatatgtattgtgcggtgaattgcattgaaaacttatattgccaattacataaagaagaggaaacaaatagaagttgaagagaatactaacgaaagggaagagacttcccaatattctcctattatttcttatgatgaatcaggtaacgaggaggagccttatattcaaccaatctcattaataaggagctccaaaaagaggattgaacccacacatgatgtgaagaagaaaaagaaaagatggagaaggaaaggtagaaaggtatctctcccaaatgatgttgctcctattactcattgtgatgatgat

SEQ ID NO: 38683 - DNA, 443 bp, Triticum aestivum
  Clone ID: PAT_TA_38683
cgggcatattgggagtcgttcaatcagtgaaattccaaagatcccgaagccctcttccatgtgtttatctgaaactgacaatgcaaatgacactaaagataagacccagcgactccatatgccagctggagcgttggttgacattagtaacttcatgggcacacattctggaaatattgaccatgctgttaatgagaagagaagaattgagggaagaaacactgcatcttcctttaaacgcccccgctcttccagataaatcctttgatttgcatccctgttagcaggctgtaaactccttgatgccatgcttttgctatgcccttgctgtcaatgtgagtttgacactgcatgtgttttgcatgctggcgacgtttatttatgcagcagcaaggcagtggatcttttttttcagacggatctaaaatgaagatgattgtctt

SEQ ID NO: 38684 - DNA, 452 bp, Triticum aestivum
  Clone ID: PAT_TA_38684
gggcacacgggaaatactagggaaaccgtcaatgatgaattcatcaatcgcttatcattgtataccacgacgtgtttgcccagagcacacatggcgtattagcatcaaccatctgtgttattatcggtcttcgcagacatttctaattacagacctagttgccgtgtaccacacacatcttgttaagttgaaccgtttctgttctcttgggtcaacgcaaacagttcatctgagtgaactgtatgccgtatatcgcacacacctttgatctggctgagcgtttctattgtgttgcctaagaaaaaacagttcagttagtgaactatatgccatatatcgcagacaccttcatctggctgcacatttctgttgtcctacctcatcgcaaataggtcactggagtgaaccgtatgccaggtatcgcacacgcaactctatctgaaatgtgtttg

SEQ ID NO: 38685 - DNA, 298 bp, Triticum aestivum
  Clone ID: PAT_TA_38685
ttcgcggggtcacgggcgggatcataatcatgaggaatatataggataataaggtggtgtattaccaccatgcccgttgagctgatgtttgtttcagctagagaaatcgttacgcccgctcataattcctttttcgacgctctggagaataataactactggtatatcattctatatcaaagccggcttgtgaaataaatgatccgccgtcttgccttcacttgtttttgttttccgcgtgttttttacttgtgtgtgtgtgatccaaggccctgaaatggagttcctgatgcagctt

SEQ ID NO: 38686 - DNA, 327 bp, Triticum aestivum
  Clone ID: PAT_TA_38686
tatatcaaacaaaaagaagcacgaactgtagtaagtacgtacgtaggtgtgacacctcaccttgtacggaaaacaatgggaatattgaagaagaccacaagttccctgagcttcttcttggcggccttcatcgtggtcatggttgcaacccttctcttctcttcttgcaacccccgcaaggaaaaggataagcccacggcttcccccttgtcgggaaaatgcttctcgaggtttttcccaaactgcaccaagcagcaatgcacgaagttctgcgtccagcactccccgggagccgtctgcatcgacaaaaccactgttgctgcccta

SEQ ID NO: 38687 - DNA, 336 bp, Triticum aestivum
  Clone ID: PAT_TA_38687
gggataggaaggatgcttaatgttgtcgccgtctgctagggattactggctcagctcttcacttctgactcatcatccgcgctgtacggcatcctaccccttcttcttctcctccgtctcctctccctccgacacatacatcattacccttaaggtagaatttacttactccaaatgcattgctctatctgcatctacaccatgaatctatgacgtgtttcaaagacgaaatgagttgcgggagtattacgaacatttgtatacagcattaatctacgatctggttcactgagtagattactggggaaatttgtataccataaatctatgatgtga

SEQ ID NO: 38688 - DNA, 402 bp, Triticum aestivum
  Clone ID: PAT_TA_38688
cggggcaatgcgaaagcgagaggaggggtcgaactgtgttatgtacctgcgtcggtgtatcaccgcaacttgttactgcacacacggttattgtgaagatgaccacgatctccatgagcatcgacatagtcgccctcaccttggtcacgggtgccagtctgctcttctcctcgtgccatccgctcatcgatatagatacgcacgtcgattcccccatgtctgagaaatccctcacgaggtttttcacacatttcacgcaccatttatacattacctaccgcatccagccactcacctgtgccatctgcatctacgtctaccactgttgctgcgctactgcgtacttatacccctctttgagccaatcgggctatcatcaagtactggttaaagatggcaacc

SEQ ID NO: 38689 - DNA, 123 bp, Triticum aestivum
  Clone ID: PAT_TA_38689
ggggttgtttcaagacggcagaaaaaatggtactaatgtaacaacgaaaccagataaattcgcctgccctgcagcaacaatcagtaatcatgcatgaataaataatggtcacaataccaaagg

SEQ ID NO: 38690 - DNA, 445 bp, Triticum aestivum
  unsure (1)..(445): unsure at all n locations
  Clone ID: PAT_TA_38690
tctcacaactgaaccgggaaaggaaattgacccagacggcatgaaactcgcgactaaataaatatgtagagactgatttctgcaggactcatcttctttagacctgaataaatatttctcacaaaccgaaattattttacaaagatctgtgtaacatgaagctagcaacccaaatgttgtgtggaagtctgaagatgtggtaattcctgcatccgtaaagtaatcttctgaagatgtggtaattcctggtaaaccttgctccaggccaaaagagtgggtgttgctctccaagaaaaagaaggcttattgattgcttgcttaagtgtttgaaagatatcaaaacaatcgtatacaagattaatgccagggcataattgggagtacttagcaaactggcagctgaaacagaggtgttcccttgcntctactgtccttagcaacatgg

SEQ ID NO: 38691 - DNA, 226 bp, Triticum aestivum
  unsure (1)..(226): unsure at all n locations
  Clone ID: PAT_TA_38691
gcaagagagcggaaagcgtcanggcagccggcgagaaaggggccggccttggttaaccaaaaccccggcaacctccaaggaacctgccaaaaaggcccggcccttgagaaccaaaaccccgaaaaccttcttggaacccgccaaaaaccgggaaaatggtaaaaaggggttgccccccttgaaaaccacaaccggaaaaaaacccaaaaaactcgttgggcccaag

SEQ ID NO: 38692 - DNA, 421 bp, Triticum aestivum
  Clone ID: PAT_TA_38692
aacgacgaaaaaatgaggctatggtggttatcaatgcaatggtaaggattagaaaaagatttcatcaaggttacggccaaggtatccgtttgaaagcatggacggttgttggcgattaacagtccttggcgaagatgaggagtggtagtgttgatatagcaccgtacctatatagccgaaacacaataggacacgaaaccacaactcaaattctcaaagacaaaaacgggccaaaattgacggggatggtagcggtgaagtgaaggtggttcttgcagaaatcgatggtggtatcggagtgtgtatgcggtggtggagttggaattgaagtgcgtatgccggagtggtggccgtggccgaaaattttcgggcgaaaaaaaagaagccaaggaagccccccccccaaaaaaaaagaggccat

SEQ ID NO: 38693 - DNA, 173 bp, Triticum aestivum
  Clone ID: PAT_TA_38693
taggtgtgatatgtcaagtactggacagataggccaagcactggatgtggctttcagggatttatgcagtgggatttgattggtactatgctacgcagtgtttgggatatgacatgtaacgatgggacatgtgccacgctcagaacacaatatctgcaagaatcgtaaacaac

SEQ ID NO: 38694 - DNA, 434 bp, Triticum aestivum
  Clone ID: PAT_TA_38694
cgggcctagctaacagtgggagtagtaggggcgatgaggcctcaatggcaacacagccggccactggaggcaggagcaggcattctccccggcgctggtttgggcggctggtgcatgaagagcagcgattgaagaagcagcaggaccgttcgattcaaatccaaatgttactgttgctagaatcgtttgttgactaagttgacaagccctgcgtacgcgtcaacttagtaggcccacaggtcagcctcccaaccagtgcgccccagatgtcagtgggaggaatcatttttttgcgtaataaggaggcagttgattgcgtgcggccaggccagtggagggagtagggtgggccggggaagcctacgcgacatcacagcgggccacatgaggagggagcaggcagtctcgccggtgctagtttaggcggctggagc

SEQ ID NO: 38695 - DNA, 454 bp, Triticum aestivum
  Clone ID: PAT_TA_38695
gtccacgggctcgtgttcgtgtcatcgttagctcatcaagcacgggcacacattacttaaccccattgttggaagagttgacatttttggtatatatggcccctgccctgttggaacgggtactgtcttaatcagtgacagtatattgttagttaatacccgagatgcagaccttgggcatgataacaccactacgtgttgcaaattgcatctgagggtacgtggctggagtatcttgttgcgtcagattctttttattcttcttcttcttctgaaaatgtacaaaatgaatctgaacgaaggactatgcaaattatcgtgaaatttttatttttttgaaaaggggattgtcgtgaacgttgagaattttaaaaattgaatctgaattttagtacttttacgagatgaaatcgggtctgaaaatggagagcccgacagcgacgtactccctccg

SEQ ID NO: 38696 - DNA, 218 bp, Triticum aestivum
  Clone ID: PAT_TA_38696
aaatcaaaacataatcacaacgcatgggccaagttggcgcctatgaaagttgggcaaggccaaagagattcgtcccccttgcaccaagctgccagacctaacaagaacatgcaacctggcaatggggacctcccacaagaaggaatgaatgggaatttcctgaaaaaagggcccctggggtaaaatggctaaccccacataatccccaaaaggggccc

SEQ ID NO: 38697 - DNA, 408 bp, Triticum aestivum
  Clone ID: PAT_TA_38697
gggttgatgtgagacctgtagcatcagtgtcccatagcacatgctgcgtggaacagtttgactgcagcatcagcaagtctcagctgccttttgtgcatcctggtgtcctgattgtcaggtgcatcaattgataccagcacattccaactgtcattaggcatacattgtcatcgatagatatatgcctttgaacttcatcgcagtacatctatgatcactatggcgtaaaacaccaggaggtaccatgtcaattcacacattttgccagcatatctcattgagcttgtcaatctactaagatgatagcagttcttacatcttttataattcgacatcaattactgtgatctataattttacagtgcattgtcacttatcactatagtgttacctattgcacacaacatg

SEQ ID NO: 38698 - DNA, 274 bp, Triticum aestivum
  Clone ID: PAT_TA_38698
cgggtagacaccagagggggctatggttacacagagtaggttacagagaaaggaatcttcacatccgaattaccaagctttccttccacgtaaaggagagtcccattcggatacgggatgaagtcttctatcttgtatcttcatagtccaacagtctggcattcgcatatagtccggctgtccgaggaccctcaatccaggactcccttagcaggcactaactagccacttcacaagcccaaattacctgctgggaatggctttggcaggccat

SEQ ID NO: 38699 - DNA, 432 bp, Triticum aestivum
  Clone ID: PAT_TA_38699
acgggttcagccaaggtatgcggatgtggagccagctaagttgtgcggcggttgcgtcgatttaggcgtgggaggcggcggagtggcgttggagccggccggccagactcacaatcgatggagagggtggtgcggtcgagagcgggaggctgtgacagtggggcgtggcggaggtggtgccgtgcggccggacgggatcatcctggtcgaacaggtcgctgcccccaggctgctcaccggactccaattcccaccgctctcaagctctagatcgagcttcgtctggacccatctatttgtgcgatactgcgtttcctctggtggccatctgttccgctcagcgtttcctctgaatttgagaggagaaggccttgaggaggttcatgcaaccatggactgtttagatgagattagttgagagaaaaggaaaat

SEQ ID NO: 38700 - DNA, 350 bp, Triticum aestivum
  unsure (1)..(350): unsure at all n locations
  Clone ID: PAT_TA_38700
gggacggtgaagatgtacatggacaacaaatccacgatcgagctgagcaggaaccaattcaacaagaaacaagttagcacaaccacaatccgtttcaatacaatcctcaattcaattaaggaaggcttgttgacaatgattatgttagcaacaattgaacaaacatctggacaaaggccctgggggcgcgtcaaagttctcggaagatgcgactttaagctcggcgtcatggaagtatcanacgggacacaggattaagggggtgatntgttgaccttgtaatcctggcgcccttgtatctagtttaagtagttgtttctttgcttttcaaaactctaccgcatgtgcac

SEQ ID NO: 38701 - DNA, 452 bp, Triticum aestivum
  Clone ID: PAT_TA_38701
ttcgcggggtcacgggaagaaaacaatgagagatccaatcttggaggggctctcgcccctctgggcaccatggataccgagtaccagggggagaacctctccacatctaggggcatggaggagcaagccagagggggtccctctcttccctctctctcgatggcgtcagaatgccaccgggggaaccatctccgcagtaatcgtctttatcaacatcaccgtcttcatcacctccctaatctctttttagcggtccactctcccgcaacccgctgtaatcccctacttgaatatggtgctttatgctatatattattacccaattatgtgtagccatcctatgatgtttgagtagattatttttgtcctatgggttgatttatgaacttgattggtttgagttgcatgttttactttggtgttatcctatggtgccttctgtgacgcgcgca

SEQ ID NO: 38702 - DNA, 401 bp, Triticum aestivum
  Clone ID: PAT_TA_38702
cgaaaaaaatataaacgaagtcaaaaaaacaacaaaaatgtcaaaaaaaaaaaaaaaaaatggccgtcgttattaaaacatcttgaaaaaaaaaaaaaaaaaaaaaaaaaaaaggggcggcccaaaaggttcaaaccttacttacccttgaatgcaaattcaaagcccttcaaaagggcccccaaatttcaattcacgggccgtcttttaaaaacttcgtaacgggaaaaacccggggtttcccaaattaaacccccttgaagaaaatccccctttcccaacttggcttaataccaaaaaggcccccaccgtttccccttccaaaaatttgcccaccctaaatggcaaatggaaccccccctgtaccggcccataaaccccggcggttttggtggtaaccc

SEQ ID NO: 38703 - DNA, 120 bp, Triticum aestivum
  Clone ID: PAT_TA_38703
cacggggagttcgaaaagatagaatagatattggattgagaatgacgctttttcccccgcaaaaaaagataatgccgctctttgcaaagataaaagcttacatacacatgcataagaggt

SEQ ID NO: 38704 - DNA, 130 bp, Triticum aestivum
  Clone ID: PAT_TA_38704
tacggtcctacattccgggtccacggggggccgaaatgctaggcgagctctgaacgtgccaggcgatcctgttgcagtttactccggactcgcttgaaggtgtccggggtctgtatcgccgaattagtgg

SEQ ID NO: 38705 - DNA, 365 bp, Triticum aestivum
  Clone ID: PAT_TA_38705
ccgggtccacggggcacggttatggcgtcgtggcggcggccgtcgtctctgctgtcttctcatccatcttctgatttttggacaagcacacgctcttttatcctctccctttcttctatccttcatgtttgtttacataactctgcaagttcccacacaacgacacgatgctttagatgatctatatctactcacgtggtaagaggattcgttcggatgacttactcttgttttaccccatacaagtagatggaaagttgagacttgtgtttcttcatgtggaagtgatggtttgtagtaatatcctgaaaaaatgtggttatgttcttcttgttctaattgaaatctggtacgcaaacgccatg

SEQ ID NO: 38706 - DNA, 103 bp, Triticum aestivum
  Clone ID: PAT_TA_38706
tctgtaaactgaagccaacccagcggtcaatctgaactctgtccacacaggagatcgttcacctggatgcggtgctcaccacgataccaccagctgaacatcc

SEQ ID NO: 38707 - DNA, 465 bp, Triticum aestivum
  Clone ID: PAT_TA_38707
cggtcctacttcacgggtccacgggcaacgaataaagcattatatctcaggtacgcctattaatgttgaaagcaatattatccaaacttttacaccgaaagaacacataaaagagtccttccggaacactccagaatcgtcaaaataaggaggtacgtgatacggtaagtaaacggactccaaaaaatctgcaaaaatattttttatcgatcttggtatattttaaaattttggaaataaagaaactcccaggaagcgtcacctgatgggcataatacaccagggtacgccaggctttcctggcgcgcccaggtgagttgtgcccacctgggacacctcctgtatttcatttttcttccatgtacttgccctgcaagattaaaaatctacataaacttaccaaacatgttaaccaccatatcacggagaaatcctctgttctcttttcttgctattttctgacag

SEQ ID NO: 38708 - DNA, 374 bp, Triticum aestivum
  Clone ID: PAT_TA_38708
gccaacgaggaaagcataacatctcatgtacgcatattaatgatcaccacaacagtaactaaacttttaaaccgaagtcacatttatcagattccttccggaacactccagaggcgtcaggataatgaggtacgtgtgaccggttttacattcgggccagaaaatctgtctttaaaccttttaccgatcttggcaaatttgaaatctttggaatatgattcaactctcagaccacctttccctgtatgagcataatagaggagcgcaagccatgctgtctagtcgcgtcaaagtaacttctggtcatcagcgatatgccctgaatggcaatgttcttgcagctgtatgcactgaaacattgccccacttgactc

SEQ ID NO: 38709 - DNA, 412 bp, Triticum aestivum
  Clone ID: PAT_TA_38709
cacgggctaaaggataaccagatcaagtctgtatcgtgtgtgtcccccggcgtgagcccgtggttgcgttcgtggagtgaacgatctgcatgcgcatagccgttgcgaactgttggagtcacgtgcgatgtgcgcgcggctggagggagttagctgcatgctacctatatggttggacgggtcatgctagtgcatgcaaggcgcagcccggcgggtcacgtggtcatgcatggatatggatcgtgcatctaatggttagcttaatgcgtgagttatttgccgagtgtgcacgtcgtgtggtgtgtgtgcaccggtataagaaaccctccgtctatgtactgctcgagctgaaccggtgtgtaaccatgtaaccactgttaggaagaaaaggattggggcgttcatgctcccg

SEQ ID NO: 38710 - DNA, 390 bp, Triticum aestivum
  unsure (1)..(390): unsure at all n locations
  Clone ID: PAT_TA_38710
ggtccacgggccctctgcatggagtagacaaagagaacacagacatattaatgtactgcacgggtggcataagatgcgacgtctactcaacgatcttganggagaaaggtttcgggaaactgtacactctgaaagggggcgtgtccaacttactcaagaccaaaggagcgctgagtgggtgggtaacctgtttgtgttcgacgaccggctctccctgccaccggccaagtttgcangggcagaagtcgcagcagaagaagggggtgccgacaacggggatctgtcatcgtctcggtggctggggcggtgctacttgtgcgggtccgangtggaggagctgangcaacgcaactgcgccagcatcgactgcaaccgcctctacctgtgctg

SEQ ID NO: 38711 - DNA, 366 bp, Triticum aestivum
  unsure (1)..(366): unsure at all n locations
  Clone ID: PAT_TA_38711
ttcacgggtccacgggggtgcggatcttggtgtggttgtgatgcatgcaggggctcgcgtgaggctggactagctggacatggctacggccatggttgccggctggttcagagaagatgagcgtgggcgtgtgcgcaagcgaggagcagagaaaacaagggagcctccggcgcatgcgagcgggacggcgaaggagctcgttggaggaaactccggcgaccaaaagctacggctgaggtgcgcaaatgaaccgcaacggggacccgaactcgcgcatgtctcgcacagcaccaagtgacgatggangcgtcgccggtgttgaggaaacagaggcggtgaggccatacttgaactcgaagaaacaca

SEQ ID NO: 38712 - DNA, 448 bp, Triticum aestivum
  Clone ID: PAT_TA_38712
ggtccacggggaaccacatacggatgtatgtggatgcattttagaatgtagattcatccattttgttccgtatgtagtccatagtggaatctctacaaagacttatatttaggaatggagggagtatattccaatgatgggcttcctcaaattgccctaggtctttgtgatgcacacccacttagtttctttttgagctttcatacacttatagctctagtgcatccgttgcatggcaatccctactcactcacattgatatctgttgatgggcatctccatagaccattgatacacctagttgatgtgagagtcgttaatagcatggtaatttgggccttctttcttgatctctcatgcttcacttagattattttgagattcgttaatagcatggtaattttcttaatgttaatatacttagtgttcaagatatgtgaaactttct

SEQ ID NO: 38713 - DNA, 453 bp, Triticum aestivum
  Clone ID: PAT_TA_38713
ggtccacggggcctgacggagcactccctgaagaagaagaactcgacatggctattctactggcgtttctgctgctgatttcttatggaaccggcaacatccatggctcaacaacggttaaccatgggaacaacacagacatgctctccttgctcgtcttcaaagcggctaccaacgacccaacaggcgtcctgcgatcatggaacagaagcgtccgccactgcgactggacgggtgtcatttgcagctcaccgaatttcaggcgcgtcgttgccctgagaatccccggccaaagcttgtcaggggaagccaccaagcttccgacaactcgattttcgagaacatgaactaagggggaacattcctgaagtttttggccagctttcacaactctcaaggcttgaccttggctataataatttccaaggtgtcatacctccatagattagtgag

SEQ ID NO: 38714 - DNA, 246 bp, Triticum aestivum
  Clone ID: PAT_TA_38714
tccacgggtggactggaacgcttctgcgcaccagctacttcagcctgatcaagccgatggtggattcctgtccgtgactggtagtcatcaagcgatacgtttgcattgacggtggccacttcagcctgaccaaagacataacttttgaatgacttcacctttgtcatgtttgtaaattaaatacgaagttgcttgcactatgtagcgcttctgtgaattagaatagtaccgtctgtacggttgttt

SEQ ID NO: 38715 - DNA, 304 bp, Triticum aestivum
  Clone ID: PAT_TA_38715
cgggtccacgggaaatgacaattcaaagatgatggctggacttccttttcgcaatagaggatcgtgatatggtggttgagcctatgtcagccactggttccactcagccgagaaggccaagcataaggtcttcaccttcagcatccagtaagagtgttacggcttgcaatttagttccagatcagctgccctgccaacactagcaacaaaagcaaacagggctgcaaacccttaacggttcgatgcacggactaaacatttctccgtaaatgcctgtgtactggtttttgctggactctgggga

SEQ ID NO: 38716 - DNA, 286 bp, Triticum aestivum
  unsure (1)..(286): unsure at all n locations
  Clone ID: PAT_TA_38716
cgggactgactgagagaacatgacaaataaggagttgcatgataaatttcagcaaatgatgagtgaacatgtgcaagatgtgctaaacagatttgaagaggccatggagaagatagatggcatggagaagaagttcgaaacaaagctcaataacaagttttaatgaattgctcgcgcgtcttccaccaccaccaccggctggccctaacgcanctctacaacaacaaacaacaacatcaacaaacaacgtcgtttttccaaatcaagtgggaacaagcacaacgtg

SEQ ID NO: 38717 - DNA, 439 bp, Triticum aestivum
  Clone ID: PAT_TA_38717
cgggtccacgggcaggtttaagtgttctaatatagcttttgttaacacagttgaaactttagcatgttccttaatcctaacacggaaaggtgtggtttctcaatataagcagaaggaacaactggatcaacattataaagtatagtttcctctttaagtagaactagttctttaatttcttctttaatgggtgggtgatatttaaaccacttctccttatggagttcaatatgggtagcaaatgattcacaaaaggaggctactatctcagagtcaagtccatatttagtgctaaacttttgaaaagcatcagtatcaataagagatttaacacaatcatacttaagtttaatacctgactctttaccttcgtcgagttcccaatcttcagagttgcgtttaattctttccaaaagattccaccggaattcaatagtct

SEQ ID NO: 38718 - DNA, 413 bp, Triticum aestivum
  Clone ID: PAT_TA_38718
ggtcgacattcacgggtcacgggtctgatcaattgaatcatgcactttgatgtgacagttttagtcaatagaagcttaattatagaaaattgtggaaacaaagcccatgttctcatctgtaagtggctagttcacaataatgtcatattcctaggaaaattataaatcactatggggttaagcggttaggcacaaatttctaaaaatgtattattttcaataaacgaacataccaatccacaaatagtggacgcaccaacagaagatttgatgccagcacagtaactcatgagtgaacctgttataacaatttcgacaatacaaagattcggctatcaaatgaatactacaaaaattacaaatattattcgttatccaaaagggaaaagtaaaagatgaagaaacacctacct

SEQ ID NO: 38719 - DNA, 374 bp, Triticum aestivum
  unsure (1)..(374): unsure at all n locations
  Clone ID: PAT_TA_38719
cggcaggatctttacctgatctctcggacaaaaacagcttaactttgaattatggtggccttttttcatgtaattctttgaccgcagcagcagcttaaccttagagcagaacacattactggctacttattatgagttttgtgaaatttgcatcatgtttgtatatggtagaagtgtggcagtggatgatgaattgaattgactaagttagagtgaagtgtttggttgaagattgcggtattgcatttgccagaancaaantaactcatgaatgaacctgttataacaatttcaacaatacaaacattccgctagcacttttctcgagcaaaaatacaaaatattactcgttaaccaacaggggaaaagtcaaa

SEQ ID NO: 38720 - DNA, 267 bp, Triticum aestivum
  Clone ID: PAT_TA_38720
aaatccatgctgccaactctcaaggtcctcctcatccccgggattctcaatccaaccccgttccgtaacccctcccgaaggtcaactgaaccttgtaagtagatatccggaaccaacccaaatccttttcctttttttcggaaaaaccaacaagagcaatctccgaaacaagcccgatgagccaatctcgaacaaagagcacacaaaaaggggccgctcaagaatactaactcttaatgactcgtaaatggaatgtcatacctcttc

SEQ ID NO: 38721 - DNA, 312 bp, Triticum aestivum
  Clone ID: PAT_TA_38721
cggggccacgggtacttgcatagtacttacaacatgtaggttgaattctactgaacatccattgagtaactgagtggtgtgaatgcatgtctcatacaacccttgagaaatatgacataatgcaatgtatctcaagttaaaattcccaagtcatgtgatatatcaagatgaaaaatggtatggggccttactaatgccaacctaaaatgcatacaagtctcaagtcaatctattgatcctaagctagaacatttcatatataagataaaagatcaagtgccaatgtttcccttcgcatgttacaaaatgtta

SEQ ID NO: 38722 - DNA, 351 bp, Triticum aestivum
  unsure (1)..(351): unsure at all n locations
  Clone ID: PAT_TA_38722
ggtccacgggtagtaccgcatagacagtagcccctgatgctcggttcggtgttcggaaataaaagccggactgaggatcttaaaagatatacgcaggagtcataaaaatatgtcaatatgggattgcaggctgcactgctgacctctgccgcactgactgcggaggtcaatactttgaagcaaaatctcgagcggtccaagaacgagctcggccgtgccaagaagcagctcgaggacaaggaaggtgagtaacaccttattaaaattgtaccttacataaaaggattttggttgaagaatgacaaggataacgtgggaattgcangggccactaacgaggtggtgaccctg

SEQ ID NO: 38723 - DNA, 409 bp, Triticum aestivum
  Clone ID: PAT_TA_38723
ggtccaccagctcatggtaattaattatgctagcgagaatgtcatcctcgcttgccagggacttcagcaccgccagctcatcgcgatcaccgacgcggctagtgcgcttgtgaaagcccttgcgtgctggtgagaactcctttgacggctccgcagcccatcaagacatctctattgtggatgtcgcgtaacggcgagacctctctagttcttttgcgaccttggtcattgctccttgggtatatgtcatccaaaactcctcctatcggtcatggcggaatgacttgacaagtaagaactattttgttagtgattaagatacgaaacgttgagttaatttctagtgggtaattttaaaacccggtgctaagtgttaacatgtttaagtttgattcgtgtgaacaaattt

SEQ ID NO: 38724 - DNA, 140 bp, Triticum aestivum
  Clone ID: PAT_TA_38724
cggggaaattcaactggttttctgcagtcgacgattataaatgttgatcgattctctacctgatggaaaccggccacctgtatatataagaaagtgtacataactgccggttcagtaatgggcaattgcagagttctagc

SEQ ID NO: 38725 - DNA, 220 bp, Triticum aestivum
  Clone ID: PAT_TA_38725
ctggttcttatcctgtgttgatgcatggtctgttgatacacgcgcatttgccagattatgcgccattggtgtatctacgtgtcattatggtactcattgctttgtgtcatattgtgttcgtccggtattagctctcttacagaacgtttcgattgaatgccttgcctgttggttcgtaaccgaccatcattacttcgtatgatcttcgctattactggct

SEQ ID NO: 38726 - DNA, 134 bp, Triticum aestivum
  Clone ID: PAT_TA_38726
cttccatctcacagacacttggcttcgggcaatcgatgtgggagtggacattgtgttggttccttcgaaatttgggaaaataagcaatcaaatttaacctggcaactaaattccaatccaatttggaatcccaa

SEQ ID NO: 38727 - DNA, 324 bp, Triticum aestivum
  unsure (1)..(324): unsure at all n locations
  Clone ID: PAT_TA_38727
ggaagatctaaaacaatatatcttctgtgcaaatataccccaacataactcattacattgtcttccttgtccanattcaactaaatttctcaagttttaaataaataaagggtaatcaaaatcatagaagatgtccaagataatataattgtatgtgaaaagttccctccctatactaatcattcaagaatttcttgtatgatcaatattgtcattgtcaagcttcaaaagatttcactttctaaacccaatgtgaagccaatactaagcatgatatgaacatataatttcaaattcatgatattcaattcattcaacaatttt

SEQ ID NO: 38728 - DNA, 333 bp, Triticum aestivum
  Clone ID: PAT_TA_38728
agtcagtggatggagagctacgagcagtggatggagagctaagagaaaaaaaacatgtgaaaaatagagtgaagttcaagtagacatgccgagaagttcaagttcttcacgcggcgcattttcgaagaatttgttttgcgataaaggcagaacgaatgatctcgccatttttgaaattacttgaaaacgaccaggaatcagagaaaaccatcaacatgaaaaagtttcgcattttccgtagcttttcaacggtatattatttgccccattccgataaactttgcagaaaatacggcaaaaaatatgtttttaaccattttcagaactaacata

SEQ ID NO: 38729 - DNA, 422 bp, Triticum aestivum
  Clone ID: PAT_TA_38729
cgggtctcacttgagcggtagcacggccgttaacatcaacggcgagatcggtcctttcttccccaccctatgtggggttcaacaaggcgaccccttctccccgttcctattcaacatggtcgtggacgcccttgccaccatcctggataaggcgaaggctgctagccatattcgtggaatcacccccaccttgccggagggtccgggatttccctcctctagtatgccgacgacaccatcatcatggtcgaaggctcggaggcgaacatttccaacctcaagttcctcctcctctacttccaacaaatgtctggccttaagattaactttgacaagagtgatgttatggtgatgggcatgaggagtgtctagccattgccaaccggcttaactgccgcctgggctcctttcccatgacctac

SEQ ID NO: 38730 - DNA, 325 bp, Triticum aestivum
  Clone ID: PAT_TA_38730
ccgcatttatcatggtagtcaatacgcggatcgccaagctaaagatagaacgggatcgacatagtatcataggcagcagatgagtaatcgctgaggacccgaacttacatgatatcgcggtgcaatctgagattgctagtactcacagtgtaggattagccttgtcagcctacagagtttcgcatggcatccgcctattcttggggagacacatggaaccacagcttatgcagatagcactgttgcctaggctatggtatggcctcgtaaagcaactcctcgtacggctagtccatcagcaattttacgtggttcaactgttgga

SEQ ID NO: 38731 - DNA, 211 bp, Triticum aestivum
  Clone ID: PAT_TA_38731
gggcgacagtataatcacaagaaatatatatataggataataaggtggtgtattgccgccatgtccgttaacctgaggttggttccaccaaaaaaaaccgttacccccgcccaaaattttccgacccaagggaaaataataacaacgggaaaaccacccaaaatcaaaccggcttgtgaaataaatggttgcgccccggttttttgtcgcc

SEQ ID NO: 38732 - DNA, 435 bp, Triticum aestivum
  Clone ID: PAT_TA_38732
ggtcgtaattacgggtccacgggcatcacggccaagagaccgtggaacggagacggcgtcctgggtccacaaggctcctccggggggttggtttcccctaacggaaccccggctgggaaccccttcgcccggggcccgggtttttacaaattaaggtccccgtcggtcctggaagccctgcctttccgctggaaccgcgacatacaccgctgcttaaaggtgagcgacggccagctgcgctacgttcagatccatggtgcatctgagaagccggtggtcagcatctggacgctgtcatccagtgattcgtcaaaggcgacatggggaagcccgaccagcctccccttggatgtggttttgggaagacagcaactacagtgatgatccccggttcgtccgggggtcgtccctgctttgccgctggtccaccccatg

SEQ ID NO: 38733 - DNA, 141 bp, Triticum aestivum
  Clone ID: PAT_TA_38733
ggtccacggccagcacaagaaggaaggtgagcacaatgagggcatgatggagaagatcaaggacaaaataagcggcaacggcaattgcgactgcaagaaggatggcaaccacatgaactaaaaggtcttatcataataaaa

SEQ ID NO: 38734 - DNA, 462 bp, Triticum aestivum
  Clone ID: PAT_TA_38734
cggggccacggatacagaagacgaacaggtgagtggagagaaaaggatgggagacgaaatatctgtacagcttatcatgttctctgtccccagttccctatctgaccaccccagcttgcaacagtagcaaattgatgcctgtcgtgtccagttgagcagatgagagatcaaatgagcatttcccgtggcctctataacaactagcaagtaaggattcatcgacttttacttctttttgtggatccaaaccatgatgtctttattgtatactaacatgatttttctgccgtagatgactccaccgtgcttgatgtaccggacacattgcttgatcacactcattgtatttaccttttccctaatgctttattatgtttttcttgagaccaagctaagtcatttaagctgatgttttgccagatcgtcttttggttaatcatctcatgcacatatcaacaaaaa

SEQ ID NO: 38735 - DNA, 424 bp, Triticum aestivum
  Clone ID: PAT_TA_38735
ttcgcgggtccacgggcagattggcatgagccctgccgaggcggcggagtacaacaaatatatcattcgtgaggttagttccgggtcaggcacaccgctcatgccaaagcggaagttcgagacgtacatattcacgctcttcaacgaggacctcaagcccgggcccgtggccgagcgcaatttcgggatgttccagccagacttcacgccgatgtatgacattggcatcatgaaagatccggtcaaaacaacatcggcgccagcgtcggtcgtcccagcggtgccgcagaaagtgacagcaatgcctatggtcgctgctgctaatgccttggaagctggagtgcctacaaaggcgaacgactcgaacaacgcctaggcatccacgcaagcatcgtcgccaggcaacaaatccttgaccgatgac

SEQ ID NO: 38736 - DNA, 313 bp, Triticum aestivum
  Clone ID: PAT_TA_38736
cggggagaacagaaaggactgtgagcacaaggagggcatgatggagaatatcaatgataagatcagcggcgacggccactgcgacggcaataaggacggcgaccataaggacatgaatgacaagacgattaagaaggacactaagcacggcgagggtcacaaggacgactatgaccaccacaccaccatcatctcatcccattatcattctaccattttcctcggcgtgaagtaaccataatcagcagcgccatggccggcatcatgcacatgatcgaggagaagctccacatgggtggcggcagcgacgatc

SEQ ID NO: 38737 - DNA, 312 bp, Triticum aestivum
  Clone ID: PAT_TA_38737
ccacggggagccataaaaaacatgctcagtctccgctggccggtgtccaagagcaacccaagccaagaaccaacctgccgggggcaatggaaacaatttaagttaatgggaaattgtgggcgctcacagggtcaaggttacctgcacaatgctagccacgtacttacttacagtgcatgtgccatacatacaacacatggacacttacacaaatggcacatgtgagacactcccgggggcaggcaccctaaactatgtgtacaatttacctgtggggcttacgtgcttttatgaggaggtaaacccctgtgt

SEQ ID NO: 38738 - DNA, 168 bp, Triticum aestivum
  unsure (1)..(168): unsure at all n locations
  Clone ID: PAT_TA_38738
gggacggggcgagaacgcagnggactcggacctgcagctggagcggattaacgtctactacaacgaagccaaccggggaccgttcgtgccccgcgccgtgctcaaggacctccaaccccggaacatggactccgtgcgctccgggcccctccggcaaattttccgccc

SEQ ID NO: 38739 - DNA, 278 bp, Triticum aestivum
  Clone ID: PAT_TA_38739
ggggctcagtttatgaaatagaggtgaataatattttgagcggtatactttcattgtcaacataacaacaaaaaaatggcaaaaccttcaaggcaaaaaacataaaaggcggttccaaaccaaaatggtaaatttaaggcccccccttcaacaaacaaccatcaaccaatggcttgcccaaaacaatgattgcctcaaactaacaaaattcccggggggagttttgtttgcaattattttgatttagtttgcataaagcatggaactgggcatcccgg

SEQ ID NO: 38740 - DNA, 203 bp, Triticum aestivum
  Clone ID: PAT_TA_38740
gggtccacggcgacgacggcagtggcttcgatttctagatcgtcagggaggatcggatgtgcagcagcaaatttcttttgtacgctcttggtattattcagttctttcgtcttcagattttccgctcaaaatcgccggcgcctctgtgcgctgctggtgtgatatggtaatgtaaatatgagttttaacatgatatgttctgc

SEQ ID NO: 38741 - DNA, 351 bp, Triticum aestivum
  Clone ID: PAT_TA_38741
ttcgcgggtccaccgtttctatgattctctatatttagacgaatctgtaatctcttgcaaagctaaattagcggctgcgacgatgacaaacctgcagagaacctctgacgactcaactcaagttgaaatgcccagcacaccaattgtttcttggcctggctgtatatatagaaattacgaagttgctgtctctcatgtccctattgtttcttcgtttccgggcattgtcgttgtaaattagcggtgatcatggtttgttctccttgtagccgcgcccctctgtggcgccggatcccctgaactgtttgctatttctacttctataataatatcgacctgtgaagcttgtac

SEQ ID NO: 38742 - DNA, 277 bp, Triticum aestivum
  Clone ID: PAT_TA_38742
tcataatacgaatctgtactctcttgcaaatttaatttaacggctgcgacgattacatgtctggatagaacatctgacgactcatctcaggttgaactgccgaggagagcaattgtttcttggcctgactgtttagatacaacttacgacgttgctgtctcgcatgtccctattgtgtcttcatctccgggcattgtcgttttcaattagctgtgatcatcgtttgctctccttgtctcctcacgcctctgtcgacgcctgctctcctgatctgttt

SEQ ID NO: 38743 - DNA, 370 bp, Triticum aestivum
  unsure (1)..(370): unsure at all n locations
  Clone ID: PAT_TA_38743
gggtctgtcccaacagtttgtcggcgccttcatangcggacaaaagcctcatggccaggagagtgatcttcatctgctcgcccataaggaaggagagcccctgcgcaagtacattcagagattcagcagtgtgcagcacaacatcccaaacgtccaccctgccgcggtgattagcgcgttccatcaaaacgtgcgaaaccgcaggatgcgggacgaaatggcgatgtgcaagattaaggacgtcagtgagttatatgcactggccgacaagtgtgcacgtgctgaggaaggaaggagaccccccggagaaaaatgtaggagcgggaggatctaacattgaagatgctcccccggcaaggaaaaaccggcg

SEQ ID NO: 38744 - DNA, 358 bp, Triticum aestivum
  unsure (1)..(358): unsure at all n locations
  Clone ID: PAT_TA_38744
gggtccacggctgacaccatagtacacatatacaatggcaactcccaatttagtgtcataatccttcgataaacatggctgcaaaaaggcattatcagttattgtagaccccgttccgcctccggttcaaaaaaggcgtccctacggtactgatatagtgaaaagttcccatttttatcctcagcctatgcaaaggcagccatttatcatagtgaatgggctcccagtggaatcaccgccaatcgaagggcagtgacgtgcccaactggaaatggacaagtcatgtcaaggcagcanggctgcaataaatactctcccctccgagtcatctggtctcagaggttctttatcctctgaa

SEQ ID NO: 38745 - DNA, 442 bp, Triticum aestivum
  Clone ID: PAT_TA_38745
ttcgcgggtccacgggggaatgggagcccatgaccgagtcatgggggtcaatctggcggttggacacgcggcgccccatgcagggacgcttctcgctgcgcagcaccaacgagtccggcaagacgctcgtcgccggcgaggctcatccgctcagactgggatcccaactgagatatacagctccatcactccagttcgactaatcttttttagtcgatcgatcatctgatctaataccatatatagatcggaaaatataatgtgtgtgtgaagacgcatcatatgcgtgcgtggtgtcggtgtatgtactataactgatgaagcaataaccgctctgtgatcgatcgagttggctcatcttagtgccatacgtagcacggtgagacgtcgcctgtgacctccggtgattagtgtcgtcctccaacgtgtaccccagtccatt

SEQ ID NO: 38746 - DNA, 353 bp, Triticum aestivum
  unsure (1)..(353): unsure at all n locations
  Clone ID: PAT_TA_38746
gggtccacggcatcctgggagagatcatcgaccacacggagtaaatcctcaagactggcatgtcacccgcgtcggagaagaacctggtggaggttctcctcggcctccacggaaatgaagactttggcttccccatcacccgctccacggtcaaagcatttatcttgaacatatatgcgggtgggacagacacatctccatggtatgggtcacggcagagctgatgatgaantcaaaggtaatcaggaagctgcaagaaaagatcagggccggcgttccgcgagatcaatctccggacgagcggaagttgcatcaagtaccttggcttggtgatcaaggagacgttcaagctg

SEQ ID NO: 38747 - DNA, 420 bp, Triticum aestivum
  Clone ID: PAT_TA_38747
ttccgggtccacggaaattaagtcaaaaaaaaaaaaaaaaaatataaacatctaaacaaaaataaacaaagaaatccagatccaaaagaacaggaataaaaaccaagtttcaaaaatatgacgcggccgatctaaaggatgaaccctaaattactcgtgcatgaaacttcaaacccctcctatagggtacccaattattaaattaaccgaccttcatttaaaaacatcgagtcgggaaaacccttgacattacccactttatcccccttgaaaaaaatcaccttttggcaatatgaagtcgtactaaatgggcccgcacggttcaccttaccgaaaaattcccctactaaatcggtaattgggatctccctgctaaaggtcaatttcgcacgaaggttgtagcgtttacgccaacattga

SEQ ID NO: 38748 - DNA, 250 bp, Triticum aestivum
  unsure (1)..(250): unsure at all n locations
  Clone ID: PAT_TA_38748
atccatatccatatactaccaccgctaccaccaccgctgccatataccaccaccatatatccaccaccaatccnaattccttgcatattaagtttgttttcaggatccatctactttcccattcgtgtttccttgtctgagtacgtttctgattccagcaatcttttgcagtccatagaataagttggtttccaaaatcaaatacgaatccggaaacccccctccgtttaagcccaaaattttccgaaaa

SEQ ID NO: 38749 - DNA, 414 bp, Triticum aestivum
  unsure (1)..(414): unsure at all n locations
  Clone ID: PAT_TA_38749
ggtccacggggcgaaatggaaaacgaagtgtggtcgaggttctacggcgccggcttctggaggagcccctcgtcgctcggcgacgagaacagatgatcggcacaggccggcggctcctgcatgcatgcgacgccctggcttcgtctacggctttcttgattcttgctcgggtaggcttccttcgttttcctcggagggaaaccgatgtanaggaggaaatgggaagcttgtgtgtcgtgtttgatccacaccgcattcttgttccacttccaccttatatccactatttttttcttcatccttttcttgttgggtgtacgtcctctacaagggaaatgaacacttcccttctttgttgccattgtatgcaactaaatatatataccgagtgatgtgattggggataaaaaaaca

SEQ ID NO: 38750 - DNA, 474 bp, Triticum aestivum
  unsure (1)..(474): unsure at all n locations
  Clone ID: PAT_TA_38750
cggtccgaacattcacggggccacgggtacttggttagatacatgccaaatgttacgttcagattagttgcattatttcgttcattttttacccaaaaatctatacaaagtgttaattggacaatgtgaacaatgtggcatgtaccctgaaccctaacccccccccacacacacacaaaaccgtaaaaacattcaaaattttgccccacatggaaaccattatgcatgcattctctatggggtcatgggatgccatgaagaaagtttgggattatacacgcaagtacgatctctgacacgcgcatttccggcctagcatgtcaacaccccgaaagcccccttgaggtatagaccgatgttttgaccagtcagtccagaaaactagctttgtttgtgcaagagatcatgtgtgccaaaactgaagtgatttggangtgtccananaatcatcgcattccggaggggccatttggt

SEQ ID NO: 38751 - DNA, 330 bp, Triticum aestivum
  unsure (1)..(330): unsure at all n locations
  Clone ID: PAT_TA_38751
ccggcaggatatctactcaggctgggaattgcctgaccaaggtaattacatatgcaattcccccttctaatccaattcagcaatttgcaggtacttatgaaacaaaaaaaataactgtccgtgatcttgctagatgaggtggccgagtggaaggctgccgggctgggtgtangaggtctccaacgattcgtgagaagttagcctaagattctagttaagtgtgggtgttgggttgtacctgtgctacacgtttgttcccattcgtggcgcacgtcttgtaaatattttttcccttctataaaaatatggtacgtctttgtcgtattcttg

SEQ ID NO: 38752 - DNA, 225 bp, Triticum aestivum
  Clone ID: PAT_TA_38752
ggcaacacttaatctaaacgtgttatttcatgtagagctcagatcagcgaaacactggatgtgggtttcagggactttttgaatgggaatttgatggcactatgctgcgctgtgatttggaagttctcaacacgcacagtacatgtgaaattctcttacgtgcaagtcatctgctctaatctcgccatttttgaaattacctgaaaagcagcaactctacaggat

SEQ ID NO: 38753 - DNA, 395 bp, Triticum aestivum
  Clone ID: PAT_TA_38753
cgggtcggccggcggcggaggctctgatcttgggcgcagtggcgtggggcggcgctatttaaacgctgcacccggactgtgtctggcccaggtaccggccgagctctgttcactgatttgcatcacagtgcaccccgagtcgagctctattctgaacatgctccagaacacgctgggtaggattccctcgacctcctaaaacaagccagacaaagggacaaggtccgatggggcatcaatgcacatttcttgcatccatatcttgccaaaattctgataagtcaacgccttcaatccgggatacatgctcgtctgattggattaataaatcctcaatatttcctcacttagggaagatcgtctcatcacctccctcatagtcttgtccacattta

SEQ ID NO: 38754 - DNA, 311 bp, Triticum aestivum
  Clone ID: PAT_TA_38754
gtatcgctataatgagtcttatgaattgttgcgctacggctgtgagttctttatggctgtcgttgagtctatggtgtagaagcactacgcagcttccgcgagtgccagccatgtcgataccgcacacctttcgcgcggtgtcatacagcgagcagatgccttcctcagaacagccagcagacgtacatatcatggtattgtccagagacgattccatgatagattgccatgcagctttccaccgttgcgtctaggaggcatgcttcatcattgtcataatgcgttgcatgatcatgtgcttgacattgttt

SEQ ID NO: 38755 - DNA, 289 bp, Triticum aestivum
  Clone ID: PAT_TA_38755
acggggaaactatgtgtcgtattacttttccaacaacttatttcaattctttatcaataatgttgcctccatggattttaagtaactcttcagctttcgaggattgcctacacgttcgaagattacatacctttccatggtactttatagcccttatatattttcatcaaaattacctatcatcgtattctatcatggtatttctatatggttccgacatatattgccatgcatctttccactgttccgtttattatgatacgcttcatcattgttatcttgctttgcc

SEQ ID NO: 38756 - DNA, 234 bp, Triticum aestivum
  Clone ID: PAT_TA_38756
gcggcggcagaactgattttgggcgcgtcggcttgtggcgagcctatttaaacgctgccccctggcggtgtcgcgctcgggtacggcccgaattcggttcgcgtttttttagtccgtgcagaacagaaagagggagaaatactaaacggactccaaaaatcctgaaataaattttccctggcttctaaaatcaggccgcacaaggtgaacatttatttgaggcctaaatgcaat

SEQ ID NO: 38757 - DNA, 117 bp, Triticum aestivum
  Clone ID: PAT_TA_38757
tttccttcgggcagcaattaatctttccaatacggagatgattcctgaattcaaatgaatctgtgataccattcaagataattcctggtacgcttttattaataaatcctcaatata

SEQ ID NO: 38758 - DNA, 419 bp, Triticum aestivum
  Clone ID: PAT_TA_38758
ggtgtcgtgatatataaacattttgcgaatgattatctgtttacttaccctcatcacctcatgtagagggaggttgaaggagcttaaactgaaggcgttcatatggattttcacgggtgcacttgtgggattcacaattcctggtttcgcctacattggccttggagacacatcgccaggatacgcggttaacttctataacatcataccgattgccgccttcatcctcgcggtccttttcaggaaggagccactggacatgacgagcctggtggggaacatcaggttcattggaaccctagtctgtgttggaggaacgctggtgatcacccgttacaagggcaacgtgctgcacctttggcccacaaatatcatcggctaccacccgaagcaagcccgaactgcctttgggtaacacc

SEQ ID NO: 38759 - DNA, 432 bp, Triticum aestivum
  Clone ID: PAT_TA_38759
ggtaccgagctatcacgggccgacgggggttatagttgaaaaggatagtagtaacgatgggggaaactttgatgcttttgctaatactaatcctcatgaagaacctactattttgcacactaaaaagtttcacaatggtaaggggaataataatgggaaaaggggtaattcaagaatttcctttacttggtgccgggtgctttaaccactatgggtggatctattctccataaaactagtagtcttgcagatgctatatctttgctcatagttgaacttgaaagacaatttattcacatgcatccttccatacaaggaatttttctagagttttctaatattgagcattcttctgttaagcgcgcagctaccatctttctagcacatgagttcatatttataataaaagaggctagtgaaatttttgcacat

SEQ ID NO: 38760 - DNA, 414 bp, Triticum aestivum
  Clone ID: PAT_TA_38760
acatgctcaagcatttcaatatggcggtctatccttggtcggacctttgagttccttttcggatagcggtcgcatattgctgcgtgccattataaccgacgcttggggatgattaaggcactccatgatattcaccgataatcacaagcctaagcttggggatgcccccagaatgcatcccctctttcgtcttcgttcattggtaactttacttggagctataattttattctccacatgatatctgttttgcttggagcgtcttgtattatactactcattgctttgtactttaccataatcatcctttgtcgtacacatccttatgggatacagcctactttgattataatctgctggaatactctatgtgcttcacttatatctttcgaacttgatagcttttggtccaat

SEQ ID NO: 38761 - DNA, 439 bp, Triticum aestivum
  unsure (1)..(439): unsure at all n locations
  Clone ID: PAT_TA_38761
ccgggtcgacgggggatgaatagatgcatgtggaggctggaggaggtcgatgttggagatgaacaatatcccatagagtcccgttttgcggtatgccacacccctcccgatgaacaggacccccgttttgaccgcaatgctccaacacatgtctgtttcctccgttttgcggtacgccacacccctcctgatcaacaagaccctgtttcgaccgtangaggtccaacacaagtccgtttcctcccttttgtggtacgccagacccctcccgatgaacaggatcctattttgaccgtgccggtcgaacacaaggtcgtttccaccgttctgcggtacgccaggcctcgtttccatcggctgttccgtccaagccggttggctcccaatgaacatgacatattctgacccagtcctttgcctcccgatgaacaggaccttg

SEQ ID NO: 38762 - DNA, 222 bp, Triticum aestivum
  Clone ID: PAT_TA_38762
gatgtacaattatgtggggcagtgaggtgtcgatgaatatgggccgagtactaactcaccggaacggacgctgttcttgatgcacagaataggagggcattcttgcaccgcatgggggcgaatgagcacgtgactacacatcaaatggaatttcgcacattcctacgtcgaacgatcaactgccatctgaagccatttataaccttgacacattgagaagca

SEQ ID NO: 38763 - DNA, 425 bp, Triticum aestivum
  Clone ID: PAT_TA_38763
atagcccgcttgcggggcagaatcacatcgtaaccttataaccacgatgtacgatcgtgttggtacacaatacgtatgagaaacaaatcacaaggaaaaaaatgctacccacagcagccgatctctccttcctccccccgtcgacgggaagctcgccggcggcgaggtggcacgggcgacggacgtcggaggcgaaaccgctcgacgaaacagaaggagggagcagcgctgaccgaggcgttgcggcctcgggcgtacggcggcgagatcgatgctctgtcgccggcggcgggttggggacggtggcgagatcgatgctccagccgccatcttgtcgtttccctttcaccgaggatatgcatttgcgaacgtgatttgacgattacaacctcccaaccctcccagggccggcccataaagacgga

SEQ ID NO: 38764 - DNA, 406 bp, Triticum aestivum
  Clone ID: PAT_TA_38764
ccgggtcgacgggattctttttgacacttaaggaaataatctacgaatcaccctcctccaggatgtttcgtcgtggtatcatggcaacccaactcctcgctacgtggacaatcgtttaccaccttcttaagtgtggaattgttgtccacctagtgaaccttcgtcatccgtttctttccacccctcttgatgcgtatctcgtgtctcaacctgagagatggttctatgtttcattccgtgagttgttcgacctttgagaagatcgatccttccagaatttttttccctctcgttgtcatgttagctaaaattctcaaaagcaggacatcaagacaaagatggtgatcaaatcaacgttcctatgaagtgcaagttggatcgtgaagattgcgctagttgcgttccc

SEQ ID NO: 38765 - DNA, 418 bp, Triticum aestivum
  Clone ID: PAT_TA_38765
attcgccgtccgacgagtgaaagaaacaccaatcgattgatattcacgtacacatatcgtgaatatataactgttcaagactgtcatccgggatgttcctgatatatctacttttcattgtgcttagtggggtttatgtcactgttgtttgttctcgctgccgctatgctatgcatctgccaagcaagcaacatctcaaacttgtgttgttataacttgttcagatggatcttatgtatattacgttgtttcattgtgcatctcacatacaatgtgtttcattttgaaaactactgaatacaacattcacggtttcacgagatactgcaatgctcttcgaaccaaccttgtcatgcagctaactcaccggctttaatctgtcgaactctaaatattccgctttatgcctgaatgtcct

SEQ ID NO: 38766 - DNA, 385 bp, Triticum aestivum
  Clone ID: PAT_TA_38766
ccgggtcgccgggctatattaaatgcgaaatggctgagtatacttggaaaatctggtgtatttagttggccaatgattttgagtagtattatcatcatggtatgcttcaccctgctcctggaaaattgaacattatctccttgtatgctattgataacctggagtgtggactttcctgctgtggttcatatgatttgacgtgaatcggcttcagatgaacagcagagaaaacgggactcagcattctcagtgtcgtgtttgcttgctagcacatcttttctgggctccactcctacgcattgatttgtctgaccagttggcatggtttggaggatgtaaatatactacagaagatgcgtcatgtgacaagcctgccctagtgtgt

SEQ ID NO: 38767 - DNA, 458 bp, Triticum aestivum
  Clone ID: PAT_TA_38767
gggtcgacgggaataagagcaagtgacagtgaaaagttactctaagactactgctgaatcaaatattcaacaatagtctcgaggactacacctagtgtgtgccttagcgtgcccccactggttcagatcagtactcagcagggtatgcccagcgtgagtccaaaaaagagagagaaagagagtacattctaagacctcacactactaggaaaaggcctactaatggcgcaccggttttgcctactaatggcgcactaccggtgcgccattagtagcacgccactagtattttttactaatggcgcaacacccgggcgccattagtatctgatatactaatggcgcaccacgaagtgcgctattagtatgtaagaacatgcgccattagtatgcctcccgggggggccatacgtaaccatgtgctttgtcatactaatggctcactctgtggtgatgcg

SEQ ID NO: 38768 - DNA, 479 bp, Triticum aestivum
  Clone ID: PAT_TA_38768
ccggtccagctagcattggccggtcgacgggtggataaataacaatatccgagaatgtttttgccgaatccctaaaggtgttcggcgttgcactgcgagacttctgttgaaaatacacaaatagtttgaaagtgccatgggctcgaaaagcgaaaaaacttattcaaaatgttaatgtccgaactagatcaagtgttcggtgccaatccgaaaattggactttagaaaaaaaggtgcttctgccgtgctttaacatgacacatcctatctcaaaacttcaagcgggtcagcctacagcttcaacctcctatcccgaaagcagagtacttcttactaggcccgtttagcaaactacactctatcggctttgagagagaaattaagctccaccgctagcgaccgcacacttgtgtcaaaaaaaaggattggcaaatactactaacaactttgcagcgactactaagaaaaacacttatcat

SEQ ID NO: 38769 - DNA, 350 bp, Triticum aestivum
  Clone ID: PAT_TA_38769
gccggccgattgggtcaccaacaatatcaatacctcatgtatcttcgcattattcagattgctttaccatattcttgcgcgttcttaggttatttggaacgaagacaccttcgaggccaggttgatcgtgctcgagcgtggtcaataacctcacggacttagtttatccattgccacagcgcaagctcgtgcaagtttgtactccgatctccaaagtcgtttccaacaggtcgatagttatcatctcagtgaaagatcgggacacgctctcctctagtaagtgagatcagttttcaagatgctcagtaagaatttctagttctcatagatgagatgtatattcttaccta

SEQ ID NO: 38770 - DNA, 377 bp, Triticum aestivum
  Clone ID: PAT_TA_38770
gacgcggacgatcacaaattcatgaactttctttccatccttggttaactaactcgacccatgtatcctggcgataccccctagctggagataagctaccagttgctccttgaaagcgaacgatgaaagactgcacatgacacatagattgagttttgtccacggatgtcatctcccccctgccctgcccttatcttgccgtccccaagccaacagatgcatgtgcgttcagctgacgcggatccgttgttgatgagacgtttattaccaccgaaaaattacgattccttaagacgaagatattggcagaattcgaaaaggagaatgaatggcgactgtcaagtcaggtatggaaacgtgcactggtgcgagctaaa

SEQ ID NO: 38771 - DNA, 459 bp, Triticum aestivum
  unsure (1)..(459): unsure at all n locations
  Clone ID: PAT_TA_38771
tcggccgagagtgctattaaatattttaaaaacaaaaaaataaagaggggaacctaaaacttttcaaaaaggaaagtgaaagttataaagacaagcattgttgaagtgagagagctccttgaactttgttcatgctcacgggaactctgtgaatcttgatttacaaaaaatttcaaacaaaaataattatccctttggtcaattccaacctattaaaaaaataatggtgcaaaggttggctttaaggagtttaaaatgcttggtggtttgtacggtgcaaggcaaaaaccttgggtgtaatgccccaatttaaaattttaactggaaaggcaaacgggtccgattccttttgcactgtctttctgtacaaagtttctaattttcccaagttttggttaaatttttggggtaccataagtangtttaatgttcagatttctacagactgttctgtttttg

SEQ ID NO: 38772 - DNA, 369 bp, Triticum aestivum
  Clone ID: PAT_TA_38772
gggcaatggcaaagttgagtgtagaaatcgtacccctaacgtatcacttagtcgtcgtaagatcctgcaacatgagacgttgcagccacaaagggtcagtacattgaatgtactggcaaattcacaccaaagagcaatgatgaataaaggctatcactacatgcatatatggctggtggaaagctctatggttacagtttttgcaaaaagccaatttttccctactacaaaggaataaattttacttactatcattgtggttgtttaacaatgagaatggttgacactattctcaatcccaatttaacatcatcattaaaacccaacaaaatttattataagtaacatgattagattaacatgataatc

SEQ ID NO: 38773 - DNA, 281 bp, Triticum aestivum
  Clone ID: PAT_TA_38773
ccgtgttaatccaaggatggatgcttgacccaactgtggttgtgtgtcattatggtccttatgtcaagctgttaattgtcgtgatttgccggttggaactctacatgtttgccaattaacctgtgcagcgggtgcaactttggcacagtgaactattacttactttgtgaaaacaaaaacgataaaagggaatacacagtgcggtcccgtcgctcggatggatgcttacgtaggtatgcatgcaacctcagtgatattccatcgagggacccacttacatt

SEQ ID NO: 38774 - DNA, 393 bp, Triticum aestivum
  Clone ID: PAT_TA_38774
tacggtctagtattccgggccgccgggcatgctaaaaagtggtatttattcataatttggttgccaaatctcatgcgtgcaatgcacgtgtaccttactctagtctaaatggtgtttctgtgcttagttctgctgagctgtacaactctgaaactaaaagttggattacacttccaagcatgaacaagcgtcggagaatgtgttctggagtcttcatggatggcaagttttatgttattggtggaatggccagtaacacggaggtgctgacatgcggtgaagagtatgatttagagaagggcacctggaggttgatagagaacatgtccgaggggctcaatggtgccagtggtgctcctcgccttgttgctgtaattgacaatgaactatatg

SEQ ID NO: 38775 - DNA, 373 bp, Triticum aestivum
  Clone ID: PAT_TA_38775
ggcctatcaagaagagcagtaatataaagcttttgagcttaagcacatgaatcaagcccccagaatccgatggcccactgagccagttttaagttggcgaggaatggtggagcactgaaccttgccacacaacggcacccccttcgcctgatgaccttttccgatcacgatgacctcctgtcgctgctgaacgaattgggaacagtactggaggaattgtgatctatgtcaagggtgatgatgtctatggaaatgattgttgagtgttatgatacatatggtgatgaatggtgacgaatctaatgtctttcgtcaagacatgcaacaaagtgaagttatgaagttctggtcaatttagcttatgcataatgct

SEQ ID NO: 38776 - DNA, 402 bp, Triticum aestivum
  Clone ID: PAT_TA_38776
tcccgggtgcacgggtacgacaaaatatgatgataattgaatttgttccgccgaaaaaacaaaacctttgaacccattaaaaaaaaattaaggaaaccacaggaacgatattttgcattgattcttagtgcaggatgacaatacagcaaatttcataggacatcatattttggtacgatttttgaagttccagaagttagcgttaggtacatattgctatacactgtactgtttttgacagattctggctttcgtgtgttgtatgcttagtttgatgcacctatggctactatgtaagggtatgaaccatagacaacttggaatacagtatgtttaacaccaagttaaatacagattgagttcattacagtaccttacgttgtggttttgtaatctttcact

SEQ ID NO: 38777 - DNA, 391 bp, Triticum aestivum
  Clone ID: PAT_TA_38777
gggtacatcacatgtccaatattgaattggccgatggtggcggcatccgtggacaccgtatccttcatgaaggctccgtcgtggtgcccttactcctttgaattgctccgggtgaaaactcaatctttgggatcggatggtggcggctatcagtggtcgtttggcaccatcttggagtccttgttccgtcgttttccgtctcacctctcctcggaggattggaggactccgttggctccaagcggatcatcctcgcgtatgtgtagtggctttgtagtcattggggtggtgtggcggtgctcggcacccttgtatcttgccttgagtgtgtgtgtcgtgtgtggtggtggcgtgagtttgtatcgtcgtgatgctttgtgattggtgcctt

SEQ ID NO: 38778 - DNA, 284 bp, Triticum aestivum
  Clone ID: PAT_TA_38778
acggtgttaacaattgtgagtctgcattgttgtatcgcgacctcaatgaatggaataaacgaaataacgctgttgttcaatcatcaggctccggttcagtactgcaccaagctgtgatttttgcctattttgaaaataagcacatgctgctgtgtttatttaaacaccatgaagcgcatacatgaaagaaggcatgacatataaaaagattaagcatcaacaaaaacgaggccgctcttaaggatcaagccttcctttagcgtcaatacgacgtcatacctctt

SEQ ID NO: 38779 - DNA, 213 bp, Triticum aestivum
  Clone ID: PAT_TA_38779
acgggaccaataatacttatctataatttttgattgttccatgctattatattatctattttggttgttaaggggctctactttacagttttatattatttttgggactaacctaatatacggccgcccagcacaaattgctgttttttgctacttttagagtttcgccaaaatggaatctcaatacggaactcgatatggcacaacaccttc

SEQ ID NO: 38780 - DNA, 377 bp, Triticum aestivum
  Clone ID: PAT_TA_38780
tcccgggcgcccggggaatctaatatcttgcacactaaataacttatcataggtagcggcaaatattattggaaaaggggttattcaagatttatttacttgtgccggtgtgttacccatgttaggtggatctattctccataaaactagtagtcttgtggatgctatatctttgcccgtagttgaacttgaaaggcaatttgttcatatgcatccatccatacaaaggatttttctagagtttcccaatattgagcattattctattaagcgcgccgccactatatttctagcaaatgagtttagatttattatgaaagaagctagtgaaattttcgcgcattataaagtagatggtggtcatcctcctatagaag

SEQ ID NO: 38781 - DNA, 383 bp, Triticum aestivum
  Clone ID: PAT_TA_38781
aagattctggcaggcgatgcccgaattctcgagcgccttcacatcattagtgatgtccaccgtagcgaacatgtagtgggggctattgacaaacctggcgaaacgctcgcaatgccttgtcgtcaggcagtagtggtagacgaggacgtggtggcgcacacacatctgagcgacgacgaccttgggacgcgacccggcacgagcgcgagcgtactcaaggtcgaacccgaccaccttgtacttctccgcggcaagcaagagctccatgatgtggatgtagtgctccacccagaatgggtcgttggtgtacaccatcaagaggtacatgaaccttctggtgggtgtccaccacggcacgcatggtgaactgctgctcgtcgtca

SEQ ID NO: 38782 - DNA, 355 bp, Triticum aestivum
  Clone ID: PAT_TA_38782
cccgggtccacgggagccacaacatctccgatgacggtgagctggtggcacgtcacaacaacggccgtggaggcgtgcggtgacgttgggtgaaggcgtccaaggcaacaacgacgacctgtcagggcaggcaagccgcacggcgagttcatggcttagaaggtgagtgttggaataagccacgccccacgctccatgatccggccggtgcgtgcatgctgatcaagccagttcggtggtccgcagtcgtggcgaagtgtagcgtgtgtgcacgctcgaatggggcgcatggccgggtgtgttgttagtgtatggcgtgagtctgttgtaattttgcccgagtcgctaggacgtg

SEQ ID NO: 38783 - DNA, 331 bp, Triticum aestivum
  Clone ID: PAT_TA_38783
acggggccttcagtctgctcatgcattcttctgatatgatcttctcgtctttggtcacaacatagctgtcactaccttgacacaattccggttgacggtcatcatggatctaagcgattggtggccatgaaatctgatgtctgcgtgggtgtagatgtcgctctatatgtttaacttttatgttcctgtaagtctacgtcataactcttctatgatgtctgctacgtttatttcattggtcttcgttttttaacttcgtgatggtgatgtccctgtctttatccaacttattcacctttgatgcacatttttttttctccaactggcgtac

SEQ ID NO: 38784 - DNA, 455 bp, Triticum aestivum
  unsure (1)..(455): unsure at all n locations
  Clone ID: PAT_TA_38784
taccgagctagaattcgcgggccgacggggcagctcatcggcaagacgcccatggtgtatctcaacaagattgtcaagggctgtgtcgccaacgtcgccgccaagcttgagattatggagccctgctgtagtgtcaaggacaggataggaatcagtatgatttccgacgctgaagagaagggcttgataacacccggaaagagtgttttggtggaagcaacaagtggaaacacaggaattggtcttgctttcattgctgcttccaggggatataagttgatactgacaatgcccacatcaatgagcatggagaggagagtcctactcaaggcttttggcgctgaacttgtgctcacagatgctgcaaaagggatgaaaggggccctagataaagctacagagatcttgaatangacaaccaattccatacatgcttgagcagtttgacaaccctg

SEQ ID NO: 38785 - DNA, 292 bp, Triticum aestivum
  Clone ID: PAT_TA_38785
acggggataacaatctgcagacggatgtagtgattgtgtatgataacaagcaatatgatcctattgcgatgcatgctgctgatagctcatctcaccttggtcgacactctttgtctgggagttactggtatatcgagaatgcttgctctaaatgatggatatggtcaagaggaagggattgacgaggctctcaaagtacatagctagtgattaccatcagcatccaacggaatgatagtccttcgttaacaccgatgaggttcatcaatgaatggtatatgtacgcatcttg

SEQ ID NO: 38786 - DNA, 192 bp, Triticum aestivum
  Clone ID: PAT_TA_38786
tacggtctaagtatccgggcccacgggtcagaataaaattagttggttaattcgttgggtttcctttctttcttggtgtgagatgagatgctacctacgactcagatccagtcaaaccctgctgcttctcgttcgctggtgtaaatataatataaaagtggatcgcgccgcgcgcgctctttcttgaccccg

SEQ ID NO: 38787 - DNA, 284 bp, Triticum aestivum
  Clone ID: PAT_TA_38787
attcggcgccgacgggcataataaaactctagccgtttagcttttgccaccgcgtatctatcttccatcatacttctccatgcagtggcacactgaaggtgtacagatgcttcatcggtcaacaatgtggaggctgtcgtgtgctcatatatatgtaacatctctagatacgacacaatatttatgccatctataactatcacaagagatagtattgtctcataagctctgtaaggactgatgttctccgtcgattgggtctattctgtgtagcaacatcatac

SEQ ID NO: 38788 - DNA, 236 bp, Triticum aestivum
  Clone ID: PAT_TA_38788
tctgtaaatctccgttggtgcgctggtgactgtgcagtatgcgcagaacgtgattatccacacgatccacgttagcgttttcatcgttggcactggcggcaggatctcggaggcgccgcagcattccgggttccgtatccagtcttccggatatcgcgtgagtgtcttcggatctatcacgtgtggctcttatacttctccttctcgacctgccagtactgcctcattgtcgtcat

SEQ ID NO: 38789 - DNA, 435 bp, Triticum aestivum
  unsure (1)..(435): unsure at all n locations
  Clone ID: PAT_TA_38789
cggggtcacgacgacgtgcacggcgaagacgagcttgatggcgagcgcatggaccacctcggctccgttcggtgctcgggacggatgaagacgtccgtggcgggcctccaggacgtcctcccacgcgaaggcgacgacggtggtcgcggtaatgacgatgacaagcgcggtcaccgtgagagtttccaagctcgaattcgagcgaaagaagaagggggcgactggggaaagaagggggaatggacgagggcggctagggttttcgttggacgcggttataggccatgggggagcacgtggaggccatccatggccacggcagccgtgggatggatgccatgacctcctctgaacgggaagaangggattgccgttaagttggcctggactatgcactgtaccagtgggctacaagtgcacagtagtagttaggtc

SEQ ID NO: 38790 - DNA, 375 bp, Triticum aestivum
  Clone ID: PAT_TA_38790
catgaacgcgcgacggaccgccgctgttgtgacgcatgccaggcggactgtgagccatgtcgaccatcaggacctcttccgcgaggtcgctgctgtcgcactcgaatagggtctcgacggagccagtcgacagatcaaacaggccgtagagagattcgtcgggctcaattgccgcgacttgaggggtggccgacttacgtgccaccacatgcttcacccaccactgaagccgtgactgaccggatctcttgtgacggcgagcggcggggagcaaagatgttgcgggggccaaccgatattgagttgccggctgccacagaaggacaccgcgaatgcacgcgcaaaagtgcgtcgccccgcggacgcggagcgcct

SEQ ID NO: 38791 - DNA, 355 bp, Triticum aestivum
  Clone ID: PAT_TA_38791
aggcccagtattccgtcacataacatagaatgtcctgcaccggatgtatggaaggaatcgggcgtgtgttaactgatctaatgttacaccgatttcatcatctcctcgatgacgagaagattgttccgaacagaactcatctattatcagtgttccgttgtcagtgtgtagtttactctgcatcggaactttgttttactcaacgaatgcatactgctatcataaatgtgtcaatgttgatcgtagcatgtcatacctgtctgactgatacaatgatcaagtagtccatgaatgataactcctgtgtcatctcagtttcaatcatcttgagagccccatggaattttctgcgtcg

SEQ ID NO: 38792 - DNA, 296 bp, Triticum aestivum
  Clone ID: PAT_TA_38792
gacggggcttcccatgatactaattagtacaatatggtataaggatatacatgcgtcatggagatatcttattactgagtttgatcacttatgcatatttatatggagtagatgtttgtgacaatagaaacaatgtcatatgatgacccctcgtgtgcttatactatatatttatttaagcaacatagtatatatgtacattggtcggagattacaaatatgtaatgatacttattttatgtttatttttacccctctgtatctaaaaggaagtataaagaaaggtcttatatttt

SEQ ID NO: 38793 - DNA, 434 bp, Triticum aestivum
  unsure (1)..(434): unsure at all n locations
  Clone ID: PAT_TA_38793
tcacgggtcgacggagaggcagatgctgctgttacgttgtactgttagctctgacgttaattaatccgttaggccgcgtaggtgtccagcaaaacacggcatcaatcgctttttaatacgctttaatcggtcgtcgtacagaacatacatatgcatgcgtggacgcccattgtgcacgtccacatcccccgaaagatgcagagttgcagacgaagagaacttgaagaagaaagtgattttgatcgactgttgttggtttgaccaagatgaacttacacctggccatggcgcagaggccggatcgcaggcctaactctcaagagctctgatgtgaggtgaaattgaactgaactcaactccattgtgctcattcatcaggccagtcagtcagagagtcngcgtcaacgtaccctagctagctgtccctagccacc

SEQ ID NO: 38794 - DNA, 412 bp, Triticum aestivum
  unsure (1)..(412): unsure at all n locations
  Clone ID: PAT_TA_38794
attcaagggtcgacggggtctgcaaactttgaatacttctgtaactccaaaaattctgataaattacgaaaacctgggaaatttgtatatcaaacttttgttaaaaaattcatatcaaaagcacgtttctgagatttttttaaaattgttttaccgagcgcaaaagtttttgtttttcagcaagatcaaatcaactatcaccgtaagccatcccaacggtcttacttggttcaaacacaaattaaaacaccaaaacacaattactactgttggcaatctangaacngtggtcncaacacctgcctgcctgcggcccgcggcgtggctcctccggcggccctgtacgacccatcttcaccagcaaacattcaagaccctcgcgaggggccaagcctcacgaggcaaacgtcgc

SEQ ID NO: 38795 - DNA, 237 bp, Triticum aestivum
  Clone ID: PAT_TA_38795
agggaaccctatagtgatgtcctatgaggtataaacatagagaagttggaatacagtaggttgaacaccaatataaataaagaatgagttcattacagtaccttaaagtggtgggttatgttcttactcaaacggagcttacgaaatattctgttcaagttttgttgtgtgtagttttcatgtcatttgggtagagaattgatgtaattcattttaaagaatggattgagcctagcc

SEQ ID NO: 38796 - DNA, 285 bp, Triticum aestivum
  Clone ID: PAT_TA_38796
actcgcgggccgacgggcatccataggatgaggcggagaaagggaggggagagccatcatgtgcaggacacgagcacgtttcttctaggtattcccctgtcctttattcgaagcaagtcaaattaggtaataataacactgcaaatcttgaaaaaaaaaaaaaaaaaaaaaaaaaaaaaaaaaaaaaaaaacgtaaataaaaaaaaataaaaaaaaaaaaattaaaaaaaaaaaaaaaaacaatgaaaaaaaaaaaaaataaaaagagatgtcacgatagctacc

SEQ ID NO: 38797 - DNA, 455 bp, Triticum aestivum
  Clone ID: PAT_TA_38797
gtaggcgtctagaattcaagggtcgacgggccacttctggattgcataccaaagatggcaatacctagatctattcgtgtttttatgcctagctaggggcgttattcgatagcgcttgttgggaggcaaccctattttatttttgttatttacttttggctcatgtttagtaataaataattcatatagcctctggttagatgtggttttaagttttaattagtgtttgtgccaagtagaacctttgggaagacttgggtgaaagttaatgcgatcttgctgtaaaaaacagaaactttgcgctcacgagattagatgtaattttttttatagaagagtgattttaagttgattatttttgcaaaagattcatagtaaaattcctcatctccaccaatttattttataatttttggagttacataagtattcgagagttacagattcctacagac

SEQ ID NO: 38798 - DNA, 400 bp, Triticum aestivum
  Clone ID: PAT_TA_38798
tcgcgggtcgacgggacggtgtagattgtgtcggtcaagtctgaagactcgctggacatggtgctgctgccgggcaaggaagcattgctcatgcccgaggaatgtagcaagacatcttccagcgccggctctgggcgtgggatgacgtcctgggggacctcccaccgctgatgatcggcgtcggtgatgcgcacgtggagctggttgtccgtctctaggctgcccccggtcatatcaaaattaatacaatgagcatacgagttgtgtgcattatgctggttgtaatggggagtatcatatactagtatcatgcatatgatactagtgtgtgatactaccttcgcaatgcatagtatcataagttagtatttttgactgccttagtaattgccatgcatga

SEQ ID NO: 38799 - DNA, 361 bp, Triticum aestivum
  Clone ID: PAT_TA_38799
tcagcagcgcgccgacatctgctctcttgtacatggatggatggaagcgttggcccagcctgttgtcttcttgcccgcgtgttgtctctgtgttgtatcataactcgaatcaattcgttggttgtacctgagaggccattcctttcattgcctaggaatgattttaagttggtgcattttggatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaaaa

SEQ ID NO: 38800 - DNA, 443 bp, Triticum aestivum
  Clone ID: PAT_TA_38800
aattctagggtcgacgggccattcttcagtacaaattccatctctgttgtagcatgttttataactgaatcaccattcttctatataaggcatgcaaggggaagacgactatgttagaatctgaagggttacaaatcaggtctttgcaaaagatccaaactccaggagataataaaccaactccatttttcatagatactgctccagcacagagaaacccaactcccactgataataagcagatttcaatggccaaagaactagtccgctccagtccagcaaaagaatgtcaactccattctaagaagcgtgtgcgtatcctcgcatcatgaaattttataccattcttatcatattttctacatgtttcttacccgtctctcttttagaaaataaggttaaacgatacaagacttcctccattgggatcgtattcgaggaaa

SEQ ID NO: 38801 - DNA, 413 bp, Triticum aestivum
  Clone ID: PAT_TA_38801
gcccgggccgacgggcggggctgtcttgaagagttgtatgcagcttcgccatacacctccttcatcaacaacgacatcctggacatctgtgcgagacagaaaaaattaagacttgaaaatacgttaaagcacaccacgcacgtggaatgaaaaaaaggaaaaaaaagtgaaacacagaccacatacaatttcgacacgttctccatggagtcggttccttgaaaggttacgccctgtatatctccacgagtcatggatatccagggactcacgatacttgttcatagtgtacagtgtgaaatgattccgattccaatatggtagcatgatctatcaacatgtgaattagacgacaaagaagagcataagaagttagctacaagatgtctcagcagtttagaagacaacactac

SEQ ID NO: 38802 - DNA, 151 bp, Triticum aestivum
  Clone ID: PAT_TA_38802
atatgccttcatcctacgtcataactcttctacaggttcgggtagattcatctcacaggacggtgtcttacaccatgaccactgggaaaattctgaggatactcaggttcatgtccttgtagaccatggacgtatcgacacccgtgttttt

SEQ ID NO: 38803 - DNA, 399 bp, Triticum aestivum
  Clone ID: PAT_TA_38803
attcgcgggtcgacactgttatggaaaaatgtggtactagggtggtggcttgggatcatgagggtctcttccaagcagcaaggtgtgctaagtatgatggtattacagatccacttaacatagaaatcctagcctgccgagatggaatgcttctagcgaaagatttcttagggctaccaatctgttatcactgagacagattgttctgatgccaagtacctgtgggaaatgaggaaggaaggacggtcactaggtgtgcgtattcttaaggaaatgcaagacaggttatctaatttttagggttttgagcttcggtatattagccgtatttgaaataatgtagcacattgttgtgctaaagaagctctaggcataggtccagttcttttggccgattct

SEQ ID NO: 38804 - DNA, 381 bp, Triticum aestivum
  Clone ID: PAT_TA_38804
catacaaggaaaacaaattggggctatttcaagcatgtcgaaatacaacgtgctctcagatgaagccttttagcctacccgaaccccctccattaaacatgatgtatttttgaacatctttgaaatgaaaccaacttttgaaagtatgtgggaacgcccatggtaagcatcgatgtcaagtttggatgatctccgacaccgtatgcaagttgcgacacacccgaccatttatcggtattttttgattgaaaaaactccagaaaatgaaaaacttgtcaagaacccaagaaagtaggcatggtgccctgagttgatcatgcaataccatgaaaaagaattagggtcatttgaggaatgtcagaaaaaaaagtgctctcaaac

SEQ ID NO: 38805 - DNA, 237 bp, Triticum aestivum
  Clone ID: PAT_TA_38805
gacgggaagtattaaaaataataagcaaatatttaaaaaatgttgaaataagtattaaaatgttgaagaagtatttaaaatatgttgaaaatgtatttgaagaatgttgaataagtattaaaatcttaaacaagtatttagaaaatattgaataagcattcggacaatattgaacgtgtgtacaaaatgttgatcacttacaaaaaatgcttttaacatatacgaaaacgtagagtg

SEQ ID NO: 38806 - DNA, 414 bp, Triticum aestivum
  Clone ID: PAT_TA_38806
gcatcctaatgactcaccgacaatctgtaacctgtattcatctattgcgtgatgcattctattggatacaagtcatggtgttctgcagtctgcatttcttcacttagtctggatttcgagagctgttgcatgcatgtgtcctcgtcagtaggctcatcttttacagtctgtgggctgtgaactggtaactaggaggttcaatgtcagtcaattttattgacactgctatttaatttttgagagggatatcattgttcagcatgaattttgctgtagtcgcacttgtatttcctagagcatgtaacagtcgtcacggccgcagatattgaaatcgatgaagctacattctatgtaaatacatatatatatatatatatttttcccgtaaaaaaaatacccttgaaggaaaattta

SEQ ID NO: 38807 - DNA, 408 bp, Triticum aestivum
  Clone ID: PAT_TA_38807
gacggggatacaaatgaagcagattaacaattggttcatcaaccaacgcaaaaggaactggcacagcagcaacacagcttcctctagcgaaaagaccaagaagaaaagaaacgttacaggtaatgacggcacggagcaatcgtggtagaccgggtcccagatgaaacaaactagatgtaaactatacttttatcatgaagattgctgcagtatattctctccctctcctctttctggtggggcaactagatacgaagacgacccgttcacaagcaagttcaaaggcaaagaaggtatcaataatagttgaccaaaggtggtagcgactccggatgtacagtgtgagtgttttgctgatgtaatttgtgtaagcctgtgttgtataaccgaggaacggaaaggggcaat

SEQ ID NO: 38808 - DNA, 390 bp, Triticum aestivum
  Clone ID: PAT_TA_38808
ggattgaagtctaatccccatgacttcttgttttcctttgccgaagccttagcatactgaaagttgcgcttgaagagattgtcgtcacgacaccagagcaatgatgatgggtcggcttcttcaggctgtggtcaacggaccatgcaaggatagaattcttgcgcaatggcttcatctttgttcttggggggaaggcctcgatagagaatatcaccccaagggctcttgataggatttttctctgcgtacgcctgggtcacacacttgtacttgtatcactgttcagcccaatagcgtcgaatccattggattcgagtcttgcgctaattgtaatcctcttcaggatctgttttgtacatttctgcaagatcatcatgtagatcctttgaa

SEQ ID NO: 38809 - DNA, 369 bp, Triticum aestivum
  Clone ID: PAT_TA_38809
atccttctacagtaacgtgccttagaccagagcatatacgaagacccttaggagtctcgatctcgagcttgccttgaacgacgactttaaattacatcattcattcagcattcagctatcaatgcgctgctcaagtgtccaagctcttagatcagcctaccacattcgacttaacgctctacctgttggcacagctacgtcaaacaccacaaaatttaggtcacttgacatgacgtttctcagcatacactagtcgtcaagtcttgtgagtttcgcattattcagcatccaaccatgcatacaactttactcaagtcttgctgtatgatgtatccacttcatgatcagccttgtctatttcttcaagat

SEQ ID NO: 38810 - DNA, 396 bp, Triticum aestivum
  Clone ID: PAT_TA_38810
atcttcgtccacgggactggaagcagcagcaacatcaccggcctttgtaagtatctcaaggagaagaaccccaacgcaagggtgaagctcattttgtttctgttatgttaagatgtaaattagatgatcctgtgatgggtttgatgtgaaggttgtttgtgtgcttcagttcaaacacatctttggatgatcctgttatcttgttgcttatttattgtttaaatcacacagttcaatctttgtgttctctgtaatatgggagaaggcgtggaacagaggaagcgtgccacgtgaatggatccagaaccgtgtactgctacaaacgttgaaggtactctcttctcttctccccctttctttgttttgtgcgcacttgatggcttggttcggttcatg

SEQ ID NO: 38811 - DNA, 138 bp, Triticum aestivum
  Clone ID: PAT_TA_38811
ttttccaatttccgaacaattaactggcatggaaaaaaaacttgtatatcaatttaaaacaaaagtaaaccaagtgctgtgtccggcttggatgtgctggtggcttatgtggttgccttgcccttactgctgctactg

SEQ ID NO: 38812 - DNA, 398 bp, Triticum aestivum
  Clone ID: PAT_TA_38812
gacgggtcatgacacacactgctaaggatgcttcaaagtcaatttcgatcctttaccgtgtgattcaagacccgtcgtccagagcatgttgaataggttcctacaagggttcaaactatctacctcgtcattcacactgggtgatcacaataacagagtaatagatactaactctgacacaggggaagctaatattcacaatggtccttctagtaatgatacaatggcacctacatctttgcacatgtacaatctccaacatacggaggaccgattctctctacatatttaaatcatgccagacctcctaatattgtcataaataaagattttgattcctgagtgtatctcttcaagcgtcatttaaatcatgtgaacaataaacttttgagaatcat

SEQ ID NO: 38813 - DNA, 380 bp, Triticum aestivum
  Clone ID: PAT_TA_38813
gcagacgagatagattatgagggtgaacaagactacctcgactttttgactgctaagcaacgttcgcatgtccgccccgatgatggtactgacgccgataccgacaccgacagcgcccgcaccgatggcggcgccgataccagtggggaaggtagcatcatggaagataccggctccgatgccggtaccggtaagatgcataagatgcagaggatataacagcctgacatactacggattggaccacttgtgatcaccatcatggcacctggcatgtttcagacttgcatgtagctcgattttctagatgatcacgcgatacttctttgtgtcggatgatgatttatactagactatatgtatgtcaatcctatgattac

SEQ ID NO: 38814 - DNA, 345 bp, Triticum aestivum
  Clone ID: PAT_TA_38814
gacgggaaattggatactgcagttcccttacggactgctcgtgtctgggtgctcttggtggagactgcgtcgtctatctgctaacttcatctccgttcaatggccgtccacttacagtcgtgggacagccaaggacagtcacctgacgctggtggctcaccatctgacaccgccgccggtcctgacgtgcccggacaagaacttgatccaccaggttgtgttctccaactacttgaacccgctggggatctgctgcaactacaccgttggcaaatgccacacgcccaaggccatcgagattgtgcacaacgtgtgcgtgacgaatacgagctgcgtgctggccgt

SEQ ID NO: 38815 - DNA, 443 bp, Triticum aestivum
  Clone ID: PAT_TA_38815
gaccggcaagagtagtaacaacactgaatttccccattgcccctgaggccctgaagacgcaaccttgtgctggacggacaaaatgtttcatgtaaaattcgacggctttcgcttctgctgtcgatggtatggcgaaagaaaagtaggcatactgtatacaccagctgttgtgttacactcactggtcctagggggcatgtgatgtaaattatttctagcgtatgttctcgaaaggaaaaaagggaaattccggtgtcctctagacgggcattgagatgcatatgctgtactgtgaccgagagtagccgattcagagagataccattttgtgatgaaaaataacttgcgtaaatcggtggatttgtggatgtaaaaaaaaaacacgaaaattgcaaaggcgcgtaagtgcatatccacccactgtccagatacacagtttaaaa

SEQ ID NO: 38816 - DNA, 351 bp, Triticum aestivum
  Clone ID: PAT_TA_38816
gacggggagcacaagatcgcggaggagcacacgaagaccgacggggagcacatcaatgacggcgtaccacaaggagggcatgatggacaatcatcaaggaccagatcagcggcgacggccatcgccacggcacgatggacggcgaccaccacgagaatagtgacaacactacacactacgacacgatgcacggctagggccacaaggacgaccacggccactgcagcagcatcagcgacagcgacagcgactgagccatctccggccgcgctccggcagcatcgtgcagtgtacgctagatcgatgaacgcttgcgagatgtgtgccattcatatatgttgcatggtttgg

SEQ ID NO: 38817 - DNA, 379 bp, Triticum aestivum
  Clone ID: PAT_TA_38817
gacggggatggcaggttaaaatcaaaaaaaaaaaaaaaaaaaaaaaaaaaaaaaaacaaaaagataaaaaaaaaaaataaacaaaaaaacaaaaaacacaaaacggtcaaaagcgatacctaaacttcaattcaacggccgttcgtcttccagggtctcccctgggttcaacttcgtcgtccgtcgttttaatcgccttgcaccgggtcaccctttccctagcccgcctctgccccgctgcgccctttccccttttcctccgctgacgtctcctccgactgggcccccacctggtcccccttccgatccgttttttaccctgccgggggtgtggaacactccccgtaccctgtccgtttccccccaccggctcccccgc

SEQ ID NO: 38818 - DNA, 408 bp, Triticum aestivum
  Clone ID: PAT_TA_38818
aaaattgatttgatccccgtaggttaaccggttggttgtaaggcggccataccaattgccataattgtggcaattttccggtagttgattggcttgatcttttggtttgcttggaggtggaactgttcgatcgatggcagagtttcgtccgctattctaaattgctaaatgcacacaggtggggcctgagttttatgtggacggttagatgcctaatcttggggttgtagtttgtcttgcttttcccgtgtacgtttatttgggtgggcatagtgaagaatatgtttgattgtttaatagtataagtagagaagtagagatttgtctttcacctggagattcgatgtagctcggtctgagcatgagtgatagcagtcttgtatcttatgtttaccatgcaaattttac

SEQ ID NO: 38819 - DNA, 451 bp, Triticum aestivum
  unsure (1)..(451): unsure at all n locations
  Clone ID: PAT_TA_38819
gacgggtgggtacattgtgacgtgcaatcgcgcgcgcggggtagcgtgtcccctaccacggatcctaggtacgggccgacagtccgacaccgacctacgacgtgcgatccaggaggaccacgtcggccgatcaatcaatcagacgaattactaccacggtaataaggggtgcagtgggtggtgattaactcgcaccgccatgggggctctgtcggtgaccgtgtgatggtccaccatagcttccagaagatttcaagaaacgtctcgttctagctactaatttgacacgtatagatctttcgtgtatcagcaccgatccgtaaatggggcttccagaacacatcgatccattttgtcgctgccaaatgcgggcaagtctcacgtccagaagcaggaaaagtagagcgattaagaaagcagtcggaagcanatggcaattggcaagcttaca

SEQ ID NO: 38820 - DNA, 407 bp, Triticum aestivum
  unsure (1)..(407): unsure at all n locations
  Clone ID: PAT_TA_38820
aggcaaacaaacttcatcttcacctgcaactaacaacgctataagaggggctgagcaaaagcggtgacatagccaaacaacggttgctaggacaagttggttagagggttgacatggcaataggtangcatggtaaacaaaggcaggcagggctaacataacgaaagagcgagtactagcaagcaaagatagaagtgatatcgaaggtatgatcatcttgcctgcaaggttctcagagttgtcgaaggctggatcctcgttagcgtactcaacaggttcctcgttcacgtactcgtctcccggctctacccaaaataagaacacaagcaaggaaccacaataaatcacggtgcaatgcacaggcatcatgatgcaaaacatgtcatgatatgcgagaggtgatatgc

SEQ ID NO: 38821 - DNA, 433 bp, Triticum aestivum
  unsure (1)..(433): unsure at all n locations
  Clone ID: PAT_TA_38821
gtttcataattttcaactttcatccatgttaaaaatgcttaaacttgttgtttgctttatatttgcataaatgccatgttaaaatgatttatttcataactaattaaccataactccgaattaaataaactatatatgtaaattgtctagaaaaatgcatagattaacatggtgcactttgttttattgcttaacaacattaaaatatgctttagggagaacagtagctaattaaaatatggacatgaggattttctggaattgttgtttgttgttccggcctcatttaaacttacctagatatgttgttttattatgcttcacctcttgccatgtttaacaacatttaatattgtttggtagcttggacgagattaaactaaatatgtcaatgtggtgtnttgtcaatatgcaacttgttgcatattgagct

SEQ ID NO: 38822 - DNA, 340 bp, Triticum aestivum
  Clone ID: PAT_TA_38822
gggtcgacgcggagatgtgaatgaagggaggtcggtctgagttgcagaaaagcatgggactacgcaaccgatgacgaacatttgcactgagagtgaagagcgagggccacgccccttgcgaagatgccgccgtgcatgtaatctacaaagaagcctacatgatcaacgcgctagtcacgcatgcaatacagaatgtctatttgaacgcttacaggttcacacatgcagctttagttggcacggaaggtagagacagtatccaggtaggtacggtggactcagattgaagaactttggcgttcattgcagtgcctgcggacacagtagacgcgcttattac

SEQ ID NO: 38823 - DNA, 391 bp, Triticum aestivum
  Clone ID: PAT_TA_38823
gacgggggacacaaacacacttcatcccccaaaacggaattgcaaaccccctccaatttgaaaataccattgacaacagcaaactttataaacccttgggtgtcaaaaccaaccggccttggtgtgtcaaaggttaccgggacaccttaaggaacattgccggatcaacccacatgctgcatcaactatttgtacctatacaaatattcatcatgctcaatctccctactccttgtttagtactgcctccgttccataatatagtgcatatagatttttttgagaagttaaacatcacaaactttggccaagtttgtgggggaaaaatatttacatctagaatatcaaacatgtatcattagatccatcgtaagatgtagttccatatttt

SEQ ID NO: 38824 - DNA, 401 bp, Triticum aestivum
  Clone ID: PAT_TA_38824
gacggggatgagaattgtgtggtggctcacggaactttatgtagttaaattataagtcaatccattccataatgtagtgtatatagatttctacaatagttaaactttgcaaattttgacaatgcttcgtgataaaaatatttatatttaaaataccaaatgcatatacttggatacatcatgagttaactattcatattatatatgtttgacattgtacatatagatagtttgttcataaacttagtcaaagtttgttaagcttaacttttcaaaaaaatccttttttgcggtaaattatggaacggagggagtgcttagaattgcaatttgaagttacacataaggtgttttccttggagttcacgattagaacgtaaaacagaatgtatcaccctgtc

SEQ ID NO: 38825 - DNA, 312 bp, Triticum aestivum
  Clone ID: PAT_TA_38825
acgcgctgatgaatatggggccgcactacatgatgaagaccgagtcacgcgtggatgtgaagacaggccgcatcgtgaatatcaccggccatcgcatcaatgccgatcatctcacagggtcctcactgcagatgtcctaccatcagcccagctacacacatgtgcatcacgtcaaccattcgctagctggcttactctacagtatgcaatcatgcatgttccgtcgatgtacttcatcaaccttaattgtcaatgggacactcactttatactgctcaagtcacgtagcagtagtgtgcgatactcacaaca

SEQ ID NO: 38826 - DNA, 464 bp, Triticum aestivum
  unsure (1)..(464): unsure at all n locations
  Clone ID: PAT_TA_38826
cccgggtcgacggggaagaatgacgaagacacagaagaagaagaaaaagaagaagaagaagaagaagaagaacaagaagaacaagaagaacaagaagaggaggaggaagaagtagacgaagaagaagaggaagaagaagaagacgacgaagaagaggaagacgaagaagaagacgaggaagaagaagatgaagaagacgaagacgaagaagacgaagaagaagaagaataagaagaagaagaagaagaagaagaagaagaagaagaagaagaagaagaagaagaagaagaagaagaagaagaagaagaagaagaagaagaagaagaggcgattgaaaagcaaacggaagaaatacagacagatgagcagaaacatgatgacagtagggctgatttcaccacagagacaatattggagccccagagcaacganattgacacaacaaataggaaagacaacgctga

SEQ ID NO: 38827 - DNA, 443 bp, Triticum aestivum
  unsure (1)..(443): unsure at all n locations
  Clone ID: PAT_TA_38827
tctttctacaaagaattaatcaaggaaattcaacaatacagccagcaggtttggtgttgtcccatgtacgatcactgggtgtgtttggaggttttgtggaaatcccttctctggaggaattcaaacatctgtgtgttctccacttgagccattgccaatcattggaagaacatcatcttgagaatatagtgaggttgccccagctaaggtacctgaacctcaaaaatacagaaataaggaagctcccagaacaaatcgggcgtttaggttgcctagagttgttggacctaagacacacttgtgtagaggaattgcctgcatctattgttaatctcaaaaaattgacgcatcttcttgttgactatggtgttaaatttcctgatggaattgangagatgcaagcattggagacattggaagaggtcaggttctccaaaacaaca

SEQ ID NO: 38828 - DNA, 414 bp, Triticum aestivum
  unsure (1)..(414): unsure at all n locations
  Clone ID: PAT_TA_38828
gtcgacgccgtccttaacatgtagtctcaaaatcgtagttagattttgttacgttaaaccaggttgcttatgtcatgtgtgtcatggttgaaccagtttgattatgtcgtgtttgttagggttgaacaagtttgtttatctcatcaagtacattgttttcttatctcattatataagtttgctagcttcgtattttgtttatccatcatttcaaattcaagtagcttgcgagtggaactttgtggctgctgttcagtactagttatcaagcaactattcacacaagggtcttccatgtgtagtttggattcagcattgtatggaaaacataacgttgaaaacaatcagtacaatttgagctgcttagcagcgcttcanaagttgaagtaatttnttttagtacttcatgtactg

SEQ ID NO: 38829 - DNA, 329 bp, Triticum aestivum
  Clone ID: PAT_TA_38829
gtattatcatggttgagttttgttacgttgatgcaggttgcttaggtcatgtgtgtcatggttgaaccactttgattacgtcgtgtttgttaaggttgaacaagtttgtgttatcgcatgaggtacattgttgtctgatctcattatacaagtttgctagcttcgtagtttgtttagccatcatttcagattcaggttccttgcgagtggaactttgtggctgctgttcagtactagttatcaatgcgactagtcagacagaggtcttccatgtgtagtttgggctcagcattgtatggaagacatagcgttggaaacagtcagtagag

SEQ ID NO: 38830 - DNA, 368 bp, Triticum aestivum
  Clone ID: PAT_TA_38830
gtcctactaacaaggcaagagatacctcgattgccttcggaggcatcgtcacggtgtcatgtggccattgccaccctgatattgtcaaggccgtgcaggaccagaccaagttgcttcagcacaccaccaccatatacctgcatcatgccatcgtcgagtttgccgaggcgcttgcctccaagatgccaggcaatctcaaggttgtgtacttcgtcaattctgggaccgaagcgaatgaactagcaatgttgatggctcggctgtacagcgggaatctcggtatgattgcattgagaaatggataccacggtgggagtgctggaacaataggtctcacgggtttgcagacgtggaagtacccgattcct

SEQ ID NO: 38831 - DNA, 423 bp, Triticum aestivum
  Clone ID: PAT_TA_38831
gcgggtcgatgggagtcccaaagtggtatagatctatgaaggataaacaaagaaaaaaattccatgaagatcattggacaaaataaactttattcttagtaatagttttgagatatgatgatgtgatatgtgagttatgttgatgagtaattgtgctctagtaagaatattggtgttaaggtttgtgattccctatgcatgcacgaaagtcaatagtcatgcagtgaaaattatgtcctacttgtggtgcattatttggtgttaattatgcttaatgcttgcttatgagattattcgtttcttggttggtcttttcccaaacttttgctaaccttcattttgcactaagtatgacctctacttgtgcttccaaaatcctttaaaccagttttgccacatgagttcactatatctacctatatg

SEQ ID NO: 38832 - DNA, 422 bp, Triticum aestivum
  Clone ID: PAT_TA_38832
gacgggggagccaatgagggccactctcgacacgctgcccccacacacacacacccacccccgggccgcgatcgtcttcctcgattcaacgagagttggaagcgggatagttcttgggccaccggaagcgtcgcacgcatggcagatgaggaggtatctgacccaaaggcactcctagaggatcgtacgaaggctaagtgtgtctaccactggtatgaatatcagaaatgcgttaagagaattgaaggtgatgagaccgggcagaagcactgtactggccagtacttcgattactggaaatgcatcgacaagcatgttgctgagaagctctttgatagcttaaaatgacaaggaaattgttctctctagctacttttcactcaacagtggtaataaatagtatcacttgcacgccttattga

SEQ ID NO: 38833 - DNA, 453 bp, Triticum aestivum
  Clone ID: PAT_TA_38833
cgggccgacggggattatcaatttaaaacctgtgtctttttcttttttttcctagtttgtattctgtttctttttcattttctcgttttcccttttttattttccaaaaatgcttattcttttaaaattggttcaaaattttaaaacacgtttgttttttcaaaatatgttcaaggaattaaaaatatttctattttaataagttgtagaactagtgaaaatgtttgtatcttaaaaattgctcacattgaaaaaagacgaacattttaaaaaagagcgaacaaaatttagatcatggttttttttgaatgtagaaaagattagaaaacgggaacattttctaaaattctgaacaaattttgaaagcatgagcattatttgaaactccttgaattttttaacattgaacttttctgaaagccatgagcgcttggctggccgaacgggtgcctg

SEQ ID NO: 38834 - DNA, 168 bp, Triticum aestivum
  Clone ID: PAT_TA_38834
cggggagcgacagcgtttttatgtgcatttgtatgcacgacttgttgagcacgacatgggcatgaatgcatgttcggtgatttgcttcgtcgatgttcataccgacttctacatcatgagatctgtacagttcatgtaatcatgtgcacctttctgtgagaactctgg

SEQ ID NO: 38835 - DNA, 444 bp, Triticum aestivum
  Clone ID: PAT_TA_38835
attcgccggtcgacggggaggagtgaccgcccagggccaagcccctggctaaatcgtaagtatccggatacccgagtaattcatactattcctttgttgcacagctttcccttatgtcgaatatgtttatgtagccacccaaagaccggctcgatgcgtcgtcgagcggttcactggactcgtcggatgtgaattcgcttccgacggcttcctccccccgccctacggacgacactgaagtgttgtcccaataggttccaatccaggaggaggtggtcctggaggcgccgcaaggtgacctcccggaccccaggagtgaaggggacagaaccccccagggctccaagtccggccctaggccggacaccgctccggaaccttcaaaggttccagagtccggcgggcgacctccttccaagaggatcaagcccaccgtgccgggga

SEQ ID NO: 38836 - DNA, 416 bp, Triticum aestivum
  Clone ID: PAT_TA_38836
cgggtcgaccggctgtgcagaagaaaacccttttttttaggaacagaagattgcccttttactctcctagtaggaatatgtatgtgaatcaccacagaacaccccctacagcacaaactattttacataattacatttcacttttcaccttgcacgatttcctctgtgatttcccccatatatgacttgtctgttttgtgaggtatggtagtgctcacataattttcttgtattggacgatgatgctataggtgtcgagctttgcgatatatgatgatcaactgcatgcatagaaagatatagcagttgatttgcttcatagtatgttattgctaggctgctagttttgtgtcactcagtcaagtaggttatcatatgcttttagtgtttgcgagctatgtgcatatgtatacata

SEQ ID NO: 38837 - DNA, 352 bp, Triticum aestivum
  Clone ID: PAT_TA_38837
cgatcccaaggcatttgttaaactaaaaatcattggagattgcaccgtgtaatacaaagggtttgtgacttcggccaagccaagtgatacatgtacataccacggatttcccgaacatcacactaagggctggtcaacagctcctgcaatcaaacttccaagggtaaatgaaagcaattaagccgcataatccttcctccaacaataacgccttcgggaaacgagacgtccgctaaaggtcataatgtggaggatgaaacaccccttgtagcacctacgtggggaaagaagcccacgactggcaaatttcaagataaatgtggccgcatatggatcaaaatttaactaagaa

SEQ ID NO: 38838 - DNA, 340 bp, Triticum aestivum
  Clone ID: PAT_TA_38838
cgggtccagattcggccgttttgactggtttggcttctatccatttggtgaatttgtccaccatgaccaacaagtattttttcttatggcttcctcctttaaggatccaaccatatcaagcccccagacgtaaaaggccaagttatggggattgtttgtacggcggtgggtggcatatggctttggttggcaaaaagctggcatccgacgcaatgttggacaaggtcttgtgcgtctgcccgggccgtcggccagtaaaaacatgtacaaaaggccttgcttacaagggcccgacctgcggtgtggtaactaaggaagccctgaattagggggtatccgg

SEQ ID NO: 38839 - DNA, 450 bp, Triticum aestivum
  Clone ID: PAT_TA_38839
gtaccggacctacattcgccggtcgacggggatggactcttttcggcggagtccgggaagtgaacacggtttttgggttatgtttgacgtaagtatgagtttaggatcacttcttgatcattgctagcttcacgactgtagcgacccgacccgaatggatcgaatatctatgcttaagtgtcatccctggatcggtatgctgacacatacagtactcgaggatttataacagaggtaaatcacatgtataaagtaacgtaaatattattacctcgaatacaaatagcggaagtaacaaggttgtggattcccatcaacaccaacgacaaagttgagtgtagaaaccgtaaccctaacgtatcacttactcgtcgtaagatatcttgcaacatgagacgttgcaaccatgtaggtcagtacattcaatgtactggcaaattcacaccatag

SEQ ID NO: 38840 - DNA, 422 bp, Triticum aestivum
  Clone ID: PAT_TA_38840
gggtcgaccgggtatatcaattcatttctgttgattgtttcctctgcatcttgcttattgctgtgcaatcatcagaccagctggacgaggcttgtcctgttttgactaggatagttgacaatggaagaaattgatatggtgttgagctattagtaggaatgcaatagctgaattacagccctcttgatttttttcgatattggttcgatgctaaaaatagtacacaacctaacagaaagagaagaattgccctctgtaattcagcatttgctgctctgttttcattgttgcctctgcatcttgcttattgctgtgcaaccgtcatactagctagaccaggtttgtcttgttttgactagaataattcacaatggaagaaattgatatgatgttcctccgattattagagtgtaacggctgaa

SEQ ID NO: 38841 - DNA, 438 bp, Triticum aestivum
  Clone ID: PAT_TA_38841
cgggtccaccggcatgcattacatatgatatgtgccctctctctctcacgcacacacgcatcctcacgattcatgactctcctgagtcctctcgcacccagcgtctaactgtaggtagacgtcacacacatatgtgctattcacaccctaccctcagaacttctaaaaaataaaagacgccgcacaccttttattttaactcacacgtcacacatttatactagtactgttgtggcgaacattctttgggcgtagtatattgtactctcacggagagaagcagtgcacgcacacactagttctctcacagccactcgcgagtacacgtaggagcacattttttgaagctaggagcgcatttgtttacaaagaggcatcccaattgacattttgactagtctagttttcaacttgatagagggtcgaggaccgcacatg

SEQ ID NO: 38842 - DNA, 436 bp, Triticum aestivum
  Clone ID: PAT_TA_38842
attcgccggtcgacggggcgatggcacgacgctatgggcggcataacggatgacctcttcaccatgattaacattcttcaaataccaaattaacattttttggatacatggtcaacattttttctatacagattttacattttttaaatggttgattacatttagaaatacaagtttaacattttttaatacatggtcaacattttttgcatacgcatttaacatttttaactgcttgattaacatatttcatatatttatttattttcaaatgcttggattaacatgttttaaatacatgatcaacttttttcatacacattgtatatttttgtacacattttctctatacacataatatttgtcaaatgattgattaacattttttggaaatgttttgatgtagattatttttgtaatatgtttattaatagta

SEQ ID NO: 38843 - DNA, 385 bp, Triticum aestivum
  Clone ID: PAT_TA_38843
cgggtccaccggtggaaccaacattatttgttgctagaacctaggttttttgctgcatcgacttctttttatgctaatgtgtttttgctggtttgctgcatcgacttctttttctgctactgtcttttttgctggttccaacaaccttttcgccggcggagctgcaaccggtgtgttgcaaagctggaaccagcgtccaccgatgctggaaccatgcatatttttgcgacaagcatatccatgttttgttggaaaccatctcatttttgctggaagtacgcgatctatctttttgctggaaccatatcatttttttgctggatccttgatttttgctggaacgtctttgttttcgctacaaatggcatcgaaaattgacaccatg

SEQ ID NO: 38844 - DNA, 345 bp, Triticum aestivum
  Clone ID: PAT_TA_38844
aattcgcgcgtcgacggggaaacctgggtacaacatcaatatggctagcctagatgactaggtttctttcttgtggtggaaccagcccatccaggttcaagtcctaaacttgacatgggtgctctcatagaaggtgtgtgcacgtgttgtgagcgtctgcgtctgcattgtgtttctaaaaaaaaaaatccccaccccactctttgcgagattcgctaagttcattgtgcttgtgcattacatactggaatgcgttagttacctagttacgtggcactagaacaacatttgtgtactgagtattcggacaaagtttgattttaaagtgagcaactttgtttttat

SEQ ID NO: 38845 - DNA, 452 bp, Triticum aestivum
  unsure (1)..(452): unsure at all n locations
  Clone ID: PAT_TA_38845
gtaccgtatcaagaattcgccggtcgacgggggaaaataatagttcctccaaggatccacattttatctctggcttctttcttatattaaaattatgactagggataacctgctgaagagaaatttgaacaagtccattgatttgtttttcttttctgaacctgagagtgtacagcacctgttgtgtgactgtttggtagctagacttgtatggaagcaaatcagttgcttattctctatgcaaattggagtttcagtagagtcagttacttccctttgggttgctggtaaaatacttgacgctctgaatactgctgtagctgctgtgctccgggctttgtggaaacacaggaatgccatgatctttaattgagttgtttggttttccttgaccaagatctggtcgctgaccttacgaatgctcaggagatggcgatcgctcttcanacatc

SEQ ID NO: 38846 - DNA, 433 bp, Triticum aestivum
  Clone ID: PAT_TA_38846
gtcgacggggagcatggcagggctggccgtgggtgcaaccatcctgcttaatgtgctgatagctgggccggtgtcgggggcgtcgatgaacccggcgaggacggtggggccggcgttgatcgggagcgagtacaggtcgatctgggtgtacgtggtggggccggtggccggagccgtggccggggcgtgggcgtacaacctcatccgcttcaccaacaagcccctgcgcgagatcaccaagagcacctccttcctcaggagcatgagcaggatgaactccgtctccgtctgattccttatcactagcaacgttgtattactactacaaggctatgtaattgtcgtcatcgtggccatatatccatggcgtatcgagtgggctacactctactcctctagtggtcttggcctaactgaacctgccagagtatgt

SEQ ID NO: 38847 - DNA, 433 bp, Triticum aestivum
  Clone ID: PAT_TA_38847
cgggtccaccgggctcctgtatagattcctgatgtctccttgggcagtgaggttagggtttctcgtcatgtggggagatttggtatcaggtgcttcaaatctattcaagggttcgacgatgacgattacggctccagggcgctggttcttaggggcaggtacacgaagacttcccaactattatcgacaaggtcaagttgactcccgtaggtaagtggcgacaacagctcgttcagacgatggtagtggtcgttcgatggtctcgaaatctcgatgcatttttattattatgctttgggtgctttgtacttctggtgaactttggtaatgatctggatcattttcccaaaaaaatgcacgtgaaatgctacttatattctatagatacttacaagtatataataatcatatatgataaatcataatatgtgtt

SEQ ID NO: 38848 - DNA, 411 bp, Triticum aestivum
  Clone ID: PAT_TA_38848
cgggtccaccggttctgtatattttatgtttcccttgtactatctctgtaccaaaaatgtcttatatttggtacagatatttctggaggttaaactactctaaaaaacgtcttatatttggtaaggaaggagtatacataaagccactagcccactgcgtataaatgcactgttcaagttcaatagatagactatcgctactcatcaaaccattctgccgcctctttatctatagcaaagtaactaaaccataactgatgataatggcaattctgaagttgacagacacacataaatgtgtggttatgcttgtataagaaaaccgagtcatccggttaacaagagaaaaactgaattaaagaccacacgacaacagattggctaactagcataaggagcatcatctgtcgc

SEQ ID NO: 38849 - DNA, 427 bp, Triticum aestivum
  Clone ID: PAT_TA_38849
gtcgacggggtgagtaaaccagcctcattttggaaacatgatctcaaggttgaccatacttccctcttcgcaagaactgcatcctgacatgaagttacttctttgttagatcaatactgagagcaacctagatccatttagtagaagccagataaacaagactcgaagaagtgaattcaaaaggagaaatataaaaacaggctccaaggtgagaacacccacttcctacatcaagctaaaaacgaaagcattaggatgattaagactcttcttattacacatcgaagaacatgaggctaagagaaacaaaaactacaacatatacacatcgaagaacacgaggttaaatgaaagtaattgaaagggtgttacttaccaaagctcgttttacaggttcggtgcagctcctctccaacttgccactttc

SEQ ID NO: 38850 - DNA, 183 bp, Triticum aestivum
  Clone ID: PAT_TA_38850
gggtcgaccgggataggtaattcaagtcagcggaaagcaacaatcatcaggcaaacatggacatatgactgttcacaaaataaagttgtacaaaactaaaaaaacattcgggtgctcgacatgatccaatcttatctatgcttgcatgcaacattagctcgcttccacagtgtcacacatgat

SEQ ID NO: 38851 - DNA, 357 bp, Triticum aestivum
  Clone ID: PAT_TA_38851
gtaccgatcctacattcgcccgtcgacgggcacgatcatgatcatgaggaatatataggataataaggcggtgtattaccgccatgccccgttgagctagctgatgttgtttcggctagagaaaatcgttacgcccgctcataattcctttttcgatgctctggagaataataactactggtatatcattctatatatcaaggccggcttgtgaaataaatgatcctgcgccccggtttttgtgtcgtcgaaaaaaaaaaaaaaaaaaaaaaaaaaaaaaatagaaaggaaaaaagaaaaaaaccaaaaaaaaaaaaaaaaggaacggtaaaaagaaataattatgcttcaagcaga

SEQ ID NO: 38852 - DNA, 415 bp, Triticum aestivum
  Clone ID: PAT_TA_38852
ttcgccggtcgacgggttggagatatttgagcatttaaatattttatattattttaaatgcccaaattcaaatatttatgatttaaatcaaaaaccttaggatggcctaggaaaatgtgcaccacttttggcagaggttctgaaccaaggcaaaaatgatgggcattttagaagggcatttcaggttcattgaaaaattattttagtaaccctagttggtttcagaggggactgggggttctgtcatccccatttcaagtttctgatgaaagagtaaacatgatgcaacactctaatgcatgactagctagggtgtgacatcagcggaaccccaggccgcccggatagatgcatcggcctggagccaccctgagatcagccccaggcgccccaacgctgcgcgaaagtccaggcc

SEQ ID NO: 38853 - DNA, 440 bp, Triticum aestivum
  Clone ID: PAT_TA_38853
gtacgagcaagaattcgcgcgtcgacgggatatatgcactttctagcaaaggtcgtgccgaaattttccgtgaatttcggcatgacttgtgctagaaagttggacatatcgagtgctcgattgtcgcgacgggaatgaaacaacatttccgaaacaaaggtcactttttttaattattcactttattataaaaagctcgataattaaacgactacgacattgaaccctaggaaacatgaccgacaccgatgaggccggaggttctcagtcccaattaggtcgagcacacgcctacctcgactttctggcggatcaggagagacagcaagctgggactgagactggcgctgatgacgacggtggtggcgccggcgccgacactgatgccaccaacgacaccgacactaagactggcgctgatgatgttgctaactacagca

SEQ ID NO: 38854 - DNA, 313 bp, Triticum aestivum
  unsure (1)..(313): unsure at all n locations
  Clone ID: PAT_TA_38854
gacatagttagaaactaagccgacggccaagccgtcggcatattccttcatacagagctaccagtagctgacacgtggcacctatgccgatcggcatngtggtcgtgggaggatcggatgggttggtacaagtatttgtaggaagacgtcgtgtagcgtggaggcgggcgattaactgcactttctgatgatgcgcttcgatggtatgattcacagattgtgtatataggcgcccaggctgctgccgacacgatcgggggcacttacgtgtggtttctgcatggcatgcagctgatagtgctcgatggagtct

SEQ ID NO: 38855 - DNA, 192 bp, Triticum aestivum
  Clone ID: PAT_TA_38855
tcgtattagttggtgagttagtatgtgaatgagataatttgtgggtattgatgtgattggaagttcgatttgtaggcttttattattattatagtatgtagagatgagatttttatgttttcatgtatatttgttttggtatggggaggtaagatttgtagtgagtaatgtgatattgaggattggttttag

SEQ ID NO: 38856 - DNA, 422 bp, Triticum aestivum
  Clone ID: PAT_TA_38856
ggatcgaggagaaaggggatcaagaggatgaaggggcaccgcgccaccaccgcgggctggccaggcggccgttggcggcgagggaggagtgccggaggaggttcgctttctttggcagaatagggggtcgtctcgtatgtagaggtacatgagcttcctctactcacttttagtttccactccttctaagattttagcaatatcatctattatattagtactactactcagaagttttcggactggttcgtgtttacagtttagtcaatattgtgtgcattaacgctttcttggatatgcattttgatttgactggattaccttaatttatcatgtgtgctaactctaaagtctaaactatgaccatacggttgccacatacctacgaagacatgaaatcttcattcttggtaaaatacaat

SEQ ID NO: 38857 - DNA, 400 bp, Triticum aestivum
  Clone ID: PAT_TA_38857
cgggctgaagcaggacctggagcgggccgaggaagagctcgacctcgttaagaagcagctggaggacagccaaggtatgtagtatcctgtgtgaatatttaggaaagatgcatggttcgtgctgacgaaagtgtcatgaactgtattaggggccacaaccgaggtggcagcccttaagaaggcgttagccaaggccgaggacaaagcggccaaggaacgcgcctcgcgcgagaagcgggaggcccgggtcagcgaggtccagcaagagctccaggacgtcgtcgagaagtacgagtccctggagcgtgattctaagactcaagagcccgaacttgccaaggcccgccagagcacacgagatgcccgagaaaaagctcagagcgccctccaagaaatccag

SEQ ID NO: 38858 - DNA, 355 bp, Triticum aestivum
  Clone ID: PAT_TA_38858
cgggttcaactaaggcattgatacccacgcaactttgcaagagaaacgcgcatttgacatcaaccgggcgcactaaggcggatcgatgatcacctgtgggcttcagcgggggcgcaaaacgatgcagtctgaggtactcctgtagccgaagtgatgtctcttctacagtgtcactctaggttcacttcactggccttcgattaacaatcatcctgtaagggaaagctctagcggtaaacatgttatccgccgtctctcaaatcgccctatctccaaccgggttaacaccgaaaacgcccgtaacgatcgcacgtcttatcatttgcacaccgtgatgcgaggcttggactctcca

SEQ ID NO: 38859 - DNA, 419 bp, Triticum aestivum
  Clone ID: PAT_TA_38859
ctcccgggtctacagatacagtcatctaactggtttattttaggctatggataaatgattctagcttcttgtaagagcctgacatggacatatgaggcatccatacctggtttgaatgacctccgacaccgtttacatgttacgacacgtccgaccatttatcacctattttcatcgagaaaactctagaaatgcaaaaaaaattaaaaaatctaaacaactctgcatttccttaccaagaaaactctagaaaaatacgaaacttgttgaaaaccaaaacaatttgtcatggtgccttgaattgttcatacgaggccatgaaaaaaattaggaaattttcaaggatgtcaaaaactgacgtgctctctaacacaccctttctggccaacctgaacaccttccgttgaacatgatgtttt

SEQ ID NO: 38860 - DNA, 430 bp, Triticum aestivum
  Clone ID: PAT_TA_38860
ccgggtcgacgggttggagtatatttgaagtcaccattagttgatctacccacctctatgtgcaacccaagatatttctctgagaacaattatttgtgacctctaggatttccttaaccattgccctagtttctccggacaacccttcccccaaaaatatgttttattttatgtgttatctagaatagcatctaccagtattctcatctccggttggttgagtaaccgttgggcctaggaataaaaggcccattggcctgttccgggttggccatcccatatgactccacatcatgagaaaatcactagttaagaggtatcccttgcaaaagttactctcaaactccactcacgacaacaagtttgtcaaaacttatcgacatggtgttgataggttttgatgaactttaatttttgaagaaactttaat

SEQ ID NO: 38861 - DNA, 333 bp, Triticum aestivum
  Clone ID: PAT_TA_38861
taaggtggtgctgatgacattttgaggtcgataacgtggaagagcatggattgaggtggctgttaaaaaaaaaaagaaaaaacaaagagaaaaagaaaccacaccgcctaaaaaagcaaaatagatcaaagagacgtcacatagacaacatcaccatcaacggaaacagaaataaacaacggacattgcaccctcattataggataacaaccacgtgcaacaaacactacgactccaacataatccccaacaaactaaatgccggagtacgctaacaaacctaacattcatggcaacaccctcaataacgcaaaattctaccacctcaacctc

SEQ ID NO: 38862 - DNA, 427 bp, Triticum aestivum
  Clone ID: PAT_TA_38862
attccaggtcgacgggatcacgttattcatggcatgatcatgtatataggcaatacgcctgtcacaagtagaccgactcctgcctgcatctactactgttactccacttcgagagcacttctatgcttgcctctccagatattaagttcatgacaaacagagtaatgcatgaagtatgatgacataatgtatacagaataaaaccaagcaatatgattaaaccatgtcgttttccccttagtagcaacaatacaaatacgtgccttgttacccctcctgtcatagagtgaggacaccgcaagattgaacttattagaaagcacctctccccctgaagataaatcaatctagttggccaaaccaaacggatggatcggagagaaatgcaaagctataacaattacacataataaagttaaaaaaagac

SEQ ID NO: 38863 - DNA, 384 bp, Triticum aestivum
  Clone ID: PAT_TA_38863
attccgagtcgacgggcgatgaaaagaaatgaggcctccacagcttcaagcgcctcttctaagtctctgtttgccgtcgcaatggattgttatgactactgtctcgtttgatcggttgatcgttttaagatatttggttgtcttgtaatcggatatattatgcgctccagaacatctgagatgtactaaacttgagcctaaataactggttgctgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaactaaaaaaaaaaaaaaaaagaaaaaaaaaaaacccaaaaaaaaaaacaaaaaacaaaaaaaaaaaggggcgccccaaaa

SEQ ID NO: 38864 - DNA, 421 bp, Triticum aestivum
  unsure (1)..(421): unsure at all n locations
  Clone ID: PAT_TA_38864
attcncaggtcgacattgtctggaaaagattagagaagctcaaaaggatgacaaagaaattgctgaaataaaggagaagatgagtgaaggaaaagctaaaggttttcgtgaggtcgagcacgacaccttgtggttcgaggaccgtgtttatgtgccaaacaatgcagagatcaggaagttgatacttcaggaagcccatgagtcgccatactcggtacacctcggaaacaccaagatgtatttggatttgaaggatcgtttctagtggactggaatgaagaaggatattgccgagtatgtagccgtatgtgatgcatgtcagagagtgaaggcagaacatcagaagcctgcaggattactgcagcctatgcccatacccgaatggaagtgggataagcttggcatgggttttatcaccgga

SEQ ID NO: 38865 - DNA, 439 bp, Triticum aestivum
  Clone ID: PAT_TA_38865
ttccaaggtcgacctcgtcgatctaggggccagcgccgccggcagccggaggcgcatcgtcctcgtccatgccaccacgttgctgcacccggaccaaggaggagggtgaggcgccacgctgtcatgccctcgtcaaggaggaggaggactctgactaagcgtgggcgatgccggagccgggcttaaggaacagcggccctcgggaggcccctcccgttgtttgttttttgtttcctgcattaagagtcatgaagagccccatggggcgtgtaatgaactgtggcgcttgcacctttatatcagtgtttcccgcccatattctaggatttacattgttactaattgaaaggttcctgcctggcgcgattaggataacttagcttggtgcgcctgtgacccttggcgggtccctgcgtcaagggggcgcgctcctccggaa

SEQ ID NO: 38866 - DNA, 419 bp, Triticum aestivum
  Clone ID: PAT_TA_38866
tcgacaccgccacattaacaaccctaaagaacgaagccgcataatataatagataggagtaaacatacactagtagaacatagggctttcgttcgggccaaataagccccttagtcccggttcagtcatgaaccgagaccaatgggggcattggtccgggttcgtgaggctaaaggcattagtcccggttcaaatgggacctttagtcccggtttgagacacgaaccgggactaaagggtgcgatgccctttagtcccggttcatacctcaaatcgggactaaagattagacctttagtcccgtaggcctgtttgcaaatttctagaatcctcaaattctaaaaggaaaaaaagttatgctcaaaatttcatttttattaaaaaaatttggttaaatctggtcaaactaattattcaag

SEQ ID NO: 38867 - DNA, 313 bp, Triticum aestivum
  Clone ID: PAT_TA_38867
ttccaagtccacggggcagaaggatccggctccgacataccactctgaacgcttacaattgctgtgctcatctctgctcttcctgacggcaccgttgtcgtttcaccatagaaggaataccaccacaaggtggatgagataaccatatggcactatcctctgatcacactcactcttgacactcaagcattgaaacatcagtagtttagctcacctctgacatcactgacggtatccgcgaattttccttggaccctatcgtggaaaatgctgtatcatcaaaaatgctatagccaaagtccaaaaattcatc

SEQ ID NO: 38868 - DNA, 345 bp, Triticum aestivum
  Clone ID: PAT_TA_38868
gggccgacgggttagtgaatgtgccatgtagaaactacaggataacgtatggtgatagttaatttgatgctgctgaaaaacagaatcgttatgcgcacgattataattttagtaatttacagaaacgtgcgtttgcaatgattcgtttctcggtagatgaatgtacaaattatccaggacatcctagtttggtaggattttttaagttcgagacgtttgcgtgacatagagattgctacagactgttctgtttttgacagattctatttttcgtgtgttgtttgcctattttgatgcgtctatggctagtacgtaagggtaataaacatacagaacttggaatac

SEQ ID NO: 38869 - DNA, 438 bp, Triticum aestivum
  unsure (1)..(438): unsure at all n locations
  Clone ID: PAT_TA_38869
aattccaggtcgacgggccaaaaaattccattgaagaaatgaccaattcccctaattctcctgacaaaggcaagctgttgagaataaatgacaccggtgcaccttcatcaagtacgagggcaagagttgaacacttcccaaaagagtggttgggtgtaaaatctagtgctctgacccaggtaaattttgcatcctccttgcatgcatgaaagcggtcatctgagaaccttgaataaactgcaggcccagaaattgttgtgtatatccttggtgcatacatgagctgaaacaaatattaaattaacattagtcaagataatatatattttaccaacttcagaattataganagaatttaaagagtgttgcgcctcaacaacttatagtctaagaagtatgacaatcagtaaatttagaaaagtaacgtgatgtgtattc

SEQ ID NO: 38870 - DNA, 365 bp, Triticum aestivum
  unsure (1)..(365): unsure at all n locations
  Clone ID: PAT_TA_38870
gacgggcacccgcaccctctcaccaccatcgccaactcgccaccctaataaaaaggggaagcatcgtcataaaaagggaaaggcaaaggataagtcgaagcgtcacacatacaaagaggcaactggcactgatgtggcttcagatatccgagaaaacggcaaggaagaggctgtgatacgcatcgcggacgacggggaatgccgcaagagcaacaaagggaanggccgccatgangacaagaacaacgtgaatgtttcaatcgtttccggcagcatagagaacggtgctggtgacgagcatgccaacaagtcgggctcaatggcaatgaaccctcgttcggaaggtgccaccgacaaactcaatg

SEQ ID NO: 38871 - DNA, 245 bp, Triticum aestivum
  Clone ID: PAT_TA_38871
agcatcgagcgatagcacacggatgtccagattgctcagatcaacgacaaccattatctcctacggtaactggaaccggttcatcatatgcaaactctacgacaacaccgcaaccaagacctacggtcagttcatcataccggcgctcttctggatccatgctaagtcttcttacggttcagctcagatcacttcgaggttgcctcctacagtctatcagcgggccttatattccactcttttaa

SEQ ID NO: 38872 - DNA, 201 bp, Triticum aestivum
  Clone ID: PAT_TA_38872
cccgggctgacaagggtatgataaaggtagtgtatcatacttgaaagatgaactgtacgtggcttgtgcatcggtacaattggcggtcggcgacgagctacggcatttcattaacagtccatcgcctgatgagcatgcgcgtcatacttgacttgggatgaattccagtgttttgcatcaagtatagcatttctctggggg

SEQ ID NO: 38873 - DNA, 411 bp, Triticum aestivum
  Clone ID: PAT_TA_38873
aggaaccagtgcagacataagcacatcagttcttgttcaataatgctgctgcaacaatctcatcgatcttacaaaaaactagcaaaagggtctgtgtgttacaacagcagaaaaaaaatcataatctccaaaggccatagcaacattttgctgcaacaccgataacattttcacgaacattctgttcaattttattaacattttaatacacaaacttttaaaaaaaatcatgaacatggtttgatttttcaaacatttgttttcaaatttgcaaacattttcttgatatggaagattttttataaaattataaacatttttttaacccacaaacattttatgatttattgagcattttacttaaaaattctccttttaaattatttgaagttacaaatttattaaaggagg

SEQ ID NO: 38874 - DNA, 344 bp, Triticum aestivum
  Clone ID: PAT_TA_38874
ggggatcactatgatgagtcggattacgaggaagaagatgaagaggaacgacgatgacgacgaagtagtattagtactcgatgaggatctagatttagatgacgagtctgacgacgaatacgaagatgatcaggacgaggaggacgaggagtaagttcaataactgtaagactactaacctgatgaagcatattcagatgtcgaatactaacaccattcatatgcagacgattatgtttatgatgaacatgacttttgcatcaagggtccttcatcggccgttattagctgcctctctttacgatcctagcttaccttccctttcttgcgatttcataactctt

SEQ ID NO: 38875 - DNA, 440 bp, Triticum aestivum
  Clone ID: PAT_TA_38875
gattcacgggtctccgggaattgagtaaacctctgcactttgggggcaaacaacttcctaactaagaggaaggctaaccctaaaaacataaatccttgaagccccaacctccgttactagtttcctacaaagctctctctctctctctctctctctcaacgctaaccctaccctccacacgaacgctctgccttcactggacaagtccgcctccgttgccgctagctattcttctagtgcccggaccggtgaccatcccttctctgataatgtggaacagatatgttagaagctccaaaaattgaatgtgttgcacgagcagcgagcaccacacttgtgctagtgcagcttgtgggacgggacagggatccccgcaagaataaattactcaataggtagcggggacacggacgagaatgagcagcggacatagatgagtt

SEQ ID NO: 38876 - DNA, 285 bp, Triticum aestivum
  Clone ID: PAT_TA_38876
atgggcctcgcatacaataagtagtcgaagtgctctgtttctcacatcaggtgctctgttgggcagagctactgatcgtgatcgccttgccccgaggcgcgggcggggtatatattgaccatcgagtgtcgtgttgtttcgctgtgccggggttttatcgtcagattttcattttccttcggttctttgtttctttcacacggtaaatgcagctaccactcgattcttggcgtctgttgcttgtaaagaagatcgtagcatgtaagtaaaatcgtttgcagcgtg

SEQ ID NO: 38877 - DNA, 423 bp, Triticum aestivum
  unsure (1)..(423): unsure at all n locations
  Clone ID: PAT_TA_38877
gggtcgatggcaatgctgaaatatagtcgcatcaatttctttcgaattaatagtttccttcaatattgttgctatgtactacctcttactaacggataaactgttttaaatagtttccctcaatattgtactagcacacttccagataaactgtactccaacttactaacggatgagctgcactgaacgacggcctaaaggatggtgaggagaaatgataccgtacttgagtttcttctcaggagaaccagttttccgtttacctagttaagatggtcttttattcgtctagaattgtcagcactgtggatggtctttgatcattacattatacggcctcatttttacaaaaactgcgttctgacgaaagccgcactcaacaacccggggtctctcttaatcttangagaacaatanctatct

SEQ ID NO: 38878 - DNA, 448 bp, Triticum aestivum
  Clone ID: PAT_TA_38878
ctcgtgggtcgatgggcatccatagattaattcgtaatattttaagagcccccaaaacacaaagggattggcggcccgcgaccaaggatcgaaaacagtgtcacgggtatcccctgccaacagattcccttcactatcgcacgataatctctactgtacaattgcaccatagacccagactacacgaaaaatcctagtcctgcctgaagtgggagtgaagaacggatgcagttgggcacacaaaatatgagttattcttttttccttttagtccttttctgcattgtcatctttcttttgttttcttttttgcgggaaacttttttttcatattcatcattttcatttttttccttttaattttatttcttatttatttgtctttctttcttttttatttccatttctttcttaaaagtaccatttattttcaaatattttgacattt

SEQ ID NO: 38879 - DNA, 195 bp, Triticum aestivum
  Clone ID: PAT_TA_38879
ggacgatggcattccctaaaatgactcgtattaacaagagatgaattggtttgcaacagtacttacagtggtgatttgatttagtacactaacggatcgtaccgacttttctgttgaagttttgtctggataaagtgtccagttgaggaggtctcgatatgaggaaaaggaagaggcaagatctcaagcttgggg

SEQ ID NO: 38880 - DNA, 416 bp, Triticum aestivum
  Clone ID: PAT_TA_38880
gtcgacgggcccatgtacaggcacacgatttaaggatgattccaattacttggccgtttgcagtctgggggcttgatatggttgggccttttaagagatccaaggataagaagactcacctcttggtggcagttgataagttcactaaatgggtagaggcagagccattgagtaagtgtgatgcagcaacgatggttcaattcatgaagaaggtgatcttccactttggctttccacacaacattataacaaacaatggcactaaccactcaaagggtgctatgaaggacttttgtcaacgtgagcatatccggcttgatgtatcattagtggctcacccccaatctaatggtcaagctgagagagccaatcaagagatcttgagaggcatcaagccccggtttatggttccccta

SEQ ID NO: 38881 - DNA, 289 bp, Triticum aestivum
  Clone ID: PAT_TA_38881
agacgaaaatcacaaggaagaacacattaatcgcgccacgggccttggtcaaaccacttgggtggaacaagaaagatgaaaaaccaaatgttgccgccggaaaactgaagtccaatgaagagttcaaaaatctggtgcttaagaagtgatgtccgtaggcaggttagttcgtcggtgtcttcacgtcccaccaaggacctctaccttgcacctgacctgtggaatgaatgaatataatgaagtgttaacttgacctttaaccggctaaaaaaaaaaaaaaaaaacaaaa

SEQ ID NO: 38882 - DNA, 398 bp, Triticum aestivum
  Clone ID: PAT_TA_38882
attctagagtcgacgggaccacacacactgccgccacggccgtgaccgccccagtgacgtcgtcggtgccagcggcggtggtgctcgtgtccgccgtggtctcgttccacctcatgctacacgcagtggacctgtcgtccattagacacggacggcacgcatgtaattgacacaccggtacgcgtgacttgctcgccccgcagcacttatacgatacacatcagaccgcgaagagaacactcctcgtgaacagtgccactatcattgcagactccttgcccgatactcctgttgcggtggatagtatcgtagtgtttacatcatcatggatcacaactgacaccttctatcagctaaagagtatttgcttagctgcttagtccttcagtcccatcctc

SEQ ID NO: 38883 - DNA, 118 bp, Triticum aestivum
  Clone ID: PAT_TA_38883
gtcgacggggaccggtaaaggaacacataatatagacataatccacacagcaccaagaagtcctcaaacttcacaaagatcagttttggaaaatcaacaaatggacgaacaaacaaaa

SEQ ID NO: 38884 - DNA, 401 bp, Triticum aestivum
  unsure (1)..(401): unsure at all n locations
  Clone ID: PAT_TA_38884
ggtcgacgggtggccctagattgaatcatcatatcattgctacctcgaagcatgactaggataccccactcatcaataagaacattggaggtgcaatgctaaatgtttcttggtcagttatccaaacaccgttgtatgggtaacatcttgattaatccttgcctcttacctaaatggttgggtactttctctcccaccctgtatgccatgttctgcttgtacatgggaaggatatactcctaataatagtgtgtaaacacaattttcctttccattgttctgtttaatcttataatcgtgttttcctttccattcttttgtttaacctttcctgaatctaacttaactgagcagagataaatccctgcttaagtangcaccttgttgtaccactctgtctg

SEQ ID NO: 38885 - DNA, 408 bp, Triticum aestivum
  Clone ID: PAT_TA_38885
ctcgagggtcgacgggtgtgtggaaatcgagacttataaagctagtgctttgggtttgggatgcatgatagcttggagagagtgttgtatttatagcctggtgatacggatgcatgcatggatgggatcgagctgtttgacgtacgtagtagcttacgtatgtgtgtatgatcagacgtggccatgtgtgattcgattgctttcaaaactgctaggttgtcctctcgatgtatcatttgttttagagagataagacaagatttaagcatgatatggtttatcaattctggagatatggcaacaagttgagcaacacccttgcatgttcatgcatgttacgcaacactgcaataccttgtcatgccacacaatatgggcgcgcatagacaccggaagctaagccgatat

SEQ ID NO: 38886 - DNA, 366 bp, Triticum aestivum
  unsure (1)..(366): unsure at all n locations
  Clone ID: PAT_TA_38886
gtccacggggcaccgtatgatcaatgtgatgatggccacatgctaacgtaatcacatccacccgctgctgaaatgcatcagtgagtggcattgcaaacccctgacgcactgctcatcacccatcgagatacagtaccaccangcgttcatataaacatctacactcgttctgaatatcgaattggttcacgactgttatacgtaaggttcctggtaaatctacgtatcattgtacctatttcacttgatacgactgttgttttttcacactgccaccatgccatgtccaagtgaggcacgcagcttctcaaacttgtgttgttgtgccttgtatgctcggatcttaagtacattactttgtttcac

SEQ ID NO: 38887 - DNA, 420 bp, Triticum aestivum
  Clone ID: PAT_TA_38887
tcgtgggtcgacggggatcgacgaaaatgggtccaatgagatcacggcagtgcagacggcgaggtcggggaggaactagagtggtcagggcgtcgagggggatctccggtgatgatcggtgaagacgaggctgttgcgctggtggggcaggaggggctcttctggttcgggagcttctggggccggacggagcagggcgaccccgtgtcttccgaggatcagatgtacgcaagcttgagcctgccggtagttctagagagagtgcggggttaggcaccgatgatgatgcagtttgatgcaagcggcttgcattgcagcttctaaatgaggtttctacttttccatccggccaaggattttatccagagtagcagctattacatcatttggtcagtgcactgaccccctactgtacatatg

SEQ ID NO: 38888 - DNA, 401 bp, Triticum aestivum
  Clone ID: PAT_TA_38888
gtcgacgggcatatgcactcctggtacacacactcagcaaaatgaggtcgtgtgcgataggggagcgctcaaatatggaaatacgtataatagagctaaaatatacaatgatagacgcagaattgcttccggtcgcaagtacatctcacacagtcagtccgcgcgaaacgtttccattcgtatgtacatcacaatcagtcgctccaaggaaaacattttcgttcacaagtacatcatacacagtttcccccgttaaatcatttgtgataacgttgacaatgcacacgatattaacaattttaacgtttgcattaatgaatggatcatacattgtgcgtacaagaaactgtatgggaaaggttgtccatcagacacaatttttacttggtaaacgtttgccc

SEQ ID NO: 38889 - DNA, 377 bp, Triticum aestivum
  Clone ID: PAT_TA_38889
ctcacgggtcgacggggtaccctacaatgagtcgaattaccattggaactctcgttcatagaacatgatcatcggcgagaggttcgcggtcgaccagcacatggatcacttcattgaccacagcatcatatccatcgtgtccatccaggcacggatcgtgacgcaataccctttccccatgcagatgcacgatagccaatcggagctctacccttgaggtcctgcactggcacgatgaaaccgtgcttccggatctcctgccggcagtcagtcaaacatatcgaacgcagctagcgttactccaaaatatactatcggtacgtcgggtcgcagaccaagcagcagtacatcgataacatcatctggaacatccatca

SEQ ID NO: 38890 - DNA, 344 bp, Triticum aestivum
  Clone ID: PAT_TA_38890
acgggcatcgctatagtaaatcgtaatatatccatacctcgaagattggatcaccaaccacacgcttgctattgacatgggtgctttgtgtcttgctatccatgtgtcaatttcatcagttcggtgctatatcgtatgggtttcacctctagcctatcccaacttgtttggaaccagatgctttgttgttgtcgtccattttgcacacagaccaataaatgatttaacactcgctataacactccacgtgcatcacttatatctttctgagcttgataatttttgccccaatgattcacgcatatctttcatagcaccgtggtggatttgcttcaaagaaacca

SEQ ID NO: 38891 - DNA, 339 bp, Triticum aestivum
  Clone ID: PAT_TA_38891
gttcactcgtctgatttttcaaaactgttggcacattattgcgaaagacttcatgctactgattcaagctctccacgaaagccggttttactcgtttggggcacttagctcttccataattaccttgcttcccaagaatgaggactccaatgcaccttggagacttcaggccgatcaacttgatacatggaactgcgaaaatctttgtcaaggctttggctactacgcttcactccctactgccttccttaatatcccaagcacaaagcacttttgtctgcaaacggagtatgcatgagaattttaaattcgtgctgaacactgcaaggacccttcaca

SEQ ID NO: 38892 - DNA, 255 bp, Triticum aestivum
  Clone ID: PAT_TA_38892
aagcacaatagttgtttcttacccgtctgcggtgccccctccacgtttactcctccggtcatattgtcgtagtgcttaggcgaagccctgtgcagatcacatcagcaacaccacgccgtcgtgctaacggaactcatcgactccttcgtacctctactggatcaagagttcaagggacgtcatcgagctgaacgtgtgcagaactcggaggtgccatacgttcggtacttgatcggttgattcgacaagacgttc

SEQ ID NO: 38893 - DNA, 387 bp, Triticum aestivum
  Clone ID: PAT_TA_38893
accccaaatcgagtcttatgatgatggactgtctatggatggatcatggataggtagatcttgatccgttcttttgcctaggtcagggtccactggaaagttgaaaagcgcttgaaagtttatgctgcctgttcaaatgatcttcttatttcaggggaaatgatctttacaacccactcaagcatccaggacgcagtccgcataataaagcagtttgatcgtgtatcgatcacgtagacggtcagcaccgcttttcattataatacagaaaaagtaagtagtaaattcagttattattatgctaatggacatagtaacaattttgtttctgacgtttttccaaccgtcttgacaacatctagcttcatgtttccagcttcagtcaaa

SEQ ID NO: 38894 - DNA, 374 bp, Triticum aestivum
  Clone ID: PAT_TA_38894
ttcgatccgaatcatcacacgcatcattggcaggctccatatccgcccaatatgtcttaacacgggcaagagctagccgagcgccctctgtgcacgctgacctcttcacagcttctaatcgaggcaccacgtcaaggagctgctgcaccaaattaaaataacttgtcggcttcgatccgcccaggcctaagcaatccatgacatatgtcatggcgagtccggacagtctattcagctcggcccactaggctaggcgatcgtccactgcaagtggacgccctggattggtaaactgcgaccagaagagtttctccacttcatgattgtccttatcttgaaagtacctggtcgcatcggcaacactagcctccaaa

SEQ ID NO: 38895 - DNA, 426 bp, Triticum aestivum
  Clone ID: PAT_TA_38895
cattcgcgggccgacgggtcaatgcaagctacgaggagccaccttcaccccatcacttcaacaggcaagaagttgttgaagactcttcaggatcaacccagaatcattccatcaaacaactacaagagacgtagcaacacctaaggaaaactcagaagactgcacggggcacagggcacgactactgagtccgagaacccctagggtaggatgagtcgcgtaccccctatgcgcagatgagtctgtatgatggttcaaatagaatcgtgattgtgtgttgcttgtttttattgtttgtgtttttagataggccgcaacttttgccctatgcaacaagtacgcaactatatcaccttccttaccttgtttcttttgtttggccctttcggcacttgtttgtttgcacttgcactataaaaccccctt

SEQ ID NO: 38896 - DNA, 431 bp, Triticum aestivum
  unsure (1)..(431): unsure at all n locations
  Clone ID: PAT_TA_38896
gggtcgacaggggcggatatgaaaaccatcgcactatgtaataagaaggaataataaaagtaacaaaattagataagtatctatctaaagtaagaatttttttctttcagaaagaagataagaacaagaggctcaccacggtggtgctggcgacgagatcgacgcgggcgatcgacggcggtgaagacggggacgggacatgacggaccgctaaacctagacaaatctcggggaaaatggagctcggaggtcgagtttcgagaggagaaggattaactaaggtggctcagacatttcatcgaacacctcatgttcatangaggtgagctagagcacccaaatgcncccccccctcgccggctagaaaaaaacagagcagctcggagagactgcggagcccgaggtgaaggtgctgaacctgaccatcctgt

SEQ ID NO: 38897 - DNA, 420 bp, Triticum aestivum
  Clone ID: PAT_TA_38897
taagtactcaatctgtacctttatatagtgtgtgtttcatcctgactacaataccaaggagtgtggtggcatgtgtactttggatcctcataggttgatcccctccaccaagtatgtccacatgcatgtgcccaacgatggaaacttcccaggcacacttccaacccagccaggggtattttcatccaaaactccaaccgtgcactacattgtggaactttgctagaaaaataaggcgcactacatagaggaatggagggaataaggtaacatgtgttgtagacgacattaagtcttggattatgtgttaagtcttcgaaaaatattccttctatgcgccatgggttcctcaatatggcaacacatacctgctacctcgcgtagagctgatgtcacgcccggataattaagctacagtag

SEQ ID NO: 38898 - DNA, 184 bp, Triticum aestivum
  Clone ID: PAT_TA_38898
gaacgtcctaaaatgttggaaccggagtttggggaatatccactcaactggaagccggccccttaataccattgaatatccgggtttggccaatgcactttggtaatggcattgcccaactgaaaaggcattgcaatgatgtgatattatgatatgcttgaagcacgcctagtgactttgatgt

SEQ ID NO: 38899 - DNA, 391 bp, Triticum aestivum
  Clone ID: PAT_TA_38899
gacgggtgaccgctacgatgaagacgacagaaatccaacggttacggcggcaaaaaaacaacacccccaaccaccctttctacagggttggaggcatcgacaaattcatcgccaaggcaaagaagatccccagcaagaacgcttgatgacgaggtgtggccaccgccctgtacaagttaatttttttgggatttcagctgtccgcccgaaacttgctcacaagcaggagtgtgccagctcctgctgagggatccttgtttttgttcgtttttactccaatttacccgtaataagcaactgcagtgacattggtttagtctgcacaacagcaacactactcttggcttggaaaacacttgtgccctttgtaatgaaaaaccggacgcactgc

SEQ ID NO: 38900 - DNA, 100 bp, Triticum aestivum
  Clone ID: PAT_TA_38900
aggtcgtgtaattttggacgctatgtatgtatagcttggatcttgacgcctttgttctattgttatatgatgatgagtagtagatttacttaatcggagc

SEQ ID NO: 38901 - DNA, 114 bp, Triticum aestivum
  Clone ID: PAT_TA_38901
cgggggcacgtgaatcgtcgagcgagaacatggatcggctggtcgagttcttgcgtgccgggtgttatggtgctacctgaatgagttataccggtgttgtttggtaccatgcat

SEQ ID NO: 38902 - DNA, 262 bp, Triticum aestivum
  Clone ID: PAT_TA_38902
taattccaagcctggtggaacagaaaaaaggccaaccttagcccaaattggaaaggccccttaacaaccaacaaattcctaacgggaattgaaacggcaagccatgcaaccgaacaacgaaccaagccaaaaccaagggacaaaagccgtctttgaagaatttaagcctaaccccgggaccaagggtcctccccttcctccgttcaactttcaaaattccttccccaaccttggtttccctcctttttccccaacttttttc

SEQ ID NO: 38903 - DNA, 226 bp, Triticum aestivum
  unsure (1)..(226): unsure at all n locations
  Clone ID: PAT_TA_38903
ttcccgggatcgcacgggcggcggtgacgtnggcggcgacgggagtggctgnaggctgcgggggttggcgacgtggcggggcgctgattgggtcgggagtgaggtgganggcggcggccggacatgttcaagcgggggaaaggatgaaacgtcccggcgatgcgganggggaatttgatctannggttttgccccgaaaactccggnggaaggggaactaatatat

SEQ ID NO: 38904 - DNA, 289 bp, Triticum aestivum
  Clone ID: PAT_TA_38904
gatgtagaccaatccgatacaaaactcctaaattaataaaagaaacccgatttcaacaaacgaacaaaaaatcccaattgagaataaggtgaattccataaacccaagattacaaaaaggtccaaggtgcaaagataaaaaacttaaggttgaaggaataaaaaatcctcctgggttcgaataacagggaaattcattaaccacaaaaaccatcaaaactataatctgaaacattatcctaaataaacaattttctgaataatgaataaattctaaaccatggggctat

SEQ ID NO: 38905 - DNA, 425 bp, Triticum aestivum
  unsure (1)..(425): unsure at all n locations
  Clone ID: PAT_TA_38905
cgggtctagccaagttttttaggttttgggaaccttctnaaaggttcctggaaaccggtttttttattatttttattattttcgttttattttctatttttctctttcttttttctgccttttttctttcttcttgcgctttttctttttgattttttttgtgttttcagctaatgtgttcagaatttttcataaaaactgagattttcagatttttcttcagaaatttcatagaattttagaatttcacaaattgttcgcttatttaaaaaaagtgttcatcttttcaaattttgttcacaaactaaaaaatgttcggtttaagaaatatgttcccgctttcataatttgttcacaaattgctcaggaatttcataaaatattcccacttttgaaagttgttcaaaacaaaattctgaaaaatg

SEQ ID NO: 38906 - DNA, 369 bp, Triticum aestivum
  Clone ID: PAT_TA_38906
ggtccaacccgaagccccggggcaaaacaaccggaataacccccaaaaggtcaaacaacacggggaatcctgggaaataaccggacccagaacgaacacaagccggcaaatccaattttcaacaaaccaatttaaaacttgcaaattttaacaagccggttaaacttgatttgggccccttggaaaaatttggtacccccggaaccggcaatttgaattaacttacaaggtagggccggccggccggtggtgtcattcaaaaccggctttccgcttgttgcaccaaattcttgcagggaaagtgtaggtccaaaattttgcaaaggaattggtgaactgggttcttttattagaaaccacacttcagcg

SEQ ID NO: 38907 - DNA, 220 bp, Triticum aestivum
  Clone ID: PAT_TA_38907
cgggagatccacactgccgtatgcctcgtcctcgccagcgaggtcacgattccgcagtctccgagggcaccactcggtgtcgacaagttcacctcctcttaggctgttcgtcggccgtttctcggatctagccgtacgggtgcgtttatggccgtgtaaacctcgtcgaatcgtacccgatgtcactgtaccgcccgacatgttacaggtgcctgcctca

SEQ ID NO: 38908 - DNA, 381 bp, Triticum aestivum
  Clone ID: PAT_TA_38908
ccacgggacacctaccaccccagctccagtgcctacaaggtcatcatcgactttggcctccaaaaattcttcaaattaaattaactaacaacctaacaataattgtaaaaggacaaaggggaaaaggaggaaaattaaaaggaaaaaccaaggattttgacaaacattcattaaggggttaacacgtttcccaaaaataaaaggaggaaaaatcctggactgaccaacatcagtccaaaaattttgtttcagtttaggtccaaattttttgccaattaagggtttacacttttccctaaaaaaaaaaaaaaaaaaaaggaaaaaaaaaaaaaaccaaaaaaaaaaaaaaaaaaaaaaaaaaaaaaaaccggccccccaaaa

SEQ ID NO: 38909 - DNA, 125 bp, Triticum aestivum
  Clone ID: PAT_TA_38909
tccgggaccacgggtcacgttgactcactcagttgagctgatgaaaccggtaagcaagcaacaacagcctgtcagccaccatgttacaatccccaatacaataacagaaaggatacttaacttgc

SEQ ID NO: 38910 - DNA, 446 bp, Triticum aestivum
  Clone ID: PAT_TA_38910
tccacggggacgaaggcacaactcatcctaaaggtccttcaaggcccgtaatagagttgccagatattcgaggtgacacagattgttttgctggatctgctggagttggcatgcctcataaactcaaacaagtacaaggcgatgattcatggatgtttgaggaaatttctgtatcacctagatcattatgtttgaatgaggaaggtgaaagtgtcgtctttgagcatagggaatctggatcttgtgttgagcacagggaatctggatctcctgttgatgattacttaccccatgcaattggttcgtgcgaagagagtaaaatttctccatatttccttgatcttgatccaagaacttcagggaagaaatgtcaagaagtagaccattggaatcataaacgacatcatgactgtcctgccggagactgtaatgaccagaatgaattt

SEQ ID NO: 38911 - DNA, 374 bp, Triticum aestivum
  Clone ID: PAT_TA_38911
catcattgggtaataataatgaaccaaacggaacaaggtcaagttaaatggaacaaagggttccaaaaaattggaccgctgtagatagagggggaaggtgatggaaatgttggtgaagatggcggaggtgttggtgaagatcgtggtgatgatgatggcccccggtggcactccggcgccaccggaagctagggggagagagccccccttcttcttcttcttcttcttcttccttgaccttctccctagatgggagaagggtttcccgtccgggtccatggtctccacggccgtgggaggggcgagaacccctcctgagattggatctgtcactctgtctctctctgtttctgcgttctctctattctgccctt

SEQ ID NO: 38912 - DNA, 383 bp, Triticum aestivum
  Clone ID: PAT_TA_38912
acgggcgtaccatagtgtcggggagccggcgcaacaagcgcaagcgctgccaatagtgccgggagcaacggacttcggcgcaatgccgcaatgtggaaagaccggtgtggagcacgctctcttgggctgcgccaacgtctacgacaactgactcctctaagccgtggcttatggggtgtgtgttgttataagccacagcgtgtgtggtcaggctcgtcacgcgcgacggattcacgcgggacgtacgggacgcactgatgcattcggactcgtcggacacgactgatgcgcgcaggacatgcggggtgcaacggaaacgtggcgtgtgtgcatgtgtggtgtgcgtgtgtgcgcatgtatgtgtgtagcgtagtggccacgct

SEQ ID NO: 38913 - DNA, 166 bp, Triticum aestivum
  Clone ID: PAT_TA_38913
ttccgagtcgacggggtatgactgataatatcaataaaggtaatccaacagaataatccaaaaattcaacaactccaaattaaacggcttataaaccaggtaggtaaaaggaaggtgtaacggaggtaagaatttgatcccttgtgtaagggtgcggatgtaacgc

SEQ ID NO: 38914 - DNA, 379 bp, Triticum aestivum
  Clone ID: PAT_TA_38914
gaagcgtgaactgggcaatccaattccaattccgaaagcctccccaaaacaatggccccttcggggccggaaacaaaacccaaccggcccttccaacttcaacaacggccggcaatcacaatgggtttttggaattggttgccgggcaagaaggccaaccaggaccatgaggcaggctcgtcatcaacctcaccagaaaccgcggccacctactcaacctcactgatggcattctcaatctcccacctgcagctcggccccgcttccggtcgtacgttaaggtggaggtatgccgatggtactggcagacctgcaccccgttgtcgtggtctgttgccaagcccgccccgcgagccgcgtgtgcgtgtgccgagcccac

SEQ ID NO: 38915 - DNA, 446 bp, Triticum aestivum
  unsure (1)..(446): unsure at all n locations
  Clone ID: PAT_TA_38915
aaaaaatgaagggcacaaaattgaggggcaccatcctggcctctcgctacttctcgtctggatagtgtactcaacgccacacaatactataccgtatgcaagcctgcaggtagctagctagcctgagagagacagaccgaatccgacagatatctcagaagaattttctttacgtgcccaatatcaatatgggctctgaaatgaggctaggggcgcgtttgttacctgcatcgttttttgccactttgcatacttgtcccaactgggcctggctgagcatatacaggataaaaaccaacatctgcatgttgattggttacctgcatcncctccagcctaaacgtgctaaaacgaaaggcctgatgtttgcttgcggactttgtttgaggggaaacacangtccggttgtttggttatgtacaggacagttgtgtggtaacctccta

SEQ ID NO: 38916 - DNA, 421 bp, Triticum aestivum
  Clone ID: PAT_TA_38916
tagccgtcgtagaattcaagggtcgacgggagatacaaaatatattttcaaatatataggtcacgtgggcaatgccttggtgacggcaaaatgggtgcattcgtccggtgacacagatttgctatggccgcagtgacaaggtaggtatcagtttcgagatctacggtttcaagcatcagaaggtatctaaatagggtgaaccttgtcaaagaatggtcacatattatactctctgaatatcatcctactgaaagtaattgaagccttgccttcacgatcatcaaatggttgcatctctaacatagtggagcacaattttatgataacatagactcaaaaaaggaaaaatagacagagggtttagaaccctagacgccaccttctccacctcgctcctcctccgggtgccctgcactgctcc

SEQ ID NO: 38917 - DNA, 387 bp, Triticum aestivum
  Clone ID: PAT_TA_38917
acggggcgaaaggaggtcaacggatggcacggaaaaacaggttgcgaagctgatggacgaggacatcggtgccgcaatgcaatttctccaatcaaaggctctctgcatgatgccagtctcccttgccatggctatctatgacacacaacattcacaggacggccaaccagtgaagcctgaacccaacaacactgcctagtatagtaacagcagctgcaacacccatccccgcagctgctagtaggcatgcatgaacctgttatcaaagtgttaagataaaaactgctggttctgatccactaactacaaggaggctggaaaagacctaaaggatcctctccactggaagttgtatcgacggtatatgatgtcacctactaacccttt

SEQ ID NO: 38918 - DNA, 385 bp, Triticum aestivum
  Clone ID: PAT_TA_38918
cgggtcgacgggtgttgatagcttgggcttgactctgggtagcaaacatggtgttgatggcgctccatacttcagccggcgtctggagcgtggcgacctgccaaaggatgtcgcgagagagggagcccatcaagtagccttggagttgttgctgttgtgcgtaccagagggatcgtgcaaagttgaccacctattcgtctttgtcgtccttggtgatggtgagggtggccggtagtgccggactctttgcgtcaagatgatgttccatttgcgcgcccttgttctggggcagaatgatagccttccagaacaggaaatctcccctcaccaggttctcttggggtggcgatccgagaaaggaattgttggaagtggatgattgggc

SEQ ID NO: 38919 - DNA, 408 bp, Triticum aestivum
  Clone ID: PAT_TA_38919
gggtcgaggcgggatactaatcgagaggtctcgagttcaaatctctagctgatagaaaaattggtgtgttcctgttgattgggcctgatcggcaggaaagcccatctcagcctcattaatcttgcatctcgtcgttgccctacccatcgtagccccagtcccaacgccaggacgatggcggccgcgggacctcctatctgccgcattctgcggcagactggcggggtttcgcacagggtactctttctctgggccggcccacacagaagcagccggtggtgaaaaaaaacaacgcataaaaagatacatgttttgaaaacaaactgcattcgaacttctaaaaaagtttagatctgccgtggattatgttcttatagtgtttgctgcttaatattgggaaagaacgtt

SEQ ID NO: 38920 - DNA, 181 bp, Triticum aestivum
  Clone ID: PAT_TA_38920
gtcgacggggcgtaccaatgcatcgcctgcggctacgagatacacctccggtgcggccgggacgcggaagacggcggcgccgtgggagctggtcagtaggccggagtacgggacagtcttatataccattaaactgaatgctgtgtgtgcgtgctctgggaaatgtcatgttgctattgtt

SEQ ID NO: 38921 - DNA, 335 bp, Triticum aestivum
  Clone ID: PAT_TA_38921
cggggaagatcagcccccggcgggaggagacccccgccgcgtcggtagatgagggaggaaggcagtggcgcagtcatggtttagatatgaaagttttggacaccgagcggaactcagtggagagcttatatatgaaaactagcgagagagagagagagagagagagagaagacgatatttatgcaattagaagagaactatagacattgtttttcccctaagctcaataaggtctgtgtcctttgtggactgcgtttcttctttgtagagacagaacataatataataccgaggattgcagtcaaatggaaattaatttcaggtttggaacttga

SEQ ID NO: 38922 - DNA, 355 bp, Triticum aestivum
  Clone ID: PAT_TA_38922
tcccttcaattatatttactttacatataagttttgtcttaagtcaaacttcgtaaagtttgatcacattagaggaaaaaatatcaatatttatactatcaatcaatatcattgcatcacggaattaattttcatattgtatatcttttctattatagatgttgatatatctttaatataaaactggtcaaaatttattaaatttgacttaaaacaaatttatatgcggagtaaaagagaaacagggggaggaagcggcgttctgtctccaaggcgcatctattcaaaaacttctgaatttttgtgtggtgaaagatgctttgggtccctgccaaatttatcttgtttggacatt

SEQ ID NO: 38923 - DNA, 104 bp, Triticum aestivum
  Clone ID: PAT_TA_38923
gctatgacacactgacccttcccatatttgcatacatacgtttaaaatctgaaatattttacaacatcaggatgttctttgattcggtaacattcttatcgaat

SEQ ID NO: 38924 - DNA, 406 bp, Triticum aestivum
  Clone ID: PAT_TA_38924
acggggctggttaaagaggaagccgaggcaccacttttcaacggtgaacccacccacagctcattctgcataacccaacagaccaagcaacacaaatccgattcattcccctcccaagctccaatcccgcgaattctcaagcgtggtcgtcatcatcatcacccagcatgatccgtttcatcctgttgcagaatcggcaggggaagacgcggctggccaagtactacgtcccgctcgaggactcagagaagcacaaggttgagtatgaggtgcatcggctggtcgtcaacagggaccccaagttcactaacttcgttgagttccgtacgcacaaagttatctacaggagatatgcaagactatttttctcaatatgtgtagatatcacggataaagatttggtata

SEQ ID NO: 38925 - DNA, 282 bp, Triticum aestivum
  Clone ID: PAT_TA_38925
attgtctggctattcatgcaattctatatgagatgcactggacgttgcagctgctcgagtaatgatattgtttgagaccatgcgttgcaaggtattgagagactatagttacagcgagttgcggcagacaggggagagagaactgcatccgattggtttgttaggacatagataaggacatcatcagtatatgctctgaagattaggtaacttagcacagactttgcagtctacttatatcaggttgaaaccacgtcttcctgagattcaccgcccagtctt

SEQ ID NO: 38926 - DNA, 394 bp, Triticum aestivum
  Clone ID: PAT_TA_38926
gtgcaggagtgtagaacacatgtaataggataaaataggatgaaattttattttggtcgattggattgtttagtttcttcacgcaaactttgccggggcctggcctcaaacacactactcaaattcagatttcattcatcaagtggttccgccacaaaatcgctgaaccgcaattcaaatgttgcatgcttgatgagcccactctgcacaattagctggagatgcgtgcgtgtgtgcagcttacaagttggaaacacagtcacagaccaaagctctggtgtttccccacctgctggctcagctcagacacaatttggtcactggactagagggaaacagacaatgcattgagctcacacaaaccaaaactttggcacaagttcatggatcactg

SEQ ID NO: 38927 - DNA, 304 bp, Triticum aestivum
  unsure (1)..(304): unsure at all n locations
  Clone ID: PAT_TA_38927
taggcgtcgtaaattcgtagggtcgacggggaactcaataattctagaataagcaataggggatagtcgaattggtttnaacaccttcccgttgtgctcaatgnncaacccttcctttgggtattgtntnntagtaaacantnntttgcatgctgcccagttttgttgctnncgcaaacgatagggaactagttgcacttgaacacagctcaattctagggttnntctagtgcattggtttccttnngataatacgttggctttttgctttcgacatgtatttcgacagcaatttcaagtacac

SEQ ID NO: 38928 - DNA, 141 bp, Triticum aestivum
  Clone ID: PAT_TA_38928
gatttaatgttgaattttgtgttgtaaagttttcaaggtttgagtaaagatttgatggattttggaataaggagtggaaagatcctaaccttggggatggccattgccctcaactggaacttctcccgcttcacgaactct

SEQ ID NO: 38929 - DNA, 375 bp, Triticum aestivum
  unsure (1)..(375): unsure at all n locations
  Clone ID: PAT_TA_38929
gggtcgacggggtcaggaaaaagtggggcggtggcgtcatgggctccaagtcgcaggccaagaccaaggccagggaaaggctcatcgccaaggaggctgcgcagaggatgaactaagcctagccttatatgtgagagcatatgccatgtagtttccctttcagtgtgtcctgattttgacgaggaactcgaacccttttagcagcagtgtggaatcgtattgtggttttctgattctctgttcccttctccagacttatgcaaagatcagatgaggtttacccatgtttggattctatatagctttatgtcctttgtcgagtcaaaaaaaaaataaaaaanaaaaaaaaaaaaaaaaaaaaaaagcggccgctct

SEQ ID NO: 38930 - DNA, 257 bp, Triticum aestivum
  Clone ID: PAT_TA_38930
ccggtcgacgggccaccgaactcctccagcctccacctgcgattgttcaactagccctctccatgggctcctgttcaaccacccctccacgggctactgttcatccagctctccaccggcaactgttcaacccgccctccaccggctactgttcaaccttccctgcacaatctcttcgtgaatacccatttctctccttaggtttgttttctctcaatatccgatacacacacacatacacagatagagagatagac

SEQ ID NO: 38931 - DNA, 228 bp, Triticum aestivum
  Clone ID: PAT_TA_38931
cgggcaagggtattcatcaaaacaaatccgaagcggtttcattcgatttgttgtgtactggatggtggaaaacttactccacagcatgcatttcaacaagatttccagtagcacgtgttaaggagtcgctccagcgtgatactgtggatgtcttcccgtgcacaatctcttcgtgaaacactagatctcctttgagctttctctggtcgcttcgacgtgcattggagc

SEQ ID NO: 38932 - DNA, 283 bp, Triticum aestivum
  Clone ID: PAT_TA_38932
gttaattattttaagccagtgaaacttactaatagtagcaggccactagtacttacgttctgaggccatatatataggtaacaagtagtggcagaggccagtattttgccaacgccatatgtacaaatgtgttccgttttggctccacatgatttcccgtatgttcatatgaaatttaccgcagtgttcttttaaacatcagtgttgatacttgaaaaaaaacaaaaaaaaaaaaaagaaaaaaacagccgacctaagaagaatccaacaccgacgtccccat

SEQ ID NO: 38933 - DNA, 402 bp, Triticum aestivum
  Clone ID: PAT_TA_38933
gtcgacgggctgcaggctggtgtacgggatgatacgccgctttgtctcggccacggggtggccggtcagccgcatccagcgctagtagtgtaggctctagtgcctcctcctcgaattgaggtaacaacctgcgctttgggtaactcttggttgggcgcttgagtctgtattgctcgggtgccaggacctcagtccatctatcagttagcagatcttgatcagcttgaagttgttgttgctttttctttaggcattttgcagtggctataagccggcgcttgaagcgctgctgctcgacgggatcctcaggcacgacgaattcttcgtccccaaggctcacctcatctttggagagggccatgtaattaacatcctccgagtctcatacattgcctgtttttc

SEQ ID NO: 38934 - DNA, 401 bp, Triticum aestivum
  Clone ID: PAT_TA_38934
cgggtcgacgtcattcatcgtggccccgtaggggcacacgaagcccttgaacgccgtgcagcaccgccgctgcgggatcgcctgtcccaagcagctgccctgtaccttgcccatctgcttcaggtgccccaactgcaccgggcacagccctgcctccatgaagccccccagtttgcggccgggcgacggcgatgcctccgggggcgaggctaaaagggccgcatttgatatgatgagtggtttgtccgacgcggcggagccggcggcgacaatggacagcacgacgcaggacagaaggacggcggtggcgccggtggaacccatctatctctctctcttccacggcgccggagcaagaccgaactctgtatcttcgtgggaacgaagctgaggtgaccggg

SEQ ID NO: 38935 - DNA, 415 bp, Triticum aestivum
  Clone ID: PAT_TA_38935
cgggtcgacgggaaacaccattatctatggtttaaaccttcttttctcacaacccaacgacgaggaccccttgaatcatgaagccgcggccgtcctccgggacaacccgcagaagttccagagaaacgttcagatggcaatgtcgggaggctatgtcgataacacccatttcccaaggtgcaagtaaggcggccgggcgggcctgctatgtgcttgcttctggcttgcgcccacctaccctaccctagccctgaatgccaaaccattgcacaatctgaagaaatgcgggcggcatacccaggaaatgtatctatcatacttgtttgtgtcaagaagatgtgactgctattgtgcttgtttggtggatgttctggaattgtcgtgtaacatgaagaagaaatggggtgacgttatg

SEQ ID NO: 38936 - DNA, 257 bp, Triticum aestivum
  Clone ID: PAT_TA_38936
ggtcgatgggtgtcaccgatactgagtcgtgttaggaccgtgaaacgcggcgacgagtgcaacaaataatcgtgtgttcgtgtgatgggtcgagttgtccaggttaattcatcagagttgctggtcgagttagcagtagtaaaatagggagtgatacaagtcgggtcgagtggtagtgcgtcaaagaggcacgcatatgtacgcgatatgatggaaaactttcatgcattttggcgtgtgtggactggacaatatat

SEQ ID NO: 38937 - DNA, 433 bp, Triticum aestivum
  Clone ID: PAT_TA_38937
tcatgggtcgatgggatacctcatagtgaatcgtactaaacctattgatcattaacttagattttcccaagattttggctgctattccgaattactctattattccgaagccaatgaaaagtaagtagaacctacaaaaatggggttttctattgatgccttgaataacatatagcttacctatagacaaaaaataaaaaaaaaaaagtaattatgtttcggaaccaggcaaaaccagattgctgtgccataggaaggatagctatactaattcggtatactcaaaatacacctttggtacaaaattgacaatctcacaaggatgaaatatcagtaattttctatttactggtcgatcccatcttttacggaatcaattcctttttttgaatgtacaaaaattttgggagttcagcatgtctggaaacacggg

SEQ ID NO: 38938 - DNA, 421 bp, Triticum aestivum
  Clone ID: PAT_TA_38938
gtgaatcggaatagttgtatcgcgacctgaatgaatgaaataaacgaaataacgctcttgttcaaccgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccgcccaaaaggatcaaacctaacttacccgggaaggaaaattaaaaacccttcaaaagggccaccaaaattaaattaaagggccgtcgtttaaaaaagtccgaacgggaaaaacccgggggtaaccaaattaaacccccttgaaaaaaaaccccttttcccaagggggggaaaaaccaaaaaggccccaaacaattccccttccaaaaatttgccaaaccgaaaagggaa

SEQ ID NO: 38939 - DNA, 149 bp, Triticum aestivum
  Clone ID: PAT_TA_38939
ctcacgggtcaatggggtaccatagagtgaatcgaaataggttattctacaagattactctatagatccatcagctctaagtaaactgcgtataaatcatgtatgtataaggtatgtgttactgatgttagaagttgattccttgtgtg

SEQ ID NO: 38940 - DNA, 406 bp, Triticum aestivum
  Clone ID: PAT_TA_38940
gtcgatgggctgcggtatatcgactcgtctaatccggtggtctccgcggtccatttggtggccgaaatggccaaaaccactcccgctgccgcgtcgggctcgccggcggctaaacgccggcagccgactttgactttgacccccggtgggccctggttgactcccctgagtcaatgacaggtggggcccagccctgttaattaaacaggattagttttaattaaattttaattaaaataatcaccctgacatgcgggacccactgtcaggtttgacccagacctgttcagttgaccactgacgtcacactgacgtcaggctgacgcagtaattgattttctggatttaaattaaatcaggaaattccagaatattatttaaacttcaaaaattcataacttttaat

SEQ ID NO: 38941 - DNA, 177 bp, Triticum aestivum
  Clone ID: PAT_TA_38941
tattgagtcgtagtaatgtaaaagctacgtactggtggttgaatagttgatgcacccgagtttgtactggcatattgtatatctgtacagtacatgctggtggttgaacagtagatacttatggaattgtatgtattctatgcaattgtgataatgtacgctgtcggtgttgtgtgt

SEQ ID NO: 38942 - DNA, 404 bp, Triticum aestivum
  Clone ID: PAT_TA_38942
tcatgggtcgacgggttccttgaaaggaaatgcttggatgagggtctggattgcgacactatttcaaggatatgccagacgtacgacttggacaaggttgatgtcctgaagtacagggatctggagtggcctagctcagcttctcgcactacctagggattctttgcccaccgatgtctgtacggtaaaacaactctactggatgataactgctggagggtgatcaggctggatcttttttgcttgggacatggacatttaaccggcatggcggatcatgcggtgcccgcattaatctgccgctagcttagaaagctgagaaacgaagaggacctctgaaaccgtagcaaccccatatggtgacccccgttgctctgtacccagagtgtaaatacagtttggtg

SEQ ID NO: 38943 - DNA, 141 bp, Triticum aestivum
  Clone ID: PAT_TA_38943
cgggcattcaaaactcgcaatatcaaacataaatggagactttgatgccaatgatccgaaaatggcggcctatctcaatgccgtccttaaaatgtcagctcggttcgtggggctggataaggttggaccccttagaggggg

SEQ ID NO: 38944 - DNA, 397 bp, Triticum aestivum
  Clone ID: PAT_TA_38944
ctcgcgggtcgacgggaggcgtgaagtttgctcatagtcggttttctcaacggcggtcccacatgaaagtgaaaatgctaggcaacacgccttccctaagctatgtgtcgtgccggacgggccgtggagtactcccaattcccgggcgtgtgggggggagtgcgacgcgaacgcggcaagccttttccttttactagcaatgtgctcgtgtgttgcggcggatccaaagtagtagaatagtaatacttgttcacaaacttgaaagaaatcactcttgttttgatatactcctaatatattactccctctattcctaaaaaaaatgtctttttagagatctcaaatggactatcacatacggtttatatggacatattttgaagtgtggattcactca

SEQ ID NO: 38945 - DNA, 133 bp, Triticum aestivum
  Clone ID: PAT_TA_38945
gggatggggcgcggcaagatcgaaatccagaggattgagaaccagagcatcacgatgtgaacttctccaaacgcattaacgggatcctcattaaggcaagggagatcaatcgtgcacggcgacactgaagtcg

SEQ ID NO: 38946 - DNA, 398 bp, Triticum aestivum
  unsure (1)..(398): unsure at all n locations
  Clone ID: PAT_TA_38946
ccaatgttcgaagggcgtcgatgcaccggatcgggtccgcgggctgggtcacgaccgtgacgcgacaatgacaggagctgcagcaactacggcgatggtgggcacacggcatgtcgcagcgggcgcggaggtccgtgatgacggcgagcaggcgacacatcacagcgtcgggcaaaggcgtggcacggcatggtagcatggaggcgctgcacggcgatggcggaggctgcggcggctcggtgtgacggccatgtagcgatgacgagccgtatcaagactacgggggaaattgttagccatagtcttgatcttgcatctgttangggttgttagttgcacgcgttgtgtttgttagcagctagctccatgcatggaaaacagcaccgctccaaaaccct

SEQ ID NO: 38947 - DNA, 419 bp, Triticum aestivum
  Clone ID: PAT_TA_38947
cgggcattcgttcaccttgatttcgagtgtgaccacaagccagagcactcgatcctcagcaagcttcctagcagccagccttgattaccatccgaattcactgtggaaaacgcaagatgttggatattttgcttgccgtgcaggattcgctacagtacttggtgtcttgcattgttggccatctaaatgagataagcaccagcgttggagactgtatagacttgtttcgcggagccctctaaatgtcgtgtttcgagtaaaagtaggttatttttgcttcttgaagctgtcattgtttgtctgcgatgagggctgcaatgtggaaatgttagctacaaaaagaaagcaagcgatttttgtgtgctcaaaatcagttttgtgaactaaggtcgcaaggagcgagctagcccacccgggct

SEQ ID NO: 38948 - DNA, 278 bp, Triticum aestivum
  Clone ID: PAT_TA_38948
gggtcgaccggtggactaaaggataaggagtggaaagagactaagctgggggatgccaaaggaacccaagattatattaaaggataaccaaaagcctaaaccttggggatcccccggttggaacccccccttcctcctccgtcaaccggaaacttaacttgggccaaaattttaatccacaaaattaaaagtggtttaacttgggcaacaatttcccctggtccgaattgccttgcggtaattaaaataaaggttttgcaccttaatttccattaaaa

SEQ ID NO: 38949 - DNA, 378 bp, Triticum aestivum
  Clone ID: PAT_TA_38949
cggacgtaactaggactttagaggcattctctctaacacctcacatgtgctgatgcaggcagagatggcggagcgtccgctggtggctatcatggtgagctggtgtgctaccacctcgcccacggccgcaggtagcctcctccccggcatccattgtcatgaaccaggactgaatttgagtaattagatacaattctcagacgctacgatttggaggagaaactcgagctcgagtccttggagcaagaggaaggaagaaatgagacagggtctcgttacattctcgataccgagtcagacgggagctcatatacggcgctctaggcgcccgtttgggaagtggcgctcacgcagccgcgaatttgcgccggcccaacg

SEQ ID NO: 38950 - DNA, 341 bp, Triticum aestivum
  Clone ID: PAT_TA_38950
caacatgaacggatacctcagctacctgtccctcgagtatgacttcgtctcggacacaaatcctgcttgggtatcttcattttggaagcaggaatcctttcctcataagatggatgacctgtagtattaggaattcatgccttccagctctaattttttcgcattgttggtgtatgctgggagtcacattattatgctgctagcaaacagtaggattggaagtcttactctgtaggttagtaatatcttttccactataccgaggttcagcaatttaattcgtattaaggtcacacaagcagtttggttttcagatttgtcttgacaaacatatttggttc

SEQ ID NO: 38951 - DNA, 410 bp, Triticum aestivum
  unsure (1)..(410): unsure at all n locations
  Clone ID: PAT_TA_38951
gggtcgaccggtggtcgtacgtacaactatggctattatctagcggatgtcatctatcaaaagtggaaaaccttcgtaaaccaattgaaaaacccttaaggtaaaaaaattcttgatttcaacaatgctaaggcggcggcaaaaaaaaatttggagaaagcattttggattttgcaagcccaatttgctattgtgagaggaccggctagattttgggatcaaaaaatgccctggtacatcatgtacgcttgtgtgatcatgcacaacatgatcatcgagaatgagcgtggccaagagatttagactactcacagtatgagctcttgggacatcccgtgcgagtgcgacggagggctgaagggtancccgttttgttgcctcctatcatgccattcggtgtcccgcaacgc

SEQ ID NO: 38952 - DNA, 415 bp, Triticum aestivum
  Clone ID: PAT_TA_38952
cgtgcacaaataaatatgtcatgtgaaaatttggaaaatttcaggggtcatttgacctattaaagacatttacgtgattttctaaccatttaatgaccgtaattcaaatttaaactacatctacatgcaacgcctaaccataacggtttgaaaaagcttatttttacgtacttgtgcgcgagttaattccatgtgcagcaaattaaaagggattttcaaacatgttggtctcaaagcatgggcacatgcatacgtatggctggagtgacatggcatattaattcaaaaaaaataaaacatgatcaaaaaaacttgaaaccttgcttgatttaatgtcatgccaccaagatgatgtggtaaagaaattggcatgtttgacgaacgtttggacacacaaccctcacaaaccggagca

SEQ ID NO: 38953 - DNA, 410 bp, Triticum aestivum
  unsure (1)..(410): unsure at all n locations
  Clone ID: PAT_TA_38953
cacgggggggaagaacacggcaggtcggggtcgtggcggtaggcgccagcgcccgtcaggcagctgttctggaaggtgaggcgcaccgtgctacggctgaagcgccgcactgcgagtttcgggtataaacgctaaagctataccagaacttcaacgacagtctcgtcactgcccaacgcctctagctatccacacccgcaggccgcatggtcttgttcctcgtcttcgcaattttttacttgccgcacggtcggaccactgcatgaggctggacattttgaagcgtgtccacaacttctgatatgctcctcgatctcagctaccagtgttcgagtattagattgtactgttcgtacacaacttgcatagtgtacanaatgacacagtgtatataatgtacctccatcctt

SEQ ID NO: 38954 - DNA, 432 bp, Triticum aestivum
  Clone ID: PAT_TA_38954
gggagccttcaaatctccccttctatatcaccggtccggcggagtgcgagtcccaccgggactggtgtgcccgccatgggaatgagaggatgagggcagacaaggcccgcctcgctaccggcatggcggcggcagaggcggctgatacagcggcacgggcggccgcataagaacgagcacgcctcgcccgagagcagaatcgagtggtccgtgccatggccggactgccacccaagaacgagaaggtggacagcgacgggtcggacagcttcggcaacgagcagatccggctaaatccgtactgagtcttcgactggtacttccgcgagaaagacggcaatggcgcgtatccgggaagggcaagggcacccgtggatgatcttctccgccatagccgaacatgccaaattttggtagtccaatggaatgttg

SEQ ID NO: 38955 - DNA, 315 bp, Triticum aestivum
  Clone ID: PAT_TA_38955
aatttgttaatccatcaatatctgcagaatggtgttgacttatactttttaacttgtcactctagcttgggatttagaggaattatgaagggccgcccgggttaagagaactgataatattgactcggaatgaattttttttgcaactcggttgggggattcatacttcaccattcagggagaatcagtcgtatgtatagaagctattattcaataggtttttattgggaagactccttgtacttcattgtgcaggagaccgggctgcaacttaagcagtgtcttaattggttcatgaaccagtgtacgcggaac

SEQ ID NO: 38956 - DNA, 429 bp, Triticum aestivum
  Clone ID: PAT_TA_38956
cgggtatatgaacagtgttaatgaagcatttgaaaaatattaaatgtgtatagaaaaaatgttgtccacatattaaaaagatgttaatcttgtattggaaaatgtcaaattatgcatttgaaaatgttaaatgtgtataaaaaatgttgaccatgtatttaaagaatgtcaatcgtgtatttcgaaaatgttaatcatgctttagaaaatgttaaccgtgtgtagtaaaaatgttgaacatttataaataaaatgctaatcttgtattttagaagtgttaacaaggcatttgaaaaatgctaaatgtgtatagaaaaaatgttggccgtgtattcgaaaaaatgttaattttctcttcaaaaatagttaaacatatatttaaaaaaatgtattagatatgtaccaaaaacctacaatgtgtaaggaaaa

SEQ ID NO: 38957 - DNA, 140 bp, Triticum aestivum
  Clone ID: PAT_TA_38957
taccggacctacattcgccggtccacggggagaagggaccgttgtgtccatcgaccaggatgatccactgagtttacaaaccgtttgtccctatttggttgcaccaaccattgtcgggaattttgtgttaacaatgggcc

SEQ ID NO: 38958 - DNA, 384 bp, Triticum aestivum
  Clone ID: PAT_TA_38958
tccacggggtccaattgatgcgggcccaacgtttggtactagctgaatctcaggtcacacatataaatatcagttccaagggacggtctcaatgcaccaaaccaccatgtactcctacatggcctcgcaacgatagctttaccacaacgtcttcaatacctcactctcattaacgacacatgctttcagtccaattgaggaccctgatgaatcagagcttatacgattctaatcgttgcaagcataacattttaggaatacagtatggctcagacagctcctacacatgctagtgcgtttcatcgacttactgtggcaatgacaagtcatgcataagaaagtgggtttaactaccgcagtatacactaatttgaatcgcattgt

SEQ ID NO: 38959 - DNA, 424 bp, Triticum aestivum
  Clone ID: PAT_TA_38959
cctatggaaaaaaagggatgaagggagatctgaaattgcttctattctgatggatattgaaggtatctccggaggctttcatagcttcaatgtggctaatgtaaggcaagaggctaaaatggcacatctttgtgccggtcgagctagtcgtactagaagaagctgcttgtggattaattttattcctagctttctcacatctttgtgctatcttttctgccaacatttctaatcagttgtattgagctatataaaaggactattcttgagtgtgataaatacatgatgcattgcttttgcaggggtaaagacttggaaaagaaaaatccctcccttggcagcttggggcctcatttgtaaacccaaatatcaaggatgggtttttgcatttcaaactttgaggctcagaatgatgctttgctat

SEQ ID NO: 38960 - DNA, 221 bp, Triticum aestivum
  Clone ID: PAT_TA_38960
cgggtcgaccggcggcaagacgcaccgcaagcagctggccaccaaggcggcgaaggaatccggccccaacaacgggcggcttgaagaaccccaacggcaaaaggcccggaaccgtggccctgcgtgagatccgcaggtaccagaagagcacggagctgctcatccgcaaccggccgtccaagcccctgatgcgggagatcccccaggacttcaagacggac

SEQ ID NO: 38961 - DNA, 181 bp, Triticum aestivum
  Clone ID: PAT_TA_38961
cggtcgaccgggatcaatcattcataagcaaagagtagaataatcctaaggaccaagtaaggcgaatccaacctccaaacctggggagccggtggatcttttttgcaaaatgaaagcaaacttgtccaacaaaaaaaaagataaaaaaacgtaaaaaaaaacgggcggtccaaaagattca

SEQ ID NO: 38962 - DNA, 412 bp, Triticum aestivum
  Clone ID: PAT_TA_38962
ccacggggaggtgacggtggctacgggtttcacggcggtgcgggcgcggctgcatcggccatggtgggagaaggcgagggagaggaccagggggagaaaggaggtgtcagcaaggtcggggcgacatccaggaagcgatccacgtggcgggacggtgtctagggcatagtagagaggcggggtggtgcgtggcgagctcaggcgcgccggtgctcacctccctgcctgcctggcgggaggaagcagctgactggcgtgggccagcgcaatgctgggacgccaggtgggctcccaggtaagtttccctctctctcagttttctgttaatgtttttctatttttctgtaacttctgggctttattaaaaataccaaaacgttttcaaaaatcctgaaaataattgttggctctg

SEQ ID NO: 38963 - DNA, 438 bp, Triticum aestivum
  Clone ID: PAT_TA_38963
gggattgatagaattttcacagttacaccagcatattgcttggggtagaatcagttatttgtaggcacaggtaagggaactcaccgagagataaacaatgtattcctaaggtcctcacgattcattacagttactttgttaacttgcaatgttaatcatgtgtatgtgcatgatatcacatatcatctgaataatatcgatcagagtcttatgttatgcagaccatcacagtgcaggataaatgatcaagttggtcaaactaccaagaaaatatttcagctatccacaaatgaaatatcatggaggataaatatctatgtgagggagtgcgaatgattggaatcttcataacaaggtaacagaaaatccattaatataggcaactggtagaatttggtgggtgtgcccggtcagtctactttcccatgtgttttacat

SEQ ID NO: 38964 - DNA, 292 bp, Triticum aestivum
  unsure (1)..(292): unsure at all n locations
  Clone ID: PAT_TA_38964
gcaaggtgagaatagaagttggtggataggggttgaatggagacgcttaagaagcggcggggagccctgctagagccccggaggtgacaaagacgcagagttccggcaggggtgtggtgttgtggccggggtggtggagcggcagcgaaggcaagagagaacgaaggaaggagagaaaatgagtaggatggagtcacggagtccgggaagggttttgggtangatggggtgtcggattcgtatgtttcgcatgtccggactcccgcaaactgggcccacttttgtctccgat

SEQ ID NO: 38965 - DNA, 393 bp, Triticum aestivum
  Clone ID: PAT_TA_38965
gccgacgggcaaaatgacggaaaacagaagactttcccactagaagtaaaaacagtgaactcacttcatgtgataacacgaaaacatagtgcggcatctgctataccaagacaccgtccgcagaatggggatagaccctaccaaaattcgccgtagcagcacttccttcaaaggagtgacgccaggcctttacaccaattgtacaggctctgtactactagaggttgtgttcggttcatccgacaacctccatcgcgaaaagctcattttccatatcgccccattcaaaagtggccatcaagcactactgggacgcgaagctttcgcccgctttaacgcaatagcgcattacgtgtctcttacgcttaaaatgcccggtccacgcggcataat

SEQ ID NO: 38966 - DNA, 438 bp, Triticum aestivum
  Clone ID: PAT_TA_38966
ttcgcgcggtcgacgggccagcactgaactgactgtattcattccaaaacaacctatacgtatatagggcatccccaaattagtaccacctcgtttatattatatcttaaatataaaatcacctaagtgggacgaaaccaagaatatcaccttgctttattagtaggtatagatatagatatagatatgtaattttatatcatttcttgaactaatctattaactcagtgcccagtgccattttctgtttttgcctatttatttgtttcacagaaaaaccataccaaacgaagttcaaacacgatgaaattttatgataatttttcctggaccagaagagaccctagaagctttgagggaggctagaaaatatacagagagccacaaggtcatacggagcaccccaaggggtgcaccacctgagcttgtgggcccctc

SEQ ID NO: 38967 - DNA, 426 bp, Triticum aestivum
  Clone ID: PAT_TA_38967
cgggtcgacgggtggtacaaaacagagcatcgagtgaagcataattgcgtaatggcaagaagttgcggagagatggcgcactggccatctcacaaccatattgatggcgcactggaaatcttctcaggcaaatactgtaatagccaccaatggtttgatgacattgcttattgcaagacttgaccatcgaaaagttattgcttgtttgactctgctgaaactaataaaggtttggtttttattcttttctctcatggttgagtgattctacttgtcaagtaaccaacaacgtttttagagtaagcttagaattttgggtcactcatgataaattaagccgggaattaggttaataaaaactaaggcgggaattttggatactctgtatcattgaagtgttccatgttgtcgtgtacaatgtgagac

SEQ ID NO: 38968 - DNA, 435 bp, Triticum aestivum
  unsure (1)..(435): unsure at all n locations
  Clone ID: PAT_TA_38968
ggtccacgggatccaccttttgccggattattaccaatataatcataaaaggctaatttttcgggaattttagaccaagcttctgataaactaagattttcggctaaaccattgctaactcttcgatatatttcttgctgaaagtatccctgatcccactgataacgagtaggcccaaataattcgattggggtcgttgctgacccataccacatagttccagcaactacgaaagctgcaaaaaaaacagcagcgatactactggaaagtacagtttcaatattgcccatacgtaatcctttatatagacgttgaggcggacggacactaagatggaataagcccgctaatatacccaatgtacccgcagcaatatgatgagaagctattccccccggaacaaaaggatcananacttctgcaccccacgctgga

SEQ ID NO: 38969 - DNA, 266 bp, Triticum aestivum
  Clone ID: PAT_TA_38969
ttcgccgggccacggggcggacggagtaggaggccggttccccttggtagctgtaaccgtcgtcgtcctcgtaggtttggtcgccgggagggtcccggccgtggcgctcaccgtactttggtccgtactggttggctcgctgcagagattgcggcgggacggcgatgtaggaacctcccagggttgatgtacattagtgagtggtggtataatccttacatacataattgttgttcttaagttattaaaaagcttgagtgcattcc

SEQ ID NO: 38970 - DNA, 371 bp, Triticum aestivum
  Clone ID: PAT_TA_38970
ggtccacgggaggatttcgttggcggggttgaacctggcgaagtgcgagcaccttgccgatgccatcatcgactccttccacaatgtcaactagattatgatttgcgtcgcggccacgctactgcgattagttccttccatagtttgctgggatttttgggtccttccagctcgagtttttagtcgcgatgctgatgacgtgtccggtgattcagaggtacagtaataaataatttggcaaaactcagggatgctaggcgctatgcacttgtaccgttttgcaagcttgtaatgctgattaattatgtatgatggcatctccaattaaaaaaaaaaaaaaaaaaaaaaaaaaaaaaaaagaagaacaaaaa

SEQ ID NO: 38971 - DNA, 412 bp, Triticum aestivum
  Clone ID: PAT_TA_38971
atgacaaaaaaaaagttccggaagaaatatggttactgcgaaaaggcagacgtgaagtggaagccatatgctcctgatttcaagcacaagaatctggctaagctcaccatctacggcttccaacccaacgacaattttaagcgatacatcaggtgtgttgtggaacatgcggttaatataacagagatatctctgtacgacaggaagctgtgtgggcgctgtggtgacaaggtttatcaatcaagatatccacggactgccgaggagaggaaacgaacggctgaagggttgggtttgacttcacctgctgtgattcacttccggtcctaactgaaaaatgatttgcatgatattcttatatgtagtttggaaatcaactcctatcatctttagtcggaaggagttcctgaac

SEQ ID NO: 38972 - DNA, 393 bp, Triticum aestivum
  Clone ID: PAT_TA_38972
gacgagggaatgtaagcacagggttctgttctcttccatgtttttctgctgttgtgccccatttgatccgtgtgtgaaaagagaatgactatggttttttgtgtgcacgcgcgggtggcacttgaatggtgtgcacgtgtacatgtgtgtatgctaacaccgatttggtgtgtgctgatgatcatgtaaattattatgggttgattgctcgtggatgtaaggtctatgtacagttgttacatgagtgctgtacagcctccgcatgcatgcgtgctgcttggcattgcacgtttataatctcgggttgttacttgtaagccagcatcagttgtaaagtacgtgtgtcaaaataagaaaactctttcctttttttttggttcaagaaaactcttt

SEQ ID NO: 38973 - DNA, 142 bp, Triticum aestivum
  Clone ID: PAT_TA_38973
caaggcctagttaaacttcaaggcaaaggcgttcacctccaaaattgtaacctaaatccaatgcatggacttccggttgacagcctgggaacgggtaaacccttgtcggttggaaatttaaccgcgtagcgtcaaatttacc

SEQ ID NO: 38974 - DNA, 231 bp, Triticum aestivum
  Clone ID: PAT_TA_38974
accggtcctacaatcccggggccgacggtccgaatcaaaaaaataaccccttggtccccaattccaaattaagcgaaaatccgaatcctgacaaaataaggctccccaaatttcgaaccaaccggaaaaaaaaaataagttccagttcaaaaaaaaaaactaagtcgggaaaatagggcaggcagttttaagacatttgtagactttttcggaaaaaatttgttgcggagc

SEQ ID NO: 38975 - DNA, 421 bp, Triticum aestivum
  Clone ID: PAT_TA_38975
gacgggaatgtacacaaaatcggatcctcaattttcactgtggctaaaaaacatatggcttccataaataaaaatttaaggcgccaccacttgaggttcaaaggttcaaaaggtagggaacaataagaacgggccaagaagcaccatttttccttccaaatcacaggtgtccttaatttggccaagtttattgcacacatcttagtgattagcatgaggaatacaaccatagtgattagcatggatagaaatttgatatgggtcagagggatttcgaatggcacatttgtgaggacgacaatcctgcactaataaccagtcctgacagtgtactgtttccaagtgcttggagcaagtgcaagtcagctgcataaatcaaaactcatagagtcaacttcttgtatgcagcaccgacacatga

SEQ ID NO: 38976 - DNA, 384 bp, Triticum aestivum
  unsure (1)..(384): unsure at all n locations
  Clone ID: PAT_TA_38976
accggtcgaatatcncgggtcgaccggggagttgatgaatgatgacagaagactcttgcaatccatatgtagtatggccaatgaggaacagccaatggtgtaaggtatatgcatatgaataatcgctttcatctttatgtatataaaggcggtgtttacagcaccggcatagggaaagcttggcctttactagactcatacacctaatctgtcttctgcatgcctactgaaacatttgaatgctttcatgccaaattgcttaatcttaccaagatttgaatgatgtccttttcatcaataatactcaatctttgccttacagaggacacaagctcgtttaagctctctgagcctgtaccaacaacatacaagtttaaatttttg

SEQ ID NO: 38977 - DNA, 274 bp, Triticum aestivum
  Clone ID: PAT_TA_38977
gacggggatagcgatgctccggccaaggagaagagatcgaggcatggtggtgagagctcatcgcgcaagagagatgctcctgcaaaggaaccagaagtggccattgatgttgaggacagccctcctatgcccagggacaggatcatggacacctccgaagatgcagcggataagggagaagctcctgcaaacaaagatgctgccatagttgaggacacccctatgcccagtaccaagcataggaagtcgaagagaggtagcaagacttcagcag

SEQ ID NO: 38978 - DNA, 363 bp, Triticum aestivum
  Clone ID: PAT_TA_38978
attcgcgcgtcgacgggataacgtaacgggattcccgggagatgaactacgatagcaagctccaaaacatgagctagttctgctacaaacatgtgaacacgttgtcccagacaaacatgaccacaaagtactcttatcataaaacactaccgacttcacgagggggaaacatcaacgagggtaacgaactcttgtgcattaccatggattaacacttaactccttttgtcgaacaaatcagtcagtggcaagtctccaaaccacagaatactttcgcacgtatgcatgactgatttgggatgattccacacaaagcaacattgactttctcgaatccacggcgggatcttgcatcagttgcac

SEQ ID NO: 38979 - DNA, 436 bp, Triticum aestivum
  Clone ID: PAT_TA_38979
ttcgcggaaagtatagatcatcctgatccggtccctctggcggtgctcccgcgagctgatgtcgcccctactgctcaggtggactcaaatggctgcttaggttgcgggcaaaactgttgggtgcgcagtcgcgggggagccgcaggcaatcaatggcgacaaggtctgctcaatcaacggacagggtgaacccgaggctccggcttaggcaaaaagttcagaagttactaaactacaagactattcagcgctggcacaagaggtggtgaggaatagcgactacgacgagcaaagacgcggtgcagccggcaacaacgactgtcgcctgctctctggtaaggcctccatcttttatctctttttgtgtcactttgaactatacacaagtgcaaactagttcggctcaagaaaagtataaacaagacacaaccctctt

SEQ ID NO: 38980 - DNA, 337 bp, Triticum aestivum
  Clone ID: PAT_TA_38980
ggtgaatcatctaataaggaaactgcagatcttaaatctataagtattcatcccaatatttttgctatcattaaggaactgattgctacaaatgaatttgtcaatattgtgcctaaaagttttataatccctagaaagaaagaaattcctaagggaaatagatgcatcatcgaagaattgcctaccaaagatggtaatacctagatctatcctcgtttttatgcctagctgggggtgttaaacgatagcgcttgttgggaggcaacccaatttaattttaatcccttgcttttttccccggctaagtattaaataaattatttacccccggttttgg

SEQ ID NO: 38981 - DNA, 317 bp, Triticum aestivum
  unsure (1)..(317): unsure at all n locations
  Clone ID: PAT_TA_38981
acccccaagggcctgattgtaatcttgtttccttttctgnggtgtttttctgcttatgttctggacacctgtgtgttctgggtccttcgtctgggtgctactacatgtgttgtactcctgtttgctatatgaatggcatgtggtgcttcaaaaaaaaaaaaaaaaaaaaaaaataaaaaaaaaaatataaaaaaaaaaaaaaaaaaaaaaaaaaaaatcaaaataaaagattaaaaaatttaattcacaaaaataaaaaataaaaaaatattttaaaaaataaaaaaaaataaaaaaaaaagggcctccccaaaaat

SEQ ID NO: 38982 - DNA, 419 bp, Triticum aestivum
  Clone ID: PAT_TA_38982
attccggtcgacgggcgaactgatgatggcccgacgcgtgcatgcgcgtggcgtgaagtgatggcacgaagcgttcgatggaggagttcatggatgaataaatagtactgtagctactactaaatgtatttcgcctgccctgctactactgtagtcatggttgtataataatggtgtcagtatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaggggccccccaaaaggttcaaatttaatttccccttaaagggaatttaaaaccccttcaaaagggcccccaaatttaatttcacgggcggtctttttaa

SEQ ID NO: 38983 - DNA, 409 bp, Triticum aestivum
  Clone ID: PAT_TA_38983
accacaagaaccaacgtcagcgtcgccctgcaagcacaacagaggattggaactctgaatcggacgacaactgaagcaaaacaatcgaccatcgacagtaaacctctgaagaaatgttgaaatgctgctgctgcttggttgattacagagagctcagtaggcaattaaggcctcacatctgacattagcatccgtaacatttgctagcactactcctagcagtacacaagatcacaagaatctccatttgctagcactactcctagcagtacacaagatcacaagaatctccatttgctagcactactcctagcactactcctagcatctgacattaagttttgacggagaagagacaggaagaggaagagagagcaatacctcaaggagtcatcacccatggacgcat

SEQ ID NO: 38984 - DNA, 392 bp, Triticum aestivum
  Clone ID: PAT_TA_38984
ggggccagcctgaacacttgagttcatgctcatggaaacaatgtagaatttttcatgaagattctcacaaaaaaataattatccccttgtaccattccattgtattataaaaataatgtgccatgatttgcctttaggatgagtagattgcttgttggtttgtgcggtgcaaaacataaactttggctgtagtgctcgattttacattttttactcaaatgtcaaatgattctgaaactttttgtaatgtctttatatataattttttttcttttttcctaattttttcagaatttttagagttacagaagtatggtggatgttcaaatctttacagactgtgtcctgttttcacatattgttgttatagcttcattatttgcgtatgtttg

SEQ ID NO: 38985 - DNA, 395 bp, Triticum aestivum
  unsure (1)..(395): unsure at all n locations
  Clone ID: PAT_TA_38985
gtggcanaaatagcgccggaggctgcattctggccataataccgcctgggggaagaaggggtaggaggattttgttgcaccagccattattaaattgaatgcgtgcgaaccactattttcctttaaagttcaagtaaaactaaaactcgatcaataacatgccacagcatccaggaagcacaatactatatcattcacgtgcggtccccgaccctccatcaagttgaaaactagactagtgaaaatgtcaattaggatgcctctttgcatacaaatgtgctcctagcttcaaaaaaaatgcactcctacatgtacccgcgaatgggtgtgagagaactagtgcgtgcatgcaccgcttcccttcgtgagagtacaatatactatgcccaaagaac

SEQ ID NO: 38986 - DNA, 399 bp, Triticum aestivum
  Clone ID: PAT_TA_38986
cggagcagaaatgacgctctagatgcggtcatagcgcacagagcgcgtgcattgccatgccagctgcacggtcaccacgacacaaggcacagggatgtcacgagaggattgcaaaccttgtctggtgatgtttccttccagggtggagcatttatgagtctatggcttgatctgaggtgctatggtgaagttggaactaagttctgaagtttgctgtagcaaacttggctgcgcactagtgatcaacagggatacaattggagccaacgaggttgtctggggtgttaagattaggaaagactaaaatccgggggagtttgaggaaaaatggaccaaggattaatatagttgctttaaaacttcatatttggtccaagaccaagattatgatgatgcact

SEQ ID NO: 38987 - DNA, 150 bp, Triticum aestivum
  Clone ID: PAT_TA_38987
ctggggtagtataagaacattgtcaccacagtagaattggtcatgaaatttttgctccaggtgaaaccatgtactaatcgaaacgggtggtaacgcaaaaaaacacgagaaaggcgtaccggtcaaagataaagtaaaataacgtacttt

SEQ ID NO: 38988 - DNA, 304 bp, Triticum aestivum
  Clone ID: PAT_TA_38988
taaatttcaaggcaatttcaaccacaacaataacaataacttaacaatccatggccaaatggctttgcaggttcatagaatacctaacaggaggtttccagggcttgtccattttttgatgtcattgctacgctactatcgttgcacatcccggtacatcgccaaaggcattcacatatagtctcagatatcgagttgtaacattgagttgtaagtatataacagtgtgatgatcatcattagtacaacattgtcccaagtgaggttatcacaataaaagtggtcatagaagccctcccccccc

SEQ ID NO: 38989 - DNA, 336 bp, Triticum aestivum
  Clone ID: PAT_TA_38989
gcaccccatgatggcaaaaatcaacaccgacggtgacggtttcaccaacttaaccaatttaacccccttcggaaacgcaaacccggggcccataaaggacttcccaaaggtcttcaaaacaagtcaatttcacccaacccttccgtccaaagagccgatgcatctacgtatggcttcgtatatcaatttcatgcaactacctactccggtcacgatccagcctcagcttcacctgaggccggccctaaatttgtatgatcaaatcttttgctactactagttactactgatgatcactgttgcatcatttatttatttattttatatatcatcaca

SEQ ID NO: 38990 - DNA, 291 bp, Triticum aestivum
  Clone ID: PAT_TA_38990
gtaccgaacaaaaattccgcgtcgacgggattaagaagtctccagtcacattattataaccttatggtaatacatttatcatcctgctgcagaccttggtcatatatgtaagtcacgcacatataattcacacaataaatcacatcataacaatggaattcatcggcaggccgtatattcatgggatgattttcgtacatagatctaaacaagaatggcatgtctaccttagggaaacttctatatacactcactcattgtttacacatacgtcaggtccaagactccaat

SEQ ID NO: 38991 - DNA, 406 bp, Triticum aestivum
  Clone ID: PAT_TA_38991
tgaacggcatgtacaaggggttcggccccgccatggcacacaatgtcccggcaaacgccgccaccttcgtggactatgagatcacgcgatcggacctgggctgatccgcacaggtcacagcgcagactcagtctcttctccgatgccgcattacacagagcatctgagacacaattgaggaccatggtaaacaattcctctttactgcgaccttgtttccgaaaaccatgcatatactggcaccaatggcaggattgttgatgaaataaacgatgagcattacctgtcgagcagcgtcgcgggaacaaccgccgccgccatggttacgatcactgatctcggcatcttgatatgagtttagctgacgctaaataacttcaatcgcggcagctttgcttcgatgaat

SEQ ID NO: 38992 - DNA, 381 bp, Triticum aestivum
  Clone ID: PAT_TA_38992
ccggtcgaccgggatctgtacggacgcttaacgcgccgaatacgagtgcgcatcctgttagtacatttttttatcagatcgtattactagtgtgttgtacccatctccatgttagcatcccaagcccatctggtgggtccttccatccagcccggcccactctgacgacgcaggtctctaacacagacgacttcttgccattcaccaacacatacatgtcactataatggatgaatgtgcaaatctagcaagagggcatatatcactttagttcgatgatctgccatttctaaaacaactagtttcaatgagtgaaattagaccatgtgggcaggttggtaagctaccgacacgtgaatgcaaacgatgagtgaaatcaga

SEQ ID NO: 38993 - DNA, 276 bp, Triticum aestivum
  Clone ID: PAT_TA_38993
gtcgacggggtgaagtagttgtagaaggggtacggccttgtcatggcactcgatgtccctaggagcatcaccatattcgttggcttcgacatcatacagttttttgtaataagtttgtgtgtgggtggatggctaatgttgtctcgtatggattatcggcattctcaccttcaatgtattgcaagactctcgacaatggcacacgtttcttcgttactgctcacttgtttccgacgtccttgaatatactgacaacagttacctaatagtggattt

SEQ ID NO: 38994 - DNA, 274 bp, Triticum aestivum
  Clone ID: PAT_TA_38994
gcgatgattttactggactgcttgccggactgtcgcagcgaggaccgaggtatgtatatgccatatagcactctcgatgcaacgaaagttacgtcccttacagttttcagcatcatgaccgcgtgccagattttgacgaagggcagtgtttgcatgcactcgcaatgtgacattacattcacatctgtcccaaaaggatcaacatcatgaccatcataatcgccgtgctctccgagtaagttgtcggcaggaacaaaccgaacctcgcaatcat

SEQ ID NO: 38995 - DNA, 398 bp, Triticum aestivum
  Clone ID: PAT_TA_38995
ggggccacgggctgattcaaattttgaactgggggcataaaggtccatttgcccattttcacctggtcggaacatattccccagcgacttacatttcggaacggagggagtagtgactatctatttcatatctttattagtcatatgtatccccgatcgtttgctccatcagggataaccataaaataaagcagatgcatgttggttattgaagagacccagaggagcaacttctgaatcttaaatatgccaaaagcacattcaacatttaaataattgtgtttaccttttgattaccacagggtgggtacagactggtccttctgacccgtgatgataactcaaggttgggcagcggcggctgtggtagcaaacggtggtggcggcagaaggggaga

SEQ ID NO: 38996 - DNA, 445 bp, Triticum aestivum
  Clone ID: PAT_TA_38996
ggggccaggggctctaacagcatgtagggttattaccggatgatgtttcccggggcccgaagctgtctaaatccttgtgttgtgttgcgtctctcgattccgctcaacccctctcaagctactacatagatgcgctggcctcgcgactaagtcctgacactaaggacatctgccgtgacaattccacgacacggcccatgtatggcccatgacgtctttcggcccatatgaggcccttattactctcggcccattaacgacccgtggtaaaactggcccgtaatgaacagtgtaccactttatacccattaacggcccgtggtgaaactggcctgtaatgaacagtgtatcactttatacccattaacggcctattattccgttgggccgtttccagcccatgttatctttcggccttctcggggcccatttgttcttgggctca

SEQ ID NO: 38997 - DNA, 383 bp, Triticum aestivum
  Clone ID: PAT_TA_38997
attcgcgcgtcgacgggggaaaaaagaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaagggggccccccaaaaggttcaaacctaacttacccttaaatgcaacttcaaaccccttcaaaagtgcccccaaattccatttcaggggccttcttttaaaaacttcttaacgggaaaaccccggggttaaccaaattaaacccctttgaaaaaaatccccttttcccaagctggcttaataccaaaaaggccccaaccattcccctttccaaaaatttgcccaccctaattggcaatgggaaccccc

SEQ ID NO: 38998 - DNA, 422 bp, Triticum aestivum
  Clone ID: PAT_TA_38998
agagggcgtgataactcttcggatacatttggacaaacaagacatcggacgtagggggaattcgttgaagcagttttcaagaccgatgacccaagacgaagaagagctcggaagatccgagggatgtctccaaacttgaagactggtttaggagctactgatggtgtctcagaattggggtcattcaccatgtcgtgtcccggccaggtgggccgggccgaggaccccatgtcggttcactagtggaccacatcaaggcggaccatggcttgaagaaggaatacttccgaagacttggcgcctactccaaatacttagatgtcgtctacaacacaattaccttatacatagccgaccttggtataaccctagccaaccctggtatctatataaaccagggggacagggctcgtacatgaaat

SEQ ID NO: 38999 - DNA, 339 bp, Triticum aestivum
  Clone ID: PAT_TA_38999
cagggagaccctgctgggcaagccgggtaatccaagggccgcatgggttggttcaagttcaaatttaatttaacttttgggttaattttccaataattgtggtttatattcaaaaaaccaaaaggtaaaattcatgtgagctttagaaaaaattataaaaatataaaaagatgtcgccgtatgttaaaatagatctatatagttccattaaaaatatgtacgtaatatttgaaagaaatattcatgtgtcttcataaaaatgtcattgaggattttaaaaatgtttatgcaatgttaaaaaatgttgtgagcagtaatttttctgtttccagtaaaatt

SEQ ID NO: 39000 - DNA, 372 bp, Triticum aestivum
  unsure (1)..(372): unsure at all n locations
  Clone ID: PAT_TA_39000
cgggtaccaacagtcacattcaagtaccggcagtttcggtaaccccagttcctctcttttgattgaacagaaataagatgacagctgggtacacataagtctttccaattggcagtaaggagctgagataaagatcaccacaacgtgatccaaagaccgcaggtggcaccgcacgcgcagcgggcgacggcaaccgccagctcaccgtcgccaggcggaagcgagctaggcttccgcagagccgcaatgatcttccggcagcatgagactgncaggatgggttgtggtgctggtggcttggcgagccaaatcatgcctcggatgcatgatgccaaccttggccgggaagaagacangacgacggcgccattg

SEQ ID NO: 39001 - DNA, 415 bp, Triticum aestivum
  unsure (1)..(415): unsure at all n locations
  Clone ID: PAT_TA_39001
attccgtgtcatgctctccgtagcagcatggagcaaactctcaaaagacgcgtgccatgcaagtgtccgttgttggttgggaaaagcatacgcatcaatgcatgcatgggatgcacacaaactttaaatgcgtgatcagtggtcatgtttatcttactgtatgtcacaacgtgtactgtagaaattcattgccttttgtttttcacatgggtcggccatggctatatttctatgaaagcgttgaaatgtgatttctttttgtatcacacggctaggcaatgatgcatacacgaatggtaattcactggcatgaagacatgggtactgcccactaggactacacgtgtcgaagttaagtctgtcattctgcangggtcaacggtgctcagatcaaatgttcatgtcaccatgacgt

SEQ ID NO: 39002 - DNA, 426 bp, Triticum aestivum
  Clone ID: PAT_TA_39002
ttccgggtcgactctgacgacaaaaatacttgggtgttggactggatgaccgaaaacactcattataaggcaccggcctctgaattacttcacgccctgcccatcagtcctccacctgaaggagctcgttgcgtgtaccaagagcctgaattgactgcccattatatgcaagtaattatgaagcctctgaagcctggtcaagctccaaggaccaaattcctcgtgaggcaattgctctatgtgccaagaactgtctatcgcattctgacgaagacaatgagtccgatcaaaggccacgactcgtctgataaggaaattgttggcatcatgaagaatctgctattcagtgtcatacatgccattcctgtcaactagcatgatttcttcatgaggactctggaaaatgtcgcactctctccgtttgag

SEQ ID NO: 39003 - DNA, 250 bp, Triticum aestivum
  Clone ID: PAT_TA_39003
gggtcgacgggtaacacccacttactatgtttttttttcttaaaaatataaatcatgatgttttttttttcatatctagcaagcttcatccatgttcacattgattgtcacccaccctcctcgacctgagtacctagttttctatactacgtctcggctcgtacttcagttctagatttagattagtttaataaagtggtactagaaaacatcaccatcgcatgcatggacaaaaggcaaaagcgacaag

SEQ ID NO: 39004 - DNA, 200 bp, Triticum aestivum
  Clone ID: PAT_TA_39004
tactttaatgctgactcgagcttagatggaaactttatcagtttatggactatttgtggcacgagcgctatttatttgcgaagcctttggttgaatcttagtggaagattctttcgagttcgagtagataattttgtcggttttgaggaagtttgaggttgcttccacgtgtggaactagatcaggacgttatttagttt

SEQ ID NO: 39005 - DNA, 422 bp, Triticum aestivum
  Clone ID: PAT_TA_39005
ttccgggtcgaccttcaatgccaatgaaaggtactcttcgggatcattgcttccagtaaatttgggcatggtgaactttagtttgccgtagcgttgctcttcattgtgttggggtcgagggtgatgacgaccttgacaaggaggattgtctccctcaacttgctcttatcatggagggttgtcaacctcattttgttcttggcgaacttgaggttcttgtcgaggagcttgtggaacttgacgatgcagtcgagcttgatggttcctctcttgaacttcctcgcgaagcgcttcttgttgctcgcgcgtgtgaccgttgcggtcggcgatggcgcgacttgtttcatggagggcacattgggccttgagtgcttgagcttcacgtcgttgttgttgttgtcggagcgcctcggtgtcttgct

SEQ ID NO: 39006 - DNA, 392 bp, Triticum aestivum
  unsure (1)..(392): unsure at all n locations
  Clone ID: PAT_TA_39006
gcgggggggacgagagtagagaggggggaaaggacttagcgaaattttgagcccgggctgccgggatttgagtcagactagcagtagcgcgttttgccgaagacgtgctatagcgaggagagctatagcgtgttccagcgaaatgcactacagctattcctttctgtttgatttttcttttgttttcgttacagttttatttgtttcatttcgccttttgataggtctttcatttgcagttacttttctacttattttgcgatttattggcttgggcatagcagtagggctctacaggatgagcgtgctgcgagagagtggttagcagtanggggcttctgggtgaagcgctaggacggagtcctagcctaccggcatgagtgagggaattt

SEQ ID NO: 39007 - DNA, 398 bp, Triticum aestivum
  Clone ID: PAT_TA_39007
gacgggcatatacatacagacagacaggagagctgccttccgagccttggaaaaaaggcactgctgcctttgctctgctcatatccggactcagatgatatgaacatggattgcattgcagcaggcgatgaagaggccaacatagtctcggacttttggaaaaccagaagaggttattagcatgtaggagaagaggagcgtgtaaaggaaactcaaggcaatgcttgtatgtaacatacaaaaaataacaagttgtaaaagcggcctcaagttttcaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaagcgggcgccccaaagggttcaagctt

SEQ ID NO: 39008 - DNA, 455 bp, Triticum aestivum
  Clone ID: PAT_TA_39008
acggtcctatcttcccgggtcgccgggtccagaactccctcaatagcccctgaactagactttaatgatgatgtgttcggcgtgcagattgtcttcagcattgcaaggcaggttctttctccggatactccaatgcagtcctccacacataatagctgtatccggctccgttaaataattacagccttaagctgcaagggtaaaaatattcaaaacaaagtaagtcgcatccataagcaatttttccggtgaggcattatgtcctgaccttgttagtattctgaactgttttacaatcctcgcttcgtgttttgggttgtggctaggaattaagttaatggcaaacaaaccgtttttttggcgtgtgtttaatttctaaccctaagcggctgcatggttgaagcctgcaacactgcacggatgcatccattacattccttggcttataaaatttc

SEQ ID NO: 39009 - DNA, 433 bp, Triticum aestivum
  Clone ID: PAT_TA_39009
cgggttatttgatatttttgtcttttttttcaaaaatataggagcaatttaagacatatcaaacccatgcttcaacatgataaattagtagaaactatgatcaaactatagtaggggccaaaacctgcgcattacatataattagcaactacaaatgtcatttaatgacattttcaaccttgacattggcacatatactatgcacactagtagcaggcgcatctagacatcctcatcctcctccgcggacgaaatatcatccatccacacataggggtcggactcatgagctgtagccacaatgtttgctcataatcgatggtatctgagatgtatttgatgatgatgatgatttttcttttggatgacgcttggcatgaccgcggcactgaggtgtcctgcgcattggacgtacgtgaagaaactcggtgct

SEQ ID NO: 39010 - DNA, 220 bp, Triticum aestivum
  Clone ID: PAT_TA_39010
gcgggaaatacacacccaccctacctaaattcaggtagaatacaatacatttggtattggggcatgcttgtatcgatgcctatgcaagcgttgtaacctgtaaaccgacatactgaaaatgcgaggaacgttaagttaagaaggaaaaaaaaaaagaaaaaaaaaaagggcagagacgcgaaaagagaaaaagcaagaagaaacgatacatgcaacgtca

SEQ ID NO: 39011 - DNA, 349 bp, Triticum aestivum
  Clone ID: PAT_TA_39011
cgggtgcacgggtccgtatgagtggggaaacaagagatagtgttgatttcggacccctccaccaagggccacgaaattcccccctcttcctccatatatacagcccttagggcatcgtttagaccttgggatttgtttagttaaaagttagccattgcaacttcgtgtacgtcgtttgtgtccaacgaccagaccaagaccgcttacggatctccaccattatcaatacctcatatatatttgcaatattcagattgctttatcatattcttgctcgttcttcgattgcttgcaggaatagaccttcgtggtcaggctgaccgtgcttcgggcatcgtcagtaacctca

SEQ ID NO: 39012 - DNA, 156 bp, Triticum aestivum
  Clone ID: PAT_TA_39012
aggagacgtggttttgttcctttccagttttcactaggatagagcactttcatttgcaggctatttttaacagcattgtctcccaaatagaacagccaagtcacattctttgcaatttatggattcacatttacacctatttttcacagcccatgt

SEQ ID NO: 39013 - DNA, 262 bp, Triticum aestivum
  Clone ID: PAT_TA_39013
gtattttgaagcaaatggcatttaattaggatactttatctttattagattgtatttccttgtctcttcccgtgttgaattctctccatgcgtatagccaaaatatatcttttacaaggggtggcgttgatgctttgctgcaatcttatgaagaaaaacttgaattagaagtttctactctacaagaattttataatgagtgggaatccaatattataattaatattaaaaattattatcgatatgcattgtgtgatttggg

SEQ ID NO: 39014 - DNA, 275 bp, Triticum aestivum
  Clone ID: PAT_TA_39014
atttgctcgacttctggcacgtttggcagtttatcacttttattcaccaacgcagactctagattcatgtgaaacttgtcacacactcagataccttggcatggggccatggttttttcagcagttaaggaatgttcaacgagtttgacataatgttcacacacttacaactttttcggcacttattcgatgttctggtttcaaaagtctaacctatccacagctccatgttgggggaaactccccttggattggtcacagttttttcgccattt

SEQ ID NO: 39015 - DNA, 391 bp, Triticum aestivum
  Clone ID: PAT_TA_39015
gcgggcgtgctatgtgctaatcacgatagattcggtcgggcccgcgtcgcctctgtgtcgactgtcgtccgcaatgattgggtcgggccccagatgacatgggtgggttagcgtcgccgtgcagcatccattctaagttagtcccacctcggtcgccgaaggatgtaccgatcagtttatatagccgcctccggtattccatgcatggtcatatcttaaattgttatatacctctatatatctgctccgcaatacactatcaggcaatgaactgccctggcagttaggtaaagtcattatacaatattaaatatgtttactttgtcattttttttaaccttccaactgtgaaacattttttttgaaatattgcctcccaacaccatttttt

SEQ ID NO: 39016 - DNA, 354 bp, Triticum aestivum
  Clone ID: PAT_TA_39016
agccgcgcacgagatccagcactcgaggggatcaaccctaggcgcgggatgcgggtgatccgcctcgtgtaagaggcgaacctgtcgcccctcatggtgtacttcatggccaacaacgcgtgcttgcctgaccacttatatgcacaccacgacaagcccctcgaggagacagcagtcccacgtcttgccttgatctgatttcgttggcctgtggtcaactttctagcccatcgatacattatttttttccattacattgttgccgttcatatcgcttagcttctgcctcggttcgttgcttcattcagaactatgcctcttggtcgcatgttcttctcaatgtccgtcccttca

SEQ ID NO: 39017 - DNA, 245 bp, Triticum aestivum
  Clone ID: PAT_TA_39017
cgggcccaaacagagcgtcacacgcaagtatcgagtgtcgtgtaggacaaccatcgactgcatgtggccaaaaaaatttatgtatgaaagggttgtgtaatgttttgaataacaatttggcgagtctaatgtggcatcggcctgcctaacaaaacggccaacccacaccatggctcacaactcgtactgtactacgacccagccaccacccccacacgcacacacccaaacagcacatcgtaaca

SEQ ID NO: 39018 - DNA, 301 bp, Triticum aestivum
  Clone ID: PAT_TA_39018
caacgcacaccaggtgttcgacgtaatgtttgcacggctgtcggtaaaagaaaatcacttcgatccatataccgtttcaaaggttatatgcgtgttccatcctaagcatacttatagttctttagatacaacttttgtgatattttagcttaagcattagcataggactggccactgattattgcagtttggaaatatgttgaaagaaaactttactgtcaaaaaaccctccaaatgaaataggatgcattgttaaatggactgtgccttaacccttgtttggtataaacttcatggatga

SEQ ID NO: 39019 - DNA, 224 bp, Triticum aestivum
  Clone ID: PAT_TA_39019
tacacacctacctcggcttagacctttgaacgtcgggccggtaggtttcacgggccagagttagaaaagtagtttccttctactactaaacattggtctcacggggtttcgggcgagtagagggtcttttggcgcttcgtttgatattttgatacagaagcagtcacatttagtgcactcatcagctttgaggtttggtctatactgacagcggtttactttga

SEQ ID NO: 39020 - DNA, 297 bp, Triticum aestivum
  Clone ID: PAT_TA_39020
cgggcacaagcatgtgttttgcttggagcgtcattttattttattttgttttgcttgctgttttattttattttgttttgcttgctgtttgtatagcataccaagatctgaaattcgggggtgttaaatattcttcagatatttacttaattattcgattacacattggatattaacgatatgactttcggactagtttgtcgttgtcgctagtgcactgactcatatctttttataacattgtagttgtcattatttatgtagaaataagcataatgctcatgcttaaactagaat

SEQ ID NO: 39021 - DNA, 308 bp, Triticum aestivum
  Clone ID: PAT_TA_39021
tatccatcaggcaaggatatgatttggtatgtatatgtgttggtatgcttgtcgaaagtattttcatatgtgtgtgtatatatatatgtgaaattgaatgaatttaaaaaaaaacagagaaaacatgggctatacatgctctttgccgtctgctggtacacagcaaagagctttgctgtctgctggctgacagcaaatatgccatgtgtcagctacctgtccaacttggggcaataagctggctatttggatgccttgtcgttaactggcaaacggcaaaacacgccgttaacccactaaccgcctgt

SEQ ID NO: 39022 - DNA, 317 bp, Triticum aestivum
  Clone ID: PAT_TA_39022
acgggggcatcaacgaggaggatgaggatggtggatatgttgcgctggatggtggagcagccgaccagcctcaacttgaccgtgcctctagcaacgaagcatgcgcgagcatgccgcttgccgctggtgatgatcaagccaaactctccagtcggccactcctctatccaaaattgccgcctccacagagctgcgcaattcgcccgttgctctcttggcccgatcttgcatctttaactttgctttcctgcttgtttactttttgaatacctattcgttaaatttgcgcacttccacccagtggggtgtgtatttat

SEQ ID NO: 39023 - DNA, 254 bp, Triticum aestivum
  unsure (1)..(254): unsure at all n locations
  Clone ID: PAT_TA_39023
attgtttctttctcggccccacttttggcctattgttatggactggttgantcttgttgcttttggtgattacatgttccgtttgctgatgtttaggatgtcaatgtatcttgatctcgccgaactaatgattggaagcatgatacccttcaacgtcgtgtccataatggcgttgattatttcatatttatgcatatttagtaagatgatgcacttttctgggaagaaacatactttgatttttggtcgatatc

SEQ ID NO: 39024 - DNA, 226 bp, Triticum aestivum
  Clone ID: PAT_TA_39024
gagatctcaatgaaagagatttcggtctggttaaggtaacgcaagttatgccagtttgtcgagtctagccttgtaaacgccgggccctccgtatgtgggaattcaacccggagggacgaggagctattcaacatttcctcggcatgatgctcgaacaaatgtacaaatcgttctctggaccccaaataaagtgtccggatacctctaaggacgtgggtttgagctg

SEQ ID NO: 39025 - DNA, 151 bp, Triticum aestivum
  Clone ID: PAT_TA_39025
tcgtaggtgattatgtgatgctgaagtatcaatgatcccatttcacgttcgggttcgtgtaatgcatgcatgcatgtacattcaattcgttcactttcaaggtgtatgatttggactagtatttcacgtcgttgtttcgaaatctctcaat

SEQ ID NO: 39026 - DNA, 386 bp, Triticum aestivum
  Clone ID: PAT_TA_39026
tccgccattttgggggatcacgagaggttcttggtccggttcggagagaccactgtagctttcagaagggcgggcccctgctgtccgcaggcatgagtgtgtatacgcccatgaattatcacgggctgaatcgctcccgtgatgcaacgcggcatactgagcctgggggggctcggtcacttctacgtcaatttcagcaaggccttcgggatgaacgtaacggtgatcatctcatcgacggggaagaatcacgaggtcctcgataggctaggcgccgactgcttcgttgtcaccagaaaggccgactaaatgaaggctgcgatgagcaccatggatggcatcatacacacggtgtttgcaaacatccccatggtccctctcttcgg

SEQ ID NO: 39027 - DNA, 365 bp, Triticum aestivum
  Clone ID: PAT_TA_39027
cgacggggtagaatagggtgctatagctcgaagatgggaaggcaggagaaggaagaaggcatgagaaaagggaggaatctttatcctcttatataggcagtgtatatcaaacgccccccggcccgcccgctcaagccttaaaacttgcccgttcccatggggtcgtgcgaatggcatggttatattacccaaaccgtattgatgaggatcccgcaataagtggacacgatctccattttgacaagacatgtaaatagaggccgcgcctcgagacgctaagcgggaggcgaaaaacggtccgaaatgctaaagaggccacatgtggcgtttcgccgaaaagttgtgagttgacgggcattattttg

SEQ ID NO: 39028 - DNA, 356 bp, Triticum aestivum
  Clone ID: PAT_TA_39028
gtgtagggattgccatgtaacgattgcactagagctatgaatgctcaacagaataaaactagtgagtgtgcatccaactcgcttgctcatgggggcctagggcatttgaggaagcccatcttaggaatatacactccaagttccataatgaaacattcccactagtataaagcgacaacttatgagactcactacatgaataacaaggtgctattttgaatcacattatatgagattcactacatgaagaacaacgtgctactttgaagtacatgtgttgaagctacatactagcattgccccttttttttcgtttttgggccttttttggcctttcattttttctctgtttgctt

SEQ ID NO: 39029 - DNA, 395 bp, Triticum aestivum
  Clone ID: PAT_TA_39029
tagttcacactcagggctaaggtatgtaccagtagctatgtgtttgatctctctctctctctctcgtgctcttgatttggcacgatcttgatgtaccacgagctttgatactatagttggatcatatggtgtttctccccctctaccttcttgtgatgaattgagttttacctttgaggtttcactattatggatttgagaactcttgatgtatgtcttgcgtgggatacccgtggtgacaatggggtattctattgattcacttgatgtatgttttggcacacaactgcggattcccgaggtgacattggggtaatctatgcatatgggttgatgcacgtgttttccttgtttctcctatagaaagcttggggcactctttgaagttctctgtg

SEQ ID NO: 39030 - DNA, 213 bp, Triticum aestivum
  Clone ID: PAT_TA_39030
ttttattgctcgatgcactacatgtcgccacgccatttcttcaaacctacttcacctcccgactttttttgcaatccgtatgcacaattcacagcgatctcacggcttgtgcccacgttctgacaccatctgcgacttttcagtcatttaccgatttgtgtagaaaccttatcgcgcgtcaaatggtccatcactacaaagtcgaactcggaa

SEQ ID NO: 39031 - DNA, 191 bp, Triticum aestivum
  Clone ID: PAT_TA_39031
catgcttcatctttgtcatattgctttgcattaccatgtcgttgacatcgtatttgtgccaaatccacctttcataattatttcatacatgtcgctcttgggggggtgcatatcccggtatacctcactgcggcacgcacatacactcatattctgttccaagtactgccttgtacttcctcatttctccc

SEQ ID NO: 39032 - DNA, 422 bp, Triticum aestivum
  Clone ID: PAT_TA_39032
cgggaaagagttattcatcatcgaagggcaaggtttctgcatcgatcgaggatgacgatgatgacttcatgtagtttttatgctgtatgttgtgagttcagttacataccatttaatttatttgtagttatatctaattgtttgtaatgtctcgttgtatgaatattatgttctatctaaatttgatcttgtagttccgataacagagtactaaaatagagtaggcatatgtctcgtacataagtacatagtcatttttctcatacatagaatagacataagtctcacacagaaatagatggtaatgtctctactgatagatagaagcgtcagtgacgacgtctggcctggcggggaggcggatctggaatcagggaccatcccaacctgtcgggtgccctaacatgacgatgaagaatctc

SEQ ID NO: 39033 - DNA, 307 bp, Triticum aestivum
  Clone ID: PAT_TA_39033
ggctgaccactgggcgcctactaacaccaacaggcgcacctgacgctataccgtgtgttttcaatcaagaagcctggaaaaaacgctgctgcaaaaggcaaaacaacggctagggggtggacttgtagactgggatgtatcccaacacgtggagccgcggacaatgcgtacgtgcgtgcacacacacatgtgctgtacatgtgatgaatactgaataatcgagtcagatgaccgcctgtggtcgtcgtctcgaccgcctcgtacatgtagacgttgcacaacacctgtacatgtgattgaataaccg

SEQ ID NO: 39034 - DNA, 374 bp, Triticum aestivum
  Clone ID: PAT_TA_39034
ttatttgggcctagaggaacgcattgtgaagtaacaagtagatgattggttgctacagtgacacaagcttaaaccctactttaagcgttgcttcgtaatgggctgatttggatctacatgtatcatgctatggttaggtttaccctaatacttcgtatgtaattgcggatgcctgcaatacgggttaatcatacttgggatgcacgtccaagaaaggacagtattcaagcactggtccatccacatatcaaattatcaaattaatgaacgccaatcatatgaccttgatcaaatctagcttgacgataattcccatgtgtcctcgggagcgttttccttcatataagaacttgctatcgattgtcctttgctac

SEQ ID NO: 39035 - DNA, 294 bp, Triticum aestivum
  Clone ID: PAT_TA_39035
catgtctagctgtagtcgtcgacgacatcgtctgcgcatcggttcctagtggacaactgtgatgtgtgctgcaggcagatggtggggtaacgtggctcgggcggataggttcgtgtcgtgtcccattgcggacgactaacaggtgctgatacgtggggtgaagcatgacctagggaaccgcttgtccggccgtgcacggtgtttccaacttatcatccccatcgtcctgaattatcggtcttctccgctttcggttacattggggatatcggctgtcatgatattacatctgga

SEQ ID NO: 39036 - DNA, 428 bp, Triticum aestivum
  Clone ID: PAT_TA_39036
cggggacactgagatgtgtgtggagaggaggtaacaaaaattatcttgagtattgtccggagggaggagagtccggaatgcatcaatgatacggttttggtgctcatacccaaggtaacaagccccactgctttatctcagtatagacctatcagtttgtgcaatgtgttatacaagatagcatccaaggtaattgcaaatagactgaaactcattctgccagacattatctctgaggagcagtccgcttttgtccccggaaggttaattactgacaatataatttcagcttatgagtgtctgcactttatgaagcggtctagatcaaaatcaaataatttttgtgcactgaaattggacatgatgaaggcctatgatcgggtagagtggacatatctgagggctatcatgactaaacttgggtttgc

SEQ ID NO: 39037 - DNA, 411 bp, Triticum aestivum
  unsure (1)..(411): unsure at all n locations
  Clone ID: PAT_TA_39037
atttgaaaaaccataaaaacctacatgtaaaaatatgtaatcttacctgccagcaatctattagtaggttggttaaaaaatatgcaagaaattagcatgaaatctttattaactatagatacattttacacatatatcacacggtgtttgacttctcatcctcttaggttgcaataagatttttactggtcattacttaggcaggctctaatccgttatcagtgagtatagttagtgatagtgttgtgggggctcggctagagggttatcacgagccgtcctaagacatactatcagtctgtgatgatgtgttcacgtcaacctcacccaaaatggactgctcaattgattggctcctaattaaaattagttagtctgttgattcanaattaatcctccattttttccgct

SEQ ID NO: 39038 - DNA, 376 bp, Triticum aestivum
  Clone ID: PAT_TA_39038
acaagtgcatgctttgcaatgtaagcatcacgcgaaatattgtataacggagatatgcattaaaggcagatggtgccgccgcggtcgagatccttcggaccgaggtggcccgggccaaaaaagcaagccccggagtaacagtgccgcttgccaagaaggaatctgcagagtttaaaggccgaataggctgctcggcgccaatgcggggagaaaatatccacgatgacgcgtgagctaaaagatgccgctagccgctgtgcaatccttgatgaggataataaagccaaaacggttgatcttaacaaggccttacgagaggcgaaggaagcacggtccgaatctagagcgccccgggaggagatccgacaagctgggg

SEQ ID NO: 39039 - DNA, 375 bp, Triticum aestivum
  Clone ID: PAT_TA_39039
ccgggtacacgggcaaggcgcagtgcagttggagatcaagaagggccacatgtacttgtctcgtgggtgggagaagttctaccgtgcctacgacctgcagctggggtacttccttctcttcaggtacgacgacgatgccaacatgctcatcgtgaaggtgttcaacaagactatgtgtcgcatgcgctacgctgccgatgatgatgccggtacattctgcctcttcttattcctctacatttggctttgtctcacatctattgttaacggtcattgttgcattttggacaggtaatgggagcagcagcagcggcactggctacagccaaagcagcagcgactatggctgtagcgaaagcagcagcgattctggct

SEQ ID NO: 39040 - DNA, 364 bp, Triticum aestivum
  Clone ID: PAT_TA_39040
acggggaagagtagagtgctgttaccgatgatacaggttagtcaagcagggagccagggaggatccatctgaactcttcgttctagcttatggtatctttgtttatggcatcgtctgtacatcgtctgtgtttttaggtttcggtgctcaatgttcttcgtgtcgaactcatccagtgtgtattctttccgtgttatactttgtcaagttcagagagacctgatgagtcttttccaacgcctctttcttgtttgtgagttatgatgttagccttcttcagacggataatagactttttcaataagtttatgagttctttatgactaatgtgagtctacggatgatctacaggctcaaactttaa

SEQ ID NO: 39041 - DNA, 253 bp, Triticum aestivum
  Clone ID: PAT_TA_39041
cgacggggaagcgtagactgctgttaccgatgatacaggatagtcaagcagggagccagtgaggatgtagctgaactcgtcgttcttgcttatggtatctttgtttgatggcatcgtttgagcatcgtctgtgtttttaggtttcggtgctcattggtcttcgtgtcgaacgcatccattgtgtattctttctgtgttatactttgtcgcggtcagggatgtactgattgtctcttccatcgacgctttcttg

SEQ ID NO: 39042 - DNA, 405 bp, Triticum aestivum
  Clone ID: PAT_TA_39042
gggtcgaggcggagataatatactggggtgtggcgagtatttataaggacagggacggcgcagcgttattacgcaggtgcccctggcggttcacatctgaaggacacgtggcgatcatgcaacacattggaggttgttccatgttcccacgcatgcctggattgtcgggtggtcgttcccgcttctccggggttcaggcaagaaggattgagcatttaaaacagatttaatgcttgtctctgtatcttctgctgacaaggacgcagctaagacattcgacagtttcaatagaatgcatatgatttggatagatagatttgagacaggagcatagaaaggttagggtccgatcacattcacttagttcaaaagattcaaacgagaagacatagctataagtgaatg

SEQ ID NO: 39043 - DNA, 187 bp, Triticum aestivum
  Clone ID: PAT_TA_39043
tgcgactgcgtccgcgattgcgactgggaaatgagcccggatgtccgcagtcagattacatcactcaagcggcatgtactcacaacacagcaggttcaaaggattgaagaggaactgggagatgtactccgccgtccagtcttcaatagcaagctgatgcaacctgagattgttgtattaagaaaaa

SEQ ID NO: 39044 - DNA, 404 bp, Triticum aestivum
  Clone ID: PAT_TA_39044
tgaacgaggtcaccgaagtttgggctgttaaggataaaatcaagcagttctctgagactttcagaagtggctcatgggttggggcaactgggaaaccgttgacaaatgttgtctcagttgggattggtggtagcttccttggacctctgtttgtgcatacggctctccagactgacccagaagcagcagaatgtgccaaaggccgacaactgagatttcttgcaaatgttgatccagttgatgttgcacggagcatcaaagatttagaccctgcaactactcttgttgtggttgtctcaaagaccttcacgacagctgaaacaatgttgaatgctcgaactatcaaggagtggattgtctctgctcttggacctcaggctgtttccaaacacatgattgctgtc

SEQ ID NO: 39045 - DNA, 420 bp, Triticum aestivum
  Clone ID: PAT_TA_39045
actcggaagtgtaggccatttaaaccattatcaattgggactaggcatgtgtgtgcgcttagtaaagtactaatctcttgatcatttttcattaatcatcaatctccgaccatatggtgtactatatgcacttccaccaacaccgacagtagctgcaagtgcaagagtatgggggcatcctgttgcaattaggtttagcaatcttagagagcctctagtagagtcaccatatatgtgatcaccatcgtccatatggagcgcaatccatatggatatgaagatcgtggtgcctgtgcgcaaacacatattctgcatatcgcagtaatttttttcattttctcattcaaacactttgattccctccaaatttaaatgtttagcccatccagcacacatgtgcataatttttgataagttgca

SEQ ID NO: 39046 - DNA, 411 bp, Triticum aestivum
  Clone ID: PAT_TA_39046
ttgttcatgctcactgaaactttgagaatcatgacaacattcaattttcactaacaacacttatcccattgtacaattccattgtataataaccctaatgtgccaatgtttgccttaaggatgtttacaatacatgatggtttgtgaggtgcatgacagaaacattggctgtactgcgcgatatttaactttttactggaatgtcaaaaggttctgacacattgtgcactgtctttctatataaattggataattttcctaatttttgcagaagttttcacgtaacataagtatggctaatgtccatattaatacagactgttctgttttagacagaatctgtatttgaagcatattctacctgttatgaggaaactatcaatttataacactggattaagccatgaaaaa

SEQ ID NO: 39047 - DNA, 396 bp, Triticum aestivum
  Clone ID: PAT_TA_39047
acgtggaaactattggttcattatgtggatgttaggactcccgcaaagtcctgatggttttgcttccaatctccggctgaggttgaagaacgctccatgaagtgacagtgcaacatgtatcggccctagatatggattgggtctacgagtgtcgttcaaccttaacgtttgggctagattgtgctgtccggtttggttacatttttctgtccaagcagcctgatacggggctctgtttgtaggtgctcttagagcacctacaaccggaccccatacccgcctcaaatgttcgtgctggctgccatatcagtgctcagacgaaaaaaagcaacccaaccgggcgtcccgtattcggtccaaatgcccggactgactatcaaccccagcatccagctc

SEQ ID NO: 39048 - DNA, 170 bp, Triticum aestivum
  Clone ID: PAT_TA_39048
acggggtaatgcaccatgtgtcactcattctacacgccatcttctgcaacgtctgcgactatctgcaagttatcacgtgctggccgtactacagtgtgatttacacgtgttctaactgctgtattgtatcatcatgttcatcgtctctttctacatgccaggcgcttact

SEQ ID NO: 39049 - DNA, 412 bp, Triticum aestivum
  Clone ID: PAT_TA_39049
ggtcgaggcggactcccaatgtgagtggtgacatcggtgaatcgaagaaatatgtcatccatccccagggagggatgacgatcccatttggaggggaaaagcccactcccgaaagatggtcatggattgatccatctgtcttcaagctaaggagtgaaacattcctcagagataagaagaaatgtccagctccgaactatgccgcgtactacccaataggtgttgacttgtttgcaagccccaagaaggtttcgcacatcgccgaacacattgatcttccacaagtcaaatcacacgacaagctcccatcacttttgatcgtcaacatccagatgcctacctatcctgctgctatgttcctcggggacagcgatggagaagggttcagcctttgtttgtacttcaaaatctc

SEQ ID NO: 39050 - DNA, 168 bp, Triticum aestivum
  Clone ID: PAT_TA_39050
atggtcaacttaagtgctgagtagaacaatttaaaagttggcaaaagatttaacttcccgaataaatgccccctggtcctcaattcggggcttttccccggggaaaacaattacgttaatgacttacggtttaacaaaaacttccccgggaaattcaagatttctcca

SEQ ID NO: 39051 - DNA, 354 bp, Triticum aestivum
  Clone ID: PAT_TA_39051
cgggtcgacgggcaaacacatactcagaggatataagtgaagcacatgagtaaatgacaaactactccaaaacgatataggtgaagatcaatgagtagttaaataattatgtaactacgtgaagactctctctcattaccgaatttcagatcttggtattgtattcacacagcaggcaaagcaaaacaaaatggcattgcacggatagcacaacacatgtgaagaagcagaaacttaggttcaaccgatactaatcgatagttgttgaagaagaaaggtgggacgcctagcggggcatcccgatgccttagatgcttgagacttcttgaactactgtcatggggtgccttgggc

SEQ ID NO: 39052 - DNA, 362 bp, Triticum aestivum
  Clone ID: PAT_TA_39052
acggggaaattcgctgtctaagatgacggttgagctgctgacgctggggtctacctctgcggaagatgtgcaactcatgatggttgtcatgaactcgcacggagattgcatcaaccatgtcaacagttcaactccttctgcatagccaacttcgggctcatgatagacgtcgccaaggacttcagaatcatctcaattcaccgcatctttcagatccaggagcagatgaatctagatacggctacgtgaaacatattcagtcaccgacctagccagggctcgatgcattctcagcttcagctggacgcaggcccaaactctgtgtgagtactctatttgcaaccaatagtcatcaatgatga

SEQ ID NO: 39053 - DNA, 344 bp, Triticum aestivum
  Clone ID: PAT_TA_39053
ttcccgggtagacggggatgatctgagtcttcttctcatcgagattggacagcgacgccttggtcgcaaggtatggatatatgtgggggagggaagttccaaaggggcatggtgtgcccgtggtcttgccggaggggaagaagtatctgccgaattcatatcgatgtttctgcgtgtatttcctctttgttctctgtcccccccttctcagatttctttgaggcgatgatgctggtgtacgggttccacctcttagattttacgccaaatgcaatggcatgcatggcgatttttgcccatctgtgtgagatctttgtcggggtcgcccccaacatggatctgat

SEQ ID NO: 39054 - DNA, 320 bp, Triticum aestivum
  Clone ID: PAT_TA_39054
cccggcccggggcccaaccggtgcccaaggtcaaggaccggattctcaaggccgaaggcttccgcaaacggcaattcaagttaccaaaggccggcttaacatggccggccttccttgaaaccaagtttaccttcatgcatgcacggtgtggtgtgcccgtttccttcaacttttgtacaaaatcatgcatcagggcgtacataccgtatggcatacatacatacatagagcgagaaatatagtagagagcttcgtggtacattattggttttattacggcactcatctctggtttgctggtgtatggactcaggaggagg

SEQ ID NO: 39055 - DNA, 326 bp, Triticum aestivum
  Clone ID: PAT_TA_39055
aagggtcaaccaagggaaaatgcaatacctccaagggtccaaaggaaaaccctaagtgattaacctggtcccgccccaccaccaaggcaactcctggaacccgggccaataaaacggctttggcccaaatttggaataagcaaccccccggtccggaacccttggaccaaatccgggaaattggcgcaatcaaccaattcaaagccaacatcgtgtaccttgcctgcggcgacaaaattcttggcgtcgatgtggttactaagaagataactaggatttctggtctagctatagctgtgccagatctccccctactaccatgtgtg

SEQ ID NO: 39056 - DNA, 384 bp, Triticum aestivum
  Clone ID: PAT_TA_39056
gggtcgacgggtattatccagtgatgtttaatacagttacaacaccaccgtgacacatagtatccgttatgtgttcgtgacgatatgatcatacgctttgagtgcaaagatgaaattttttgctgttggcaatggacatacttgtgatagcaatcaccctcatatgcctctcatgcctaccgggaaagatccgggaaagtctctttcttgggtagacacgagcttgtccctcgtcgagacggttacgaccggcggggcagggggaggtatgatgagtggtggttgtgtctgatggatgtgagatattatccttgagctaatcatgcaggaaatacttaagcctcctgagtcggccgtagatcgaatcctgttccagtaaccccc

SEQ ID NO: 39057 - DNA, 402 bp, Triticum aestivum
  unsure (1)..(402): unsure at all n locations
  Clone ID: PAT_TA_39057
attcccgggaccacggggggacaaaagtgtggcgccagagtagccgcctcgccaaccgcgtatcattaatgtgggcggtagacggatggacggacggtacttctgtcatttgaaggcggagcaatcacctgcactangaagcgcgacgggcgacgctgaccgtttcgggcggaaagcacgcacaagcgagggaggaggtctgggtgggccagggcagtcagactcgtgcttggcaacgggtcggtccagcagccggacatgctggctcgccagcaagctcgcctagctgagcgacgacaatcagatgatggacgtagcttccaaccaggagccggcgccactgtccaagccggttcatgccatgttcaccatagagcaagtgcggctgcacttcgacgccct

SEQ ID NO: 39058 - DNA, 390 bp, Triticum aestivum
  Clone ID: PAT_TA_39058
tacacttaaaaacgctcatcgatttgaaggcccgcacagtatccttaaacggcaacctaaaatttacatcaccgaccgacaaataaaaaattgatggccattgataaggccctggtttgatcccttcggtaaactaccactgacctgcaagccattaaataccgtttgtgatgacaaagtcattactaaccctgatgggtcattcgcgcatcagtgatgatacaatttggccgatcagtgctattcgggtctgcagtagtggtaaacaagctaggattagatataaccgaatatacatggagacgaagatgtatcccgatgttctcttccttggaggagaactagtcaccgctagagaggtgggaattcatggatacggtccaaatatgt

SEQ ID NO: 39059 - DNA, 195 bp, Triticum aestivum
  Clone ID: PAT_TA_39059
aaacgctcatggatttgaaaaagttcacaaatttgaaaaaaatgttcgcgaatttgcaaaaagatcatggatttgagaaaatgttctattatttttttataatttttcccacatttaagaaaattcaggaatttagaagaacaatgaaaaagaaaatgaaaaacataaccatacaaaccttgaaaaatacacagg

SEQ ID NO: 39060 - DNA, 111 bp, Triticum aestivum
  Clone ID: PAT_TA_39060
gtgtccattgggttcagctcgatgaaaataggaatggttaagctcaaaattgaacaattcatccatcaaagggtgccctttgatggataatttgatagaacaacactatgg

SEQ ID NO: 39061 - DNA, 257 bp, Triticum aestivum
  Clone ID: PAT_TA_39061
ggggtgtccatgtgctagcgttcttcgctgtcggtggtgccatcgtggtactcactcatcatggggctccttgtggtgcatggcctcatctgcactccatgtgaacatcgcatcttacgtgcatggacagggtgttattttcttgttagatggatgctcagatgcatctatcctgcagaggaatcttcttctttctttcattctttgggataccttttgtggcgtgatttatttaggcttcaggtctgccagtcaat

SEQ ID NO: 39062 - DNA, 391 bp, Triticum aestivum
  Clone ID: PAT_TA_39062
ccgggccgacgcttcgatttacgtgcgccgggcaaatacgaatggtccatgctttttttgcaagggatttttacatctgtgctcctggttccttagctctactcattcatccccgcgctctaaattttggccaattttccccaatcccttgccagaaaccctcataactgggcacaacgaacattgccgtcgggtcataggcttgaccgttaactctgactagtggggccacgctggactgtgttgtccgttcaacctgacaagtggggctgcgctgggtggtgtcgctgtttgaccgttgggccgtggtttcgttgggccgtcccttgcattaaacgtctgcgcgcactaccaggacaaaagcctgctatgcatgcacccagcaaaccct

SEQ ID NO: 39063 - DNA, 398 bp, Triticum aestivum
  Clone ID: PAT_TA_39063
aattcgcgagccgattgaatttttacagatactcagccacatattgatttccttggacaagcgcgagaaattcacgctgcttggccttcataactccagtagggatgtgatatttgcggaacttatccttgaatttttcccaggtgacttcctcattaatcggccacatggcttttgtattttcctaccatatggcagctgcgccttcaaggtaatgggttgcaaatgggactttatcatttccttcagtacgggcgatctcaagctttttctccatggtgcgcaaccaatcgtctgcatccaatgggtcagcaacctgactgaaattgggtggattggtcctctgaaaatctgacagctttgagtgatgaccattctgatttccattttgtccaact

SEQ ID NO: 39064 - DNA, 336 bp, Triticum aestivum
  Clone ID: PAT_TA_39064
acggggagcacaaaaaggcggagaagcacaagaagaaggacggggagcacaagaaggacggcgagcacaaggagggcatgatggagaagatcaaggacaagatcagcggcgacggcaagaaggacggcgaccacaaggagaagaaggacaagaagaagaagaaggacaagaagcacggcgagggccacaaggacgacgacggccacggcagcagcagcagcgacagcgacagcgactgacccagctccggcccgcgctccggaaccgttgcagtgtaggcaaaatcaatgatgaacacttggaaaaagtgtgacagacatatatgttgcagggttt

SEQ ID NO: 39065 - DNA, 402 bp, Triticum aestivum
  unsure (1)..(402): unsure at all n locations
  Clone ID: PAT_TA_39065
atgccgccaaagaggaggccgcttggctccagcaccaggatgagctgaactcccaggaggaggaccttgccgcttgcgaggagaagctcgccgtgacactccgtgacaaggacgaggaggtccaggagctcgtcatgcagcggatccgggaactggaggagaggcacgaggagggcctcaatgcttaggcccaggcccatgccggcaaggtggacgagctggaggcagagcgtgacgggctgaagaggcaggtccaggagctaacggggtagagggacgcggccaagggtgctttggctcacgcataggccgtagtcctcgagaaggccgcgctactctccatggccaacgagtccatcaaggacatgaacctgaagctgganggcattgaagggacactct

SEQ ID NO: 39066 - DNA, 417 bp, Triticum aestivum
  Clone ID: PAT_TA_39066
gagaggaaaaaaatatttttcttaaatgaatctagtcaaaccaaaatattgatttaacccgaatcggatgatttttggagtctgtatttattggtggaaaagaggcttagagtcaaaggctaggcaatgtgggactaaacgtagacaaaaatatatgaaacagagaagaaaagaggcggatgggcctaaaggccttcggcccgccgcgcgcacgctgcagctgcagttttttttaaacaaaattcggcctaaaaatgaaaaggctggctaggcctggctcatttaagagaggaaaaaaacaatggggcgccagaagctactatactgcgcatgtaggcgacaaataaatatgggccgcacgtacatttttttaaatagaaacagaaggaaaaccgaatagcaaagattaaataaaaa

SEQ ID NO: 39067 - DNA, 378 bp, Triticum aestivum
  Clone ID: PAT_TA_39067
cggggtgacaaattgtaaataaaattgttgtatcgcgacctgaatgaatgaaataaacgaaataacgctcttgttcaaccgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcccccaaaaagattaaaactaaatatccgggaaaaggaaattaaaaacccctaaaaaggggacacaaaattaaattaaaggggcgacttttaaaaaaattcaaacgggaaaaacccgggggtaaacaaaataaaaccccttaaaaaaaaaccccttttcc

SEQ ID NO: 39068 - DNA, 407 bp, Triticum aestivum
  Clone ID: PAT_TA_39068
cgggatgccgcattcgtcctgttacatcgtcttcacttcatctcgcccgccgtcaaaaccacctccaccggcacagaagtcgtgatgatcgatgtctccccaagctcaggttggatggccaccgtccgcggccgatgccttgccctttcccttggaacaggttgtcatgtggcgcactggaagcacccattcacagtgagactcctccaaggctgcgaggagcaaggacatggtgcattgatcgcattgttgtagaaggttaatccaacgcactcacgccagagccgagacaccatacctgcatgcatgttgttgtgctgtgggtgtgcatgtactccctttgtaccgaaatatttctagttgaaaagttatcacgtaaaatgtaaccgtttttaaggaaagaaaaa

SEQ ID NO: 39069 - DNA, 412 bp, Triticum aestivum
  Clone ID: PAT_TA_39069
ggccgacgggtgtacccagcggaggccatctatgccaacgctggggtctacctcttcaacaacgccaccagcgcccgggtcaacgtcacgaggctcgtcgtccacgagatggactcctcctacaatcaggcctacatgacctcactgtaaaaagaaaatgcaaatattatttttgtttagtaaaaatatgatagatagcacattgtatgtactgtttttagaccaaggaaggtcgtctcatttcttcgttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaataatataacataaaaaaaaaaaaagggggc

SEQ ID NO: 39070 - DNA, 120 bp, Triticum aestivum
  Clone ID: PAT_TA_39070
tggactgtttctagggtatactccatacactatgcattatgtgtcaatttcacgttcgccctttaacagctccatgcctgcataggaggttgcatcagctgactgacgttatccaccaca

SEQ ID NO: 39071 - DNA, 423 bp, Triticum aestivum
  Clone ID: PAT_TA_39071
tcccagcggtactaccggccacatgaccggtactaccggcttgcctgcgcgtagtgaagggggttttcacctcatgtatcctctcccacttaccccttcgtggcttagactttaaatagaccacctccaccttctttctaggggaagcaaatatgatagctcattcttaggtgagctttgctcctacctctacctaagaggcaaggctctatacactagaatagttttgatgtgtcccgtcaactcacagaacgaggagaagctttcttagtatgccgtctcccccgccaacgggcacggtggcttgcaggatgaggtgaagcttgcttactagtacgccttatgcccgctccctggcccaagcgcgtggttgatcacaggacaaggagaaaattttactactccgtcgtttactcctcaacc

SEQ ID NO: 39072 - DNA, 412 bp, Triticum aestivum
  Clone ID: PAT_TA_39072
cggccgcgagaaacacggaggcatcgggcggacgagacggcgatgacgagcaggcggccatgtcatgtcttaggggtgagtgttggcaataagccatgcatgtgatggtggcgaccggcttgaaggcaactaggtcaagtctgtaccgtgtgtgtgcactcaagtccgacacgtacggcatagccgatggcaagtgtgccggccaagtctgctagatgcatgcacgtagttagttggagcgcatctcatgctcgaccatgtcgttgccgttgaggtatgatgcgcatgtgctatatgtacgtgcatgcatgtaggagtcagcaagaagttagctggttagtggccggtgggcgtgcgtgtgtggtggccgggttagtggtgtgcgtgcatctgtgctagcccgggtataaaa

SEQ ID NO: 39073 - DNA, 378 bp, Triticum aestivum
  Clone ID: PAT_TA_39073
gcaggttcaagggaaagatgcgacggagttagaagttgcaagtatgaattgttatatctcgacctgacagaattatactaaataatgctcttgttcaatcgtcaggctccggttcaagtactgcaaaaaaaataaactagatcagatttaagaaactcaagattatgttcaaaaagaagtttgaatatgaatctgaaaaaaaatttgaaattttaaaatctcaaaaaagttgatgtgacaggtgcactggatacgtgaaaacaagacgaacctataggctcaggtttcatctaatttggatacatgagtgaaaacttatggctatttgaaaaatcatggttaaacggttttacggaaaaaaattagctacgggaaaag

SEQ ID NO: 39074 - DNA, 411 bp, Triticum aestivum
  Clone ID: PAT_TA_39074
cggacatcggcactgcgccgtgttgcctggcacaaccaaggagaacctaaaaaatgccaggaaaaggaaaactccgttccggttaatggcttcaaccaagccctccctccaaaaggggcaacgcttgaccctgaccaagacccaagtgaccacggtaacgcaaataatgatgatggtttgccaaatgagtatgtcctccgggcaaggcttaatctgcttcttcaaaaattggctgagaatgaccccaacccgtatgggacacccccaacgaagaaagaagcagtctaaaccctgcccacggtcaaaatctaagaggttgtcaactgttcaatctgtcttgatgatcttgatataaggtcccacgctaagcaattgccctgtgaacataaattccacccaccatgtatcctg

SEQ ID NO: 39075 - DNA, 195 bp, Triticum aestivum
  Clone ID: PAT_TA_39075
tcttgaaacccgatagcccagaaggaaagtcccgtaccaaaaaggaaactggttaaataataaatggggcaatttaagttttgccaccatccaaaccgaaaggaaaacctctgtccgggcgaatttaaccaaaaaatcatttatactggaaatggaacagtcccgttcaaaggatccatgctgacaaatgcctca

SEQ ID NO: 39076 - DNA, 377 bp, Triticum aestivum
  unsure (1)..(377): unsure at all n locations
  Clone ID: PAT_TA_39076
ttcccgagtncacggggtccgtcgacggcatcgctctccactgtgggaggatcgccacttgcagtgcaacgtgatcaccgctccaacctccgtatcgctgcgcatcacggtgacctgatcctctcaccatttcactcactctctcagcaagctccgccatcatgatcctctgctgtganggggaatccgctgtcgagcacaagtcctcgtgtccatcatcgaggcaccatcatatcctcacaccacggcaaatggtacacacatactacgcataatgaggggatgtacgctattgcagaatggcaccgtcactctcccgttttacacactggccggacctagcctcccaaccccaaaggccttagccctgctcgacc

SEQ ID NO: 39077 - DNA, 372 bp, Triticum aestivum
  Clone ID: PAT_TA_39077
ccgggtcgaccgaggagagctgagctgaccaactggtttgcgccatgtcataacccgtcgattgcggcagctcatggcaacttcatgacctgcagcatagaatctccatgggagacctgccgtctggtggcacacttcaatcggcatacaacagatgacccgttcatcagactgtatacaaaggccaacgatggctcatatatcgatcacaaggagatccccctggtgtggcatcactacgacgcggattgaaacttcggttcatgccaggcgaatgagctgctcaaccatctcgagagcgtgatcgctaacaacccggtcgtcgtgaatacgtgccattacatcgtggcggttcatcctcagggcatcagc

SEQ ID NO: 39078 - DNA, 345 bp, Triticum aestivum
  Clone ID: PAT_TA_39078
gcccctcccctccaattgcaaggcgcccaaatccggagttccgggccaaccgatctaacgggttaacctggcccgaacaaccaaacccaaccggggataaccaccaaatgggggtgtggaaaaatagaaaaaggaatttctcgataagttgatttcgcggtaatatttgttctcccgcctcggttcatttgctgtataaccatcaaactcttgatatcaagagttttgtgttttaacttccagtgctgctgttcatatatgactaatatattctcccccaaatgatataaaaaaaaaaaaaaaaaaaaaaaaaaaaaaaaaaagaaaaaaaaaggataagaaggt

SEQ ID NO: 39079 - DNA, 378 bp, Triticum aestivum
  Clone ID: PAT_TA_39079
gaaaccgaaaaactttcgtaaatcacaaatttacctcaatggggaaatgcatttccccaacattaagcatttcaaatttctttttgacagtaggtagaggtatttgaaaacttccaatagtgattgtcggagatttttcaataacattaataccattcacctggaattgtttcttcgaaaagtgcaccgtatgctcattaccattgatatgaaaagtgatcttgcttttattgcaatcaataacagcccctgcggtattcaagaagggtctaccaaggataattgacatgttgtcgtcctcgggcatctcaagtataacaaaatcagtcaaaatagtaacattagcaacaacaacgggcacatcctcacagataccga

SEQ ID NO: 39080 - DNA, 364 bp, Triticum aestivum
  Clone ID: PAT_TA_39080
gccgagtcgatgtcactgtcgggagcgccctagacatattcgggggagatttgccctacgacactgttgtccattggcacaaggagcaaaacctggttagccaacggtgaagaaatcagatgatccttttatagagcatgatcaaaagttcagagctcatgtgtgatccccacctgaccataggtcaggttatagagctttgttgtttgctggacattgtagtgtgaacattgtgtgtgtcttgtgtgacatgtcaaagctgaagcggaggtgtgaactcggtgtggtagaagaccactcggtattcagatactgttcttcacattctgtttgtattgtggtactggtaatgatgaataaacag

SEQ ID NO: 39081 - DNA, 266 bp, Triticum aestivum
  Clone ID: PAT_TA_39081
cccgggtcgacggggagcacaagaaggacggcgggcaccacgagggcgtcagcgagcacatcaaggacaggatccacagcgacggcatgatggacagcatccacgacgagatcaacgacaacagccacagcaacggcaagaaggacggcgaggaccacgaggacaacgacagccacagcaacaacgacagcaaccacgacaacgaccacaccgactccgacccgcactccagcagcatcaacgccagctccatcaacagcacctgc

SEQ ID NO: 39082 - DNA, 426 bp, Triticum aestivum
  unsure (1)..(426): unsure at all n locations
  Clone ID: PAT_TA_39082
tacggtcctacnattccgggtccacagccaggctccaggacaccgccaatggactccgaactacttcgcggcaggatagcccggcccgtccagagctcaattaaacactccggcgaaggctaggacaggccgcataccgcggctcaaccgctctccggcacacaaacatttcttacatttgctttgcaggttcacctttgcaccgaccaggactggcgatatggaagcaactcgaatgcgcaagggaatccttagatattccccgcagtgaccatccgaatatactctggatccacacacagcttctttccccctgatctcagcaggttccacagtcatatccctttttttatctcattacctgtcctcatacgcatcaacgtactattcaaatacaacatatggatttatatgacgcttatctgc

SEQ ID NO: 39083 - DNA, 410 bp, Triticum aestivum
  Clone ID: PAT_TA_39083
gacgggaaggtcaatactgatatgcttggccccacgcgtagtagtcttcttcaccctgcaaaaaaataaagcacatgaaaaaggtattaaaaatgaacaaaaatatgtttgccttggtagaaatcttaaaaaaatgaaaaacaagtggaaaggctggtagttgccatgtaaggggaacgtgagttgccatgtgtcataattagcagttgccatccagcagcagttgccatgttagccaacttgaagaatgataaaaatgtctaatctgtcatgaatacaatttcaaacctaggtgtaggatgagctcacaagccaacggtaaagatggcagttgccattaggtacattaaagttaccatttggcctagattccagttgccatgtaaaaaacaataggagttgccatacac

SEQ ID NO: 39084 - DNA, 350 bp, Triticum aestivum
  Clone ID: PAT_TA_39084
gagcacatgatcgccagctgcatcaggttggcatgtttgacatgatcatcgacaacatcagtggggtcgtggcagccataagcacaggaatgaccatgttcacattaaggccgatgagcacagcatagaacgatggtgagcactatatggtcggcgagcacatggatggcatgttggagattatcttcgttaagatcagcggccattgccactgtgaccgcatgaacgactgtgaccacaaggatattaatgtctataacaccaataacgtcaacattcaggcgagggccatttggacgattacggccacggcatcatcagcatctacagcgacatcgactgagccatct

SEQ ID NO: 39085 - DNA, 372 bp, Triticum aestivum
  Clone ID: PAT_TA_39085
gtcattggtgtcggggttgaaaatgaagttcatcatgtgagagaaagtcgggtgagcgttgactaggccaagtgacatgacagtgtattcttatgtaacatatcttgtcctgaaatgccgtcttgggaatatcttgctcacggattcgaatctgatgataacccatacggtgatcaagcttggtgaatacttgggcacctttgagttgttcaaacagctcattgatgttgggaagtgggtatttgctctttatattcttcttgttcattggacggtagtcaacacaaagccggtccattccatccttcttcttcacaaacagaatttcacaaccccatggagaagagctaaggcggatgaaattcattcttt

SEQ ID NO: 39086 - DNA, 378 bp, Triticum aestivum
  Clone ID: PAT_TA_39086
cggaattagaagttgtaaatatgcattgttgtatcgcgacctgaatgaatgaaataaacgaaataacgctcttgtacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccccccaaaaagattaaaactaaattacccttaaatgcaaattaaaaacccttcaaaaggttaaccaaaattaaattaaagggccttcttttaaaaaattcgtaacgggaaaaaccctgggttaaccaaattaaacccccttgaaaaaaaaccccctttcccaaagtgggttaaaaccaaaaa

SEQ ID NO: 39087 - DNA, 397 bp, Triticum aestivum
  Clone ID: PAT_TA_39087
cgggggctaataaaagaagtaggaggtgtggagacagacttaggaaccgaaaggttttaggcttagtagaattaaaactgagtttgtgaggtgtggtttcagtactactagccacaaggaggaggttagccttgatgggcaggtgatacctcagaaggacaattttcgatattaggggtcaatgctgcaggatgatggtgatatcgatgaagatgtgagccatcgaatcaaagctggatggaagaaatgccgccaagcttcctctgtgacaatagtaccacaaaagctaacattgcaggttctataggacagcgattcgacctgcgatgttgtatgaagcagaatgttgccaaataaaaggcaacatgtccaacagttaggtgtagcacagatgcgc

SEQ ID NO: 39088 - DNA, 375 bp, Triticum aestivum
  unsure (1)..(375): unsure at all n locations
  Clone ID: PAT_TA_39088
agaggttacacggaaggatgacgacagtaattaacatgtgtacatatatcaaaaccatggaagcatcacattaactatttcagctacgggcttaatcaatatatatttacctgaccggactcggttcggtcaatggagcagtctgcacggtcaccatcttgtacctccattgtgtcacctgagcactcggcagggtctccttcttgtacctccactgtgtcaccgaacccatcatgaaaatagtcctcttcttgtaccagcattattggcccgaanccattattagcatagccctcttcttcagccagtccttccagctgactatcactgtcgatgacaaatgacgcaacttcatcacttccatttgcgattatg

SEQ ID NO: 39089 - DNA, 411 bp, Triticum aestivum
  Clone ID: PAT_TA_39089
ccgggccgacgggactcaagatgtttcgagaatccaaatccgacgtacttattctgtatttgatgaaatgacaggataattatggggtagtttttgactgcgttgacatttacaagcagcccgcattcgatcaccctctcctgaagaaccacatactacaggtcaccattctatactttctatctttactgtcaaaaaattgtaggaatttttgttgctttttgaaacatggtacgaattcttgatgtaatcagtttttttagtcatcgatgtcagatttacagatctatccgcccttgtattagactctgacgtgtccttgtagtattcccgagcactgtggttgatacggcacataccatagcaaatggctctcgaaaaaacaacggcactatagttctatttcccact

SEQ ID NO: 39090 - DNA, 395 bp, Triticum aestivum
  Clone ID: PAT_TA_39090
cggggctttgagaggttttgagaggggttttgaggggttttgagaggttttgactgattagggttgagcataactaattcaaaaaaaatcaaaaaaatataaaacttgtgcacatagtcttattatgtcgtatagtaacgagaaaaaaaatataaatatggtttacatacatttttacgaaaaatccttcacaaaattgttattcctcaaacaatgtagtatggagttgaagggagagagtagtgggcacccgagagtaggtggagttttaaaaatgaaaagtgtgaaaacctcaccaaaacttcattttggattgactaagaaagatctgaacttacttttctcattttcatgttttaaacttgttttatatataattttctattaaaccttgt

SEQ ID NO: 39091 - DNA, 311 bp, Triticum aestivum
  Clone ID: PAT_TA_39091
gcagagtaaagtcagggggcggcccgaaatagaaaaacccccgggttgccccaatcaattcggttggaaaagaattggcgagttgccaatagccggttgcaaaaaaaaaagttcaaaggtggctggcctttgaaaaaaaattaacgggtgagaagggcggtttgccgaaaattcggtgggaaaaaacaagacaaaacaaatgtgtgtccgagctggcaaaagtgtgtctcgtacgcgtgtggtgcgcttgaaggattgcaaagagcgagagtgttgtctcaggctgtgcgtgcacacgcgtgtggagaaca

SEQ ID NO: 39092 - DNA, 315 bp, Triticum aestivum
  Clone ID: PAT_TA_39092
acgggaagtgtaagagaggagatggtcactatccgaggtcccaggaccagccatgacgtcaagctgctgcagcgtggagtcaggagtgtgttcgcaccccggcgtgtcccagtatgtgctttggaagactggcgtcaatctcaacagacccttatgcgtccacattatttgcttcacaaacagatagcatctctctgcttcgtctctggagtcacaaagctcgatgacagctagatacggatgatttacaggtttggagccaaaatataattggctagtctttttgaacacatgatgtaacacaaaagttattat

SEQ ID NO: 39093 - DNA, 409 bp, Triticum aestivum
  Clone ID: PAT_TA_39093
ttccaggtcgacgggacgaggaggaggaggaagacgcctaggtctgcctgccgcctcgtagtttaggttgtttttatttttcttaaatgctaatgtggatgcgtggactctcgccggccttcgtggccggctgtaatgtttaattaatgatgttttttaagtatgcatgtgttctatttttttctagagccgtcaaaatggataggcctagcgttgagcgcacgtgccgacccaaacacggaagcggacatccgtgtccgcctattcgatccaaacggacgaaaagcggacaaaatcgctgtccatttgagtcgatccgttggagttgctctaagggcctattcggtttctctcggctcctgcgactcaactcccgaagcggagcaagctacttcagcttttttatgga

SEQ ID NO: 39094 - DNA, 304 bp, Triticum aestivum
  Clone ID: PAT_TA_39094
attccagaggtcgacggggtctcggcagaacactcctttgaacacggacagttacacttgagcaaatcatctgcaacataccatcgaccatatgatggctctgcattttctgactgaggtcttcgatacatgcaagcatagaaccattgatcagtaacttcatgcctagtcatcagtgggaaattcatgtctgcaatacctccacacaatcgctgagtatcattcatcacagcatactcaggtatcactacatcagagttgaaacataactctgtccaatatcatcggttctaccgaatcattg

SEQ ID NO: 39095 - DNA, 162 bp, Triticum aestivum
  Clone ID: PAT_TA_39095
ttatgtttggtggttcctttatgcagactgtgatcctgttgtgggttaccgtgaggaccgactggaacatagacgtggccgtcgcgatgacaatattgatcaagtgggaatgcaccactatgcctctattagcaggccaagaatgaatcagtggatcctgtg

SEQ ID NO: 39096 - DNA, 289 bp, Triticum aestivum
  Clone ID: PAT_TA_39096
gacaaagtgcacgtggactagtcggataaaaagctcttatatgatcagcagatctacaagatcaacacttaactacacattcatattagatatgaggtcgtctgcattatcccatagattccattaagctcacggtgctatagagaataatctgaggctgaacggatacataattcatcttgagtctgatgacaggggactgcactacacaccactagcatcataactatgatgtggaacagtatcctgattaaactattttctggattatgaatgaattctggaacat

SEQ ID NO: 39097 - DNA, 386 bp, Triticum aestivum
  Clone ID: PAT_TA_39097
acgagatgtggaggaaacgagacgtatggcacctagtgttcactcgactttatgtgagaatgagttgagagacccgtaattgctacgtttccgaattgagaagcatccactcgtctagtaatacccttatggaccagtgcataccactgtggcatttcgtattcatcataagcagtccaaacctggttttcaataaacaaagcttaagtccgatccgtgtcgaagtcgtaaaaatcagcatatggaacactcataaccacctcattatattcatcctcattaaccatataactagtgttcttgttttcataaatctttactctttttactgcattacatatctttaagttttgaattgtttttgttaaccagcagcaccaactttc

SEQ ID NO: 39098 - DNA, 403 bp, Triticum aestivum
  Clone ID: PAT_TA_39098
ccgggtcgacataactaaaaatccaggtggttaaaccaaaatcacacagaaaaagggagtaccttgctctgataccaattgaaagtgcgttatatcgactagacggggtgaataggtgacttttatgaattcttcactgaggaatttcagggtgaggaaattcctaactgaagaactacttgcagcggaataagtactcagaatctatcataacagagcataagcatggtcatcatgatgaaatgaaaaacaagcacagagtacagaaagtgtaaacacaggatacacaggatgaagacaaacagactgaagaaaatgaactgaggaaattgagaaagtcttcagtcaaagtcttcaaacaaatatgaacaagcacacagtacagtaatgaggaaatggaaga

SEQ ID NO: 39099 - DNA, 375 bp, Triticum aestivum
  Clone ID: PAT_TA_39099
ttagacattttaactatctaattatagtgtatataatctttaaataactaattaatttaacacaaaatataaaaataaaagatcaaaactcagaaactagcctattgaaagtgtcttgaccaaacttgagttcaaaggtgtcaattctatttaaagctaagaaaaacgtatgcatattcaatattcagtatccatcaaattttggtcttaatgatgcgtggttttgagtggaaagtttaagatggactactgttttgtttagtattattcttacattcatggattgtaagaaaactttaatatctttttgctcctcacagggataaaaaagataaagaaaatttatctagaagaaggtgaatgagaaggtgaata

SEQ ID NO: 39100 - DNA, 258 bp, Triticum aestivum
  Clone ID: PAT_TA_39100
atttacatgttatttgcgtataaaaccttatatgtgtgtgtgatgaggtgtctatgtgcctataggttggtatcatatccgtcaagcatcaggtatgttaatgactgtcgggagtgttcccccccattgcatcagtctgtttgcgcttgtgaatctgttcagcaggttcaacgagcgatgttcatcaggttcaaattttggtcacgtaaggtttgacaatattcagccattttttaaaatcatcagccgatattttcg

SEQ ID NO: 39101 - DNA, 398 bp, Triticum aestivum
  Clone ID: PAT_TA_39101
ttcaacgtagagaagttgactcatcaatgaggaactgttgcgatgaatatccaattaggccaatcccattcactttcacacggtatgttgtgtgttgtagtctggtaatattttgttcacttcaatatcaggctgcaatgtatctacctagccaaatggtgtggaatacttaaattttacttggtatatttgtcagcagatgtaacatggaaggtactggcaaagtggcaatatgattggtgttttcttcacaaaggaaaatgatgtccatctggcttcaatgtcacagttactctggaagtctaattcttctgtgttcttgcagcacacacaaaaaggaaaaaagaaaaagacaaaggaaaaaataaaaaaggaagaaaaggaaaaagaaaaagaaa

SEQ ID NO: 39102 - DNA, 127 bp, Triticum aestivum
  Clone ID: PAT_TA_39102
atattaattattacagcattgtcccagtgaggaaaggatgatggacactatgatttccccacaagttcggatgatactccggacaaattttaaatatttacaaggccaaaatagagggccctatatc

SEQ ID NO: 39103 - DNA, 402 bp, Triticum aestivum
  Clone ID: PAT_TA_39103
attaaatggggcgctgctaaaatatatgaccggctagggttttgcgggagtattcggcagcttgctggtgtcttatggtgggggtctgagaattttgacaatgataagcaacaaataactgtgttagtggtggttggattgaattttgattctgaagggtggaattgcttggctgtgttcagatgagagctcctttgcaagctccctttcggatagcagctagagcttgaatttcagagtgtggcactaagaatgcttataatgagttttgcagacatgcttgttggttaatttcaattatttctcatgggtatttgtcccagggttttgactgtcaaaacggtttctgttattttgcctgttttcatcagtgtatactgaataaattgtaatgggaaaacc

SEQ ID NO: 39104 - DNA, 414 bp, Triticum aestivum
  Clone ID: PAT_TA_39104
acgggcataataatgtacgaagcagatttgaatcgaccaggaatagctagatggcatggcatgatggatgccacagcacacagcagcaccagcagtacagtgttgtcgagcgaacgcgtccatgcatgtgcggaccatgctctgcctcctctgcttcagcgcccgcccaagtgtcggcagcgccgtccagtccgagaaacatggatggatgaatgattggccacctttaatcaatttgacactgttcactcattcattagccgtcgctttttggtacgtgccactgacacgtgcactgtgtacatgtatggcgcaggacgctcggcgcgtggccggtggcgacggtgtcggagcgcgagcggagggcgacggtggacgggccggtgtgcggcggctcgccgttggcggtcaccg

SEQ ID NO: 39105 - DNA, 219 bp, Triticum aestivum
  Clone ID: PAT_TA_39105
tctggcagtgggcgggagatcggtgcggtgactctggtggtgtatacggcgaccgcgagtaagtacacggtcaggcacgtcgagctccggtgaacatgggttgctgtcggttatcctctttggtgtatatgcttcgtctacagagctactttgacatgtttcaagtccgcccagtttcctgaacttgtgtccatttgcataccgcgtccctttggaaca

SEQ ID NO: 39106 - DNA, 388 bp, Triticum aestivum
  Clone ID: PAT_TA_39106
atcaaataactagggagaaaactagcaagaatgatccacacaagcatcaaattgtcaaaatgctacaaaaggcaaatcgtcaattcttcatgatgcaattgtgccaggttatttgttacttttctactcatgattaatcaagtggacctagtatccgagcagatgacacagttatgatccacaagaagctcaatagagaagcaagcataaagggaagattagtaagaccactgagctcacccgtttatgagaactttcgagccaatacttattaagcttggagtaacttaatttgccagctctcatggcagagatagcatcattatcctaaaataagccaaaagaaacaacacatgtcaatctacaattcctttttagttgaatttgt

SEQ ID NO: 39107 - DNA, 308 bp, Triticum aestivum
  Clone ID: PAT_TA_39107
actcgctgtgccacgtcagcatgcctccgcaagaagctcggccacgcccaaatcatcaacgtggaggaagtgaataagcctgacgagatgaagaaggatgagccgaagccatacgccgtgcacccgccgccctacttcttctacccgcccagctcctactacccccaccagtacccgctgtacttctgaccatgtaactgccgagacatgtaactgccaacgagcgtgctttaattttgtcagcaactacaaatatttaccaccacaaattttcatcataacaatattaaaacattgcccaaacaaaa

SEQ ID NO: 39108 - DNA, 375 bp, Triticum aestivum
  Clone ID: PAT_TA_39108
gcaatctaattaatctgagtaagtttacaagcgaaagatttctcatctctatgggattaaatcccgagatattccaaagaaaaaaaaaataataataataaacgattaaattatggaagtaaatattcttgcatttattgctactgcactcttcattctcgttcctactgcttttttgcttataatttacgtaaaaaccgttagtcaaaatgattaatttgaataaaattttactatcaaaaaaaaaaaaaagatttcaatttctcgtcttaaatgaaaggaacgcattagactcagtagtagtatcctaaggggtccgctagtatggtagaaagagatctctttcaaccatactagccattatggttattgtaa

SEQ ID NO: 39109 - DNA, 388 bp, Triticum aestivum
  Clone ID: PAT_TA_39109
aaacccacgcatgacgaagaatgccgccatgagctcgtgatcggacggaggcgtggtgagtgtcagtgtttattgttactggaatgtgagcgtggcagaagtagaaagccggatcgtgaatggtacgcagagcacaacggggttccgtccagttttcgttggcgctcggagggatctggagagactaggggaggatccctgggccggggcttagtgctttgatcagtgaaagtacgcaacaagaaatcatggtttgaacaattatgtatcacaacaaattaatttggaggacaacaaatgcaaaagtcttcaactcacaggactgagcgaccagccgggaggctcttcaaggtgagggattactgcaagaccataactaatccccttg

SEQ ID NO: 39110 - DNA, 374 bp, Triticum aestivum
  Clone ID: PAT_TA_39110
ggataaggtgcattagtgctggtatgatcgtatttgttactacatgcaatgcaattgtatctattcttttttgaagactttatgatccatttgccgtgggtcccagcatctatgtaggaataccctatcttgtttataacagctttgatacatgttaaatattcgaaaacaatgtccgaacatataattgttgtcccctaatataacaaagatcacgaaaaggctcgaaaagtacattaaagtacaatttggagtagaaaaaaaacaatagaagaatttcattttccttcctcattcattggagagctctctttgggctttccgaaaaggtatcacatgtcaagtttggcctcactgtataaaagttataaagt

SEQ ID NO: 39111 - DNA, 363 bp, Triticum aestivum
  Clone ID: PAT_TA_39111
atacaatgaaaaatgtaactaaattaaagtagttggaacttcaacccaaagacaaaactctaaatgctctttatcattttttttcatttatatgaaaaaaaattgataaaaaaatgctttttcgaaaaataaaaacttcttcaaaatccttagcaattttaagataaaattagattttcctaattgctcaagagaaatcaaaaaaattatcaaaatattttttttgatgtatctttttatattgtacaaacataagattttttgctcacttaaagtaattaatttcaagatcttttatttcctcattaagaggaaatagaagatctttttttaatactgtctcaaggtagtgatgggaacaat

SEQ ID NO: 39112 - DNA, 386 bp, Triticum aestivum
  Clone ID: PAT_TA_39112
atacggacttagcatagattaattaatgcctatccaccatatgaataattaaaaatagttatcgagccaaaatgtatactataatctttggctgtgttcaacgaaagcaattatggacgagcgcggttccctcatttattacttaaattgtagatattgctccatgtaagaatataagatactgactatatattgactaatgtattactccaatttaacggaaataaaggtgacacatgtactcaatcaacaagatgagttattcataatgtaatgaaatgggacatatcaaaacttgagtggtagagttgctgcctcttaattacaaacagtttgaaagcaacccctccttctaactaaatctgatattgctccttattatagaa

SEQ ID NO: 39113 - DNA, 223 bp, Triticum aestivum
  Clone ID: PAT_TA_39113
tcccgggccgacaaagctataatcaacgtgtgactgatttggtttattaagggtgtccagttgtgtgaaagtatgctacattgccccgcttgataagcaagtaatactcatcctttcatctatgcatggccgtttaactcttgtcttaaaaaaaaaaaatgaaaaaaaaaaataaagggtaaaaaaaaaaaagaaaaagaaaaaaaaaaataaaagtagaaaa

SEQ ID NO: 39114 - DNA, 234 bp, Triticum aestivum
  Clone ID: PAT_TA_39114
gtgtcacgaacatacacgtgatattgagcccttgtagacatggattgtcgtaaccccatattggtacaatcttcgaaagacaggtctcgatcaccctgcatctaacgtgtctgtcatcagggatttattccaatctgttccactgggctaatacagaactcatgtgaacctgcctgtaacgttctaacctttctttagtcttccttcgattttaaattcctctctctgcgtttt

SEQ ID NO: 39115 - DNA, 347 bp, Triticum aestivum
  Clone ID: PAT_TA_39115
gacgggacttcccatgcaatcatgcttccgaaactggtgtccatatcgctctataccagcgacggttttcactacgccagtttggctagttccatcaactcgctgggcaggactaataccatcaagtccaaaaggcccttcagcctttggccgatctagcgaaactttatgaaaagtactctggctcaccatgaaaggaattgcaaaatgcttcaaagtaccccacgaccgtgtctacgtagatgtttctacggcaggaatctgatcgcattgaccccaaacagctgctaacctgccactaccacggcatctttgaagtaaacatccgccccttatacggacctcat

SEQ ID NO: 39116 - DNA, 229 bp, Triticum aestivum
  Clone ID: PAT_TA_39116
gaccggtctacggtatatctatcttcatcattgtttagggtatcgtgctttcttgcagtggttgagccgtgtgtcattacgattatatttctctgttcattggatctgtgatgtttatccacacgctcatgtgggttcagatacatggatggtctgagtacaacgctatgtcaggaacacaacaactgttacagttcattcataatgtacttcttgtgtttgctcaaaa

SEQ ID NO: 39117 - DNA, 377 bp, Triticum aestivum
  Clone ID: PAT_TA_39117
gaatatgaatgcatttttcattcgctgaagagtatcaatgattgataatatacgagggaagtgtaatgattagaaagctgtatatgtttttaggcttatttttaaaaggagagtaacatagaaaactacttagaggcgactgactcacacaaaaaaaaaactaaattcatttttttttcaatcaaccatgttagtttgttagaaacttaagtttaggtcttagtttaacaaacgcacgaaatttcgataacattagatgttttacatattgttgtaccatttacaaaaactcctactattactttgtaaactaaaatccaaaagaatcatttacaattaccacattccgaaaaattaaaacttgcgatagtacaaga

SEQ ID NO: 39118 - DNA, 389 bp, Triticum aestivum
  Clone ID: PAT_TA_39118
tcccgggccgacgggagctacaacaactccgatgatggtgagatcatggcttaggaagtgagtgttatctataagccatatgagtgtgcatggtgcgtagatgcacatgtgtgtgccacgtatgtgtgtctaggctcaagccagaggccggtgtgtgaccacgtctagctaagcgggagtagccgagagtcagtcaatctgtttgagttggtcatgtagtgctatagtgtggcgcgcggccggacgagccaatcatgcagatcgtgcatgcatgtaggagtcagcgggtagttagctggttagtggccggtgggcgtgcgtgtgtggtggccagggttagtgttgtgcgtgcgtctgtactagaccggatataaatcccctgctgctgt

SEQ ID NO: 39119 - DNA, 176 bp, Triticum aestivum
  Clone ID: PAT_TA_39119
ttgacagggtaactgtacctgctcccttattggaaagtggtacatcatagaaaactgtttctgtgacacctacaccagttagtgaggaagctaaggatcatgatcatgacacttcagaacaggatactactggaagctcgtagatcaacgagatctaagatccgcaccagagtggt

SEQ ID NO: 39120 - DNA, 360 bp, Triticum aestivum
  Clone ID: PAT_TA_39120
ccacggactcctgttcatccagcctccactgcgcgctactccaccggctactgttcaaccacccctccacgggcacccctccaccctccactattcatgcagccctccacggggtcgtactattcatccagtcctccacggggtcctgttcatccagccccaaccggctcgatcgatcggggtcctgttcatcccgaggcaacgccaccgctcattgttcatccaccctcccccccccgcaacgctcactgttcatcccagaggcagcattgatcagcttctgttagcagcagtagctaaggaatcgctcgatcgggttcagttaacagccattgatcgatcgcccgggttcagtaacac

SEQ ID NO: 39121 - DNA, 429 bp, Triticum aestivum
  Clone ID: PAT_TA_39121
ccgggccgaccaagacacggattaaggaatccttgttggaagcacaccaaccgcaacagccgcagccgccgccacgcttcgtggccgtgctgcggacgatgctctctgtgctgcgccagagaggccaccttgccgggggaaccaatggctcgcaacactacacgcggcaacaggctccagccctcgtccaacccaatcccgttcacatccccgactttctctggggctattatctcggctacgagctgggctttgatgattgcgccaaactggacgaggtgatagacgacgccatggctgatatggcttgatgacgactctggtctgatgaggaaatggatgaggctgcatgattctatgcatatatagtatcgaaggccacgctctccgtgtttgtgattttatttgcccactgtttgtgtggagtta

SEQ ID NO: 39122 - DNA, 352 bp, Triticum aestivum
  Clone ID: PAT_TA_39122
ggtacgtattattattgtgatatcaacattaggagggtcaatggtcacagcgaatcttgatatttgtatgagcaagtttgacttttgcatgtaatcgaggccagtgtggtgttcgaccgacgaaggcttaacgtgacgcgccccaaactaagtgcagatgctaggatgccgtgtgatgctgcaaacacggcgatatgccgatggtgatgcgtgagaagcggcacgacgtatcagaggctggagccgtgatggacagcatcaaattgggtccggtgaaccagacggtcttatcggtatgtctggccagctgttcaaacgtatgttccttcagtcctaaccgatagtatcgttg

SEQ ID NO: 39123 - DNA, 246 bp, Triticum aestivum
  Clone ID: PAT_TA_39123
acggatactgtaatctggtatctattgttcttgactgagaaaactaactagattcagtctaatcatttataatgatcttatgtagggaatactatgtctatttcatgaaatgacgtcacgggcgtatttcatatgatgtgggctttaagaatccaaatatagttaagcgctcatggtgcctgtgatatcatcctgacgctcccgggatattcttttcctgctgggtctgataaaaggttacttctt

SEQ ID NO: 39124 - DNA, 270 bp, Triticum aestivum
  Clone ID: PAT_TA_39124
ttgaatgaaattcagtccaatttcttgcatgggacgtaagcatgcacccaagaacaatgatttgacttttcaaccactttatgtgcactggtgcatgtgcatgtagttaaaatttgaattatgcacataagtgcattgacaactcacttaatgcataaaaatgtccaaacgaaccacgacgattctcaaaaaataacacagcactcatgttgttctaagttgataccggaaatttttttaaagcaatatgaggcaatggatatagtttcg

SEQ ID NO: 39125 - DNA, 451 bp, Triticum aestivum
  Clone ID: PAT_TA_39125
accggtcaaacagtcacgggccgacggggttataaaagaatatgataaggttttgcattagcttatactaacctatctcacgagttcttgttgagtttgttgtgaatgaagcttttgataaaaagagaaaccgtgatatgagaggaattaaggacacataaaagctcaagcttggggatgcccaaggcaccccaagataatatttcaagaagtctcaagcatctaagcttggggatgccccggtaggcatcccgcctttcttcttcaacaatcatcggttagtatcggttgagtctaagtttttgcttattcacatgagttgtgctatccttgcaatgtagttttctttagctttgcttgctgtttgaataaagtatcaagatctgaaattctttaatgagagagccatacatgatttggaatttgctataatactctatgtacttcactt

SEQ ID NO: 39126 - DNA, 295 bp, Triticum aestivum
  Clone ID: PAT_TA_39126
gtgcatcaatgagagcttcggtgggttccgcgacgggaccgggacattgttcgtcaacatggctgacagtgttgtttcgcttgacatcaggacgttggccatggagaggctatgtgttccgcccactacgaacggagacccctcggcgacctctacccctacgagatggtggcgtggccgccggagctcaaggacctggtgaatcctccggtgaatgcatatcgtggcactgcgtgctgattactgtatcgtgtgttttggtggtgtcagtgacaatggaactgctaagttcagt

SEQ ID NO: 39127 - DNA, 421 bp, Triticum aestivum
  Clone ID: PAT_TA_39127
gacacggcaccagtagtcggccgcagtacaacgggggatctaccggcagacacgggtccaaagctactcatgcgcttagtagccaacaagcggtcaaaccaaccaagcctccgcccgtgcagagcacgggaggatcacttgcacgaaggcgtcctgcaaggccaaatcacgcgtgtcacaccagcagcaataaagctacggatgcaacgattttccaaaggcaactttatcgggacatcggtgcaacgttgtcggacggtcttatcatgcacgaaacgggctactttcctgtttcccgagccgcattcggctgttgggtcagaatttcacttgagacgtacaggagaccgggacagcgatgacgttgccaccgaggggcaacgtttttccggaggcgacattggagggacatcgttgcgac

SEQ ID NO: 39128 - DNA, 413 bp, Triticum aestivum
  Clone ID: PAT_TA_39128
gaaattcacgatttgatgacttggtgaccatagtacaaaagtactatgcgatggagagcgcctggaaaaccgaaagtaaattttgggataatccggccccgaatacatccctagtccaaaataaaagggtgcatcattaccaagcacctgtgttaaacaccaaaaaaccaaaaacccctaaagggtacggaaccgtactggagggttggctaaacggaccctgcaaaattcatagcacagagggcgccactccaactcacagccttcgagcatgttggatactacggcaggtggccaaaagtggcgaaaagcttctagcttcagaatcccaacccagcaacaccagtacagtgttaacagtcttcgaaactttggcatcaaattacatgcgaaaacaaacactccgcaacctt

SEQ ID NO: 39129 - DNA, 429 bp, Triticum aestivum
  Clone ID: PAT_TA_39129
attcgccggtcgacgggctcaagaagtccgtcttcgggcatgacgacgcgctccggatataaggccagagcggaagttggggtcacgaatccttgggagatcaagtctccccagacatcagtgacgtagtctaggttttccaaaactaatctggtgacctgggaggtagctgtcgatctgctccagatggccaagcgagttggcccacagtgcgaagccgccgaacatgaagatctggccggggagaaaaacttccccccggacagcattgttgtagatgattgacggggccatcaaacctcttggtgacgacgcagcggaactctcagtgaaagcaccagtctcggtgtcaaaaccggcggatctcgggtacggggtcacgaactgtgcgtctaacgtcgatggtaacaggagacatgggacacgatg

SEQ ID NO: 39130 - DNA, 429 bp, Triticum aestivum
  Clone ID: PAT_TA_39130
gggtgttgtaataggtaggacaccttatttcagaaaatcaataataaacaaatgcaacatggatagttcacatatctgcatggatagttcagaaacactagtcattttcattcatctctgcatcagcatgatagcactcaagttcacattgacagcacaacatgggcgatgctccagtatttcaaaataaaagagaggaaaaaagggacatgccccagcatgatacatgctccagcttgggctccacaaaagataaagtacatggttaacagcatcttgctgtttctagttacacaaaaatgatgtagcgcatacatttgtctacaaaaaagcagtctaaaactatctaggaaacactttgctccaattgacatcttctaagaactactcagcagtttctgaaactcttcggctgagttgagtgtgttt

SEQ ID NO: 39131 - DNA, 435 bp, Triticum aestivum
  Clone ID: PAT_TA_39131
attcgcgggccgacgaagtcatcaaaaacgcattcgtaatcgacgggaacgtcttcttccactgaacgcacaatattgaaagggctgaaataaattcagaaaaatatgagcaccaacgtcaaataaagtctgacacttaaactctattcggctgaggataccactgtcctcataaccatccaaccacaggttaatttgttttttctttcttttaaggatacataatttgtctgatgagattgattttacaacacttgctgcgttaattaacaagctcgagaaaaacacatcagatgaacgagtaataagtgggcaggcaacataaaacaagaaatgcaaattgaccatagctcagatggttatgtttcttgtggtggaaccaactcattagaatttaagtccttgacttagtatcggcggtcgcatttttctgaa

SEQ ID NO: 39132 - DNA, 369 bp, Triticum aestivum
  Clone ID: PAT_TA_39132
cggtaatacaagtaaattaaattacctcatcttggagcttagtttgtttctttaaagcaatgatcagctgcatatgttatatttacatgctttggtgttgctgaaatgcttatattcatttttgttaaacctcctatttattttattactaaaaaggctatgaagcttgagcatcatagtttgcttctcagggttgaatcatgttgttgctatgcagtaggtatggttgccaagaagcactacgggaaactgcgaagaacactattaaaattctttggttggttgttgatgtcttgagagcaagtacaatagagttgagttagttggctataagaaatacactagtatatttttgcttagttggaggaa

SEQ ID NO: 39133 - DNA, 390 bp, Triticum aestivum
  Clone ID: PAT_TA_39133
cggtctactatccggccgacgggggcagaaacaaggggacgagcatcggcggctatacgaggagcatctgctgcgccgagagctgggatcaccttgacccgttcatggcgccgcgatgggcgaaacatttcaacgtgtacaggtcctgagagtgagtgattcacaaggtggaagatcgtgatgatcggctgaacacaaagtctggttaccagtttgaccacaatgtgattcttgttggttctttctttgcactcttacaagcatttcaaggaagtgtttgttaatctttacatggcttttgttgtgggttcagagtccatccatgttgtccaatatgtgtgcaaaagcttttctttctgcccttgtccggtgtgttttgcatttgtgtgt

SEQ ID NO: 39134 - DNA, 358 bp, Triticum aestivum
  Clone ID: PAT_TA_39134
tcttgttgagtttggtgtggctgaagcttttgttaacaagagaagccgtgacatgagaggaattaacgagacacaaaggttcaagcttggggatgcccaaggcaccccataatcatatttcacaaagtttcagtcatctaagcttggggatgccccgttaggcatcccaccttacttcttcaacaacgatcggttactatcggttgagcctaagtttttgcttcatcacatgagttgtgctatccttgcattgttactctattttgccttgcatcatctttgcataagataccatcatgtcaaattctttaatgaaatagactctttgcataggttcaaaactatttaacctcccttt

SEQ ID NO: 39135 - DNA, 433 bp, Triticum aestivum
  Clone ID: PAT_TA_39135
gacggggctagtaaacaaaccccttttcgaatccaaagacaaacagctctggaatatctctaagtctaaggagaagcacgctaagcaactagaacatcctaatgccggtgaaaaatccccttcccgaaaacaagtaaacggctctggaataactctaagtctaatgagaagcacgctaaccaactagaacatcctaatgccggtgaacaacccccttttcgaaaacacattatcacaactctggaatatcactaagtctaaggagaagcatgctaattagctagaatatcgtaatgccggtgaacaatcccattttcaaaatcaaagaacatcagctcttgaatatctctaagtctaaggagaagcacgctaaccaactagaacatcctaaacccggtgaacaatccccttttctaaaacactttcacaccag

SEQ ID NO: 39136 - DNA, 419 bp, Triticum aestivum
  Clone ID: PAT_TA_39136
ctgtttttcaattagataatgtgaagtaactttcagtataggaaatctcattttccatatgccgataattctctcaacatgattccgaagttgagcatgtcgaagattaattagttccctgtgattttgtggcctttgacgaactcttccttgttcgtttaaatgatacctagtaccacggtatggagcaagaaactgtggtgtgtttgcataatcagcatccacgagataaaatttaccatcgggaacttcaaaaccatggttaagtgcatcatttagaactcttgcatatgaagctgatccctcccaaccaggatgtatatgcacaaacttcaagtcaaaatctcaggcaaccataacattctgcgagattgtttgcctcctatttctgtatggttcttgctcatccaatggaagct

SEQ ID NO: 39137 - DNA, 106 bp, Triticum aestivum
  Clone ID: PAT_TA_39137
cactatggctccagtctcatcgcttctttctttcttcataacacgtttgctccttttccatggctactgcggctcactgagggtacaccactggtctgcagttttc

SEQ ID NO: 39138 - DNA, 238 bp, Triticum aestivum
  Clone ID: PAT_TA_39138
cacggcgcacctccagacaaattgttgttgtatacggtggcgctgactaaccgccattatcatctttgcatctattctgtccggatttgttgaataaaagcacgaaggaaattaacaatgagtgtaccaacacatcgaattcacccaaaatgtacacttgccatgtcaactccgttgggtctgggtaatcagttcaacctgacgtctaagaatccgttaaataaaatctctgacatat

SEQ ID NO: 39139 - DNA, 391 bp, Triticum aestivum
  Clone ID: PAT_TA_39139
gttgggagccaagcgtcaggtactgtctatgatatcaattcaaaatttgaactcctaaatttctgcttgtgccttaccttctctcttgtatgaaaactaatttcagatgaatctccttgctcaaaggatcatatgatctcaaaacaataatgggctctgcattgctcttgtcaatacctctctcccttttgccttgtgacgctgtacttaattaattactatttaattatgtatcatcagtctgcacctgcgcttcattaacctttgtttcttccaatattatttgatctatatttactctttgcaaaatgtacaataatggcaacgcttataaagaattttctttggggaatttattgaattatccttccatcaacaatgagaagggctt

SEQ ID NO: 39140 - DNA, 178 bp, Triticum aestivum
  Clone ID: PAT_TA_39140
gggtccacggctgattaatagcagtatgcagatcgaagagtaggtctggtttctgaaggagaattttcttttgtttcagggaaatttctgcggtgatcttgatttgcaacgcgtaacgatatgcaacttctgtgtatagacgcgtaatgctcagagacttgaacaccgtcttgacttg

SEQ ID NO: 39141 - DNA, 419 bp, Triticum aestivum
  Clone ID: PAT_TA_39141
agggcacacaacggtggcagtggcacgctaatctgatccgacccacgtagacctaatcatgcacgagagaaaccagatacaccgctccaggagataagatcgtggtttcttatctggatgttcatgggcttttattatggcattttaaaatcctttttaatgtgtatacaagctgagattggagggggaggggggcaactatgcttgtacgtgtgatttatctctctttgtgcgcaccgattcgaagtatcagtcgatggttggggggcttggcccctgcttgtccccccttgctccgccactgggaagacccatgtgtcacgataattttgttagatgatgtacaactcaatcgtctattcaccagaggtgtatcaaataagttgtatttgtctttgttctccttgacgggtaacacc

SEQ ID NO: 39142 - DNA, 230 bp, Triticum aestivum
  Clone ID: PAT_TA_39142
gtgttttcacccttcttttgtgtaccctggagtctgtaatatcatccttgctgtggtgcatcgggtttgtgcacatcttccggtagagttcagttcgcttcccgtgttaaaactagtgattgtcatggagattactgtttaactgagataccgatgttgccatggtggatagaacaataatttatgcggctgagaaataatggcgttactctgactgtttttcacccact

SEQ ID NO: 39143 - DNA, 401 bp, Triticum aestivum
  Clone ID: PAT_TA_39143
cggtcgacgggatatcgctagcaatatgaaagttatcttttcttcgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaagaaaaaaaaaaataaaaagaataaaaaggaaaaaaaaaagaaaaaagcggggtttctaaaagtttaaaaacttcatcatatgatgacgggagtttaaaattttgaaagtttggaccaataatttttttgaagggtcgttttttaaaaaccggtaataggggaaaaacctgtgggttccccaataaacccgcttgttggaaaattaacttttatcaaaagggttataattgaaaa

SEQ ID NO: 39144 - DNA, 386 bp, Triticum aestivum
  Clone ID: PAT_TA_39144
cggcacatttaaagacttatggtactagcatttcttcttacgatggtttgttttcttcagcaaaatgcactgctataatggccgtttctcaggcctgttgttgttggcgaaaaaaaaaaaaaaaaaaaaaaaaaaaaaaaaaaaaaaaaaaaagaacaaaaaaaaaaaaaaaaaaaaaaaacaaaaaaaaaagaaaagaaaaaaaaaaaaacaaaaaaaaaaaaaaaaggggccccccaaaaggatcaaacctaactaacccgtgaatgaaacttaaaacccctccaaaagggccaccaaaattaaattaaagggcgtccttttaaaaaattcgtaacgggaaaaacccggggtttaccaaattaaacccctttgaagaaaatccc

SEQ ID NO: 39145 - DNA, 280 bp, Triticum aestivum
  Clone ID: PAT_TA_39145
atgtagtagacaacgtatttgtggtaaagccaccgttcataagtccttcagacatgtcactcatgcatcaatgtacatcgcggtacaccgcctgatgcattcatatagagtcatacttcgttcaagtgtcgagttgtgatcattgaggtgtcaatacatagaagtgtgatgatcatcattcaatatagcattgtcccaaataaaattagaaaggccaaatcatgtaaggaaaggccaaataaaaaaagagaaaggcccagctgtaatcatgtattatgat

SEQ ID NO: 39146 - DNA, 224 bp, Triticum aestivum
  Clone ID: PAT_TA_39146
cgggccgacggacggacggatggattagccttttcttttttacctttggctaaccttagcgctaccctttttttaacctttggggaatgtaaagtttctagatgcaagaaggaagaaaaaactgtggggaggaaacctggaaaatgtgttgcttcgaatgaatgatgtagagagaacaaaaagtcacacgaagaaaaagaatctctcgaagaaattgcttcaac

SEQ ID NO: 39147 - DNA, 423 bp, Triticum aestivum
  Clone ID: PAT_TA_39147
ggtctaggacccccgggtcgacgggcatccccttccccaagtacaagacccggggcttctggacctaaaaggtataattctcaaccaaaaactgcacagacattagatgctctgtttctagtagcaagtttcagttgagcgtaagcataccaattactgctgtatttgtctacttgctgggaccatcttgttaccatagatgttttaactcaaggcagatcatgcaggggtatttatgtatttttattttctttagaggtttaccaccatgcatacatgatgactggcatcatgaactctatgagccaaactgcttaattgcaaccaatccttgggcacttagccaaaggattgtggtccaatctatcggtggtttaatcctagctacactatcagaaaaatttccctacttctataacaaaa

SEQ ID NO: 39148 - DNA, 418 bp, Triticum aestivum
  Clone ID: PAT_TA_39148
cccgggccgacggaatcctaaagtagttgacaacataaactgaattgatttgttcacacccatcactgtagagtaacttgtgttgggtgatatacacacatgttgtcaaaaccaattttacccccaaaccgctgcttgttcagtactgaaaaaaaaattcaaaggtgggaaaatggcatagtgttttatttttaacaattttcttcctttaaaatccaacacttggagttcgaacacaatctaagtaccgagaaccttttcatatctcctcataagtacaacaaaacatcgatgacttaatttccaaatattacaaagtaaatacccgtaacttgaaatgaacatgaaacactgtcatagatcgctcgacgggcccagaccatcagcatccctaatcaactggataagaataaccaaa

SEQ ID NO: 39149 - DNA, 425 bp, Triticum aestivum
  Clone ID: PAT_TA_39149
cggcgtccaatcatgtgcattatttggggaattggaccgagatacatcatagttgcttcacaactccatatttggtccagaatcaagatcaagatgatgcactcacatagagtaaccacttgagctcaaattcggcaaggcagcatgttttggacatataaagatgctgtaaaaatttcgtaccaaatggacttggcaaaatggaacttgcttcacaaacatcctctttgtccagaaacttgcaataatttttggggagaaaatggcttgattaaatgttcccaaatttggtggagagatgggatattggtaggagcatgatctagtaatttttcaaaaataatgaagcaatataaataacacttgcttcacaacctgaaaatattaacagaatataagatatgaaactgtgctcacatagatga

SEQ ID NO: 39150 - DNA, 434 bp, Triticum aestivum
  unsure (1)..(434): unsure at all n locations
  Clone ID: PAT_TA_39150
gggtccacggcgagacttatcgcctaggcggcgtaggtgggctcgagtgggccgaaggccaaggggtaaggggctgctcttttcttttcctttgattttttactttttatttaattttcttttctattttcgtttagtttcctgttttatttaggttctgctatcanatgaattttgttgaccatgtaaatttgcaaataacccacgcactatattttggggctgcacaaaatgcttccgggcaattggagttaatataaattatgattgtatttgaaagggcaaaaaaaggtgtcgttggtccattgtttaaaatccatgggtgtttttaaacatctccaaaaatatttcttaatgaatgagaattatgtagtgaatatttccaacctaaggaacatttttaatttacagtttttataaattctaatttgact

SEQ ID NO: 39151 - DNA, 437 bp, Triticum aestivum
  Clone ID: PAT_TA_39151
cggctggccgggacatgtatggatactgtacttggaattcttgcgagctgtgactgatgtgctgcaaatagaatgaccggccatgaattataaggtcgagcgatgtgcggttgtctcctccgtttcttagtttcgaatcagcaacgcgcgtttgctgatccgtaagctgcaccggagtttgtatccacgcgttttttatttcttcatagaaacgtttgtatccacgcgcaggcggtgacccacacggattttctcccaatgctccagactacacggaatgggtcaccaactttcagaaatgcatattgggccaggcctaatgaagcgaaccaacaggctttatttgggccggttcagcgtcttgaaagttttcaagtcctcaaagaaagttcttcatcgattaaaaaaaagatcttcaagggccaacctatattaat

SEQ ID NO: 39152 - DNA, 465 bp, Triticum aestivum
  Clone ID: PAT_TA_39152
gtgacggtcctacattcacgggtccacgggcccagtagaagaattgttaaaattcactagagcatgataaaattctgatttttttacacaagattgatatacaaatttcccagtttgtactaatttttcacaatttttggagttatagaagtatatgaaatttccagattactacaaactgttctgtttttgaaaaattctgttttccttgtgttgtttgcttattttgatgaatctatgggtagtatcggggggtatgaaccatgaagaagttggaatatagcatatataacatcaatataaatttataatgagttcacaacagtacctaaagtggtgatttgttttattatactaatggagcttatgagttttctattgagttttgtgttgtgaagttttgaagttttgggtaaagttttgatggagcacgaaataaggagtggcaagagcctaagcttgggg

SEQ ID NO: 39153 - DNA, 444 bp, Triticum aestivum
  Clone ID: PAT_TA_39153
ccgggtcgacggggaatgatagttgctttggaagaaaataatgatatgcatgaatctatagataattatgattccgatgatttgattgaaatatcccttgatgaacatgatgcttgctattcttatggccatgataccaatatttatggagatgaatttgctatagtttctgatgttaaacatgagattgttgccattgcacccatacttgatagttccttgaatcgaaagcatgattgcgatgaagttattataaattatattaatgtcaattgtgttaatgatatgcaaaaccctaagcttggggatgctagttttgctatctctactatttgttgcaatgatcatgattgggatgattcttcttatgatcttgaaaatttatttaagccccatgatgaacatgagattgataataatgtttgtaataatatttaaaatggg

SEQ ID NO: 39154 - DNA, 438 bp, Triticum aestivum
  Clone ID: PAT_TA_39154
gggtcgacggggatggctatgattaccaacttgtaacgcccacgacgcggctatatctcccacgtgtcgaggcacgacttagaggcataaccgcatagtggttttgtcgcaagaagggtcatcttcacacaatcccatgtaatgaacaagaatgggataaagagttggcttacaatcgccacttcacacaatacatgaatataattcatacatcatccgaaatacaaacatatagaccgactacggtcaaaatccagatgaaaataagacaaccccaaatgcttgatccccgattgtcccaactgggctccactactgatcatcaggaaaagacacatagtaacgaccacgttcctcgtcgaacgcccacttgagatcgaccccatcgtcggcaccggcatcgtcggcacctgcaactgttttggtagaatctgtgag

SEQ ID NO: 39155 - DNA, 411 bp, Triticum aestivum
  Clone ID: PAT_TA_39155
cacggcacttcaatataaaaaaaaaaaaaaaaaaaaaaaaaacataaaaaaaaaaatattaaaagcaaacaagtatgaaaaaaatacaaaaagtcccaaccactaaaaagataaaaaagtcaaaaaaaaaaccggccgcccaaaaggttcaacactaatttacccttaaatgcaacgtaaaacccctccaaaagtgccaccaaatttcatttaacgggccttcttttaaaaaatccttaatgggaaaaaccctggcttaaccaacttaaatccccttgaagaaaatccccttttcacaaacgggggtaatatcaaaaaggcccgcacctatcccccttccaaaaatttgcccaccctgaatggcaaatggaacccccccttaagcggcccataaaccccggggggtttggt

SEQ ID NO: 39156 - DNA, 407 bp, Triticum aestivum
  Clone ID: PAT_TA_39156
ccgggtctacgatcaggactacaagacatacgtctcggttattgttcggggagataaggcaaaatatatttaccaaaagtacttttgttcacttacagcttagtggagggctgacccccttgcgggcactgggcggcaaggacgccctccgaggcagggcctcctggcgagggtttcttctctcgtttggaaacctttgtttccaagtcttcaggggtggtccttttccttccttcggaagagggaatttcggattcttctcctcgattatcctccttcgtggagatactaattctcctggtttggatgagtaatacgtgaggctcgcttttggcttcttcatctctccttttatcttcccccgagggcacttgataaggtatgtactccagcatcctggctagtat

SEQ ID NO: 39157 - DNA, 405 bp, Triticum aestivum
  Clone ID: PAT_TA_39157
cgttgagctgcatctgctgtattgagctgccgaggtctgctatgttgagccgccgaggccgcgttgagccgccggggctatattgagtcaccggtctgcctgagccatttctgttgcgttgaacggatcatcgatcatccgaacaaatcaggtgatatccatctaagtttgttttattagcacatattgctttttgtcaaaaaacagtttatctttgccttggtctgcaatattgttgatgcaggacaattgttcactacatcaacacgacgtggctaacttacccatccgcctggcttaccgtgtctgtgattgacttgcctgtctgcactggcttacaacaccgtggctgactcatctgtctatatcgtctctgatgttgccgtcgtccttaacgttcgtcct

SEQ ID NO: 39158 - DNA, 330 bp, Triticum aestivum
  Clone ID: PAT_TA_39158
ctcatcgatagacgggacacctttgcctctatcaagtggtatcagatttccaggttgctcggtgagattttacagtttttcgtagtttatatcgggtcagttcgtcataccgatagtccacgaatcttccagacaaaaaattagggtcagttcatcttaacggaaccaatctaagccgttgcataatctttttagggttttgcgatgtggaatttgcggttgcatcgtcgtttctaactgctgggcgtacagtctagtcctttacactttcgagttctggtcataagttgtcaagtcgctgccgcaccatcatcatcaatcctgtcatct

SEQ ID NO: 39159 - DNA, 248 bp, Triticum aestivum
  Clone ID: PAT_TA_39159
ttccctgggttttgttgagttaacagttaaccagtgcaacttcctgtacttcgggtgtgtcgaacgaccacaccaagaccgcttagggatccccaacattataaatacttcaataatattcgcaataagcagattgcgttatcatattcttgctcgttcttcgattgcttgcaggaaaaaaccttcgtggtcaggttgatcatgccccaccctggtcaataccctctcggacttggtttagcgacttt

SEQ ID NO: 39160 - DNA, 347 bp, Triticum aestivum
  Clone ID: PAT_TA_39160
ggaggacctatgcgagtctaactttgtattctgacttgaatgagtagtgttgtgctcagcttggggatgacctatgagattcttagctagaattccgatgtgcatgtccgaataacgaagggaaatctgtcttgagggcaaatacttcgggtcagggaaacttgacattatcagacgcataagtcacaggccagaaaatcagtaacgggatatgataatcatcgctctaactgaaatcactatcttctgtgggaatggccaatccgaatgttctgaagcattccttgaagcagtcgctaagtccgtcgagttccagcagtccagatgcggacatcctcttggcttaa

SEQ ID NO: 39161 - DNA, 409 bp, Triticum aestivum
  unsure (1)..(409): unsure at all n locations
  Clone ID: PAT_TA_39161
cccgggccgacgggaaggaaaatccctataaattagggatttgtctgatttgggtaggggttggactatatatacatgggaaaaaagggagttgaatcatccgatgaaaatccgacggtcaagaatagataggctatgaaagtctaaataagaaacggagacgttttgtacatgtttggggatgatccggacacaacggtgacgactgcccgggtcgggtccgggaaaactttcggacgcgcgcgcgaggatggccgcgggctgacgagagagcttaagttggatctggcggtangtagtgggctgtgtaaacggtctcgagctaagagaagagaagagatggaggcccggcgactgtttccggagaccgaaaacgttcgacgtgtgacccactatattgtcactatag

SEQ ID NO: 39162 - DNA, 420 bp, Triticum aestivum
  Clone ID: PAT_TA_39162
cggaaatggcacttgctcgatcgtcttgttgccgtattgttgtaggaggtccatatgatgtggtacctcatagcttgtctccatgactgaagggaaattcccattctcggccatctttcttgaggggcttccgacgatggaagtgtcaccctcgctcataggtggtcgccttgttcttgaagatgtcaatgtatgcgaactcatgggaagtaggcgaagatgtcgtacgtccgaaggcgaagatgccttgataacacttggcaaagatgtcgaagtggttggtgtagccgtaactacgtcttggtggtgctcgtctcgcggtcttctctttttctcatgaagcttcgccttggcgtgtagtaaggctttttgggacttgtgcatttgcgtttgtggagcatcttcaagatgataatgtca

SEQ ID NO: 39163 - DNA, 382 bp, Triticum aestivum
  Clone ID: PAT_TA_39163
gaaacggggttcatcagcatgagcatcataattttccatgtaaatactactgtccatatcgacaatagtttccccaatttcagacataacggcagaaagtgcgaggagcaggaagaaagaaggatgcgaacggaaaagagagggcgaataaaacggcaagggtgaactggacgagaggaaaacgagaggctaatggcaaataatgtcatgcatgagataagagtttgtgatgggtacctggtatgttgacttttgtgtagactccccggcaacagcgccagaaatccttcttgctacctcttgagcattgcgttggtttcccttaaaaaggaaagggtgatgcagtaaaatagtgtaagtatttcccccagtttttgataac

SEQ ID NO: 39164 - DNA, 350 bp, Triticum aestivum
  Clone ID: PAT_TA_39164
cacaagaaggaaggcgagcacaagaaggacggggagcacaaggagggcatgatggagaagatcaaggacaagatcagcggcgacgaccacggcgacggcaagaaggacggcgagcacaaggagaagaaggacaagaagaagaagaaggacaagaagcacggcgagggccacaaggacgacgacggccacggcagcagcagcagcgacagcgacagcgactgagccagctccggccgcgtgcagtgcaggggagatgaacgcgtgggttaacttggagcgtgtggtagcatatgtatgtaatgcttgacatgtctcatggatcttgtaatgtaataaccggctgcactgca

SEQ ID NO: 39165 - DNA, 402 bp, Triticum aestivum
  Clone ID: PAT_TA_39165
gacggctgagcaaaatacagcttcacattgcaacgctcgtaggctaggtattcaatatagagtccaacctatggctagcatgtctacattacaagtaaggtcacttaatgccatgtgtaatgttgagatgttgccatcactttcatgctttgaagttttgcgtgtcctagctttggaaggcccctatgattcacaccatcctagtcatcttgagcatgttggaaagttagttcacttgaggcacctcaaactatcgagcatggatatcggtgagctcccaaaggaaataggatatctaaagttcttgttggtattggacttaggtagaaatagcataagtgaacttccagagagtattggttgactaagtcaactcaagtgcttgaacatatgcgaaacaga

SEQ ID NO: 39166 - DNA, 405 bp, Triticum aestivum
  Clone ID: PAT_TA_39166
cgggtagcgaggcgctaacgctcgctacagacttacatgtccagtccatatgtgtggccacagattgcctagaagtggtgacaaggatcaaggatgacttcccatgcatgtttttcccaattctgcaagatatcaagcatcagagaagagctttcagggcagtagagtttatccatgagagtagaagacataatggagaggcgcatgctttagctaaggctgccgcatcactccctcccgggcgccatgtgtggctttcttctatgcccgatattatctgtattccaatgacagtttatgcttaagaaaggatacagattatgctaaaaaaattgtcttctttaacgcgttacaaatataatctttaaacaagatgtcgcttaacaaaatatcgcattttttgtc

SEQ ID NO: 39167 - DNA, 363 bp, Triticum aestivum
  unsure (1)..(363): unsure at all n locations
  Clone ID: PAT_TA_39167
acatccacatcatcatcctccaccccgagcccgacaccaaatccgtcgagccccgtgcagtgtcngcccccaccggggcttcctcttctcgggccacaacgttgtctggatcaccctcccatgcaccatgggcgtctagaggtctgcgaacgtctcttcaccgcacatgactgctagtacctcgtcatagttgctggaggagtaggagcctcgcttgaattgctaaatgggtagagctttcaatgaagtggtggagcggttatgtaggttggcaggtggagatgaggacaatcacctatgtacatggtgttcgcatgacggtcgcccccctaggcaagggggcatgtggtanggcccatgcat

SEQ ID NO: 39168 - DNA, 406 bp, Triticum aestivum
  Clone ID: PAT_TA_39168
ccgggccgacgatataaccaacatgcttgacttcagctctgaagacatcgatggcatggatgacgatgtaggagacgaacaggaaccagcacctatagggcgctggaaggccacctcgtcatatgacatatatatggtggatactccaaaagatggagatggcgatggaacagtgggggatgacgcccccaagaaacagccgaagcgccggcgtcagcggcgccgctctaaatcccgccaaagaaaaaaacggtgattctggcacgggagataatactaccccggatagcgccgaagaacacccacctcagcaagattcagcacaggaagatggagaagccagccctcatgagagagcggcagaccgagaggtcgaggatgataactatacgcctccctccgaaga

SEQ ID NO: 39169 - DNA, 182 bp, Triticum aestivum
  Clone ID: PAT_TA_39169
ccccgtaatggcaaacgcgcctaagttcctccgcatcgtcgtcgtacccctagattaagcttgatgtcatttacatctgttacttgtggcaagtaatgttttgaactcatagctgaagttcgacgtgttctgatctgcgtatggtggacatgacaaatcaaactgctaccataaactaaaca

SEQ ID NO: 39170 - DNA, 426 bp, Triticum aestivum
  Clone ID: PAT_TA_39170
gtggcaactggcacctgggatccaccatctggttgcaacaactggaaagaaaacagaagggggggaaagaggtagcaaagcaaccgtgagtactcatcctaagtactcgcaagcatcagatctatactaagtatgcattggtatcaaatggaaaggttgtatctgtgcactgaactgcagaatgccagaagagaggcgaaagcctagcctatagaagactaggatcttgaagcagctccaagcatcttgcaatatgtagaagagtgtgacaccccaaaagtttggccttgtttttagttattaaaatgttgccaggaaataaaacttttccaattgtcaagttttacccttttgtgattttggatttatgcctcttgtgggaaaaaacttcaaagtgtatctttgacttgtgtgccctcttaaaaa

SEQ ID NO: 39171 - DNA, 181 bp, Triticum aestivum
  Clone ID: PAT_TA_39171
cccacgtcgttgcttccttcatgtggatattcttctagtattacagtgcctcccttgtatatatcttcgtctgcttgtcaatctcttgaccaccacgtgggtttttattgttagttgatatgtggtactggagatactgattactgaaccgatctcttggttggaaagggaaagcgcgatg

SEQ ID NO: 39172 - DNA, 338 bp, Triticum aestivum
  Clone ID: PAT_TA_39172
tagcgtccaaattcacggtcgacgggttcgaccacccaaccgaccccaacgatggatccgggtacggaggaagcacgaatcggtcactgcagatcctgcatgggctgaaactttgggaataaagtcaaccaccaaggcaaggttccccgaatttaaaaccttctttcccccccccgtaattccactttgaaattgtccatcccccaaatttcccccaaaggttcccccaaacttttttccccgtaaactcacacacccaatgtgtgttaaatatcccctttttccccgtgttgccccggaaatttctctcccccaaatttctctcacaggtttctcgt

SEQ ID NO: 39173 - DNA, 343 bp, Triticum aestivum
  Clone ID: PAT_TA_39173
ctggagatggctgacactgtgtgctcgtcgtcgaatcgttctgtgctatatctggtgggcgttgccggcgcatgccaactcgttttaagtggccgatggcggacgctgcttcagctctacattcttgtttgcttggacggttgagccccgataatcgccttccactttctacccgccatctccgggctgcccgggtgaccagtgtcgtggagatggtggctgccatgcagtaagtcatgcatcatgtcatacactagtgatgcacattgcatgtcttgaataagacggaagagtgtcttgggcctccgtatacaatgagattccctttcacacatgatttcca

SEQ ID NO: 39174 - DNA, 379 bp, Triticum aestivum
  Clone ID: PAT_TA_39174
acgggcctaagttgcatcgggtaattccgcaacgggaaagggaggtaacgggagaaagcatgggatccagtacgtatggccagatcagtgagtccgaacgagggtgcaatctgtaccatcgattgatcgtgagtcagcggtgagttaatgctggtaacgtgatgcttcacgctatagggctcctgtggtcgcatgtgtcggcgtgtctatacgatgcatccttacataccccttgatcacacttgatagcgcatctatagtgtgtatcaattgatatcatgagtgcttgttctacaatgtccagagtgaaaaaaggctgacataacacaagatggtcaccttgaaggacatcaccctttagacaactcgcgggttacct

SEQ ID NO: 39175 - DNA, 192 bp, Triticum aestivum
  Clone ID: PAT_TA_39175
tgaagtaaacctagctagagacggctcacgcgttccggcttgcgttgtggaccaactgctgccccgtcgcagacaccgggcagtcaggtccgccctgcacactctgacatcgtcctaatcgatgcgaagttttgtagtagctaattcatgttgtaaatcacaatatctagttatgcaatcgtaacattgagc

SEQ ID NO: 39176 - DNA, 296 bp, Triticum aestivum
  Clone ID: PAT_TA_39176
gggccgaggcggaagaaaactttaaacagcaaacggccgggtcgggggatatatcctcttgccgtggacgaggcagtcgtaggagcggcaacggcaagatggacgacggcgccgatgaagcgagaggaggcgatgaaaggatcctggtccagcgccgtggatgagagacgtccatctcttgcagtggacgacggggtatgggtagcggctctggcaaggtggaggatggggtggcggacggaggaggttggccgcagtgcggaggttgtcgtgccgccgacggtgtatgaatggcc

SEQ ID NO: 39177 - DNA, 414 bp, Triticum aestivum
  unsure (1)..(414): unsure at all n locations
  Clone ID: PAT_TA_39177
aaccggatcatcaacactgactccggcatagaaaacttgcaagagaatggtacaccatgacgatgtacactgaattgaagatccccagaaagtggaaatccgcccgcttccaactgatgataaaattcttgcaattgagtatcaaattggtggtagtaagctccaagaagaagaggtgcattgtgctcatcagcctgagaaaagtgtaacatccaaccacaatctataaaataggcatacaaattcgaaggagcgaaagatgaagatgcaacaatacttgagagctcaaggtatcctctctgtgattatatttttttcatcatttcacacatcgatgttttgcgtcttgagatgtttattggattgtgcaagaacaagggtttcaatatatgcaaaanaaaacgacaacagtac

SEQ ID NO: 39178 - DNA, 416 bp, Triticum aestivum
  Clone ID: PAT_TA_39178
ggggctgaagtgatgggctgggccgattctgctgggccaccaggtgggtgggcctcaggtaagcgtcaggtaaggtttctctgctctgtcttttacttattgttttctatttttttctgcagctttgtggctttattaaaaatactaaatcaatcccaaaaatcatgcaactgctcatgaccactgttagaaatatattctacagtaaacatttcagtttgggattatttgagcatttagaatattttatagtatttaaatgcccaaatgcaaataagtaatgatttaaattcaaagtcccaaaaataaatccttttaaaatgttcattattttttgtttggatgaaaacccttgccaaaaatattaaacatctaaggagagcattttggagcaatgaatgagaattaaggttttt

SEQ ID NO: 39179 - DNA, 232 bp, Triticum aestivum
  Clone ID: PAT_TA_39179
cttcggtgatggttcgcttcattatccggagcccattacgacagtcatgactttcatgcaggggtacgctacctgcatgcgtgcgcaagttggttaggctatgcatggcgtcagttacctggctaagttgttacgctacgtgcatgcatcgcatggacatgggtgcatgtggttgagatattctaggcggtgactgtccgtgtgtgtgcatggatatagtttgctagactcc

SEQ ID NO: 39180 - DNA, 422 bp, Triticum aestivum
  Clone ID: PAT_TA_39180
tgcggtcatgttagtctcctcttcagagccagttagcagttgtggaacaggtggagctttactgagcatttgctcatggatctgtgtttgcaacagttctttgtgtcaaagaaacagaatggggcgtatttaagaagttcttcaaagtgtgttgggaattttacctcatcaattacactttggcgttctggggagccgaattttggtggtgtttcacgtgatttgatagcgagtgctcgtctatcttccttcttgtagtccagtgaacccaatgcgccaccaggatttgttggcatgaaagcaatcaatgctactagtgctgtgcgtactgcaacacgaatagtttggctcagatgtgtatacatcatatgaacaagaaaaaggaaaaggaaaagaagacacatataattaatataacacac

SEQ ID NO: 39181 - DNA, 304 bp, Triticum aestivum
  Clone ID: PAT_TA_39181
gacgggtcacgttgtcgagcttaggtttcacagggttcaaaaggaagtccgaggagatcgaatcgagtggaaaaggccgttgtaagttcttccaggctcgtaaacttgagcttatcagaaagttccagtgacttgcactaggtcagtggcactttcagattagaggttctatttcgtcgggctcagtttgtatgtttattctgcatggaacacttgcaagtccagtgaaaccgatgttggactgtactgagccggtggccaagactgggtcagataattccttaatcaatcctaatcctaaggc

SEQ ID NO: 39182 - DNA, 381 bp, Triticum aestivum
  Clone ID: PAT_TA_39182
cgggcagcataattaatgaggttttaacaccacaaaaaccagtaaataggatggagaacaatcgtcgtccgttttgggacatttttggtatgacttctggaaggaaaattgtgccagcacaacaagctgtggatcaggatgcttctgctgccaaggtggatcaaatagacatggagtcaaatgacatccgccgcttcgaacagttgagacgtgagttgattgagttagaaaggagagtgcagaagagtacagatggtgctaaaaaagaggagttccaggaaacggaggttccagatgaaacaatgagcccttctgagtcagcaccccctctgtcagggcctcctggttcagtaatcaagaaagaaaatgttattacaaaat

SEQ ID NO: 39183 - DNA, 399 bp, Triticum aestivum
  Clone ID: PAT_TA_39183
tgtaatcggctgggggccgaattggatatggcccccatcgccagtctccatgggggtttgctcccccatgtgtccagcagctgaggtttcaccctctggcgccgccctgacggcctcctgcatctctccctggcctgggatccttcgggacaacacctcggtgtcatccatggccctgggagaggaggccgccggaagggacccgctgtccatcaccttcgggtccagcgaattccccgaagatgaggatcgctcaaagtcggaacgagccggactacaagtgcatgattcaacatgttaaaactatgaagtaaaaaggctggatatatgaatgcgtcagggtctttgagtactcatgattcggccaggggcttatctcgggggcgccgctctgggctg

SEQ ID NO: 39184 - DNA, 390 bp, Triticum aestivum
  Clone ID: PAT_TA_39184
ccaatataaataaagaatgagttcattacagtaccttgaagtggggtttggtttccttccgcaaacggaccttacaattttccggtaaattttggggtggtgaattttccaagtttggggtaaaaatccaatggacaatggaacaaggattggcaaaagccaaaccttggggatgcccatggcgccccaaaatgatcaaaggacaccaaaaacacaattcttggggagcccccggaaggcatcccctctttcgtcctcatcaaccggtaactttacttggagctaaattttaatttaccacaagatatgtgttttgcttggagcgtcacttcattttcttttgctttgcttgaggtttgaataaaatatcaagatctgaaattatcaaat

SEQ ID NO: 39185 - DNA, 408 bp, Triticum aestivum
  Clone ID: PAT_TA_39185
tccggatatcaaaggtcgaccggacctcatgtcatgacatatcatctcatctcacgtgcacaacaaactttggattgttctggacatgtcttggttcattatttgaaaatttgattgctatggtgttgtttgaggctggtttgagcagaggaaaagttgttccttttttgatgatcatggtgatactgctgtcatgttgcttcttgtagtgagtagtatacacatggacctgataaaatggtccttgatatgatggaattagtagcatttgtgtgggtttacactgttgtgcctaaactactatggttgccaagccagcatccattgcatcaatcctcatgaattagtggacaatgtatagataaactctatggaacaataatgatagtgaatcagcacaatagttta

SEQ ID NO: 39186 - DNA, 481 bp, Triticum aestivum
  unsure (1)..(481): unsure at all n locations
  Clone ID: PAT_TA_39186
cgggtcgaccggttagctggaaaaaccctctgaagtttattgcagtaaacttgggtgaacactgatgatcaacacggattttactggcgccaaagagtttgtcttgggtgattaactaaggaaggactatgatcctggaggttttgtggcataatggagcacaaactaacatagttgctttgtagctcacattatgtgtccagaatcaagatttggatgatgcactcacatggagtaaccacttgaggtaaaacttggcaaggcttagtgacttggccagataaaggtgctataaaaatttcataccaattggttttaccaaaatggtacttccttcacaactatcttcactggccagaatcttgcaagaattctagaggagtattggctaggttaaattgtgccaaatttggtggagagaagttattttgtaggagaatactctagtaaattgtcaggcaaaatgaancaatataaaata

SEQ ID NO: 39187 - DNA, 260 bp, Triticum aestivum
  Clone ID: PAT_TA_39187
gtaagtgtagaaatgactatttgcagcgtgcatatttttcacgctatacaatgtcgagaatagacattgttgcgtgtattattatacttaatacatggttcactagttatattagggtggttctgctaatgttattcttctcgaactcgtgatcagttttgactgataaaaatgtccagtggcttcgaggattcatcatattattttatcatatgatatgttttttttcctatttttacattcgacagactttgataatg

SEQ ID NO: 39188 - DNA, 436 bp, Triticum aestivum
  unsure (1)..(436): unsure at all n locations
  Clone ID: PAT_TA_39188
cctgactaatatggacatcccgaccttcgatattgcatacctgcaacccacgattttctcgagctttcaagtactcccttcatcctaaattacttatcgcagaatggatataatttttttccgaaaatataagaaatgaatgtatataaaactaaaagtacataaaaaacgccacaaccctgaggagcaacgaatctacttttatcaaggattactactgactaactgcttcgttttgtataatatcgtcatgtttaccaggaaagaagggacgaaatttgcctgctcccctcgcgtgtgcccatccgtgctcccgcgtacgtggtttaatttgattgaaacaaaataaggcccggccccacctcattaaaatcagggggggagataattagattagaaaaaaaaaanaaaaactaaaaaaaaaaaaagcggccgc

SEQ ID NO: 39189 - DNA, 435 bp, Triticum aestivum
  unsure (1)..(435): unsure at all n locations
  Clone ID: PAT_TA_39189
cggtcaggccattccgggtcgaccggaatggagcaaagattggagctgtacaatcgagttcctcccaatggattggtgctttatactggagttttactatccatagaacgcatggagttggccggcagcggcagagtatgggagcagtggtggcggcgtggcatatcagctctcctagagtgagctagttgcagtagaggctaaggaaatgcagtagtgaacaccaaagaaatagatacgaaacgtccgcccgcccgcgccaccgccgaatctggcagcaagcgcacccgtgcggccgagttgcacaacctctccgagaaggcggtgtcncgcttcnccgtcgttaaccacttttccctgagtttcgccccgcttttctactgttctcttctcgccctattttcccggctgctcattgcttgcttgcttgattgg

SEQ ID NO: 39190 - DNA, 456 bp, Triticum aestivum
  Clone ID: PAT_TA_39190
gggaagaagaaggaggcggagggatggggcgcgggaagatcgagatcaagaggatcgagaaccagggcaaccgccaggtgaccttctccaagcgcaagaacgggatcctcaagaaggccaaggagatcagcgtgctctgcgacgccgaggtcggcgtcgtcgtcttctccagcgccggcaagctctacgacttctgctcccccaggacctcgctatcaagaatcttggagaagtaccagaccaactccgggaagatactgtgggatgagaaacacaagagcctcagtgcggagattgatcgaatcaagaaagagaatgataacatgcagatcgagctcagacacttgaaaggcgaagatatgaactcgctgcagcccaaagagctgatcatgattgaggaagcacttgataatgggctgacaagtctgcatgaaaaacagatggagcactatgaca

SEQ ID NO: 39191 - DNA, 237 bp, Triticum aestivum
  Clone ID: PAT_TA_39191
acggtcaggctagtccgggtcgacgcggcaccgccggaggcattcatatagagtcataccttggtctaactatcaattggaaatcctggattggtaatctatataaattgtaagattcaccataataaaacaatggcccaatgtggagaagagattatggacaataagacttccacacatctcgagatggcatccgactttataaaaataaaagaggccaaagatgctcagcagctc

SEQ ID NO: 39192 - DNA, 369 bp, Triticum aestivum
  unsure (1)..(369): unsure at all n locations
  Clone ID: PAT_TA_39192
cggtcaggtatnccgggtcgaccgggatgacattgtaatccagcaggacttaagtccactttggtcggtacatctcaaaggcagggttaatggtgccgtcaaaacctgtggtgagattttcaatatgtttgatacgtatctcaacttctcaaaccctcttatcgccaagaaatttgaccgacgtgcatgtgggtgggcatatggcatgaacatgtttgatttgtctgagtggagaacgcagaatattactgctgtgtatcactactggcaagaacagaatgaacatagactgttatggaagttangaacactccctgctggcctggcgacattctggaacancacttccctctcgatcgctcatggcat

SEQ ID NO: 39193 - DNA, 449 bp, Triticum aestivum
  Clone ID: PAT_TA_39193
tcggaaatccaaggtcgaccggcctggtatttgcagatatttgaactatttagtcgccataatattctcttgggctcgcctggaacctgcgtagaccaagtacaattttggtcttaagttgtagaagtgaagatgttaaatattttctaatgttcttaccaaaggaatgtgtaaataaatcatatatatatatatagcttgttcgcacgatagagcggacgacttaggtgcatagttgaaaatgtgcgtaaaattctatacaagcatacacatcttttacggtttgttatcgtgttaaatcatagcattcctttttatgatgattgtgcatgtaccttgggtatgtattctgcaaccttgacaaccggcctccactcttctgggggaggagctcgaacaagaatcaagaaggagccaaaggagtttacacaagagttaaagcatacaaa

SEQ ID NO: 39194 - DNA, 413 bp, Triticum aestivum
  Clone ID: PAT_TA_39194
tcggatatccagggtcggccggtcctccacggcgtagtccatttgccgcgacctcgccgccgtcagatccgacccctctagtactagtttagcgtagtatgtagtataactatgcttgtagttttttgatcatgtgatgaactatgtagtatgtgatgaactatatttgtgcaatttctcccgcgaaagtgttttttcaaattatgcaggtttagatacgggttctgttcggccgcgctagttttcgacccgcaaacgcgatcttcgtggaaccgcaaatgcgttttgcgggtcaaatttttgcagggtctgctagagttgctctaagcacacacatttttgcttccttgatagatattctggtttttcgcaaatacctatttcccaacctaatcaagaaaagaccactttta

SEQ ID NO: 39195 - DNA, 184 bp, Triticum aestivum
  Clone ID: PAT_TA_39195
acatggcaagtacaacttcgactgcttcaaccacagaaaggcaatgctgatccgccggttccgttgccaagccaacgcaaggtaaccaacctaaaagggaaacaaacaaaggatcctgaagggcctcaaccaaggcaacttccttgccctgatccttgcgcccctggggttcccaacggaaaaa

SEQ ID NO: 39196 - DNA, 418 bp, Triticum aestivum
  Clone ID: PAT_TA_39196
ggtcgaccgggcccgagcacaaatgacattctggacgcgcacattgcatgcaaaagcggtggttaccgcgtgcaggggtgcacacagtggcacacggccggccaaacaatgtctgggggcttgtccttcctggggaggttgcatctgatgtggtagattggttaaaagtgacacggttaaatggcagttaacacctgaagtttattgcagtaaactttgaggagcactggcgatccacaggagagggattggaaacaatggagttgtctggtagatttagggttagaaggactttcatcctggtaattttgagaagaattggaccactaattaatatagttgctttacaactaagtaatccggtccagaatgaagatcatgatgatgctctcaaatggagaagccacttgagctaaac

SEQ ID NO: 39197 - DNA, 259 bp, Triticum aestivum
  Clone ID: PAT_TA_39197
cttacccccggtatgtagttcgggcaagccctgaaccggaacgggcgttggctgcaaaattttttgggcgcaaaattaacaaaaggtggttttaattcctaagttccttaagttttccaaccttgaccgatgtttgggcccaaaatgtccggaattttaagcctttttgtgttaccttttcctgccgtggttaaaatttttttccctctaggtaatgacatgagcaatttttaagaaaaatttatacccataccaattt

SEQ ID NO: 39198 - DNA, 353 bp, Triticum aestivum
  Clone ID: PAT_TA_39198
cccaattatcccccaaaccttgattaaggttccccaaaataaggcccaaaaaatggtgccaaaatcccaatcccgccagaatggctaaggggttaatcctggggccggaatgcaaaaagggaaaagccaagaccaatggttcttggaacaatccaatgaccaaaggaacaaagcctcaaggtgtctaaaaaataattccaaaattggttaaatttgaagcctaaaccaaggaatttaacgggcccaaccttggggaaaattttgaagaaaatgtaaaaggcaattccccaaccttcgaatctcaatccacaaaaccttgacaatgaaaacccaacccagtttccaaaaaacaa

SEQ ID NO: 39199 - DNA, 321 bp, Triticum aestivum
  Clone ID: PAT_TA_39199
gggtcgaccgggtatgtcgtgaaaactacatatttctgctgaagaaactacataatagttttactgatcgaggaggaaattacttggcttcaatattggtaatggtagggagagaaagaatatgccattctctctagctggaaaggacactataccatactggatgttataaaaaaatttggtcatgcccccggaaacattgaccacctcaacgttgactctatttccgttacaatcaatcaataactggtataataccatgacccgtggcctgcttcttggcatatttgtggttgttcaaacctcaacaataaaggtttg

SEQ ID NO: 39200 - DNA, 249 bp, Triticum aestivum
  Clone ID: PAT_TA_39200
tccatgggtgataagataaactcagatgcagatgaccacaggttcagtgcgtttaaagtatgtatatgcgcagctgccgtaggtacagcttgacaactccttaggccgctcttgggagaccggtttatattttccaccagtattaatctacaaagggtattttcctgtgcacacctgagatacaagtgtaacgaaaacacgattgtaaaattctggatttctgctaaaaaaaaaaacatcatcaacaac

SEQ ID NO: 39201 - DNA, 464 bp, Triticum aestivum
  Clone ID: PAT_TA_39201
gccgtgagtaatagtgcagagaattcaccagaaaaataattcaattaaattcttaccagaattagaatgcccccaagaattttaagttaacaaaatggggaaaaaaaaacattacaaccgtccggtgtacggtcacaaagcacaacagccaaagtctgctcacttgcgtactgacatgacatgttggatccatccaaccaagtgatatggcgttatctaccgtgctggctagctagtgacccactgaccgctgaagtactgaacccatatacaccacgatagtattctggtcccatatgctcctgcagtccctacgtcgcgtggcttctagtatttcacgatgcatgataaatacttcctccatcctaaaattattgtcttagatttatctagatacagatgtacctaatactaaaatgtaatttgatacatccgtatttaaacaaatctaagacagaaatttt

SEQ ID NO: 39202 - DNA, 179 bp, Triticum aestivum
  Clone ID: PAT_TA_39202
gtcggccgggacgcgctcactaagtacaaggcgaggaggcggttgcaaacccggctccttaacaaggtccccaacttcattggcaattgcccggaatggcaacaccatggtaattgaacccttctggcaaaacaaccggttacccaatccaatggccggaccctccggcttttcataaa

SEQ ID NO: 39203 - DNA, 285 bp, Triticum aestivum
  unsure (1)..(285): unsure at all n locations
  Clone ID: PAT_TA_39203
ctgcaagatggaccatggttgtatccggacaattcaatttgtgttaaaacacacaaggtggcggcctaaataacctgacatattgccaggaatattggttaaattaggaaatggaagtgatttcagcgacaacaacatggaattttggtaatgatggtggacaattcctgggcaatggaaaacgcgacgcagggtcangggcttgtgcccttcggtgggaaaacgagtaacatgttgttcgggctggagttcgtgatggccaatggttctctacaatggggactg

SEQ ID NO: 39204 - DNA, 289 bp, Triticum aestivum
  Clone ID: PAT_TA_39204
gtcggccgggcaaaaaaatagtatcaatgtgcttcatggccaagtgacggttggcatactcgtaatgcaagaatgtgccggtggtcctccggttggaactcctccaaatttgaaccgggcctccgggtcctcctcaagggagttgcgtccaatgacaaaaatcccctggtgctattaaatatccgttcctggggaaatctctctatccctctcccggtacattgtgtgcccttgggtttcttaaagctgatgataaagtctttcctcctcagacaaaatgaactgtacc

SEQ ID NO: 39205 - DNA, 249 bp, Triticum aestivum
  Clone ID: PAT_TA_39205
gggtaaataagaaattagagttatggctagatacgtcggcctgtgaattccgattgcccaaaccggaggcataggtaggtcgataatcatgccttacgatcgcacttgtccaaaacttacggtttgtcacaaaagtacccccaccaatttgaactaccgggcctttcggctcaggtttataccggggatttcccctgttgggattttgacacctgccggacttttcgcgcgcgttgtaatttctggata

SEQ ID NO: 39206 - DNA, 394 bp, Triticum aestivum
  unsure (1)..(394): unsure at all n locations
  Clone ID: PAT_TA_39206
cggaggaaaagcaaanaccgaaaacggcaagggaccccggggcttcccgcaacccccaatggcgggaaggaaaatccgcctcccctaagaagcaaccccatgcccaccgaaaggaccggggatggggttactaacaaccttcagctatgcttacaaaacaaactttgggggctcccaaggccagttcaccaagctaacaaccggcggcaacttgaaccaaaatgccccattacccaatgggaaactaaacatggcaaaggaaacacctccattaaaattataaaaaccaaagatgacaccacctaaataaatttgggtttttatgccaccctaagggatttaaaaaaacgcttgttggaagccaaccccattttatttttgtcctttgcttttt

SEQ ID NO: 39207 - DNA, 406 bp, Triticum aestivum
  Clone ID: PAT_TA_39207
cgccccataggaaggagtggcgacgccggggctgctaaagcactggaccacggcgtggagatggagacagaggttgtcgtcaccgccggcgagttatcgttgcaccctgacgtcgtcgacggtgtcgagcttccacagccggaggcagagttccacaccgactccgacgaccactccggcgatgactccgacgaccactccggcgacgactccgacgaccactccggcgacgactctgatgaccactccggcgacgactccgacgacgacggacagctggttagtcatctatacccatttatgtgtcaaatagatcatagggtttctctggttaatcctgcctccccctttttggaatagaaatcctatggttatgttctcccaatccatgaaatctgagtaagtt

SEQ ID NO: 39208 - DNA, 394 bp, Triticum aestivum
  Clone ID: PAT_TA_39208
atccatacagaactgaaggacgggaaataggatgggacagagagagaggagagagagggagggagaggggtagagtgctggatgggtgatggagttgcttctcgaagagtggggatgtgtttctgtgtgtgcctgtgcgtgatagagctgtcgggacgcatccatggatgatgaaggggaaccatgtgtttggtaagcaaacctaactagatcggtagatcaattgttgtttgtcggaggaagggagagacataactaatgaggtagatcgatcgacgcgtggggaaaaacgagttataaggacctagctagctatatgtatagcgggagatcggtcggtgtacgtccatttgttagaggcaaataaggcccggcgagacggatagacagagag

SEQ ID NO: 39209 - DNA, 462 bp, Triticum aestivum
  Clone ID: PAT_TA_39209
ggtcaggaaggccgggtcgaccgggacccgcactgaaaaacggtctaccaatagacatgggtggaacatacgactgagctggggaaggcaccacataggatggcctcggtgtatatccggaaggaagagcggagtttggaacccaaatccggcgcttctgggaactagagccagaggaagatcccaatatacgggtgtgcttacgagactcctcgtaagtgagctgagctgtctctgcattgatggccttgttcacaagggcttggaatgtatcacaatgatgcaggtggaggtcacggcgcaacttgggggttagaaccctttggaatctagcctgcttcttggcgtccatggacacttcttctgtggcataacgggcgaggttctcgaactctctgctgtaagcatcaacagccatcttattctgggtgagactacagaactcttctctcttgcgatcga

SEQ ID NO: 39210 - DNA, 280 bp, Triticum aestivum
  Clone ID: PAT_TA_39210
cgggccgactggagagccagtggaaagcaagcacgggaagacgaggactatcgcgagcggccggcgagcacacagatctggcatgcgcgctcgctgtccttttttttgtgtttcctgtgcgtgtttttttttctgcatgtttgacttttaaaacaaagcaatcagacggtggggaacggatgtatcgggcggctggggcttgaccggacgaacagttcggccggtgcgccggcgcctataagcgcccttatctttaagcaaccaatttggagttttggac

SEQ ID NO: 39211 - DNA, 395 bp, Triticum aestivum
  Clone ID: PAT_TA_39211
cgggtcgaccggcggccgtagatagttcatggtcgctactcactccgatggaggccagggagcatttggttactggatctatccgctgggagatggtagctcgggatatcttcaaccggtttggatggcagtcatgtaatagggtaggcaattagtttacctatttatctttagccagccggttgtggcgtcttatcttggctagtctgtgtgtccagcctctttaactctgtgtgagctgtctttttactacttttcggtcggagactttggaaccttgttggaactttttatttcgttaataagatggccgtatgcatcactctgatgcagtggccggggagatccccttttcgaaaaaaaaaaaaaaaaaaaaaaaaaaaagcggccgctct

SEQ ID NO: 39212 - DNA, 405 bp, Triticum aestivum
  Clone ID: PAT_TA_39212
cgggccgacgggagagcgcgcggcggccgacgggcgatggcggcggcgacagcgggaggagtttgatttgggggacgtggtcgtggggaagaacgaaccgtgcggttaagtcagaagtagcagtagcgcgttccaagaagtgcgctactgctaagctagctacagcgcattcctctatacgcgctactcctattcctttttcttttttcccctttttcatttatttttctttacattttattttttttcctttcacctttttctatttctttcattttcatttactttccatttaattttatttcctttagcagtagcgcctttcatcgtaaacgcgctgctacaaagcaggtagtggtagcgcggttctacgtacatcgctactactatgcgtagcctatcggc

SEQ ID NO: 39213 - DNA, 458 bp, Triticum aestivum
  Clone ID: PAT_TA_39213
cgggtcgaccgcacctgaatacagaaacctccaatctgcagtgtacatggaatagcgcagtctatggtcacatcatccccttccccttcaaaagaaaccgtcctcggtttcgaggcagtctttgcaaccttcttcttcaatgtgacatgtccatccccttgattgcgttctcaaacatcggccgcagcacgcgtcgcttcctagaatcccagaatgaatatgtattcgtccgaccttcatgtgtagcattgtgatcatattgccatggtctccccaataacaagtgacatgcatccataggtatgacatcacatatcaccatatcagtataatcaccaacataaaatttgacgcgcaccttatgagtaacctttaacttccctgtatgatacatccactcgacatggtgggggttgcgggtgcttccatacaggcaaccccaaagcttcaacaaaccc

SEQ ID NO: 39214 - DNA, 480 bp, Triticum aestivum
  Clone ID: PAT_TA_39214
cggtcaggccagtccgggtcgaccgggtggccttcaaggagatgccgaaagaagggtgcttgaccgtgagaagggggtccgtggcgtggattgggtcagggccagagttcctgatcagcctagctgaccacgcggagtggagagacgcctacacggtgttcgggtccgtggtgccggaggacatggccatcgccgaggagatgtcgatgctccccgccagcacagacgtctggagcggtgtgaccgtcaggctgctgaaggacccggtgtatatcaaggtgaagagaagaagcaatgcgactgcctattgagctcgccagcgattttgttcttcttcttcttcttctttcacatgatgtagcagtagtgccaaaagataagaacacaaaattacatgtccaaacaaagaaagaaagaaaatagaggaggtttggaagagaactgttacacctgtggtttctgtgcccgtcagcaagccat

SEQ ID NO: 39215 - DNA, 472 bp, Triticum aestivum
  unsure (1)..(472): unsure at all n locations
  Clone ID: PAT_TA_39215
gggtcgaccggttatgcatggtgaactttgccacaaatacgatgtcaactacatgatcatggaaggcaatataacaatagtaatgtatgtcatgatgataaacagaacggtggaaagttgcatggcaataatatctcggaatggctatggaaatgccataattaggtaggtatggtggctgttttgacgaagatataaggaggtttatgtgtgaaagaccgtatcgtatcacggggtttgtatgcaccggtgaaagtttgcaccaactctcaaggtgataaagggcaatgctcggtactgaagaggctagcaatgatggaaagataaaagtgcctataatccatggactcaacgttagtcaaaagaactaatatacttattgcaaaaatctacaagtcatcaaaaaccaagcactacgcggaagctcctagagggatagattggtangaaaagaccatcgctcatccccgac

SEQ ID NO: 39216 - DNA, 398 bp, Triticum aestivum
  Clone ID: PAT_TA_39216
ccgggccgaccgggagcacaagaaagcggaggagcacaagaagaaggacggggagcacaagaaggacggcgagcacaaggagggcatgatggagaagatcaaggacaagatcagcggcgacggccacggcgacggcaagaaggacggcgaccacaaggagaagaaggacaagaagaagaagaaggacaagaagcacggcgagggccacaaggacgacgacggccacggcagcagcagcagcgacagcgacagcgactgagccagctccggccgcgctccggcagcagcgtgcagtgtaggcgagatcgatgaacgcttgggagaagtgtggcatacatatatgttgcagggtttggagcgtgtggtagcatatgtatgtaatgcgtgacatgcctcat

SEQ ID NO: 39217 - DNA, 333 bp, Triticum aestivum
  Clone ID: PAT_TA_39217
ccgggtcgaccgtagcccgtggaggatggcggatgtcgatggtggagatgaacagtatcccgtggagtcgcgttttgcggtacgccacacccctcccaatgagatatgacccccattccttctccccgcgctagaacagagatgcgcctcagtagggcagcagcagcagtagcgtctccatggacgcggtggcatgacagctcccaggcacggatcccctcctctgcctccatcctccacctctccggtcggcctgttgcaatgtccgaagcagcagcaagcgacctgcagcagctcgttcctacgttccatggacgagctcgatggagacat

SEQ ID NO: 39218 - DNA, 394 bp, Triticum aestivum
  Clone ID: PAT_TA_39218
actcttccaaacccactttcaataatattgcaaacactattatcaatctcatatttatcatgggccttaaataaatttcaagttcataagaaaaatcaccccaatcacgatcatcacaacaaatagtagtcatagcaaaactagcatccccaagcttgaggttttgcatatcattagcacaattgtcattaagagaatttatgatagcatcatttcaatcatgcttttcatcgaaggaactatcaagtacgggtgcaatagcaacaatctcatgtttaacataaggaactatagcaaattcatattcataaatattggcatcatggccacaagaatagcaagaatcatgatcatcaagggatatttcaatcatatcttcggaatcacaattatc

SEQ ID NO: 39219 - DNA, 243 bp, Triticum aestivum
  Clone ID: PAT_TA_39219
acggttctggtgttcgccctagtattccagacgctttaaccttattatagctgtcccagcgtatatgctctgcggtttcagatgaagcgagaatgtcttatcatgtttgcggcaaccaattcgcgactcggatcgaatacatggggcgtcattctatttcagctgtcgctcgacaggatcgattcttacttacccctgcatgctactttctagttcttctatattgtcacctaacttcacttc

SEQ ID NO: 39220 - DNA, 427 bp, Triticum aestivum
  unsure (1)..(427): unsure at all n locations
  Clone ID: PAT_TA_39220
ccgggtcgggcgagccgcaaaggtgcactgtcctccttcgccgtctttgggctggccattgtgtggttccttcagatgaactctgaggacgaggagtacatctccctctgatgtggttcctcgctagagatagggatcatcaaattgtgaatatctacagtacgatttggagcattggtgtttgagcttgtttgtaccagtgaagtgaggcattttcagttgcatgtagagttatcctcttcatgcagtcgtgctagtacatgatgtttgatgtttttgtgcaggctcttgacctcacttgcatcactcagttgtttgctatggcatcactgcatactctgcctaggtttggccattttaatttttctgtttcctctgcctgtgcctcgagtagtctctagtantagttgccacgagatgggagcaa

SEQ ID NO: 39221 - DNA, 440 bp, Triticum aestivum
  Clone ID: PAT_TA_39221
cgggtcgacgggtgctagtatttatgcatgctatgataatttgttttcctataagatttctatgcataggaagtatgttagactcatatgtgtttgtcacatgttttatgatgctctctttgtgattcatttgctatcattcatgtgagcatcattaaaattaccaatgcctagctaaaaggccttaatgaaaagcacttgttgggaggcaacccaatatttttcttttctgtttttgaataagtaattcatctagcctatgtttagatgtgttttgtgttttaattagtgtttgtgccaagtaagacctttgggatggcttatggtgatagttgttttgatcttgctgaaaaacaggaacttttgcgcccaggaaaataattttcatttttttaaataagcgtgcttttgatctgattatttttgcacagattgcacac

SEQ ID NO: 39222 - DNA, 399 bp, Triticum aestivum
  Clone ID: PAT_TA_39222
gacgggtaacatcacggtagtgtattttgctggagagaataattttggacaacattaaggtggcaaatttaatacacatctgggtgggttgtttggggcacctagagaaaccggtgcttgcccatgggaatcccggagtactcgtgtgattaccctaggcccgccacccaggctcaaaggaatcatatgatatttcatgcctagaaacttccgtgtgcagccacaagccattatgggctctggcatagttgagtgagttgtgtaacctctttcagtggtggactagcagatgtaggggaaagtaggtgtatcggtctacccagagtaaagagttaatgcttcagaaagactatgtctcaatcttccgatcatggatgtggtcgagtcttgtggggaaaa

SEQ ID NO: 39223 - DNA, 103 bp, Triticum aestivum
  Clone ID: PAT_TA_39223
ccgggtcgaccgggagtcatatctagttctagttttgggttgtaattcaagagttgtaaataaatagaagtgtgatgatcataattattagagcattgtctcc

SEQ ID NO: 39224 - DNA, 427 bp, Triticum aestivum
  Clone ID: PAT_TA_39224
acgggtataatcacggcagtgtatttttttgtagtggtaagatctgttagtataataaagcaaatcagcagtccaagtagtgtaacacatcaattcatattttatttttgcattgtgtcgactttaagatagcttttccatggcttaatccagtgatataaattgatagtttcagcaaaacaagcaaactatgcatcattaatagaatctgtcaaaaacagaacagtctgtaccaatctgaacattcactaggcttatgctatccccattcattctaccagaattatgaaacatacacaagttgtacatcaagacagttcacaatgaatcacaaccgtttgacgttccagttgaaaatgtacaatcgtgcattacagccaaagtttctgtcctgcaccgtacatactagcatccattgtaaacatct

SEQ ID NO: 39225 - DNA, 420 bp, Triticum aestivum
  Clone ID: PAT_TA_39225
cgggctcctagattggcaaggacaaatatccttccatggaccaaaccaaacggatacaaatgaacatgccacccgtgcttggaaaaatatcctggagcggcatgcatggacccgtaccgcctataccacgtgggcccggttacctgtccaggggcccactggcccgcgcgccaccaccccactgacactataaaaagaaccatgcgttcacagtccacggtcacaactcagaccaacacatctgctccagtcaaaactagctcttagccacaagcaggttaaaaatttcaacgaaatttcagtgaaatttccgaaatttcagtggggtgcgaaatatctttaaccctgaaagttcaatgcagtttaaaagtaaattcaaaataaatttaaaattttgtttaaattcagtaaaattaaatt

SEQ ID NO: 39226 - DNA, 404 bp, Triticum aestivum
  Clone ID: PAT_TA_39226
attcgcgggccgacgggagcatcaacctagagctctgcatcatcctctacaagcaagtaccgaaccaccatggccatgccactcgccattgtgcaccaatttgacgacgatgatttccacagctttgttcatggatggctggcttacgaaaagctcacgccgacgcctccggtgtggcttcccctacgcctccagcatagggttcttgtacatgcgaaagtgcatgatttttcgatggttgtctagctgcagttgtctccccatgtaatggcatcaagttcagagcgccccaactgcctctccttcgaccgtggttcaggtagtggctcggtctccactgtactctatcccttgctctgtggtgcctggccattgtgcttagtccatgctgtgatccttgttgt

SEQ ID NO: 39227 - DNA, 401 bp, Triticum aestivum
  Clone ID: PAT_TA_39227
cgggccacaccatgatgcaggaaacataagcccctggtgtattttacccgtaccaaactgtacagatgcaacatgcagtacatgatcatatgtacataagtgaagtgcagttatcagcaaattggtgctgcattgtttattcaacaaagactgctgtacaggcatcacgatacaaatggtgcaataagcaagggatgggactgttacacatgtccccctccaagggtaagctgccgatggtgcttacaacagatttaatgctcgtaatgcataccacctggatattcattgtagcctttatccttccctgtctgtatgcatcgtcagttcggcaggtctgctgccggccagggcctctggcgaactgtgtcctacaggtaggcggcaagaatggaacaaaa

SEQ ID NO: 39228 - DNA, 167 bp, Triticum aestivum
  Clone ID: PAT_TA_39228
atccgtaatggatgtgtgaataatgggaacttggatttgaatacacccactaacactaagttccttccgttgtgccaagctggtgtgaacttgtcctgctttccgcctgacctaactgatgcccctaattggggccctcgaaggaaacttcaacactggaatccttc

SEQ ID NO: 39229 - DNA, 226 bp, Triticum aestivum
  Clone ID: PAT_TA_39229
aaaactggcaagtcctgtatatatagccagagcatccgtcccggttggtggctccaaccgtgactaatgccccctttaattccggttggtgccaccaatccggactaaagggcatgttctgcccgcgtcgcgacacgaaagtttaatcccaactcgctaactgaaggaactccaaaatggtttaaaagccctaatcccgctgccctctcgaactcctttcaaatgc

SEQ ID NO: 39230 - DNA, 365 bp, Triticum aestivum
  Clone ID: PAT_TA_39230
cggcatgtttatcaagaaagataactcagatggcactgacatcttcgttaataaagtaattacccacagataggtaggtcaccgttaattactggtagtttgataattaccccttcgacagcaaaaactatatttaaatcaaaccttgagcagattttggacacaataaattccttgcagtaatttaacctactaatggtcacacaaactaacgaaccattctaatgaatcataaactatacaaacacatgctatgatttaatggttataacataattataataatataaaattaagtaatagaacatggaaagtgtacaaatcaagtacaccagtttccccataataaacgtactactatgttt

SEQ ID NO: 39231 - DNA, 446 bp, Triticum aestivum
  unsure (1)..(446): unsure at all n locations
  Clone ID: PAT_TA_39231
acgggtcccataaacgctgatgatccacaaaccgcttccgccatcaaccactagaaaccatttgttgtactcacagaccataatggtcttgtactacatatgttgtattttgcatggaatttctgtatcaagttggtgcctcatcagctaacagttatcctggggctgatgagcacaagggccattttctgggaattaacacccggagattcggtcgccacagacttggtatcagagccaggctgaccattggctaattctatcttagccaggtcggataacttaggtaaaccaacctacgagaccctaaccaaaaccccagccaagcttctcgtgcaagatagccacactgtggtcncgacactttttgcagtcggtgcccaacctatcanattagcctgtcgatcacataccagttgacgatggcaaaaatgtctcattcgcaa

SEQ ID NO: 39232 - DNA, 364 bp, Triticum aestivum
  unsure (1)..(364): unsure at all n locations
  Clone ID: PAT_TA_39232
attcgcgggccgacgggggaggcgaaacgcaagaccgcaagttattccagtaccgcgatcccgccgtcgtcgccgccgtctggaatcgcctcgccaccgcctggattcgccctcgaccccgactgcaaacgccgtctgcgtgccgccgcccgccgcgtggggcagatcaaggtgcctcagactcatctttcaacaacatggatggccttagactcccctcaaccattgggaaagcaaagagctacgcatcttcttccttaggagctctgcgaaagaagatgcctcaatctggaagccgatctctacacacaagtcgcccccggtcagctcctgttgcanaccgcccaatggtccccccatcttc

SEQ ID NO: 39233 - DNA, 401 bp, Triticum aestivum
  Clone ID: PAT_TA_39233
attcgccggtcgacgggccccaccacccaacaatgctcaatgttcatccagaggcagcatcaaccggcttcagttagcagcagtagcgaaggaatcactcaggctcagttaacagcaagggatcgatcgatcgatcgggttcagtaacgcgtagcctgcagtgcaatcgctcgggttcagtaggcaaacgcctcgctcgggttgtcatatggatgatacgtctccaacgtatctataattttttatgtattcatgccatgtttataatatttctacatgattttggtatgatttgattagaactaacgttgatttcagtagaactatcgtggtgttgtttttgtgcagaaataaaagttctcggaatgcactgaaaatcgacggagattttttctggaaag

SEQ ID NO: 39234 - DNA, 416 bp, Triticum aestivum
  Clone ID: PAT_TA_39234
acgggcacataaatcctatttgcgacaataagaacatcattaatccttcccataggttttttaatagtggaatccgcaagatgcaaatttaaaagaacaatcatcaaattcacggaaacctaacacatcacataaagtttttcgaatcatggaaacgctagcacccaaatcacacaaagcatggcactcataatctttaatcttaatcttaatagtaggttcccactcatcataaagttttctagggatagaaacttccaattcaagcttttgttcaaaagattgcatcatagcatcaacgatatgtttagtaaaagctttgttttgattataagaatgaggagaattcaacctggattgcaacaatgaaatacaatatattaaagaacaattatcataattaaattccttgaaat

SEQ ID NO: 39235 - DNA, 403 bp, Triticum aestivum
  Clone ID: PAT_TA_39235
aggggatggacaacttgctccgtccctgatgggccgttcgaacgtgcgaacctggaggaacaccggttctccatgacacgggcaatccgcaactccggatgaagcctgttggctggcattggcatggcacgccgcgcctaataaaacgtgatgccattaaatgccctctgcgttcctccttgggctgcctcatcgacgtaacggcatggctttgtaactttgcattgccctccatgaaataacctgtagatatccgcttgtgtggtccggttgtttgagagatgtggcgcgagagaaacgcggtcttaaatcacaaatttctcgcctatgcagcgagtcatcaatcaggttaaagcccgatgagggtttctagttgaagatggatagcaaaatctggatgttc

SEQ ID NO: 39236 - DNA, 459 bp, Triticum aestivum
  Clone ID: PAT_TA_39236
ccgggtcgacatgattatgtaattatgaacgggctcatgtactccctagccggattgaaaatcatttatcatgacggaccctttcgcttcagcccccggatctgacagtccggggtgtatccgaatacccacacagttatgaaaacccggggtatgcgtggaaaccatgtgtaggggtcataagtgcttgaacagacaagtacccaactagttaagttatattacatggatagtaagaaacatcttccagatagaatagttccgttaggggttcctttctttgggtacgcatgcatcgatgtgcatgtccgaactgcgaacagaagcgcagaaaacaaaacatctgggtatttttgttgttctgaacgagaacatcttttgttcaccgaccgaatattcccttaagaacgctagctttcggcttcacccagtctgaggtacacatccggctcaaccggc

SEQ ID NO: 39237 - DNA, 426 bp, Triticum aestivum
  Clone ID: PAT_TA_39237
gactgctttctttgacctgtctgagtttaccaattaaagcttacccttcgtgtttcttgccggtcagtgttgtcgtttacaagggttgttatgtctatcctctgctacccgcctccattataaaccctccactagactaactgaaataaaaattattaagcatgatccgtttatcagttgaactgttagaactaataaccaaaccatgctaacatcaattataaaagaaaataatagtggtgatttttgtaccaggaaaaaaattaccttggaggataattttggttgtcaaaaagttgtcttgtcgttcaaccaaccatgaagttatgccaatttaagaggatagaatggaactaacgcaaaatgtactcattagattttgaaaagaacatgatccctttactgtattatttagttaattatata

SEQ ID NO: 39238 - DNA, 408 bp, Triticum aestivum
  Clone ID: PAT_TA_39238
cgggttctcttacttatacaaatcattcatgaatttcttgtaggatcaaaatggccatggcaaaccttcaaagaatttaatttccaaaaccaaaggtgaaccaatacaaggatgaaggacaaataattcaaatcaagatattcaattcattcaaacaattttctcataggatataagtgaagcacaagagtaaatgacaaactactccaaaaagatataagtgaagatcaagcgagtagttaagtaaaggggtagctaattgaggactctctcttatttaaaaactttcaaatctaagtattttattaaaacagcaagcaaaatgaaaacaaaatgacattccaaggatagcacacatcatgtgaagaagcagaacttaggctcaaccgaggctaaccgataattttt

SEQ ID NO: 39239 - DNA, 147 bp, Triticum aestivum
  Clone ID: PAT_TA_39239
cggtcgacgggcttgttaaggatcgagactgtaaactctgagctgttcagaaaaaaccaaacctcaatccaataattaacggttaaacaagttaaggcgttaaatgtccctgttttcacacaacaataaaatcttgtacgttctctc

SEQ ID NO: 39240 - DNA, 287 bp, Triticum aestivum
  Clone ID: PAT_TA_39240
catggcgaaagccgggataagatggccaagatggccatagaattaaaagccgccgtttgaccgttgccgggttcttggaaaaggaaaacctaaccaaagcatcggacttgagaaagctgttgcgacgaggaaagacatccgctctgctatgagggcgaagaaggaggagctgcgggaagccggggatatggtagctgggaaatcgtttatgttgcggaggaagttcggagattcacggtatgccactctggatcggctgtggagttcggagaatgtgtatatggatt

SEQ ID NO: 39241 - DNA, 383 bp, Triticum aestivum
  unsure (1)..(383): unsure at all n locations
  Clone ID: PAT_TA_39241
tatcaaatctanaaaaaattttaattcggatagtccaaaccaaaattacccccggaaggccggaaaccaatacaaccaaaattggtgggtttttaaacaatcccggaaaatcaaaccccgacaaaaaggggcccaatccccaagccaaggaaatgacgaaccccaccaacagaacaccggaagtcaaaagactttcccacaagaagtcaaaacagtaaactcacttcatgtgatagtacggaaaaccaacacggcactcgctaagacaagtgtcgcacggtccaccccagcggaacaccgatattggatgtcaaaaccaatcactttcgaccatctggatacaacanacagaccgtcaagtaaaaaaaaaaagcggccgctct

SEQ ID NO: 39242 - DNA, 397 bp, Triticum aestivum
  Clone ID: PAT_TA_39242
tttagctcggatatgtcaaatccacagtacctccggaaggcctgcaaaccataccaaccaaaattgttgggtttttaaacagtccggcagactcaaggccggacataaggggctcgatgcgccaagcgaggacaatgacgaaccccaccagcagagcaccggcagtcaaaagactttcccacaacaagtcaaaacagtaaactcccttcatgtgaggctatgggaaactaatatggaactcgcatatgagcaagtgtctcattgtctacaccatgggatcatcgatattgcatctaaacatgaacaattttccaacaacgggcatgactgcaatgattttactataaattctcttgaggtccactgtgcgatcaatacgcaaaacctcaaccttggg

SEQ ID NO: 39243 - DNA, 171 bp, Triticum aestivum
  Clone ID: PAT_TA_39243
gggggaaacgaaatcagaaaaatcgtggattaaatccgagaaaaagaaaaacaatgaacagattaacaaacgaacgttcgttatctggacctaaacgatgaacgcgttctttaaaacgaatgaacgagcaaacgctcgctaattaaataaactggaaaactgatctacaac

SEQ ID NO: 39244 - DNA, 130 bp, Triticum aestivum
  Clone ID: PAT_TA_39244
gtagcgtctacaattctaggtcgacgggcagttgaatatgttagtggtcggccaaactagtatgacaactgatgaatgcaatcgattgttaaattcgggtgaaaaaaacctccaactccttaatcaaaaa

SEQ ID NO: 39245 - DNA, 356 bp, Triticum aestivum
  unsure (1)..(356): unsure at all n locations
  Clone ID: PAT_TA_39245
cgggaggaaggaagaaaaaaaatcggtggtggtgggacgaaatttaactggtttaaatgaagagggagaatgccggcagctggaattttggacttgaaaatgagcaaatattagagacctattctgcacaactccaaaagtcctgaaacttcacggagattagttttggaatatattaaaaatactgggcgaagaaagcaccagatggggaccaccagtcagccacgagggtgaagagcacgccctagcccctgggcgcgccccctacctcgtgggccccctggcagtccccgactcccatcttctgctatatggtgtctttttccctgnaaaaaatcatagagaagcttttggga

SEQ ID NO: 39246 - DNA, 447 bp, Triticum aestivum
  Clone ID: PAT_TA_39246
ccgggccgacgggatgcacaaaattttgcattcagtgcatcccacagaatttttccgtcgtttatgtgcatgtacacatcacacagacggtcagcaagaacactcagaatgcatcccacaaacatagtattggcttcctggaattttctccgatcttcgtcggtcattccctctggagcatcaacactagcgtggaaaactttcagagcagtaagccagagtgttgtcttcacctgccacctcttaaagtgcacaccgataaacttatccggcatcagtgcatcagcgaatccagccatagttaactcaggaaattgcctagaattaggtttttggattgttggaatatcaggcaagttcatgattaattccagtaaataattcatgactagaagagatactagcatgcaataatctagcaaactagaagaccagcaggacatgcat

SEQ ID NO: 39247 - DNA, 322 bp, Triticum aestivum
  Clone ID: PAT_TA_39247
gggtccacgggccatgataaaataagctcgagcacacatcaaatcctaatcacatccacataagatgcatgacaccaagctaacagggtatttccagagacatgtctgtgatatactcgcacgcaacgtccaggatcgatcattctgtgatatgaacatgcattgccacatagctttgcatgatggtagcatatctatgatgatgtttccagagcttgtccgtttgtgacgtcgctgtgatgcaagttcaatgtccaacgcggtacactgccggaggcattcatataaactcaggtcgttgttcaagtttcgagctgcaata

SEQ ID NO: 39248 - DNA, 315 bp, Triticum aestivum
  Clone ID: PAT_TA_39248
gggtcgacgggggatttaatcttactggtgtatgactatgtaaggtcttgtgtgaataattaataaagtggttgtatgcatagtccagatgcagaggccgggttcctcctttttcaaaaaaaagaaagaataatagacaggcaccagcaaggtcaagtgaaagcatgcatctgcagcaggtgatcagctaagacaactatttgcgtaccaatcaatgtaaaaaatacaacctttaatttgttcattgtagcaatgatacggtgctagtttaaagtaattgtaccagaaaattagacaaaagacatcccaagtttt

SEQ ID NO: 39249 - DNA, 405 bp, Triticum aestivum
  Clone ID: PAT_TA_39249
ccgggtcgacagtaggcttcatataaatgcaataaatccattagctgatgcgtcctatcattagctcttatcaataattctattaaattttgaagctgacctgtccgcccgttggctttggttgccacaacaacggattgcttgggatactaataggatggcttgggatttgggagtacgattcccaaacgtgttactatcatatttggcttgcagtggttgtgcaggaggaagatgttgcttgattggagtccctcggagcctagcagtgctgctcagccctatgcattccattggtcgcctcggtaggtaattgggatcctcacgctaccaatttggtcatccctaggaaacatcaaggagatgatgagactgcatcttgagaagaagcattatttacaactc

SEQ ID NO: 39250 - DNA, 435 bp, Triticum aestivum
  Clone ID: PAT_TA_39250
cgggccgacggggggatcaatcagtcgcgggcgatgcggatgaatcgggggcctgccgatccactcgacgcggtcgaaccgcctgcgtggaaagggtgagacgcgggcggtaatggccggcgcatcattacgacttctgattttccatatttttacatgggaacaggggagctttggaccttgtgtctagactacaatctaaccatcaatagccagcagcttcatccgcgtaacactgaaggtactcctggaccatgatccatcccttgggaaaacgtttgccgaatcaaaatgtggctcctctgatttgcggcaattagaggccacctcaaggtagtgaaccttctgctgggttggttgaactaccaaaggcgaacggaacaacaattgcacataccctttattttcctggtacaggcaatctccagacatgac

SEQ ID NO: 39251 - DNA, 267 bp, Triticum aestivum
  Clone ID: PAT_TA_39251
catatatcaatctttacctccgaaccattccggagatcctcgttatgtccgtgatcacatccgggactccgaacaacatttggtgaccaacatacataactcatataatattatatcgtcaacgaacgttaagcgtgcggaccctacgggttccagaactatgtatacatgaccgagacacctcccaatagcggaacctggatgcccacattggctcccacatattctatgaagatctttattggtcgaaccttatgacaacatatg

SEQ ID NO: 39252 - DNA, 277 bp, Triticum aestivum
  Clone ID: PAT_TA_39252
agtcgtgatagagttagaagttgtaaatatgcattgttgtatcgcgacgtgaatgaaataaatgaaataatgctcttgttcaaaaatatcataaattagaatgtgaggtagtattaatgtaaagtataaaactgaaaaaataactgtagttcagccgatttaaaggatgtaaggttatttacctttgcatgccacgtaataactcttctaaagtgtcatctaatttcagttcatgggcgttctttttacaggttattaactgggaaacccctggctt

SEQ ID NO: 39253 - DNA, 256 bp, Triticum aestivum
  Clone ID: PAT_TA_39253
gggttgaactaacgtgagtcgtaatatagttttgcttgctgtttgaatataatagcaagatcttaaagtattagatgttagagagtcttcacatagttgcataattattcgaaactcattgatgctcacttatatctgttcggagtatttagttatctgctccactgcgtgacttacaactttctagctcacggtggcggttttattttgaatgatctacatatctcgcgtgattaacttatgatattgtgagagt

SEQ ID NO: 39254 - DNA, 425 bp, Triticum aestivum
  Clone ID: PAT_TA_39254
gggacacacgaaattcactctcattagttgcagctcgttgtaactatagtccttcaataccttggcacgcatcgtctccatatatttgattactcgagccgctgcaatgtccactgcatcttctgtagaattgtatgaatagccagacaatgacattgcttcataatcacgtcgctgatgttgtgtgctcggacgaacctttaatgtgactgctaatctttccccaactttgtagcagaagaacatcagtggtgggagctgcaacttaatgaacattacatcaagcatgaacttgtctgtaatgtcaacgacccccatgccagtttctgtcgatatagagaacgtgccaatgtctgaaaatggttgtagttgcactcatgcactgcaaagcatatgtaagtggcagaaatgatgaattagtaact

SEQ ID NO: 39255 - DNA, 433 bp, Triticum aestivum
  unsure (1)..(433): unsure at all n locations
  Clone ID: PAT_TA_39255
ccgggccgacgggtaggtttattagcacaatatatcagatgaatgtcttttctagggctagaggaggtaatgttaattggtttgcttgggaagtgcctatattaattggtagtcaaagttaaccggcatttagtaaagcaatgttgtaggactgggaaattttctttgatctaatgtgctaaagccagttcgggtttgtgctaaacttttgattattctttcagtgaaatgctgaacttttgatggtaaatgttttgtaattggtcaagcacataagaaggcaaactcaagtaatgctatttgattattttgtgaaactttgcagctaggccaactggccaagccatagacaaagaagtgcaagtatatcaggagatctangangacatacctctcgactttcttcagcacaattacccacgagagagaaaaa

SEQ ID NO: 39256 - DNA, 269 bp, Triticum aestivum
  Clone ID: PAT_TA_39256
gacggggaaacctaagtacaacatcaatatggctaacctagacgactaggttccccatccaggttcaagtcctaaacttgacatgggtgctctcgtagaaggtgtgtgcgcgtgttgtgagcgtctgcgtctgcattgtgtttctaaagaaaaaaaaaaaaaaaaaaaaaaaaagaaaaaaaaaaaaaaaaaaaaaaaaaaaaaaaaaaaaaaaaaaataaaaaaaaaaaaaaataaaataaaaaacaaaaaaaaacttaaacacaaaa

SEQ ID NO: 39257 - DNA, 432 bp, Triticum aestivum
  Clone ID: PAT_TA_39257
tgttgtgcaaggactctggatcgaagcctgcctttgtcggtagttttttttgtcgcccaacaggaaacaacaagcaacatgtaggtgggccggcccaggcggaggactgcctttgcgaagccccgccattctgccacataggagatgcccacgagtgctcctagtcggcgccttatctggcgcccactagcctgcaggaatgggttggcccatttgcattgggtttgtgagtcaacagatgaccagtcaaccattgacttttgaaaaatatgttttttaattctaaaacaacaaagaaactatgattttaaaaatgttcacaagcttcaaaaaagtttacgaatttgaaaaaaaagtccatcaggtttgggaaaattttatcgaattttcaaaaacgtacttcaattttgaaacaaaagttcacaaactaaa

SEQ ID NO: 39258 - DNA, 181 bp, Triticum aestivum
  Clone ID: PAT_TA_39258
gaagagcactctagtccaccccagtgtagtcttgcaacgtgcgtttttgttaaaattcgggaatccggaaaatgaactggtcccttgaattttggttggcctggcgggaccaaaaaattgggtaaccccgataagttgccgtgctgggcattggatcctaatcttaatccgttcgtccggc

SEQ ID NO: 39259 - DNA, 254 bp, Triticum aestivum
  Clone ID: PAT_TA_39259
tgagtcgtattattgcagaatgaaatccactcaacctcttgcaatctccatcaaactgaactgaacaggctgtaaaatttaagggagaaaataagctgacagcctgcccctttctactttgcagcagccagatcaatgtgcatataacttgcgctcattccttccaatatgtagtactcttccaagtttataaaatacgaaagtggcccggcacgcaccgttccacacccccaaaaggatcaaacctaacaaac

SEQ ID NO: 39260 - DNA, 133 bp, Triticum aestivum
  Clone ID: PAT_TA_39260
gtgagtcgtattaagtgatgcaacgtgccgtttcgcccaagtcctgtactcggtgcgacgatccgtccctttacgttctgtctgtcttgctggacccatagattgtgtgaccgcgatcacgtggcgtgctggc

SEQ ID NO: 39261 - DNA, 437 bp, Triticum aestivum
  unsure (1)..(437): unsure at all n locations
  Clone ID: PAT_TA_39261
atcaattgactagaagctagacccatggaggcaataagcgcaaccatcacccggttttggaaattggtaaacaaaaccggcttgcggccaacaaccaaggaacttctcaagttcttccttaaggcctcaaaggcaaaaggcctcttggacaacaactttgtctcccttatttgacgaaggtcctcgtcggcttcctcgacaagttcaacgtcatcaagaagctcccgaacgaccttgacgtacgcctctagcccatgcgcccatgctctgtgatgcctgccaccctcaacggcctctatggtgacaacctcttcgacgcactggtggccctgcgattgcccgtcgtcgcgccggagaatgtcaacctcgangtcgcgctcaacgcgcagcgcctggcgcagcaagacacaatcgacataatcacccacatctacgcg

SEQ ID NO: 39262 - DNA, 425 bp, Triticum aestivum
  Clone ID: PAT_TA_39262
cgggtcgacgggaaattaacaacagcaccagtattggttgtgccagacatacacaaaagttttgaagtgtattgtgacgcatcccggaaggtcctcggatgcgtattaatgcaagaaggcaaagtagtcgcatacgcttccagccaactacgaaagcatgaagaaaattatcctactgatgacttggagttggcagcagtcattcatgcactcaaagagtggaggaactttttgctcggaaattggtgtgaaatatatacggaccataaaagcctcaaatatattttcacataaccagaactcaatttacgacaatggcgctagttggaattagtgaaagattatgatgttgacattcactaccatccaggaaaggcgaatgtagtggcagatgctcttagtcgaaaccccagctcgggcaacga

SEQ ID NO: 39263 - DNA, 272 bp, Triticum aestivum
  Clone ID: PAT_TA_39263
tgggagaaagcaaacccaaagacgtcgtcctgatgacgatcctccattgtagaataccttcctggtttcttttttcctgtatgtatgatgttgatgatgtaaaggctgattggtttgcagccaatttttggcatgccaattgttggcaagcctatttttggcaaagctggaagttgccaacatttggcatgtttggctatcaattggttggttgccagtttttcgccaatatttagcaaaaaaaacatgtgtctatcaattggtttgttacc

SEQ ID NO: 39264 - DNA, 458 bp, Triticum aestivum
  Clone ID: PAT_TA_39264
gggtccaggcgcataaatgagctcatttcatgcgatcgaacacgacgccccggccggccggccatcgatcgtgtcgtcactcccggccgtaacacggcgaggaacgactccggcgaccggtcatttgcaagtttccgctcgctcgtaccgccgacgtgcagcggacagggaggactcatgaagctgaagggtttggattagtgttcatgctactactccacaatgagcttccccatgagaagccaatgatccctattgaagcatctaaacgatttttgtctagctatgcgaaatcattactcatgatcagtcagtgcccgtatggagatatcatcaaggggaagctacaaaaatatattggaagaggtagtattgcatactccctccttccatctatatagggcctaatacatttttcgaagctaattttgaccaaatgttagagcaataatatatga

SEQ ID NO: 39265 - DNA, 385 bp, Triticum aestivum
  Clone ID: PAT_TA_39265
tcgtaaaatgcgatgaaacttcctctctgatttttttctccgtgagacggaatatatggagttggagttgaggtcggcggagcctcaggggggccacgagacagggggcgcgcccaggggggtaggtgcgcccccaccctcgtggactgggtgtgggccccctattattgattatttcgccagtatttttatattttccaaaaagtgcctccgtggattttcaggtcattccgagaacttttgttttctacacataaaacaacatcatggcagttctgctgaaaacagcgtcagtccgggttagtttcattcaaatcatgctagttagagtccaaaacaagggcaaaagtgtttggaaaagtagataccttggagatgtttcact

SEQ ID NO: 39266 - DNA, 158 bp, Triticum aestivum
  Clone ID: PAT_TA_39266
ggttgggcttaattattcacttttatattatttttggaacaaacctaattaaccggaggccaacccaaaaattgcggtttttggccaattcaattgttccggataattaaaaggtcaaagggattcaaaatggaataaaatcttcggtaacttaattt

SEQ ID NO: 39267 - DNA, 149 bp, Triticum aestivum
  Clone ID: PAT_TA_39267
catcatcatcatcatcatcatctcctttcttgtgctaagctgctaacaagatcgatgggtacatagcatggcttgcgcatgaatccatccacggtcacccttcgtgcccattccccctcaaatgatacgggatcgcactggagatgtgt

SEQ ID NO: 39268 - DNA, 391 bp, Triticum aestivum
  Clone ID: PAT_TA_39268
cagattagtcattacgactctgcctcttttgcgatacctgaccattgcaaccaaaactatgcgcatattgtccatgccagcgaatttatcgccagactgaccgttgcctctacagcaaataatgataggcatgaatctttacataattgcgatcccgatcatttgactgccctatcccttgctgaacatgatgctctctactcttgtggccatgatgccaatatttttgaacaccaatttgctatacttccttatgttacacatgagatcattgctattgcactcatacttgacagttccttcgacgaggatcatgactgcaatgattttaccataaattcccttgatgtcaattgtgcctataatatgcaaaaccttaaccttggggatg

SEQ ID NO: 39269 - DNA, 205 bp, Triticum aestivum
  Clone ID: PAT_TA_39269
ggtctatttacatacttctttctatttatttatttcgaccggtgacctgtttcagatcaactagtgcagcctcctaaatttacttctgccattgatgtatcatatattaatcgtaattgggaacttttgccactgtgtatcagatccatggcccattcctacttctccttgcctcaccatctctatgcccgcttatttccatttt

SEQ ID NO: 39270 - DNA, 170 bp, Triticum aestivum
  Clone ID: PAT_TA_39270
cgggccgaccggatcgaaagtccaaatgattgcatgaagggatagacgacatcccgattcaagtgaaaaagattttgcaacaagcctgacatgcgagctctacatgatcgaagcttattgtgacatcaaagcgacttcagagctcttagaggaagacatcgcagtcaaag

SEQ ID NO: 39271 - DNA, 332 bp, Triticum aestivum
  Clone ID: PAT_TA_39271
ctggttttctgcagtcgacgattatgaatgttgatcgattctgtacctgatggaacatggccatctgtatatataacaaagtgtacataactgccggttcagggatgggcaattgcacagctctagtagatcaaaacacacacacaacctaccacatcatcccaacccaccaccctccacaccccccaccccaaatgtccaccaacgccccacccacacccaaaccttcaccaccccacacccaacaaaacaaaaaacgcggccccccaaaaggttccaaccttaattccccgttgcaggaaacttcaaacccccccaaaacagtcccccaa

SEQ ID NO: 39272 - DNA, 208 bp, Triticum aestivum
  Clone ID: PAT_TA_39272
cggtcaggacatcccgggccgacggggcgtttcacgagttcttgatggacttggagaaatgcgtttcaaaaaaattctggaaaaaaagtcgaatgttaaactgttaattgaaaagcgagacaggagagcagtgtggtttcgcttgcattcctcgtctcatacctccttttgctagtccaaagtatcacggaacttcgttggaacctca

SEQ ID NO: 39273 - DNA, 356 bp, Triticum aestivum
  Clone ID: PAT_TA_39273
cgggccgaccggcaggataaacacatgtatacacgatgattgtccgtgacatcactgaaaacacgacttttaaaggccacacacaggacatcctatggcaacaacttcacagttaggttcatgacgtaagacaattgcagcattttgaacgacaaccttggttaaacattcgcaagtgttacaaacaggcagttagcgcacgaatgtctaaggaattacgcaaccctaatcgcaacttcaatgtgatctgcaaccgcacaatcattccaattggtcagctaggtaagctcagtatcaggttcatgcttgtagcctcgaatacttcgcaacccagctcattctgtccaaccattcac

SEQ ID NO: 39274 - DNA, 445 bp, Triticum aestivum
  Clone ID: PAT_TA_39274
cgggtcgacgggggcagatcaactatgaggagctcaaggctgggctggagagggtgggcgccaacatgaaggagtcggagatatctcagctcatgcaggctgccgatattgacaacagtggtaccatagactatggagagttcatagctgccactctacacttgaacaaagttgatagggaagaccatctatatgccgccttccaatactttgacaaggatggtagtggatacatcacggctgacgagctccaacaggcatgcgacgagtttgggattgaggatgttcgacttgaggacatgataggcgaagtagatcaggataatgatggacgcatagattacaatgagtttgtggccatgatgcaaaaatcgaccgcaggctttgggaagaaaggccatcagtataacgttagtgtcggtcttagggatgccttgaacataaa

SEQ ID NO: 39275 - DNA, 374 bp, Triticum aestivum
  Clone ID: PAT_TA_39275
agcagctaactagaccccagcgttgctggcagcgtcaaccccgacgatgaggtcaccgtcacccccaaccttgacgcccaggtcagtagaaggtacatttgattgctggtgtggatggaagagtgacaataactacaggttggtcaaaggttgaaagaaattctcctttaaattaggccaatgctactcaacttttctttgagtgacgaggaatttcaaccgtccttggcgaaggactgctatctgattgtcactagcctcgtgtgtaaatgcttcgctttcaatattttgtactatcttgctgccctatgtgctacttaagcctgatctattaaacattacttggcctattcctttgtgccgagcttgatgtg

SEQ ID NO: 39276 - DNA, 424 bp, Triticum aestivum
  Clone ID: PAT_TA_39276
gtgacgaatgacattggttggaggtgctatctcttggaagagcaagaaacaaacttctgtggcgcagtcttctatggaagcagagtacattgctgcgaatgaagctgtaaaagatggcgtttggttgaggaacttcctggtttctctcgagatagttgaaaatgcgtctgatccggtcacttttattgtgataattaagctgcgattaatctttccaaggattccaagtttcatagcagggctagacatattgagggaaagtaccattatattagagatgtaataaataggctgaaaactgttcggcttgcatttttgcctggtaatgatatgttggcagatccactgactaaacctcttagtcaggaattgttttgcaaacatgtcaggaacatgggccttaagatttttgattgaatgtttt

SEQ ID NO: 39277 - DNA, 386 bp, Triticum aestivum
  Clone ID: PAT_TA_39277
gtgaggcaacgctatctgagggaggcgttcgggatgtacgcatcatcatccacggaagccacgatgacgacgatgattacgccggcgagcctgaggcggacgctgagcaggctgggctctcacgaactgggcgtggacgagtgcacggcaatgatctgcagatttgacctcgacggcgacggtgccctctcgttcgatgagttccaggtcatgatgatggcctgatcatcgaccctcttcgtggcatttttctagactgatatgattttccacttaatgcatcgatcgatcacatgtatttgtacgtgttcattctttcgttgatttgctcgcacgatcatcctcgatttttgtgaacacgtgtacagattcatttggagtcacac

SEQ ID NO: 39278 - DNA, 295 bp, Triticum aestivum
  Clone ID: PAT_TA_39278
cgacgggggggacagcgcggtgccgttcgtggtggcgctcttcagttgcatgcattggatcttctactcgctggtcaagaccaattccatcccgctgctcaggagcaatgcctgcagctgcgtcatccagggcttcaagatcctgccctacgtggggtactcgcccagagccggcaggcaccacgcccacgccttcttcctcatcgtcgacggctccgccttcgcactgaatgtcaccgtgagtgttctcctcgtacgacagcctagtcgcgtcaaagtccttgggagagtctgc

SEQ ID NO: 39279 - DNA, 422 bp, Triticum aestivum
  unsure (1)..(422): unsure at all n locations
  Clone ID: PAT_TA_39279
ctgaataacggatggtgggaggggatcgtgctgcagcaggagactgctggccacgtccaagtttatctccaaggtgaactgcctgcctactctctctggctctcatcacctagctagcagttaatagtactccctctgtcccaaaataagtgtcttaactttatactagctctagtacaaatttgtccaaagctcaagacacttatttatggacggatggagtagtatatattcggttggtacttataacactggactggagcttttcctgatgcattgcatgcttgccaaaatttccaggggaggggagacttgtagagctccaagtggagtgtctgcggaagtcatttgagtggcgtgaggagcaatggctgcctctagatgcangaaaagatgttgcggccaagataacccttgacctg

SEQ ID NO: 39280 - DNA, 403 bp, Triticum aestivum
  unsure (1)..(403): unsure at all n locations
  Clone ID: PAT_TA_39280
ggtgacgggcggggggggaaggaaagacccctggtcctatttataaaaggcaaagggataagtgacaggcgcgagaatcgaggagcccaaaagttagatatatggcagagctgtcgcctcgattgtcggaggctcattaaggaaggtgagctatatgcaatttttaataacaggtgacgtcatggcggtttatcatgattctggaagatgacattatggcggtttacaagaattctgtgaagatgatgatgcgtttaagattgacatgaaccagttcagatcaatctggggcctaatgttggggatattactactgggcataaaccggccaggagaggccgggttatccccacaatggtttactgtnactgaagcccatgaagacagacggtggtgctttatg

SEQ ID NO: 39281 - DNA, 377 bp, Triticum aestivum
  Clone ID: PAT_TA_39281
atccaacatatcaagagatttagaaggccgaaatggttcaggcaacttattgggcaaggctcctcctatgtggaccgcgagagatttagaaggccgaaatgattcaggcaattgccgaacatccaacttaataagaccatcatggattccaaccgagttatttgtgatatccagaatataacccgacacaaagagttatttgtgatagaagtacatgcatttgcaaaaaatagataatgcattactcttatattctactccctttgtaaactaatataagactttttagatcactaaagtagtgatctaaaaagtctctattagtttacagagggagtagtatgctatctccatatttttgagattcttaaattatc

SEQ ID NO: 39282 - DNA, 273 bp, Triticum aestivum
  Clone ID: PAT_TA_39282
ggtggccgggcgccagcgacaagcaaagtagggtaggggatgaggagtctggaattcagaaccaggtgcgaagttcctttgctggcggcaatgataaccaggcctcctacaaggagctgccatcaaatggcagcccctccaagaactaggcaataggcgcatagactgatactcgtacggcaataggcagttacaacaattctcagtgaggaaatccttgtacaagtaaaggggaacctgtccagtttgagatatcaactttcttctcgttgt

SEQ ID NO: 39283 - DNA, 400 bp, Triticum aestivum
  Clone ID: PAT_TA_39283
ctcgacctcagtggaagctgggaaaaaatagcgaagatcagtagaagggcgcccgttcaggggggcaacagacaccctttcgaggttggtggcggtagctggtccctccaatcggcccaaagttactaggccctggcagatcttcttctttgtttgggttcaagtccgagtcctcccactggcattccggataagaatgaatgtcaaataaggattagagttagaaacaaaccatgaagttgacatcaacggggaaacataaatttagacgagtaaagtacatagactagtactccctccataaagaattataagagcatttggatcactaaaatagtgatctaaacgctcttatattagtttatacagaggtagtaaatgtataccggatgcaagcatg

SEQ ID NO: 39284 - DNA, 425 bp, Triticum aestivum
  Clone ID: PAT_TA_39284
ggtggacgggctttgaggatatcatagcctggcaacctaatcgcaccagaattttttcagtgaaaactgcgtaccatttgcaatggatgcacactaatagggcacatgcaaatatgatggagagtgcaagtcccacgtatggtggttcagcgcctttggcagtgtggaatacactttggaaagtgcaagtcccacgtagaattcagatttttgggtggagggttctgcgaggaatcgttccgctaaaagcaatcctgacaaacagacacattggttctaatggggcgtgcccgatatgccatcaaggtgctgaggatattaggcatcttttatttctatgtgtgcatgcaaaggaagtgtggaggcgtcttgggatgttgcaactggtggaagatgttgttctagtggattcgggctcgattata

SEQ ID NO: 39285 - DNA, 222 bp, Triticum aestivum
  Clone ID: PAT_TA_39285
ggtatcacaataattatgctttttcactcttattttataaggtttacatgaagagggagaatgccggcagctggaattctggactggaaaaggagaaaatattagagacctattctgcacaactccaaaagtactaaaacttcagggagaattattttggaatatataaaaaatattgggcgaagaaagcaccagagggggggcactagccatccacaaggg

SEQ ID NO: 39286 - DNA, 470 bp, Triticum aestivum
  Clone ID: PAT_TA_39286
ggtccgtacttatcgggtggccggcaggtccaacacaacttttttagaccgtactctctattttgcgagcttgtaaagtgcattttacctcagccatcgacccttggcatgtcaaatatccagggtcgtggcgttattatatacaaaacaatgattggcatgtcactcaagttctagtgaatataatttatatcatgtattcacttttctctaaaaaaactgtattttgctcctttagttatttcacacgccgtgccaggggctcgatatgggaacaaactaaattgccaataagtctgaacagctttatagcatacttcggcgtcgcgactttggccttatatgcatcagctccgaatcatgtcttggctcaatagtttggtttcccggctcctgtgcttgctaccttacgttccgctctatccgctaaggtagtaaagggagaactactgcgattgtgccctggttta

SEQ ID NO: 39287 - DNA, 442 bp, Triticum aestivum
  Clone ID: PAT_TA_39287
gggcattataggaagttcccaaacaaaatggtaaagtttatactcccctccaccaacaagcatcaatccatggcttgctcgaaacaacgagtgcctccaactaacaagagtcccagggggagttttgtttgcaattattttgatttagtttgcataaagcatgggactgggcatccctatgaccaaccactttctcgtgagtgaggagcggagtccactcctcttgagaataacccgcctaacatggaagatacgaacaaccctagttgatacatgagctattcgagcatacaaaacaggatatttatttgaagatttagagtttggcacatacaaatttacttggaacggcaggtagataccgtatataggtagatatggtggactcatatggaataactttggggtttatgggattggatgcacaagcagtattcccgct

SEQ ID NO: 39288 - DNA, 422 bp, Triticum aestivum
  Clone ID: PAT_TA_39288
ggcccagtatctaaataaactgggatgtttagttcgtggaggggacggtcacaattggaaccatctagctctagggttagaacgcaacttatgatctcgaggtagatcaagcttgtactcgatacacaatcatcaatacaatcaaagcaagacgtagggtattacctcttcgagagggcccggacctgggtaaatactgtctcctttgtcccctgttacccataaatctgagatacacagttcgggaccccctaccccgaggtctgccggtttttactaccgacacctacaatgtcgctggcgccgacgtagaagcactgagctttcgctcggtacctcctccctcatacattgttgtggaaacttgaccatcgagcccactccaaggaggcccaccgccgccatgatgaatttgggccttc

SEQ ID NO: 39289 - DNA, 463 bp, Triticum aestivum
  Clone ID: PAT_TA_39289
gggcatgtaagagagacatgatttacagaaccaggtgttggtacacctgctagtgtataagaacaacgaatgtgaagttttcctctgcggcatttggttagaggcaccgaggtaaacttatttttgattgaatcatgatgagaaatatattcacgcgagtcaccccaattttgtttaaaatcgtatcaataaggagatatttaacacaacacaatcataacttgcacgcgatgtacgccttgtgaattaatcatgttcttaccaatgcctcatgtctaaattttttgttccatgagggcattcatgtagacccatccttgtttttctcgtgacaatatcttcaaagctagacccatttttcggtgtctcctttgtacctatatgttggatctttttcacgtgctaaagccaagtggactcgcccccgctcggtagcggcacacacctagaacgaacaacgcgc

SEQ ID NO: 39290 - DNA, 335 bp, Triticum aestivum
  Clone ID: PAT_TA_39290
caccgaggaaccagtggcgagtacaccgtggaagaacaaatcctgttgtcggagaggtatcctcgatgatgatctgttttggcctgaagaacaactctactgcatggttccttgtaatacatgtcaagtcaaaggacgtcttcggatgattttgctgaggatgaaacctagtttttgttcaactgtaaatctttctggaagcaatttggtagcgacatttccttgattcagatgattttgtacattttttcatgtgaacgttaagaaggtgtttgtttccagggacttattggtttagggacttaaaaaagtccctataagtcccacctaaacca

SEQ ID NO: 39291 - DNA, 399 bp, Triticum aestivum
  Clone ID: PAT_TA_39291
cccggctcgacgggtaataaattttgcatctactttctgtttagttgtgttttcatgtttcatttagtgtttgtgccaagtagaacctataggataacctatgatatgagttgatttgattctgctgaaaaacagaaactttgcgctcacgagaaacaaattgataaatcacagaaacgagattttgcattgattctttttgcttatgttcaataaacaaattgtttaggacgtcctattttggtaggatttttaaagttccataagtttgcgttagttacatattgctacagactgttctgtttttgacagattctgtttttcgtgtgttgtttgcttattttgatgcatctatggctagtatgtatgggtatgaaccatagagaacttggaatacag

SEQ ID NO: 39292 - DNA, 339 bp, Triticum aestivum
  Clone ID: PAT_TA_39292
tgtcagttaaaaaaaatgtaaaaaaaaaaccagaaaaaaaaaatctaaacatacataatacaaggaaaacaagttgagtcagtatgcaaaaaaaatcgggccgcccaaaagattcaaacctaacttagccgttaagtcaaggccaaagccctccaaacaggcccccaaaatcgactccaaggccattcttttaaaaagttcataacgggaaaaacctgggtttaaccaaattaaacccccttgcacaaaatccccttttcccaaccgggcttaaaaccaaaaaggccccaaccaatgccccttccaaaaatttccccaccctaaatgccaaatggaacc

SEQ ID NO: 39293 - DNA, 310 bp, Triticum aestivum
  Clone ID: PAT_TA_39293
tccgagaaggtcaatgaccaaatcgtcctcaaatgcgtacgtcatcgagctcctctcccggttccgccgacgctcatcaagggccgctgccatgtttccaacctggatatccggaacttcctggtcggcatctattttaccgtgaagggcactatcaatgaagggtccatattctgaaaccttcccgcccagaaaaacccttgtttctcccagccgtgtttgtttcaccctgtttccatcttgcccatcctcggcgtcttcctgaattttgccactttcccataccctgaattttttattcggctttcaa

SEQ ID NO: 39294 - DNA, 438 bp, Triticum aestivum
  unsure (1)..(438): unsure at all n locations
  Clone ID: PAT_TA_39294
ggctccttatgacaatcataatcttaaaaaattctatggaaaatttaagagttccctaacatcaaacaccaccttttgttgttagcgtcatcgcagtcactccaaggtaacaccactttgatatgtattgcatcaataatctgctagttactggtgtgttgatgttggctcctcggagccatttggtggacgacattgacacccaaaaatttgaggagttttatgattttcttgacaaatgggtggcagatcagcctcaatctagcaggacaagtggttgcccctcaaaggagaagccaggcagggagaaagcaaagaggaacaaaagtaagaagagtggcgccattcgaaaggcgtacatggtttcatgatggagggtgctcaggttttgccgttgtcggtgtgtttggcangagtgtcattgtgttgtgcaagtgt

SEQ ID NO: 39295 - DNA, 371 bp, Triticum aestivum
  Clone ID: PAT_TA_39295
gggcagagtggaagcctacttcgacgacggtgctgggtcgctggagatcaaggtccccaagaggagcagcgacgcgcaccaacaagcctgagagaatcggaacctctcgacgcccgcaactggattggatcagattaactggaggaccgcctcatttgccggtgaaaggcaattattctccttctgatgtgatgatgagcagttgatggcgactcaaaagaccgcgtaatctctgtagaaattcggaaagatatggctgagacgaaaagcagcgaggattacctacctatctatccattgcatgatgttgcaaatccaatgtagtagtaaaatatgttcttcagttccactgttaccaaatgactaattaa

SEQ ID NO: 39296 - DNA, 249 bp, Triticum aestivum
  Clone ID: PAT_TA_39296
tatgcttaatgtcactttgggcgcgattatgccgacttctcctgtgacgtggtgatgcccctcatgttccatatggcatctgcctaaattcatggtgttctcttggtcagctgcctctcaagttcgtcatcacgggtatatgttgctcctgggatgtgagatcttgcattatttactgattccacgctctacactggtcttgttctatgttactcattggtaagtttcttattgtcatttcatatattt

SEQ ID NO: 39297 - DNA, 153 bp, Triticum aestivum
  Clone ID: PAT_TA_39297
cctataaagagacgtattaatctcttagtggtattgttggtatgaggcctgtatttcgtgtgccctggtgctacttcattagtcacgctttatgaagtattgactcaggagttactctttcttgggttctaccttatttgcttttaatatgac

SEQ ID NO: 39298 - DNA, 487 bp, Triticum aestivum
  unsure (1)..(487): unsure at all n locations
  Clone ID: PAT_TA_39298
cgggtggccgggaaacaaacctagacttgacttggcgtaaatctccctagtaacggtgccagaatttctttctgctacttcttgagcgtgtgttggtttttcccttgaagaggaaagggtgttgcaggaacgtagagataagtatttccctcagttagagaaccaaggtatcaatccagtaggagacaacacacaaatcaccgaatacctgcacaaacaatcacacaacttgcacccaacgcgatataggggttgtcaatcccttcacggttacttgcaaaagtgagatctgatagagataggtaaacgataaggtacatatttttggtattgttggtttatagatcggaaagtaaaatattgcaaaatagtagattggaaactaatatgatggaaaattgacctgggagccataggtttcactagaggcttctctcaagatagaanataatacggtgagtgaatgaaatactgtcgagaaattgat

SEQ ID NO: 39299 - DNA, 172 bp, Triticum aestivum
  Clone ID: PAT_TA_39299
tatctcatagctaattcccataatcaagtttattttctccaatgatcttcgtgaatttcttaacaatatcctccttggatatctatccctttcgacctagtttcaaatgttgctttaaataatcccatgcatttatatgttatgaccttgagcatcataggtctttctctca

SEQ ID NO: 39300 - DNA, 444 bp, Triticum aestivum
  Clone ID: PAT_TA_39300
cccttagggtttatggaatatttgggtatttatatagatgagaggcagtggaaaggactcctgtgggccccactacccatcagggcgcgccaggggcctctagcacgccttggtgtcttgtgggccccacaggcctcccctctcgcacttccttggctcccaagttgtcttttgggcaaaaaaatctccaaaaagtttcactgtgtttggactccatttgatatggatattctgcaaagtaaaaaacaagcaaaaaacaacaactggcacttggcactatgtcaataggttagtcccaaaaactgatataaagttgttataaaatgaatataaaacatcccagaatgataatataacagcatggaacaataaaaaataatagatacgttggagacgtatcacactgccagaggcattcatatatagtcctaatgttctagatat

SEQ ID NO: 39301 - DNA, 406 bp, Triticum aestivum
  Clone ID: PAT_TA_39301
cggctcgacggggctgtagaatacatgcccgaagaggaggtgaagagcacagctgcggagcgactgaagatatccatggagaggatagcgctactcaaggcagccaaacctaagatgccgcccgcgaaaaccgagcaagaggaagaggagaggaagcagagcgaggagttggacggatttgggaaccccaagggcccctccacgctctccaagctcacagcggaggaagccgagcaccgtgccctccaagcagccgtgctccaggagtggcaccagctgtgcaaggagaaagtcatgaaggcacagtgaggcctggtctgcgctccgcctgtataattttgtacctgccttttcctcgagccacattttgatttatttttttcagccgtccgacattttgattttt

SEQ ID NO: 39302 - DNA, 194 bp, Triticum aestivum
  Clone ID: PAT_TA_39302
ggggtcgctgcactggttcagacgtcggcggtagagtatggcagctgacttcaccgaggagcttgtgtcagactcgatgattagtaggatcaatttcttgtctaggacgggctcggtcatggatccgagtggggactctaccagcccggattcagcctcaaagagtggtggcggttcgttcctcaataggttta

SEQ ID NO: 39303 - DNA, 404 bp, Triticum aestivum
  Clone ID: PAT_TA_39303
acggcgacgaaccgatctaccttgatctagcggcagaggagactagcaagggctggatttgattctctgggtatttcctaatataacaacaaaatttcataatacaaccagtgatgattttccaatcaaacctatataattgcaagctaaatgccaatcgtttcattatacaatgatcgttcttgatatattttaattttccataggacatttcctagtagcaaggtatttcatgtcatattttggagtaatttgattatcaacttcgtctactcgttgcgtatgtgaaattattgccctatattagctgtagctagacacccgctccagctgcaaaaaaagaagtgtgtgtctatgcatgaaatgtgaatattgggtaggttctttgaagcaaaaaaaaaaca

SEQ ID NO: 39304 - DNA, 400 bp, Triticum aestivum
  Clone ID: PAT_TA_39304
ggtcgacgggtatataggagaaagaagtacgtcggtggacgcccgaggggcccacgagatggggggcgcgccctatgggggggcgtgccctccaccctcgtggccgcctcgggagcttcttgacttgcactccaagtcctctggatcacgttcgttccaaaaatcacgtttaattcctgctcatccttgagtaggtaaatgataaaaacagaatttttgatgtggaatgctacctagcataattctcaatgtaattttctttattgtggcatgaatgttcagatccaaatgattcaaaataaaagcttataagacataaaaatagtaatactcaaagcatactaacaaataatcatgtcctatcaaaataacatagccaaagaaagcttatccctacaaa

SEQ ID NO: 39305 - DNA, 350 bp, Triticum aestivum
  Clone ID: PAT_TA_39305
gacggggggggattcaaccgcgatagcttcgcgatccgctcacgctatctgagatttggacgcgggtcatgcctgcagctcttgcccatatggctctcgttttgcattcacgcaccggcaacatgaatgccgtcaaggcacttattgctgcagactactgtgcggtcaaggtttagctccccatgaacttctagatgggtgtatcatacaaaatccctgaattcatcaagatgaacccccctggtaatgttcctgttcttgatactcttgatgctaatgtttttgagagcagtgctattacatgctatgttgctcgcccaaacggtgacaacctgttttagggtggtctc

SEQ ID NO: 39306 - DNA, 399 bp, Triticum aestivum
  Clone ID: PAT_TA_39306
cgacgggcgcgcagcactgcggttggccccagtcgagcgttacgtcagacgggcgtaagattaggggaaagcaccgcgaggggaggaggcagcgtacctaggatggcgagggatggctgctgcgatgccatggccgactgcgcgagaaggtctcggcgaccggcggagagatcacaagcggagctgcggtggaggcggcggcgcggcgaggggactttgctggatgcgggtggtgcctatgtcatgccttcctcactgacacatgggggtcattggtttgtgggcctcagtttttgttagggaattgtgggccttagttcgtagctacagaaacgggataaaaacgtcggcaggctaataaatagattgcgctgcattcctgggaaatgggccagccca

SEQ ID NO: 39307 - DNA, 399 bp, Triticum aestivum
  Clone ID: PAT_TA_39307
cgacgggcatgcatgttagcagaccatttcacaccactgatgtggcacgtgcgtcaagaatcgtacacgagctccccacacagatcacgatcagttcaggacgtgtcggtgcacgagccacttcgacgcattgggagggattcatgcgtacacatgcatgtgtgtgtgcgcaaacggtatcatgcatgtcatcccagagcatgacctatatatataccgtattacaagcaaaaaaatcccctcctaagtcaaattaacctctcttgttgtcaggcaaaaagtactgatggaccaagcgggcccacagatggaaagcatcgatatcgctgataacctcttaagtgggtgccagaggacaaccaccaccgctttgcatgtgggccgaacatatacatgttg

SEQ ID NO: 39308 - DNA, 390 bp, Triticum aestivum
  Clone ID: PAT_TA_39308
tcgacggaaggaaaattatactcatatcaaattcgtatttgaacaaataaactatggaattatgagtggcataatgtttagcttcaagggtggagtgctggtaatgcgatacatagcaagtacgcagattgtattccatgtaaaagattgtagtctatgtaaaagctggaaatgacactttctttctatataatgcagtgttcgttgcccacacatgatggaagagatcacccagagaaatactagtcactcaagtctacagttccagtattttgagacagggtgctccaccctaaaagaatattgagaaaatctggaaatgacactttctttctatacagcgcagtgttcgttgccgagatatagatggaagagattacacagagaaat

SEQ ID NO: 39309 - DNA, 411 bp, Triticum aestivum
  Clone ID: PAT_TA_39309
cgacgggggctcactgaagatggaatagggtttttcccgcctagtcccatcccggtggtgcgtctagcatcattgatggacatgtggacgtgtgtctacggtgtatatgtctttggtggatttgcttatatcttgtagtcttccgtctacgttcgtgtgtcttcaagttggatccttgcgatatacgctactcttcatcgcggtggttgttgttctggtgcgttagtcctatgggttttagcacgtttacttcctgactgtctactgcaacaagttttggccagaaaaggcgatgacgacagtgcgccttcggttcgcttcaatgcttatagtcgtcgctaggtgatctgtgaatctagatgtattttttattacttttaatgtttgttgtactatcatgatagaataaaa

SEQ ID NO: 39310 - DNA, 320 bp, Triticum aestivum
  Clone ID: PAT_TA_39310
tcgacggacaggtaccggccataatcgacaccgagatgacggggatggtctccatccgcgacctgcttcccgctgtggtcaccaagtacaaggatgagctgaaccagcgcagcacgaacatgtacgtgagtgttgacgacggcctgctctcgctcgccgtttcgccgaagtagatcaacgacttattatatgttaagatgccggatcagaccgtgtatcttcgcacacaccggacgcaaaacgcaaacatgtgtctcatacctcactcctgcttgggtaatgtttctttccgtggcctcgcgatcctccgcagcgttccc

SEQ ID NO: 39311 - DNA, 179 bp, Triticum aestivum
  Clone ID: PAT_TA_39311
cgacggggtcaaaaggaaggtagtacatttaagtgccgattttcatgtcttaccaaagcatccaagtcatcgttcagcgtcatgacatgcaaatcagcttcaatcttgatctctggactaaagtccggttgtcacggtaagataaaactgtactatattgattaatgcaaacatcaggg

SEQ ID NO: 39312 - DNA, 359 bp, Triticum aestivum
  Clone ID: PAT_TA_39312
tcgacgggcgctttagttcgcagctggtcgggatgatcaaagcctgtatagtcgtgggggctaatccagatcgcttcgatcatgtcgtgtaagatcagctggcgggccgtcgtgtggtaaacttgtcagtgggagtcttcagacgtggcctctggtaagcctcttgcagcatagccatctttcgtcactcggagatggagcgatgtggtcaggttttataggacttccacgcagtcacgaacactgactggagacttagctgcatatagtccttgcggacctggcatagcagttgacgtgtttgacgctcagcctaaacagctcacttgcacaacatatcacgctgcactgctctcgtt

SEQ ID NO: 39313 - DNA, 251 bp, Triticum aestivum
  Clone ID: PAT_TA_39313
ttgacagggttggtcgagatgagggatagtgtccggtcatcactagggtggaactgaaactatcactataggtagacatatgtgatgtgagcagtgcgcggtaaatcgatactgtaattatgatgtagctcagtgtagctgctgtgaacgtctcaacattggtttttatctatcctaccagctgcgttgtcttcaacagttggttaatgcggttttactcactgggtttaagtagcagaaggattttctta

SEQ ID NO: 39314 - DNA, 299 bp, Triticum aestivum
  Clone ID: PAT_TA_39314
tcgacggagtagaagagaccgagcacatgtaatacgcactgtcctggatgatgctccaattcttctcaccggggcatcaccagcaatgacgtctcgtcgtcgtaagagccaagcacaccgccgcgatctccttgggcctcactggagcatacgttgctctgtccgttgctgcggacctgaaccagacctcgctccgcgtcaacgatatgacaatgcagctcaacgcgcacgtgagcgataaagtcggtgacgtggtgcaacgcgatgtgatgatcgtcgtctacgaagcgatcgacagg

SEQ ID NO: 39315 - DNA, 370 bp, Triticum aestivum
  Clone ID: PAT_TA_39315
gggttgttgtagtggtggtggttgttgttgtggttgttgttgttgttgttgttgccttggttcaagactaatatctgcatcaaggcacactactagatttcccactataaccgagggtcaaattaccatcggatatttttgctcaccgtcggatttctgtataactgacggtacaccgtcggcaatctcccgtcggctatgcttggtcggccattaccataatagccgacggtactgtagggtaataccttctccgacggcaattacccgacggtgagccgtcggacatgttttggttaccagccgactcggataaacttgacgacacttatagctgagggttccccgttgggtatttattttctgatag

SEQ ID NO: 39316 - DNA, 383 bp, Triticum aestivum
  Clone ID: PAT_TA_39316
cgacggacgccagcgcgcgcactgtccttgtttccactttggtgctaaggaagcaagcgcgggcgaggagttctgaggcatcaggcaaaggtttccatatcggcgcaacgagaccaagaccagcaggacggcaggacggaggtcactgtggagcccaagacggcatcaccaccagagcctttggcaggcgaagactacttttgtcaggataagctgtactagctgccccctttcaaattggccgttgtgggttcccttcccgctcaatatttgggaagaggaccggggcctctataaatagtactagccaccacagtagggggggatcgatctcatcttgagcaatcctcacccacacaagtccaccaagcacaagaacacct

SEQ ID NO: 39317 - DNA, 182 bp, Triticum aestivum
  Clone ID: PAT_TA_39317
tgagtcgtattagaatgctgggatgtagcggatagataatgtatggaaacttcggacatgtttgttgatcataggatcattgatacgcagacttctccagttgatcgttcgatagcattcttactttttcaggagctatcatggcaagtggttggagctgttgatggtcttcgctactaatg

SEQ ID NO: 39318 - DNA, 273 bp, Triticum aestivum
  Clone ID: PAT_TA_39318
tgatctactcttctacgatacatgagacatgctgctttgggttcacgactaaactagccattcttgctatataacatcggctttgttataccttgggatccggttggattcatgttcctgatgcactatgtgccaagcttcatggctttagacagatctctgccatagacatttcccggaagttatagggagtcatttatttccgtctactgctttcagactctttaagtcacaacatgcatgactatgggaccccaaaactttttccggtcg

SEQ ID NO: 39319 - DNA, 409 bp, Triticum aestivum
  Clone ID: PAT_TA_39319
ggaattccgccgtcgacgggacagcagtcagcacatgccataatgctccgagaaaatttgtggtcggcttacaaatgtttttctcggtatacgccatgaaaatcgaattcgaaatggtatgaccgtgcaagttgagcatgttttaatgtaattgtgtacatagatggctaattgtttccaagttgttttattttataatgtgtgtactccgcgactgagctgtacatttccttctgatcctgtattcatatgcgggcactatttgctccatcactaaatctgaaaaatcgtacggtcggtaggcggcgattggtcttgggaggcgtgggcctacgataaaaattgtggaggccacatgaaagtctgcgggggcaaatcgattggaatcagggttggcaaggattcaact

SEQ ID NO: 39320 - DNA, 241 bp, Triticum aestivum
  Clone ID: PAT_TA_39320
cgctctttacgattgatgtgaaagatggaggtactgatactacagtcatgcgagttgggtgattatgaattcaaagacagcttgtgttgaagttagtgactcccgtagcaagcacgtatggttaaaggtgtgtaacacctttgagacatgaagtgtacttggcttgtgcatccatattagtaagagtcggagactagtgatggccctttcctaccactctatccccccagaagcaagcctg

SEQ ID NO: 39321 - DNA, 390 bp, Triticum aestivum
  Clone ID: PAT_TA_39321
acttggaggatcatgaaatatgttcctatgatgagcatgtccaaaacttggaggaactgtccaccattgatattactgacgaaaggtcgcgtgatgatgtggcaacattgctgtttaggtcgaagaagctaaggatgcttggtgtgagagctaatagaggtggcaatacacatggtgttatacctttccttaatgagctccgaaaatataacctcgagtcactcatcattgaaagtgacctgtgcggtctggatgaatgggagccatggcctgagctccgaagatttgaactgacaaaactcctcccacgggttccagagagttgggcctcactggacagcctcacccacttggattttgcaattcgtaaaatccaagcaacggatgttc

SEQ ID NO: 39322 - DNA, 367 bp, Triticum aestivum
  Clone ID: PAT_TA_39322
cgacgggaatgagacatctccccaggactagtgaagttgcttaagaacaagctctgcaggagatacctttggtcttcagtttcaaagacagtacactttcctgcgataactcaggcatcaccatcaggccttcttgtctcttaggtttcaggacctaccactttgtggatcatcactgtgcataagcccatgggctggggctgacacgagacattcatcccatggatcaaaacaggctgtgattgtctgtgtgcagaacacataagtgtgtaacgtttataatctcaacacaacacaatatatcgcacatgtgcagtcatgagtttggatgtgtccacggaaatagaacattcttcctcgatttcat

SEQ ID NO: 39323 - DNA, 359 bp, Triticum aestivum
  Clone ID: PAT_TA_39323
ccgggtcgacgggccggcgtagtcatcggctccggcatgggcggcatcacggcgctctccgatggcatcgcgagcctggtgaccaaggggtgcgggaagatatctcccctgtgcatcccgcacgccataaccaacatcagctccgccttggtcgccatggacgctgccgacggcttcctaggcccgaacttctcgatctccaccgcgtgtgccacctccaaccactgcttcaacagcgccgcggaccagatccgactgggccgagccgacgtcatgatcgccggtggcaccgaagctggcatcatcccgatcgccctcggcgcgttcttcgcgtgcagggcgctgtcgcagaggaacga

SEQ ID NO: 39324 - DNA, 208 bp, Triticum aestivum
  Clone ID: PAT_TA_39324
gtgtatatgtgttccgccacggtacatcgggggcagaatgtagtggcagtaatatcttgttctacgttcgagttgttagtcatgtggtgttgtcattaacggtgtgatgatcatcattattagtgtattgcccatggaggggatgatgtaggacaggcgaaatgaaaaaaagtccccatgcacgcaataactcattaaaaaacataaa

SEQ ID NO: 39325 - DNA, 376 bp, Triticum aestivum
  Clone ID: PAT_TA_39325
gcatggagacagcaggacggcaaggttggggaaaggcccgcccaaggaaaacggataacccatttttggcaaaatgcttcaacaaccgttggaattggctacaaacggcatcaaatacagctgcaacaggagtcatgttttgcaacaatgcaaaaacggggtcgagtttttgttacaactggcgtcgcattttgctacaaatgttatcattttttgctacataagtccaccgttgagttgtgagttgccatgatggctataagcagtggcgacgccgaactgtggtcgtccggcggcgacaatgatagctccttggaagctccgcctcccagctgggactggaaatccaatggcgccgtcacaccggtcaaatccc

SEQ ID NO: 39326 - DNA, 396 bp, Triticum aestivum
  unsure (1)..(396): unsure at all n locations
  Clone ID: PAT_TA_39326
taaattccccaactccaaaaacctggaaccaaacacggtggaattggtaccgccgcaccgccggctattacctcgctgctcggagcaaggcttgacggcggtattcctcccccagcatgagatccatcctccgtgtggcgtcctgctgcgtctcatcgaacgccaggacccgcgtggagcgatgcttgacctcgtaagggagaaccgcttctgctccatagatgaggaagaacggcgtttctcctgttggcttggtcgcggcggtgcggatggaccacagcacggactgcagctcgtcgagccagcccctgctgtaggcctcgagcttcttcttgaaggttcgggtcttgaggccccttangactttcgcattggccctctcagcctgcccattac

SEQ ID NO: 39327 - DNA, 372 bp, Triticum aestivum
  Clone ID: PAT_TA_39327
caataaggtaacggtcccttaaaaaaacgttaaacggcaaaatacaagggtaatttcaaaaattccttcccattgtatttgcaatggccttttcccattgtataaaatttggcactctccatcgcatctccaaaggacaaggtctgttgtaacgatcttctctgattttacttagcactctccatcgcgtttctttggacaagtttagttgcacgtcaccggcctctaccaaccacatatagttcttttccctcagtcactggagccaacacaagacatggaagcacaagaggacttaaggtcaggtcggctccggtatatgggagcggcgtcaactgtgcgttggcagcttgttctcgcaacggcaatggt

SEQ ID NO: 39328 - DNA, 242 bp, Triticum aestivum
  Clone ID: PAT_TA_39328
cgacgggggcggaagtgaagaccaatggcatgctgtcatcgatcaatcaatcaaccatcccatcatcaagccgtaagcaggagatgtagtacatgaaggtcattgaaagcccgccgaggccacgggccccacgtgtcagcggcatttgccttagctccgtggcctagcttaggtcgttcatctgtgaggtgtacatatacgtggtaacctgcaataaaatctcactcacacggctgatatgg

SEQ ID NO: 39329 - DNA, 316 bp, Triticum aestivum
  Clone ID: PAT_TA_39329
ttccaaagccatcacgcaggaggtcggcattgaacttacacaagttcaggttctcaacaccttccagttccgccggcacggcataaaattcaggacaaggagttgccgcgtcataattccaagggaaaaaacagcacaatagctgtcagtgactagcttgcacatgacatcggagcacaaagattgaaggaaaaataatgtagtaaagatagatcattcaccaggatggggaagcatttgttgctcgggcgaacacaattggtcagcgcgaaatggctgagatgaggtacatgagtagctccaacttgaaaacatc

SEQ ID NO: 39330 - DNA, 403 bp, Triticum aestivum
  Clone ID: PAT_TA_39330
ggttctaatataaagttttaaaaacaaaaataaataaagaggggaacttaaaactttacaaaagtaaaagtgaacatgagaaggacgaacaccattggagtgggggatatcctgaacttgttcatgcccatgggaactttgtgaatcttgaattacagaaactttttaacaaaataattatacccttgtacaaattcattttattataagtttatgtgccaaggtttgactttaggatgattagattgcttgttggtatgtgcggtgcaaaaacagaaactttggctgtagtgcgtgattttacattttttactggaatgtcaaaagtttctgaactttttacacaatactgctatgcaattttttttattttgccctattttttcagaatttttggagttat

SEQ ID NO: 39331 - DNA, 163 bp, Triticum aestivum
  Clone ID: PAT_TA_39331
acacagcgatcgcaagagctgtagtacgtacgtaagtgtagcttagcctcctctgcacgccatggcgatgctgaacaagaacacgggctccctcagcttcttcgtggccgccctcatggtggtcatggctgccatccttctcctcttctcgttcgacgccctc

SEQ ID NO: 39332 - DNA, 319 bp, Triticum aestivum
  Clone ID: PAT_TA_39332
gcacgagcccgtcaataggatgcgcatctcgaggacctgatcgcagtgtgaatggtccatggagtcccacactgcgagagcatcagatccagcgaatcacacatgtcacgtacgatgcagcgctcataatgatgtgagtcattggcgacacgacgtgatcatcacgagttcacactactcgtgatacgacctccaaaggcatcatccagggtggcgtacttggcatgatcagcattagacactcgcgacttcagattagggcgtgagcctatgcagataacatccattgcagcgtatagtccggtggcgtgagactgtg

SEQ ID NO: 39333 - DNA, 425 bp, Triticum aestivum
  Clone ID: PAT_TA_39333
cgacgggaactaagtaaaaaatgttaatcatgtattaaaaatatattaaacatgtatataaataatattcatgatgtataaaaaaatgtacaatgtgtatgcaagaaatagacttaaaaatatgtattaaaaatgttaatattgtaatacaaaatttttaaatgtatgtattagaaatattcctgatatatacaaaaatgtaaaatgtgtatgaaaaaaagttcacataacaaatatttctttgaaaaaaatgttagtcatgtgtttaaaaaatgttcaacgtgtataaaaaatgtttcttatttagggaaaattttaagtgggtataataatgttcctattctatacgaaaagggacaggatcaaccgatggaaaccaataagagaaagaaataaaaattaaggaaacctaaaaaaaaacaagg

SEQ ID NO: 39334 - DNA, 210 bp, Triticum aestivum
  Clone ID: PAT_TA_39334
cgacgggaatgaagctacaaatgtactgtggtgatgcagattctgatgcaatacacaacaggcaggcaatgagcatatgtgtgtaggtcccagttgagtaacctttacacaccttcccctatatgagcacatcaaagataatcatatacagactcgaaagtctagtagccgaccacgtaaaattattctgtaacagatctgcgtactgcg

SEQ ID NO: 39335 - DNA, 387 bp, Triticum aestivum
  Clone ID: PAT_TA_39335
cgacgggaatcagatactcagatgctcaggagcaccaacagatggcccaatggaacaatttaaacaatctaggtctcattctgcatgatggaatttctataaccattggaaccctatctatccttgaccacaattggtgtccatcaatttcacgatcctacatcgccaccgtgtcagtaggagcatgcaatctcttttctcacgtgacacagggttcagtagccaccgagtggcgaccatcgatacacttcgagaccatatattttgccgacatcacatgtgtacctttgaggaaaatcattttgtgatagtctaatatgagaataaatccctgggtcatccaaagacagagacccttttgtacagcaactgtcacgaattctggcc

SEQ ID NO: 39336 - DNA, 231 bp, Triticum aestivum
  Clone ID: PAT_TA_39336
ggggcaccttcataattctttcatacatgtcgctcttgattcattgcatattccggtacaccgccggaggcattcacatagagtcatattttgttctaagtatcgagttgtaattcttgagttgtaagtaaatagaagtgtgatgattttcattattagagcattgtcccatgtgaggaaaggatgatggagactatgattcccccacaagtcgggatgagactccggatg

SEQ ID NO: 39337 - DNA, 211 bp, Triticum aestivum
  Clone ID: PAT_TA_39337
gcggtggaatgaatcctttgcagacgacttagatacgccacggggcattgtcagtggcagagtggccttgctgcgacgatccactgagcattcagccccagcgtctcacaggattcagtctaaggaaacgagaggccgagcattgtactacactttgtgagccacttctgaaaagtgtacattgaactgtcacgcatgatactgtgggcct

SEQ ID NO: 39338 - DNA, 329 bp, Triticum aestivum
  Clone ID: PAT_TA_39338
gggggcgaagcagagatgcgtgcggccggttctgcaacgatgccaccaacattgcatccgtcgatgcttgatcatgtatgagcatgcgctgaggtcccgatcgtcttcccagtggcttaccttcttcgtcgttgctgctgcctcagccgttatctagttcttgctttagctatgatgtgctaggctttgcttccaactactgtatgctgtgtctgaagtgttgtgtgggtgctctgcttttactttcagatcttgcacgatccttttgaggtgctgggctggggttcgtcgtaatccccggtcatgttagatagtatgtcgtgtgcggg

SEQ ID NO: 39339 - DNA, 328 bp, Triticum aestivum
  Clone ID: PAT_TA_39339
gactaatagattagtgatgagagcacgtgcgtttctgaaatttttgtaaatctcgtttttctctagtccttccttgtcaaactgtcaccgtgtcagcatcagcattagtcctactagtactacgataatcctccttacagtttccaatttgtggtcccaattgtaaaatgccgttctcctgttctgttcaccaattttaagcacagaacgtcataatgatactctcatactgttgctttgggacaagtataacatcttctgaaatgtcaatcttgttcgattcacagccattatatgatgaatataatttcagatatcaccatggcat

SEQ ID NO: 39340 - DNA, 391 bp, Triticum aestivum
  unsure (1)..(391): unsure at all n locations
  Clone ID: PAT_TA_39340
gacctctagtacaccgatggttatctcggcaaagatcagaaggttgtcgtcgcccagttgtgcgtgcaccatcatgtcctcatcttccactactgcatggccacaaagccttgtgaccgtttcgccaggtttgtcagcaacaccgactacacgttctctacggtggaaacctgcaacgatgtaaaggcgctcaaggttacaggcttggcctgcaaaaaccttgtcgaaatccgtgagcactatagggtctggggcagcttgaagaaggactcactggttgaactcgcctcggccatcatcgacncctactatgacaagatgaagcaggatgccaagagaacaaatcctgtatcctggcacggggcctaaacgcggcaactagatgaaactc

SEQ ID NO: 39341 - DNA, 379 bp, Triticum aestivum
  Clone ID: PAT_TA_39341
tcgacgggaggtcatccccattgcggcgaagaagtgtgcaatctccgactgggaacccctctcctccaaggttgcgaatagggtctgcccgtggaggggccgctttatgtcttcaggggcaagactaatcctaaccaactccagcctctcttctctgcccatgtttaccatgggcctgttcttgctggcggacggggtacactctaagtttgacacaccatggtcccgtttcttttgggaaggagcgggaccaaaacggaaataccatatggttaaatggcaggccgtgtgtcttcctaaagcccggggggtcttgggatcatcaactccaagttgatgaacatcgcactaatgtgcaagtggatctggaaaatgactc

SEQ ID NO: 39342 - DNA, 308 bp, Triticum aestivum
  unsure (1)..(308): unsure at all n locations
  Clone ID: PAT_TA_39342
gatgcaataacaatcagagctttcacatatcctgcttgaccggacagcggtggttgtgaagtctgtcgagcagatgaccatggtggggaggcgggtgttcagccgctgatggaggcactacccaacccctatgttttatgcatgtttctttgtgaaaattgtgtgatgatcaagtcgaatggaatcttgattagtcagattgctttacttttgatccacctgaactatctgtaatggatcatcagatatcaacatgctacctatgggttcgtatgtgtttagaaaacatncacaccccccccaccctc

SEQ ID NO: 39343 - DNA, 218 bp, Triticum aestivum
  Clone ID: PAT_TA_39343
ggggctaatagaaggggagaaggctccagaaaaacggtaacaacccgggttacctttggaacatgcccacaaccttaaaaaccccaaaagaaggaagggttccagcacaaacaaccactgaacccgcgcattgcacacaaagcccttgcacagacacaccattgtcttggtcaccatgtccaatggcatgtattggtggacattggttgtaaattgtt

SEQ ID NO: 39344 - DNA, 381 bp, Triticum aestivum
  Clone ID: PAT_TA_39344
gggatacaatgaaatgcgacgcaagctacacaaaaatgacaaataccgattttgaaacattgatcggtgtgtaaggctcactacaaataaaatcaatgattttaaaacctttgtgtaccttgcatgtcaatgtattttctcatgaaattttgcacacatgtagtatacatctatcgttagtgggtaattttttccagaatttttggagattgtgaaatgcgaagtttcaatttttcaaaacaaccaagctcaagcaccaaacgtgttttctgaggtaccagtccaaaactagaaattcataaaaaagagaatacaagtggaatagggccagttaaaaaactaaaaagttggacttgtctaaaagtacctctagaaagcctt

SEQ ID NO: 39345 - DNA, 187 bp, Triticum aestivum
  Clone ID: PAT_TA_39345
cgagcgatggtctgttccaatcaatctagccctctaggagtatgcgtttaacgccttggtttttgataaattctaaatttttgcacgaggtgcatgagtttttgactaatgttgactccatggataagacgcactctcacccttcgaccattgctagcctctctaagaccgtgcactttatgccggt

SEQ ID NO: 39346 - DNA, 275 bp, Triticum aestivum
  Clone ID: PAT_TA_39346
tcgacgggtaattcctcgccttccagccgccgttgctctggaccagttctgctgcccaagtgcgagaccttcctcaacgcctctgcttcaatcgctgataatatttcaagttgccccgatacaaattggaacgtataagaaatttctatggtagacagccacagtacattactactcatgcatccctctatttagcacgaacacaatttttatcctgatttgattcatttattgggaaaattcttggaggctgtgtttcggatatatttgttcag

SEQ ID NO: 39347 - DNA, 366 bp, Triticum aestivum
  Clone ID: PAT_TA_39347
cgacaaagtctagattgaagtaagatatagagcaacgggcacacgaaattaaatttttgtattgcatcatatgcgagactttctaagatctgactgctgttgcaccatatgaacatgaccaactagaaagaggaggttaggaatgaccttataagtggggtggtttcgtcttgcacgtgggataacacaatgggaccagggacctagaggaagaccagcctgccgcatggcggagagagatctacatcagcatcgcgactcgtgatcggggccctcgggggaataggatcatcgcgaagcagcggactcgcgatgggaagaaggaaaacagtgatttctccgtgcgtctaggtcgatgcctcctta

SEQ ID NO: 39348 - DNA, 428 bp, Triticum aestivum
  Clone ID: PAT_TA_39348
tgatacagaaggaagaactgcagctagcattattcataactcctagcgggcaaaatctttttattgacagggtttttgatttgtttgatgaaaagaagaatggagtaatagagtttgatgagtttattcatgctctcagtgtcttccatccatgttcacctgtggaggataagattaattttgcatttaagctgtatgatttgaggcaaaccggatttattgagcgtgaagaggttatgcaaatggttattgccattttgaatgaatctgatatgaaattgtctgacgagcttcttgaggccatcatagataagggacatcacaacatcttttcctagttttgtcttcaacacggcagttgaagactaaatagtgcaagaattctaaaatgacggcaacaagttggaagcatattatgtctgtcagct

SEQ ID NO: 39349 - DNA, 355 bp, Triticum aestivum
  Clone ID: PAT_TA_39349
tgcatgaatgttacatgtgaagagcgagggcctgcaacaaagaaaaccgaagaatgggcttcgtacgcgtatggtatgatgggctgggcttgtcgagctggaccggccagagataacaataccggtccgttctcatccccaagaaaagagaaaatgggtccgttgaagagggcttgctcccactcacccccgcaaaaaaaaaaaaaaaaaaaaaaaaaaaaaaaaacacaaaaaataaaaaaataaaaaaaaaaaaacaaaaaaaaaaaaaaaaaaaacttgaaaaataacaaaacaaaaaaaaaaaaaaaagcggccgcccaaaaggttcaaacctaacttacccttgaatgca

SEQ ID NO: 39350 - DNA, 272 bp, Triticum aestivum
  Clone ID: PAT_TA_39350
gcgggtaattcagtatgatgattgtgatatcaagattaagaaggtgaatgttaaaaccaatcctgaaaattgtaataacaagtttgaattttgcatgtaatccaatccaatgtggtgttcctccgaagaaagctttaagttaaccccccaaaaaagttagaatccaagaatgcgttttaagccgccagcacggcgagattgccatggtgctgcgtgaaaagccgcaagacgtatcaaaagctggaaccctgatggactgcatcaaattgggt

SEQ ID NO: 39351 - DNA, 300 bp, Triticum aestivum
  Clone ID: PAT_TA_39351
gtcgtctatcatttatcttcaaatgagattgaagctatatagatatccgtgagatataactagaacttccatgaatgtgtgtatttctatacacgcacaatcaactttatcccataattaaggcttggccacacctgtgcaacgtatccatatgtattgtgatgatactacttaattatctcagtgcaactcaggtacttcgcatataaaaaaaaaaaaaaaaaaaaaaaaaaaaaaaaaaacaaaaaaaaaaaaaaaaacaaaccaaaaaaatcaaaaaaaaaccaaacaatacaaaaa

SEQ ID NO: 39352 - DNA, 278 bp, Triticum aestivum
  Clone ID: PAT_TA_39352
acggggtatgcaagacaatgtccatatacgttattctacacgatcactctacagatccatctcctcttggttaactgcgctatcaaccatgtctgtataatgtactgtgttgctgacgttggaagttgattcacaacactgtgaccagtaggcagggctgcccacctcccccatcgtgtctcgaccctctgtgtgcgtctgaccacatcagtacatcgcctccgctcatccctcgacgtcccaccctactccctctctctccagtcccttgtctgctg

SEQ ID NO: 39353 - DNA, 229 bp, Triticum aestivum
  unsure (1)..(229): unsure at all n locations
  Clone ID: PAT_TA_39353
ggtgagttgagttgcttggttaccttcggcgttgaaagttttgttccttaggctggcaacgtgaacatcaagcgttgctgaatatgtgcctgcggctgctgttgtatgtagtagccacacattataattatatgggatgttccattgtcttgttcaccaggttatgaggctttggccatggttttaactgcagtttcgattttcattgactaacanataaacttctacc

SEQ ID NO: 39354 - DNA, 226 bp, Triticum aestivum
  Clone ID: PAT_TA_39354
cggggagactaggcatgtcaaatccccgacgtgtcatgagtatacactggccttcgtatgatattgaatactttttacaagggtgcccccccatatgtcgaagcctaattaatcctggatacgaaatcatagctcttccccaatatgatctaaacttacgtaaccgtccattctatgtcatagtccttccagggaataccctaactcattcaccgaccgtcctttt

SEQ ID NO: 39355 - DNA, 411 bp, Triticum aestivum
  Clone ID: PAT_TA_39355
gacgggacagccaaactgcgacgtcatctacagtgtactggtccccttggcactattttataaagtgcccaggggacagcctgacatgcaccacacctcttatgggcatggtgccccatgctcacttgccccccacgccactcacctagcttaggaaattagctaaccattgcatataagggcacacatccatccatccagggaatggatccccatggactctcacgcacacaccctatcatgcgagctctcaagagagctatctacccatccatccattcacacacaacacacacgcgcatgagcactcacatgctcacggccatgagcatggccggccactagcatgccacatacgaggccaggtgccagatgcctacggcatttgactcagatacagctcgaggagca

SEQ ID NO: 39356 - DNA, 139 bp, Triticum aestivum
  Clone ID: PAT_TA_39356
gtcctgcaattgaggagattactggtgatgccgttatggcgtctcaaacttcacgcacagtaaatagggctactaacatctctgctctagtgcttatcaaactgatgtacaaagatgttcctatacgttgtggagttga

SEQ ID NO: 39357 - DNA, 369 bp, Triticum aestivum
  Clone ID: PAT_TA_39357
cggctacctcatgaacactgcgttggatttgcccgaacaggagaggatgatgcagtaaagtagcgtaagtattttccttagtttttgagaaccaaggtatcaatccagtaggagaccacgcacaagtccctcgtacccacacaaaacgatagtaactcgcaaccaacgcttaggggttgtcaatcccttcacggtcactcacgagagtgagatctatagagataatatttttggtatttttgatagatagatgcaaagtaaaaataaaggtaaagtaaaaacaaagcaagtaaataaagtgatatagattgatatgatgagaatagacccgggggccataggtttcactagtggcttctctcgagagca

SEQ ID NO: 39358 - DNA, 388 bp, Triticum aestivum
  Clone ID: PAT_TA_39358
acggtggataaaggcatccgcgtctcgttgtcaatcaatgatgcatgctgttttaccccggcgttggacacgacagcagctccttgtgccgaccctttgcttgccagtgataactccaactacgttaaccatttggcttgaaaaaatttgatttgtttttgacgggtaatttttgtttccattataggtggacaccatgatatactccctctgtttttgaatataagcccttttagagatttcatcgatacggactacatacggatgagcaagttgggcggctagtgacttatattcagtcggtgatgagatgagatgcgtcgactttgacgtggagtatggaagcaaactgtggaaagttggaccggcaaccatggccaaggaagca

SEQ ID NO: 39359 - DNA, 244 bp, Triticum aestivum
  Clone ID: PAT_TA_39359
acggggatgacaggtttcgggttcgggtattgctcaaacaggtttgaacccgtgaaacgtgtcgggttttatattttacccagcagctgccccgtggggttaaaaatacacccgtccccgtcccctaatagggtaaaaacccgtggggacgcgggttttggggccccattgccatcttgagtcaggcacgaactcgatgtcgagaatactcaccaatagccgggccaccccgttagctcgggcc

SEQ ID NO: 39360 - DNA, 350 bp, Triticum aestivum
  Clone ID: PAT_TA_39360
aagtcccgggcagacgggcagcggacggatgtatttgctctccagtgcacgtgttgtctcgattgacgacttgttttcttctatgtatcgaatatgtggaatattatttgtaatatacttgaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaggggccccccaaaggattcaaacttaatttacctttaaaggaaagttaaaacccctcaaaaatggcaccaaaattcaattaaagggcccttcttttaaaaggttctaaccggaaaaaccc

SEQ ID NO: 39361 - DNA, 159 bp, Triticum aestivum
  Clone ID: PAT_TA_39361
acaatcaatacatgacgctttttaaagggaaagaatttaagttggccgaattaattgacagttcacgacggaaaaaaaatgtttccattcttaaaatttgttctatttttagacagattttatctctttacacgatcgtgagaggttggttatatttcg

SEQ ID NO: 39362 - DNA, 370 bp, Triticum aestivum
  unsure (1)..(370): unsure at all n locations
  Clone ID: PAT_TA_39362
cccgggccgacgggcacataagtctaaagatgaccgctaaaccagcatatataaaaaatatgcagatggcagcaagcccacaccaaaaagtcattttctccaaatctatggctacctttaaaagcatattgaaagtggagggtgtaacaaatagtgatgatcacaacttttcacattagctagtcattctgttttctctgactattgatgcagtgtaggtagattgttatgaaggagctacagaaaactccatcaagaaaatgtcaataaacttatgatgattgtaacctagattaagcttaactagaaactacgtaatttgtaacagtggtaagggtttgctgcatgattcatgctcattaacanagct

SEQ ID NO: 39363 - DNA, 319 bp, Triticum aestivum
  Clone ID: PAT_TA_39363
acgggagagttatggaagctgctcagcctcaagcacggcagcggcaacgactgcctcctcgaggatttcgcgacgcacggaggagacacgaacgatgtttttttcgacgaaccggatcatgagcatcagaaacccatggctcttcttatggatttatatccaggagtgcttacaggaatacatagcatcgactaccagatcctattcaaccagaaaactagctacctttcagaccatggtggtggtgccggcgacacttgggctagtggataacatcacggccaacaagtcgtggacaacatcctggacatggtaaatc

SEQ ID NO: 39364 - DNA, 391 bp, Triticum aestivum
  Clone ID: PAT_TA_39364
aggctttggtcgtctcttgtacatggatgtagtagttatgatccttatgaactcatggttcatcagtgtaaagttcaggatatgtatgtccctgttcttgtagatttatacatattgttgtatagaaagaaagcaagactcggaaacgtgaactaaaaaaaaaaaaaaaaaaaaaaaaaaaaaaaaaaaaaaaaaaaaaaaaaaaaaaaaaaaaaaaaaaaaaaaaaaagaataaaagaagaagaaaacaataaagaaacatcaaaagcacttcgaataatgtcaacgaaattcgaattaattgaccgtcatttaaaagattagctaatgggaaaacgctgccgttacgcgaaacaacgagcggtgcaacaaagcctccttttacaagaag

SEQ ID NO: 39365 - DNA, 298 bp, Triticum aestivum
  Clone ID: PAT_TA_39365
cccgggccgacggggaacccaacatgactctactcgagctaactgtcactcctgccttgttcacatctatctccttgcctttcccctcctagtcatcccgtgagatggacagacccagcgcactccgacaatggctgcccacgcgactgccaaccacatttcgatcgtactctccatctaccatccgcccctctgcttccatttgcacttctcctgggggatcgatttccaggtctgcttccagcgcaccatcgtctggtaactcttcggcattatctacacgctctgggtcatcacc

SEQ ID NO: 39366 - DNA, 427 bp, Triticum aestivum
  Clone ID: PAT_TA_39366
gggtcgacggcagtcgctggtctgactgaactgctgggactatattaagtcgccggtctgcctgagccgcctctgtcgcgattgtccgtcgtccgaaagaatcaagtcatatctctctaaatatattttaataacacatgttgtttttaaccaagaacaaattactttggccaaaatatttttgtaaacaggataattattcactacaaatagggtttatgccacgggtgtggaacacgggctgatagtgttccgcccagcgatagtctgtgacatattacccgatgaatggacgcgcacaagccgccgccctagtggcccggtctacatcgacttgcggggatcgcgtttgttcgcttttcaatggacgtgcgcaagtcgccgcccatgtggcttgatctacatcaactagtccggaccaagcctg

SEQ ID NO: 39367 - DNA, 110 bp, Triticum aestivum
  Clone ID: PAT_TA_39367
agtcccggcccgacggggatcacaagaatgcctcggatcacaccaataaggaccgcgatcatactaaggaccgcgagcacaaggatggcatgattaagcacatcatgacc

SEQ ID NO: 39368 - DNA, 364 bp, Triticum aestivum
  Clone ID: PAT_TA_39368
ccgggtcgacggggattgtgaaagttcggacactgtagactactgaggtgttcaaacacagcgaaggctaaatcgactactaacggcacagcaacatcacgatgacagctatagctattgacacagctcaggacgctctcgtgcatcatcgcacaatgtaggcgaaatcgatgaacgcttgggagaagtgtggcaaacagatacagtcgcaaggtatggtgcatgtgatatcatatctctgcaatgctttacatgtctcacagatcatgggacgtcgaataataacctcgctgcagtgaacagcacggtgcttgtaacattaacgtcaatcaatcatgttggcattcacgcatcgccgttggta

SEQ ID NO: 39369 - DNA, 354 bp, Triticum aestivum
  Clone ID: PAT_TA_39369
gggtcgacggggcggggacggcgtcggtggtgaggtccatgaacgacaagttcgacctggtcatcgtcggacggagaggggaggacagggacgtcgaggggtcggcgctcacaagcggcctctcggagtggaacgagtgcccggagctcggcgtgctcggtgacatgctcgccaccgcggagttcgcgtccaaagtgtccatcctcgtcatccagcagcaggccgggattaccactggcggcgatgccgactatcaataatagggactggttcgactttggttcatcgttacattgtttctttctcgttgaatatatgtatgtatgttgtaatgaaagcaaggtaaatttgttc

SEQ ID NO: 39370 - DNA, 237 bp, Triticum aestivum
  Clone ID: PAT_TA_39370
ccgggccgacggggaacgtgaaagtgtgcgccggtacgctatgagctgttcatacagagtgaaggttcatttgtatcttgacagatgacccaacttctgctgttcattgcagctgttttgaactatgaagaggatctcgatcctacactcgtgtgtcagttcaattactattttagatgcatgttgtcgctgtgttgttgcactgccaggtagacgtgcatgcgtcatcaaagctca

SEQ ID NO: 39371 - DNA, 269 bp, Triticum aestivum
  Clone ID: PAT_TA_39371
tgatcagctaagagtgggtgccctgcctcgagttcagcatggttggcttcgtctttcgtgagcacaacagctcccccgggtactacgacggccgatactgggcaatgtggtatctgcctatgttcgggtgcaccgacgccacgcatgtgctcaacgaggtggaggaggtcattgaaggattatcctgacgcgtatgtccgcgtcatcggtttcgacaacctgcaccaggtgcacttcgtcagcttcattgcattcaggccacctggttg

SEQ ID NO: 39372 - DNA, 308 bp, Triticum aestivum
  Clone ID: PAT_TA_39372
accggtacgatattccgggtgacggtggtctttaagctgtcgggactcaattggccaatcaccttctaggtgctgaccttctacgtgcgcttactggcagggactggagcaacgatctttctactatttcgtccacatcagagatgccttagcgtcgatgacggttaacatcatgtaggaattggcctctgtggcatccaccttcagatcctgcttatcatgttttcacgaaacagcatgacgaggacttcgccaccactctgccgcactacactttacaatgctgcggcattccggtaccagcagcc

SEQ ID NO: 39373 - DNA, 338 bp, Triticum aestivum
  Clone ID: PAT_TA_39373
gtcggaataccgggtcgacgtcgacgtcatcgataaattgtgcgtctcgactaacatcactagtctcgcgcatgacacacatttgagcatgttcaagaacttgacgagcaaggtctgcgtttattgcaatgttgggagacacactcacaactcttccacggtttcccacaggcagctctagactctcggagtcgcatgtcacattggttgcattggtcacggcaagtatcgtcaggacacgcagcacggcgctaatttcacaagtttgagcgctcattacaatgacgattaggtcggtcccacacgcacatgtgtcgtctctatagtttctaggcact

SEQ ID NO: 39374 - DNA, 328 bp, Triticum aestivum
  Clone ID: PAT_TA_39374
tccggctcgactgccaggccaaggagccccagggcggcgtcctcgtcttcgtctccggcaccatcaccaccggtcccggcgagcagcccctcaagttctcacagatgttccatttgctgccagctggagggagcttcgacgtgcagaacgacatgttccgcctgaactatggctaaggaagggcgaccgctctggaggcaggcagcctgttgagggatttatgttagcacagggaagatcaggtggatatgctgcaggagtcgttgggtggtcggcagcttgtgcaggttggcgcaggcggttgccacggcttggggaggcagcgacg

SEQ ID NO: 39375 - DNA, 367 bp, Triticum aestivum
  Clone ID: PAT_TA_39375
ttccgggtcgactgctaccaccaagacttcaagcatctcagctggtcacaggcgagcgttggctctatcaggtggtatcaggtttccacgatgcgcggtgagattctacagtgtttcctcggttacatcgactccgttcggcatacctacagtccacacgccggccacaagggcaactacggctagttcatcatagccgaaccgctcggagccattgcacagtcgttctagggttttactttggtgaatttgcggttgcatcgtcggtatagttgcgggtcttagcgtctagtcatttatagtttcgagttctggtcatgagttgtcacgcagtcgccgcaccgatcatcatcgcccctgccagcta

SEQ ID NO: 39376 - DNA, 427 bp, Triticum aestivum
  Clone ID: PAT_TA_39376
aggtaccgatctacgaattcgcgactcgacattgtgacaaaaaagagcggcacctcttattgattgtgtgtgtgtgtgtgttgaggaggggcgattcaaatcagtggggtgaacttgtggtagtgtcgtgtatgtattttcaaccataaataggtagggaatggtagaaaaatgtgatataaagtgagagagaagtggacaacaagagagaataagataatggtgatgcaagtcagagaatcggaactatgcaacatgcaaaatcacaaaaaagaggggaaattatttcgaaaaagggaaaaaagggtgcaatggccatatgaatggtgccctaccgcatgggttaaagttctcaatggcacaatggaaacacctcgtggtgcagagtcccacatatgtgtgtttagccataatataagtagataga

SEQ ID NO: 39377 - DNA, 275 bp, Triticum aestivum
  Clone ID: PAT_TA_39377
tccgggccgaccattctacacaaactgttcagtgacgcgtatcagaggtacttgcgcataccactgtccgatatacctctggtattctgtgcactgcccttgaactgtccaatggtcatgacatagatgtacactctgtgccagcagggttgcttcaaagatttgtcagactactcggtgctggagataccgaggttccttacgtccttgatgctctagcaaggaaattgcgagcgccacggcggcctcaggatgcgctcgtcattacaactatg

SEQ ID NO: 39378 - DNA, 412 bp, Triticum aestivum
  Clone ID: PAT_TA_39378
acagcgagtatgatttagctacccatgcatgcaactattggatatgtgatggaatcatacagaaagacacagacattgctgaagcatggcaagttggtgagagactgcaaggtgatatccgatggaatatggactaccgcgacaatgaatttccctctcgctttctatggtatgccgagtgcgtaccacactgggcatcaccagctcatggatttgtgctggtccctgatggagtcgttcctagcagaacgttccagcattttgacaagcttggcgtgatgaaactctcaaggtgtagcttcagcttttcatcacctccatttctctgctgccacagccttagatttttatggcttgaccactgtcaaaacctaggaaagagaaatggggcgcaatttggagaagaggacac

SEQ ID NO: 39379 - DNA, 441 bp, Triticum aestivum
  Clone ID: PAT_TA_39379
ggtcggaataccgggtcgactcctgcgtctcaggccaaacccttcacgaacttcatcttcgagcaaaagatggcattctctctgcccggttgctgaccatcttcgctctgatgctccctcatccactcctggatgaaaaaaactgcattacataaaggagtacaatcgccagcgttactcgtactaatttgcatcacacagcctatcttgaaaataagttcaaatatctatatgggagaaagtcatgtacgtgtactatgaaaaagtttgtgtacgaaattgctgatgacattattatcgatgtgttcatttatataacacacatagagagttaatagcatatagatccttcaaaaatagtaggggtccatttggacaaacaacgggtattcgcaaaatagtttaacaggataatgaaaaaagttaacagttctcacaaga

SEQ ID NO: 39380 - DNA, 430 bp, Triticum aestivum
  Clone ID: PAT_TA_39380
cgggtcgacaccttcaaatggatatttgatgagtttgttaagatgatgggaggaaaaagaccaattaccattttgacagaccaagccagggcaatggaggtcgctattgcggacgtatatccagatgcgacacacagatggtgcaagtggcacatcctcaagaaggccaaagagagcctggggtctaattacaccaagaagtctgatttcagggcagaatttcacaagctggttcacgaaatgctcactatcgaggagtttgaggacgggtgggcagcgttgcttgagaagtattcactgaagaataacacatacctgatgcaaatttacaagacaagacagaaatgggccaagccatactttgcagggaaattctgtgcgaggcaaaccagcaacgggaggagtgagagcgcaaatcacatgttgaaat

SEQ ID NO: 39381 - DNA, 393 bp, Triticum aestivum
  Clone ID: PAT_TA_39381
gccataggatcaggggactggttcaagaccatcatcagcaggaagaagtcgaaccggggcaagtcaaagcacgcacaggttgctgcacaacgcaatggagccaacctgccgcatcacaagccgagcaacgctccatcttccagcatcgaccctcaagacaccgcagcactggaagactgggcaacgacccggattcaaaacgcgtttcagcgccacaaagcaacgaggacgctccgttgcctgaagcgacttcaaccactgagcattgttgggcacagcaatcgagttaccagccagaccagtgccacactgaactccataaattcgttccacaagtctaaggctgagcctacacaacggcgtgccttcatcgtccccgatgggctcaacacg

SEQ ID NO: 39382 - DNA, 421 bp, Triticum aestivum
  Clone ID: PAT_TA_39382
cgggtcgacctgttggtactggagaaggttctactaagctcgtacatgatgttgactgccccatggatttcgacttttcaccttatgtgagtgctaatggaggagtcgaacaaaagtatgacttatatggagtcattcatcataggcagtatggcccaaaaggtgggcactattggtgcttcaccaagtataatggagaatggtacgagatcaatgacgaacgggttacatctatcactaaggagggtgtagaaaagaaaacaaagaaagttatatctttttctataaaatgaaaatgggagaacattctgaaccacatggcgagcgtgcaactgaagacgacatcccaagacggacggacgctgatcccttacttttcaggcccccacctgatgaagatacccccaggctatctgataag

SEQ ID NO: 39383 - DNA, 427 bp, Triticum aestivum
  Clone ID: PAT_TA_39383
gggtcgacggcaagatttatgatgtgaccgcgtatttggatgaccatcctgggggtgctgatgttctgcttgccgtgactggtatggatggcaccgacgaatttgacgatgcgggccacagcatggatgccaaggcgttaatgaacgattacttcattggggagttggacttggacgaagcacctgacatgcctgagatggaggttttcaggaaagagcaggacaaggacttcgccagcaagctggtggattacgctgtgcagtactgggccattccggtagcagcagccgggatatcagccgtggttgccatattgtatgcacggaggaagtgatgactggctatacgttgattgaagaaccatttttgggtaacacacacatttatagcctgttatggatggagaaattatgtacttcggtccaa

SEQ ID NO: 39384 - DNA, 191 bp, Triticum aestivum
  Clone ID: PAT_TA_39384
gatagctcacccactaagctcgaagctttccctgatctggatgatcgccgtcaccatgcttctaattgttcgtcgctgtcatattgatcgggacatgtcatcgaaggggtggcctgcaaatttggttcgagtgagtttgttcacattatcgtcagtgcttgaagttacgcgactgggtgcattcgaccatg

SEQ ID NO: 39385 - DNA, 440 bp, Triticum aestivum
  Clone ID: PAT_TA_39385
ggcgaaggcgagagaaggggacagcagcgggcgagacagagagaggcgaggagacgacagcaccgccgccatgagcgccctcaagttctgcagcaaatgcgacaacatgctgtacccgcaggaggacaaggagatgcacatcctcctctacgcctgctcgaattgccagcaccaggagattgctactgattcttgtgtgtacaaaagggttcttcggaaatctgctgatgaacctaaagacaccctaaaagacgcagctgctgatgcgtctctgccacgcaccagaagtgttaaatgctacaactgtagctatccagaagctgcttatttccaggccccgacgacaggagaggttggcctgacgctatacttcatctgctgcagccctacctgtggccacaggtgggtggactgactgactgacaagggggaaccctcca

SEQ ID NO: 39386 - DNA, 297 bp, Triticum aestivum
  Clone ID: PAT_TA_39386
ggtggccctgtagagctgaaaagggccgctgaagacaggattactatcagatggactttcaagaaattcaacgaaggcatcatgcgagacatactggacccgctgctggaagatcgcgtggacgaagacgtgttggaagaagcttcagactgtggggttccagtgcgaccctctcacacaggacgaccgtctcacggtaaccgaggtcctggagcagctgtgggacatcaggaaaggcgatcggatgcgcttcaggatcgcatccaatcatttgctcatttaatcacgaccagtgca

SEQ ID NO: 39387 - DNA, 443 bp, Triticum aestivum
  Clone ID: PAT_TA_39387
gccatcatcgaaaataaagaagaggattacgggatgttcgtctggccatgcagcgtcatcctcgcggaatacgtgtggcagcagaggccgcgcttctcctgctccagagttgtcgagcttggtgcaggaacctcgctgccaggtatagtagctgcaaaagttggagcaggtgttacgctgacagacattgcacataatacagaagtgctggacaacatcaagcaagtatgcggcctcaataatgtgaactgtattaggacttacttggggagattgggatgaacctgttcttgatttgcaccctgatattattctcggagccgatgtgctttatgattcagcaaaatttgatgatctcttcgcaatgggtaccttcctgctgggaaattctcctgtggcagtgttcatcaccacataacagaatcgcagtggtcatcacttga

SEQ ID NO: 39388 - DNA, 375 bp, Triticum aestivum
  Clone ID: PAT_TA_39388
cgggtcgaccgccgcggctaacaggtgctacgcaaccgtcgcgccccgtgcccgctcgtccaccatcgtcgccagcctcggcacccccgcgccctccaactcctcctccttccgccccaagctcatcaggaacaccccagtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcgcgtgtgtgcccctcggtcaccctgggcctggagcccggcgaggccttcaccatccgcaacatcgccaa

SEQ ID NO: 39389 - DNA, 443 bp, Triticum aestivum
  Clone ID: PAT_TA_39389
accggtctagtaatcccgggccgaccgacagatcgaggacagctgcggtgcacttgtcacctcaaccagccgagcactcctcctcctcgccgtcgtcgtctccgatccactaccgcttccgcagccatggtgaacgttccgaagacggggaatacctactgcacgaacaacgactgcaggaaacacaccctccacaaggttacccagtacaacaaaggcaaggacatgcctttctgctcacgggaagcgtcgttacgaccgcaagcagtctgcatatggtggccacacaaaccctgttttcaacaagaaggccaaggcaacaaagaacattgtgctgaagctgcactgccagacctgcaagcatttctcacagcgtgccatcaccaagtgcaagcacttttaaatccgtggccacaagaacggccgtggaacatccctcttca

SEQ ID NO: 39390 - DNA, 436 bp, Triticum aestivum
  Clone ID: PAT_TA_39390
tacggtcttatcttcccgggtcgacagattgtataaaatattatgtgcatgtgcatatacatagccaccgattgcattcacatacgagcacgctttctcgagccatgttgttacatgaacatggacatacacatattcttaggaacaagtaagagagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccagctcgttgatcacctgtgtggcgtcggtggcaccgaacataggcagcttccacatttgtca

SEQ ID NO: 39391 - DNA, 278 bp, Triticum aestivum
  Clone ID: PAT_TA_39391
ccgggccgacattgcaaaggataaacagggccgtgccgcagacgtagttccaatagcaagaggccctcctaagccagtcggcaacacctgaaaaaatgcgtgttgtgctgatgcttgttgcttaaaaaataagtgtaaataaagtagattgcgatgctcttagagaaaagccgatgtgtaattatgctgaattttatgttttgcaagaacataattttttaatgtaatcgacgcgtaatattgtgtcgaattttatgttctgcaagaacaacagatcc

SEQ ID NO: 39392 - DNA, 439 bp, Triticum aestivum
  Clone ID: PAT_TA_39392
ccgggccgaccgagaagacgacaaaagggcatcgagtagaccctgttattgtgagaattcttaattcaagagttatagggagggacttatgtcaccacaaacagaaactaaagcaggtgttggatttaaagctggtgttaaagattataaattgacttactgcaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgttt

SEQ ID NO: 39393 - DNA, 385 bp, Triticum aestivum
  Clone ID: PAT_TA_39393
aggatatgaacaagactgtagcaatcaatactctctctgagtacatgatgcacctcctggtcaagcaccctgacattctgctcgtcaatacagattctcggggattgattgacaaagcctggtactcttgcataccgctgtttgtatcatattctgcggatgattatgaccaggaatttatggattacaaggtataaccttctaagtacttggggctaccataatactttaatcaatatattgaacaggataaagaatatacttcccagggcgaagccatgctggtgaaagcaagcagcattgctcgcacaatgctatacatggatctggggctagtagattagatggttataaacggaacaatgtgcacggagatgttgtgcta

SEQ ID NO: 39394 - DNA, 420 bp, Triticum aestivum
  Clone ID: PAT_TA_39394
ccgggccgacactgtcacaaaacaacacatcgggattgccactgtgctgtctccaccagtggcatagaactcggtacatagttcagtaatagcaacagataggtctacatactagtacaaacggtaatacgatggatcaagtgttccgttcgtgatttgcagccgaaatagaatgtccataaccgacaacagcatcgaccgaagattctagatcagaaggacaatgtcatgtctaaggtgctgtccgtgccatatgttctcaatgcaactcgttgtcacctttggaaaactacattgaaagtcggtccaaccaacgtaactgcaatctagacacatcgtgcttaactcgagatgtggaatatcaccttttaggctgcatgactgctgctgtcgttcagcaggatgatgacacacgtagac

SEQ ID NO: 39395 - DNA, 432 bp, Triticum aestivum
  Clone ID: PAT_TA_39395
aattcgccggccgacaacaacaatgaccctcaatagcttgaggatgctagtgatgaaagacttggcgtgttgcacccaacttcctgatggattatgtcagctcccatggctagagtacctgaaagtcaactgtgctccagcgatcaagtgcattgggccagaatttgtgcgtccccagagccaccgttgctatccttcatcctgcatggtgactgcatttccgaggttgcatgagatggatttattagaattggtggaattggaggaatgggaatgggatgaggaagtgcaagctatgtcagtcatggttgagcttactttcacaagatgtaatttgaagtgtatccctcccggtcttgcctcacatgcaaaggctttgataaagttaaccttgtggagcatgtggcgtctccattcgctagagaactttgc

SEQ ID NO: 39396 - DNA, 289 bp, Triticum aestivum
  Clone ID: PAT_TA_39396
tgatccgatcaaagtgggtgccctgcctcgagttcagcaacgttggcttcgtcttccgtgagcacgacatctcccccgggtactacgacggccgatactggactatgtggaagctgcctatgtgggggtgcgctgacgccacacaggtgcggaaggaggtggatgaggtcacgagggagtaccccgacgcctatgtccgtgtcctcggcttcgatcgcctgcgcccggtgcagtgcgtccgcttcatgcccttcacgcccctgcgtttgcgacgagtccgggcgtggcc

SEQ ID NO: 39397 - DNA, 247 bp, Triticum aestivum
  Clone ID: PAT_TA_39397
tcaccaaggtcgggttcatcgtccgtgagcacaattcatcccctgggctgcttcatggtcggtactggagaatgtgtgacctgcgtaagttcgggtgcaccgacgcaaaacaacttatcaacaacgtggatgaggtcaagaaggagtaccccgatgcgtatgtccacatcatccgcttccacaacatgcgccaggtgcagtgcgtcagcttcagcaccttcatcccaccgggttgcgacgagtccgg

SEQ ID NO: 39398 - DNA, 317 bp, Triticum aestivum
  Clone ID: PAT_TA_39398
catctagtagaccctgttattgtgagaattcttaattcaagagttatagggagggacttatgtcaccacaaacataaactacagcacgtgttggatttaaagctggtgttaaagattataaattgacttactacacgcccatagtatgaaactaaggagaccgatatcttggcagcattccgagtaagtcctcaacctggggttccgccctaataaccacgggctgcactacctgccgaatcttctaatggtccattgacaactgtttggacttattgacttaccactcatgatcgtcacaaaggacaatgctatca

SEQ ID NO: 39399 - DNA, 100 bp, Triticum aestivum
  Clone ID: PAT_TA_39399
acagcatgatcgtcttgacatagacttcacattcggcatctgatatgttatcgggaatgtcctacggtactgcgccttgctcatcattgcacagcttaat

SEQ ID NO: 39400 - DNA, 337 bp, Triticum aestivum
  Clone ID: PAT_TA_39400
catctagtagaccctgttattgtgagaattcttaattcaagagttatagggagggacttatgtcaccacaaacagaaactaaagcatgtgttggatttaaagctggtgttaaagattataaattgacttacgacaccccatagtatgaaactaaggatactgatatcttggcaccattccgagtaagtcctcagcctggggttccgcccgatgaatcatgtgctgcaataactgccgaatcttctactggtacatggacaactgtttggactgattgacttaccagtcttgatcgttttaaaggacgatgctatcacatcgagccttgttgctgggg

SEQ ID NO: 39401 - DNA, 211 bp, Triticum aestivum
  Clone ID: PAT_TA_39401
cgtagcaagcgaagaaatgcttcggggaatttaaaataagcataaattcggaaaatcccaaataaggtcaccctttaaactgcctgcttgaatcaataacaaggcagaaaacacctggccaaactgaaacatcttagtacccaaaggaaaaaaaaaaacaaaaaaaaaaaaaaaaagcgggcgccccaaaagatataagcctatatatacc

SEQ ID NO: 39402 - DNA, 287 bp, Triticum aestivum
  Clone ID: PAT_TA_39402
aatatgagacgaagacttaatcttgatatacctcagaagaatacattcctgttacgacaacatggattggccgctacggatcacttgactgggagtgaaatttggaacgggtatacttgacgatgaggatatcaatcacttgaaagatagaggtaatcattcggttgccgatccgttacaagatcaagtcggattggctcttgggcgttgtacaacatgcagttcagaagaccatttgtacagtactcatacgtcaatcgaagacgactccccaaacgttggtaact

SEQ ID NO: 39403 - DNA, 450 bp, Triticum aestivum
  Clone ID: PAT_TA_39403
aattcgcgggccgaccggctgaagaagacagaaggggcagggctggaagttctgcgcattataaatgagccaactgctgcatctcttgcttatggttttgagaagaaaaacaatgaaacgattctagtgtttgacttgggtggcggtacttttgatgtctctgtattggaggttggagatggtgtatttgaggtgctttccacatctggggacacacacttaggtggagatgactttgataagaaaattgtagattggcttgctagcaccttcaagaatgatgaaggcatcgatcttcttaaggataaacaagcccttcagcgtcttactgaggcagcagaaaaagctaagatggaattgtcaacgctcacacaggcgaacattagcttgccattcataactgctactgctgatgggcccaaacacattgaggcaaccctctctagagct

SEQ ID NO: 39404 - DNA, 383 bp, Triticum aestivum
  Clone ID: PAT_TA_39404
catcgagtataccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcatcattccgagtaagtcctcagcctggggttccgcccgaagaatcaggggctgcagtatctgccgaatcttctactggtacatggacaactgtttggactgatggacttaccagtcatgatcgttacaaaggacgatgctatcacatccagcctgttgctggggaagacagtcaatggatctgttacgtagcttatccattagacctattt

SEQ ID NO: 39405 - DNA, 401 bp, Triticum aestivum
  Clone ID: PAT_TA_39405
gtgcctctagcgtagaatgcttgctcatgacgtgacgaacttagagtcgtctgagagtttggataatcatctgacttagtatacctgagtattggccataatttagaagaacattctgtcgtattagtaagatgaggaaaggttaaggatttacccggtgtgcgatatcacattagtcaaagaaccctagatgctgtcgcaatagtcaatcgtcaacaacggcgttctaaatatgtggtcaaaacaccactgggttaagtgattttagcccttataaaaacaggatcgattcatgagcctcttacacgctcatgtcacgtagaagtactgcatacaaaagaactggaaaatgggatacactttgtcgtaatccattagttaacatggtggttaaccatatt

SEQ ID NO: 39406 - DNA, 256 bp, Triticum aestivum
  Clone ID: PAT_TA_39406
taatcttgatatatctcagtcctgtgcactcgtgcaacgacaaagatgtacatgcgccgactatcgcgtccactcgcgctgagaataacactttgatactgatgcagatggcatgaccatgcctctcacgataggcatgaaaattttcgatcagtcgaggtttcgtcacactatcgattcttgctagcccattgccccataaaacttgtcatctccccccgccatccgtacaatctcatccctccccctccttttg

SEQ ID NO: 39407 - DNA, 431 bp, Triticum aestivum
  Clone ID: PAT_TA_39407
agacgacagaagggtatccaatgcaatttattttgcaaaaaaagaaaagtgtacaaaaatgaatatgcatgcatgtacatctccagcaccttactgaacctaactgaacttcagactaaagaagtacaatttacttggttcagactaaagaagtacaatttacttggctttacatatgaagaagcagaaaaagaaccagactaactgaacctaactgaacttaaacacacaaaaacagtatgatctgccacactctccagcaccttacaactgcatgaaaaaacacacaaaaacacctccaaatctattggctgcttgaacaataaggacacgagaaaataactaaaaaatcctagagttgactatagagttgaagctattaaactttgcttgatccacacagacaactaccctaatctcttcagatatga

SEQ ID NO: 39408 - DNA, 403 bp, Triticum aestivum
  Clone ID: PAT_TA_39408
ctggccaaatgaacggtcaaccgttgacttttgacaaaaaaatcatagaaaatcctgaatttaaaacagttcatgacatttgaaagaaagtccagaaacttcaaaaaagttcatgaagttgaaaaagttaattgattttgaaaaaaatccaacacaactaaaagaaataattcatcaattttgaaaaaaagtaagttcatctgttttggaaaaaattaaatcaaaaatgaagaaagagttcatcgattttgaaaaatgttcatcgaatttggaaaaagtttatcgattttgaaaaaagagtgtgtctatagtgaaaaaagttcatcggtttttaaaaaattagttgatttaagaaaagaattcaatcggttttttaaaaaattagttgattttaagaaaagag

SEQ ID NO: 39409 - DNA, 134 bp, Triticum aestivum
  Clone ID: PAT_TA_39409
aattcccgggctgacggcgaataaaagcgccatatgttctccaattatgtggtgttctgtaaaccagtgtgtgatgagggagacatacgcactccctcctatgaataatcgttggatttgtgagtgtgatcggt

SEQ ID NO: 39410 - DNA, 375 bp, Triticum aestivum
  Clone ID: PAT_TA_39410
cgggccgactctcctagggtttcaggaatattggggtatttatatagcagataagcagttcaaggggcacccaagatgggcacaaaccaccattgcgcgccctgctgggtgttgccctcctcgacgaatgggcaggtacaaccttggtcgactggatgtcggtctggacaacaaagtcctcaggaattttcactatgtttggacgccgtttggaattgatttcctgcgagtgtaaagacatgcatactccaccaactggcattgagcagtatgtgaataggttccgactaaagaatgttattgaatgactataaaatggttgtgccacatccaagaatgatgatattgcatcatggtataatcaataattataca

SEQ ID NO: 39411 - DNA, 436 bp, Triticum aestivum
  Clone ID: PAT_TA_39411
ggtacctatcaggaattgacggctcgacgacgaaagaagggcatataacttgtgtctcttgcttcttaagattattgcctggtatggtgtaataaattcagagattgcctttgcagtggtctgtagctacaaagatgattatttagaagaacatagatgatgactaactattgagaagcataataatgtttttatttcttcttcatgacaatcaaggtcaaacaaatatcttcatgtttatcagaatgaaataaaattgatggacagtgccactccattgataactagagctagcagtgtgtttcatctagatggttacattttcttcatagaagaatgtacaatgctagaattagtagacgcgagacagtcaagatcttcatgcactcaacactcgttgtactgagttttttaacaatactcattgtaatatgtg

SEQ ID NO: 39412 - DNA, 344 bp, Triticum aestivum
  Clone ID: PAT_TA_39412
cgggccgactgtagtatcaaagcattgaacactgcctcctgtctgcgagtatcatggtatgacttgttgtaccgtatgtacgaccacgtgtatctatctatgtaccacaacacatgtagcgtgtgtgtggttatgtgcaccgcaatagcatatgtctgtaacctaccgtgtcgtgtccgttgtctgtatcgatatcacttgtgatctacactaaggccaagatctgggcatcgcaccacttcttgtcagtgtagtcaacctcatgattcatccgacaacgttaaccacattggatcgtgagactataggactcatgggaagtcctgaccggagtgcctgaaaac

SEQ ID NO: 39413 - DNA, 348 bp, Triticum aestivum
  unsure (1)..(348): unsure at all n locations
  Clone ID: PAT_TA_39413
acttccatgtgaatgggaaaaagaaaatacaaaaactataaaataaaataaagttaaataataaaattcctcatattatgcgtgtttcgatctcattgccacacaagtctcgtcacagttgcggacgcgttttaccccttgagttgcacgtagcttcggatgcatgcaattgcatacgttttgcaccttcgtagttgcatggattccgataattctagttgtacgtaagtgaaacaagagtttttgtgacaaataaaaagaaaaggcaacaatttttctgtcaactgacgtaggaaaaatagggcatatcaacactacganaatatattcctggataatacatgactg

SEQ ID NO: 39414 - DNA, 238 bp, Triticum aestivum
  Clone ID: PAT_TA_39414
gccgacgacgaaacctactacaccggcggtgcctactactacgtgcagcccgctgaccacgaccaagagtagttaggacgatcccagccacgaggcctgcgcctcgttcgatctgtctccgagtttgtgctactcatcttatcggaacttgcgtaacttaagtctgtcctcagatattcttgcttccgcggactcgtccacgatcgagcacttctattcgatgccccgaggaccctgg

SEQ ID NO: 39415 - DNA, 422 bp, Triticum aestivum
  Clone ID: PAT_TA_39415
cccgggccgacgagtggaggagtgtcttccccaacgaccccgacaacgacactagcccggacccggcatgcggcacaccgtacgtgacgaggaaggattggctcgacctccacttcgaccgaaagtagtttagcttagtttaaatttatgttttatgttcggttatgcaaaactatctatgtttaggtttgaatgcatactacttttcgttgaaccttctttgaacttgatcaaattaaagtttacaacattaagtttaggggatcgaccagaaatggccaaaaattgctggtatatatatatataatagagagagagagagagagagagggagagagtagcactattctgatcccgggatcagaatagttatttggatcacgatcagcctaaataggttccgacgggcatgttcccgaact

SEQ ID NO: 39416 - DNA, 347 bp, Triticum aestivum
  Clone ID: PAT_TA_39416
acgcgaaaacgacagaaggggaaagaaaaaaactcgtacggagtacgaaagaataaaataataaatgtctttgacatccaattataccactgaaatttttttttcatttttgaatggcagttccaaaaaaacgtacttctatctcgaaaaagcgtattcgtaaaaaaatttggaaaaggaagggatattggacatcgttgaaagctttttcattagggaaatcactttctacaggtaattcaaaaagtttttttgtacagcataataaataaaatacactataataattagaattagcctaacttaaaaaccaatttgtttaaatacatctaaaaaaaataggaagc

SEQ ID NO: 39417 - DNA, 397 bp, Triticum aestivum
  unsure (1)..(397): unsure at all n locations
  Clone ID: PAT_TA_39417
cgaattaaagaagtttccgcattcactccattgtggaacaccagaagttacttactctgcaaattttccaatcccgattcggacatgcacattacacgcattcacacctagggaaaggaacccttaacagaactattctctctggtagatgtttcctacataatctctccctaataataaagcacggattgactttgtcgggttcaccgtcacaatactcttcttcccgtgaatttacactttcagttcanatttannacatattcaaggtggtactaattttttgctaattcctggtttcgtctgctcctacgtctatgtcgccccgtacgtcctaaatcgggcttgtccagcctacnaacaaagtgggccgtatgttcnnttgcgctgcaccttt

SEQ ID NO: 39418 - DNA, 414 bp, Triticum aestivum
  Clone ID: PAT_TA_39418
cccgggccgcccttcccactatgcaaggtattccaacatgtggaagccgcagtcgtgcctaaacaagaaaagagtcaggttaactcacaagaacatatagaaaaaaaatcataacttcaattcagaggtgacaaaaaagagagggtgagcattggtttggaggacacatgaggaaaagatgggaaaataccggtttccttgcttcatagtcgccacgtactcaattggaaaatgtctgatctggacctttgagttttcatagtgacggttccatgtctctttgaggttgttgatgaagtattcaccatgcgtagtaaggtctgcatcagcttctgaacgcattgaatcaagcacctcaaaacgttggttcttcaagtcaaggcagatcgcatagtggtgaacacacttgtcgtg

SEQ ID NO: 39419 - DNA, 455 bp, Triticum aestivum
  unsure (1)..(455): unsure at all n locations
  Clone ID: PAT_TA_39419
cggtccagntatcccgggtcgactacatcaacacatgcagtgcgtttggtcctcggatgtggctcactattgagggtgatgttgttcacttgcacacattgtggaagtgtgtttttttagcaaaatgacaaaaaagtaatgcggttcatttcaatatatattgtggttcacttgccctcgtctctgcggtccactctcactcataaaaaatgttgaaaaaaatacaacaaaaactcgtgtgagaaaaattacgtccaacaaaggaaaccatgaagttcacttgactgtctgatgcggtgcgactttttaatctaaagcagtgcgttcctttgtctgatgtggtacatacgacgattttgggtcgccaaaaaatagagtgtccatatttcgttaaaatcaaaattgctcttaaaccgtaaggaagttcgcttcttatcagatgtagttcactcgct

SEQ ID NO: 39420 - DNA, 455 bp, Triticum aestivum
  unsure (1)..(455): unsure at all n locations
  Clone ID: PAT_TA_39420
ggtcttncaatcccgggtcgaccaagcacggagataagagaggacactcctctctattaattaattagctacctaacacaatatatgaaacacattaattaaccatacaaaacccccaaatcgccccccttcagaaaaaaaaagaaaaaccctagcccctgaacagctgacgcgtggatgcctattggtcccggttggtgtcaccaaccgggaccaaagggcctcctgcctgggctcgccgcaccggccacatggaggcccatctgtcctgattcgtgtaagaaccgggactaaaggccaagggcattagtaacaaccttttagtcccggttccaaaaccgagacagaagacccttacgaaccgggacaaatggccctttttctactagtgtgtccattttgtacacgaagtgcatccagtttttctcgtaaccctctcaaaattttagcacatg

SEQ ID NO: 39421 - DNA, 389 bp, Triticum aestivum
  Clone ID: PAT_TA_39421
ctccacttggatctcagcagtcatttggatatgcttgttgatatgcttcggaagcatcacaacatgtggctacattgtggttcaacttctccaagtgtcataccaagacccagtctaccatctgctactgaactcccatagcaagaagacctgaaaactcattgaagggatatgttcttggtacacaataatgtcccctctgttcataaaggtgccacaataaagggtataccagagtagcaattagagaagttttttctttgtggaatggaatgatttcttaacgaagttgaagctccttgttatggtgtcaaaggtggttttctaattgtatatcaaatttaattgcttggcagatgatagacaacagatttttcttttttacgaat

SEQ ID NO: 39422 - DNA, 431 bp, Triticum aestivum
  unsure (1)..(431): unsure at all n locations
  Clone ID: PAT_TA_39422
ttacgtataaaattaggatatgtcccctcatgtgccagttttgagatatcttagaagttcacgatctggttttagttcctgcatctttttccacctttctgtagagatttgagtaaaacttaaatgtctagatgcatataagcttgtgagttaattaatgctaacttgatggtccaaactaaattctgcaaatatgaccatgacagaaagataaatggaggtttagaggcagagtggatgcctgcaccaactttataggttgaactacgttttgctagatgactcanatttcagaacacgagcattaatttttgggaatgcagttaacaacagaatcaagtcaagatgaaaaatggagaactattcaatattgagtttaattcccttcttgcagagcaacagagatgagtgaagagattattaaatattga

SEQ ID NO: 39423 - DNA, 419 bp, Triticum aestivum
  Clone ID: PAT_TA_39423
ccgccgacgacagaaggggcagggcaacttttcaagtggcatttcctttataatagtaggtgatgttggaccagccgacgaaccctagctactatacatggggagttggggagtagtcgcatagaagaaaacccgcatgcagcaacctggggagctggaacagtacaagaagttatacctcaggtgggcgagatgtcacttaggcgggtgggcgggatcttcccacagaacaagggcgcagaggacctttgtccgcgccagcgccggctccgagtggacggtgcacaacggcttcctccatcgtcgatggtaacaacgtcaacgctgcacctcctcacctcccgcagcggacggaattcggccggatctgtgaccaccgatgaggagagagatagagtggacactgtcatcttgttttg

SEQ ID NO: 39424 - DNA, 446 bp, Triticum aestivum
  unsure (1)..(446): unsure at all n locations
  Clone ID: PAT_TA_39424
tcccgggtcgacgattgtgtgcattgccatcagtgatgctcatgatagtgactgctccggcgtgcggcggctgcttcgcttcgtgaccggacgacctgtccagacgtatgaggctggtttggggcacccggctgtagatgtgctaagttaacaaaatccaccctttgtcaaaaatgcacgcatctgaagcgggcatccatggatcgttgctactaattagcatgattaggtcatagtgacaatactggaggttgttaaacattaaatcacatttgaatggttagatgtctacatcttgccgacaatcagggaaggtacgtcccttatgggggccgacggtctttttcctcttttggtgagcccgacaaagtanctgtattcgtaatttttttaacaacacaatgagaacttcagttattgttggttgataactttaagatgtgaaa

SEQ ID NO: 39425 - DNA, 450 bp, Triticum aestivum
  unsure (1)..(450): unsure at all n locations
  Clone ID: PAT_TA_39425
attcgccggtcgacgttcacaagaaaccactaagggaatcacaacatacatataatcaaaatatcaaacacatcaaattcacatgattacttctcccgtgacctcaagaacaaaagtaagtactcacaaatgatattcatgctgaagatgagatgggtattaaatagcataatggatctgaacatataatcttccaccaaataaaccatatagtaatcaactacaagatgtaatcaacactactagtcacccacaggtaccaatctgaggttctggtacaaagattgaacacaggcactanggtttgagaggagttggtgctattgaagatgttgatgaagattggcctcccaaagatgagagggttgttcgtgatgacgatggcttcaatttcccccttcgggagggaagttcccccggcggaatcgctccgccggagggcaaaagtgc

SEQ ID NO: 39426 - DNA, 310 bp, Triticum aestivum
  unsure (1)..(310): unsure at all n locations
  Clone ID: PAT_TA_39426
agagaccgggacctgcgagaaggccaagatcacgatgcaccgagtggttccgtacgtcaggtcccgagtgctttagccgttacatacgagcagctgagattcccaacaacttcaggttggccacggggatcagcaaattcactagcgagtccaagcctgagatatggctagaaggttaccgaatagcagtctagatcgacggcggcaacgacaatgtggccatgaagcatgtcncgctgatgctagagggatccgctcgagcttggcttactcggctcccgacaggcagcatattttgttgggatgacct

SEQ ID NO: 39427 - DNA, 426 bp, Triticum aestivum
  Clone ID: PAT_TA_39427
atacaggtagagcgaaagatacctgagataccatgaacgcgtataggtcgagagagatagtcctacataagcatgactgataactatatgatatgaatatctggattaaaggggattcaactatttaaactggagatcacgacatcgataatatcataacgcacatctggtgtatcaaacagtgcatatccatttgaatttgggcacatgtgctaatgttatatagtttatcaatattggtgatccatagattcttcaattacatacaatgcatggtttatatgcagttaatgtctacactggattacactatatgttgcatgtgtgaaacacattagacatgtctgagaagtaaaaaacccgcatgatacacacattaattggcgacacttatcgaggaatgcatacattggatttcaacataaa

SEQ ID NO: 39428 - DNA, 430 bp, Triticum aestivum
  Clone ID: PAT_TA_39428
acttccccacaaagagacgcaattttgactgtacaattttgattatacagtttttatacttccgagagaaaaaacgcaattgtgattatacttctatactttccaatagaatgacgcaattttgatatttccccataaaaaggttaaattttgaccaagaattctgatcatgattcctacttctttttgctcctcttttttttttttttgcggtgctgttgtaagaggatctatttgtgctatataaaggaaaaaaaaaggagcatgaggacgaactcaccatcatgtcgagggaggatttgccgaggccgttctggcagccgtttgcctgggaagagagctgatcgtctcctcttcaaactgatatataggtgctggggtgccgccagcaatggaaactcggagactgaatccgaaagagggcctgttt

SEQ ID NO: 39429 - DNA, 429 bp, Triticum aestivum
  Clone ID: PAT_TA_39429
acgcagatctatttcccgtcatctttgaccgtgacacgtgcatgccttgtagggcgcggtccacatgcttgcaggcataggaacaaactctttgttacctagctccgtctttggcttggcacttgaatctgctggctaatcaccctcagccaggtgcttatgtttagctagctagcatttcttctttgaaatggggttctaaaagatggttaggctctggctaggggcctatggttacgtgtccttttttgcgggtcacatcggccggaagcatggtatgtgtagctagcctgcttctgcttgtaacacatttcagataattgtgcgtgcagtgtacagaataaagcacgacaaatatatatacatatgtgcatacaagtgggtgatggatacgtgtcgatccatgcgtatcggtcctaatgagacgcg

SEQ ID NO: 39430 - DNA, 446 bp, Triticum aestivum
  Clone ID: PAT_TA_39430
cccgggtcgacctgtctggtttaatttaacaactgccatattttgacatgctacaatagtgcattttcatgtgctgaaaccccagctttctaacgattcacttgtctgcagatatattgtatgactcgtggtcaccagcaatgacggtcagttccgtgtgcatcagcatcttgtccatgttgtcaagttcaccagctaaggtcacccagctccctctacattatctacaatctaactgaacggtcatctaactgtacatattgtttgcatgcaggaacgcccatccgataacgatcgctacgtcaggaactgccgcaacgggaggtctccgaaggagacgaggtggtggtttcatgatgacaaagtgtgatgggctccagctggtttcttcttccggcatcagcagctcttatacatcatcatcctgcctaccgtagtatggcgtg

SEQ ID NO: 39431 - DNA, 414 bp, Triticum aestivum
  Clone ID: PAT_TA_39431
aatgtttgtaaattcaactgctcttcctgtgcatcagccatttgaattggtgatggataaatttggagtgaaaacaaggtcttcagagcagacaatgctacctattgaagcagatatcttgctggttacagatagctcttcaaatgaggattcagaggcagatgaccagtcctattatccccttgaggtgtatgctcaaacttggcagggttatattactcatatcatgcatatgttgtattgcaatgcttagttttttcatcatatacacgatattgaataccatctccttagtagacacatcatatatgcgattgccctcttctcacttccttagtatataaatcatatatttgaatcatatcatgtagcgaccagacctcaaacagtctgatctctgtgctccggtgtcat

SEQ ID NO: 39432 - DNA, 422 bp, Triticum aestivum
  Clone ID: PAT_TA_39432
gggtcgaccggatttggaagatagaaaatggggaaaagaaagtctccactacttttttacgggaagcaacataatgcaaaatacattatcatgtgtccaatggcacccacacgtatcctcatagttttattttcttgagttggtctgaccgacatgtggaccaacgaatgggcatgtacgccacataagtaggagcacaatccgtgacggtccggatggtgtatattaaaaaaatgctaggcccgactaagcccgcttggtcaatctgcgacggattctgtgacggtagcccgacgtccgtcatcaagggcccgctgttttcgggcccaaccacggcttacaaatcagtgacggtagtcgtgacaggtcatggttttcccgtcatattcatgacagattctaggaatgtcagcacgaatccg

SEQ ID NO: 39433 - DNA, 416 bp, Triticum aestivum
  unsure (1)..(416): unsure at all n locations
  Clone ID: PAT_TA_39433
ccgccagcttccctgtggataagttcttcctccattcgattacatatttgacatgtttcacgtgaagaagctggattttacgtttgtccgcctttatgccttgcacatgaactacatcattggggttgagcagatacgtcatatctgtgtcgctgacccgtactacatgcacgagagcttcttgggagtctgcgcagagcaacgtgaatacgtgagggattacatcgtcagtttcatgctcgccaataaggacaaggaggcgattctcgtgccttatcatcccatgtaagtcatccacgctgctatccttccttcgatttcaataattcatttgcacggcggaggctaattaatttgaggtgtacttattttgcgcagcggcgggtgcgccgtcctcatcatcctctanccccgat

SEQ ID NO: 39434 - DNA, 406 bp, Triticum aestivum
  Clone ID: PAT_TA_39434
gggtcgaccgcaggcctgaaaagatctgtgcgtcagtacctgctctggagatggatcgatgaaagaaggcggcggcagcctcagtgagtgggccggactggcgtgtgacccagtcccggtatgtggctaggatggggcatccggcattagatattaggatttgatgcgatatctgtttggtattaggctccactgcattaaggggtaggagtagcgacagatgttgtctagatggtggcttcaagcttactgatatactactttgtaaggtttttgtgcttaatacataaagtggccgtatgcattgtccagatgcagaggccggggatgcatcctccttttctaaaaagaaaaaaccacggcacttgttatggattcaggtttggtcatgaagtgccccaaaaac

SEQ ID NO: 39435 - DNA, 366 bp, Triticum aestivum
  Clone ID: PAT_TA_39435
gggtccacgtcggtatccctacaaagactgggggtgtcccttgtttagtgccagctatccgcaatgaacgtctaaccaaggacttcaaaggccctaggaaggtgcctaattacacggcagacttacaacccgcagcctggatcgagagttatgagatggctatggaactgtgtgacgcccggataattaggctacagtaatcccacgttaacgatgccacgtcaccccgtttactgttgataaactctcgatagttcagaaccgaaacaaattcaaaatttaaataaaagcaaataatagaagtttacaaatattaaaactaaaatgttcggagtgagccaaatagtccatattaaatattggtga

SEQ ID NO: 39436 - DNA, 450 bp, Triticum aestivum
  Clone ID: PAT_TA_39436
gggtccacctcctccggcctacacctgcgactgttcatccatgggctcctgttcatccagcctccaccggctactgttcaaccagccctccaccggctactgttcaaccaaccctccacggggtcctgttcatccaaccccacaccaagaattgttcatccaaaccccgtcaacaatgctcactgttcatccagggaaggaggcaacggtgtttgatcggcttcagttagcagcagtagcgaaggaatcacactcgggtttagttaacagcaagggatcgatcgatcgctcgggttcagtaatgcgtatcctgcagtgaaatcgctcgggttcagttagagcccaacgcctcacacacacccccgtacgtacgagagaaacgcacatcgctcggcccctgaccagccaccgtaaccgggaactccccggtattttcctcgccctcgcttc

SEQ ID NO: 39437 - DNA, 436 bp, Triticum aestivum
  Clone ID: PAT_TA_39437
ggggccacgtcctctgcttcatcttcctccagggctcgtagatgtttttctggaccaatgaggtctcccattagatacagagaggggccgctggactacgagccattcacaccatgtgattgccgtgagaagccaaaagcagccatgtggatctcatggagcgacgagaatccaggtagaagatacaagacatgttaccgctcgaggaggggaggttgtgagttctacgagtggcacgacaatccgatcgcagatcctttcctcaaacagctggttatcgatcttagggaccaagtgtggttatttgagaggaggaacgctgctctgcaagatgctacgaggacagcagaaactgaagcggcaaatctatctcgacaactttcagaagctatggagtcgggcatggacagccgtgcaaaaattatggtggctcctg

SEQ ID NO: 39438 - DNA, 386 bp, Triticum aestivum
  Clone ID: PAT_TA_39438
ggggccactctcttgacctgatcaacgtggatttcactgggacatgatgcccgccgcctgcacacaagtttgctatttctgcatggactaccaatgctgtcaacgttgtgcttgcctcagacaacgctactgacaccacactacgaaaactgcacgttaattctggtttctttgcccacaccgcatgcctacaaattgcgatcaagcaaccgtctgtgggtcataagagatgactacctttgttatccacggcttgtctactactgtatccatgtctcaatccacatggcaactcttttcaattctgcttaaacttacattctctctcttacgtcctaacgttatttcatttttttcctttctgttcttttccaactgatttgcca

SEQ ID NO: 39439 - DNA, 339 bp, Triticum aestivum
  Clone ID: PAT_TA_39439
gtcgacatcgatcatgatacgcaggtcaagcaggctatgactgagatcaatgcagctgcaaagatgatggtggctgcaagcgagaatgcagaggctgataagattgtccagatcaagcgtgccgacggttaagcagaggccaagtacctgtctggcctcagtatcgctcgctagcgctacgccattgtggatggcttgacggacagcgtcctgagcttctcagtcaatgtgcctggtagcactgcacacgacgtgatggacatggtgctgatcacgcactaccttgctactaataaagacattggcgcgtcctccaagtcctctgtcgtgcttatcccc

SEQ ID NO: 39440 - DNA, 426 bp, Triticum aestivum
  Clone ID: PAT_TA_39440
cactacatgacacttaaccattatttgggcctagaggaaggcatagggaagtaataagtacatgatgggttgctagagtgacagaagcttaaaccctagtttatgtgttgcttcgttaggggttgatatggacccatatgtttaatgctgtggttaggtttaccttaatactccttttggtagttgcggatgcttgcaatatgggttaatcataagtgggatgcttgtccaagttagggcagtacccaagtgtcggtccacccacatatcaaattatcaaagtaccgaacagaaatcttatgaacgtgatgaaaactagcttgacgataattcccaatgtgtcctcgggagctcctttctcattattagatttgtccagacttatcctttgctacataaaggattgggccaccttgctgcacttta

SEQ ID NO: 39441 - DNA, 395 bp, Triticum aestivum
  Clone ID: PAT_TA_39441
gggtccacacgggtgcggaaacatagggtgcgccaccgccgggaaagggcggctgtccttgcccgatatttgattgggaggagggatatgatgcctatcaacatatcatcggggaggttgttgatgaagtctaggcttgctggagtcacttgcggttctttctcgacccaccaccggttgtttgcagcttcgttctccaccttgtcggcggggacggaaacctctgtctccatattcacgccgtgctccggtgcttcagcagccccaacgtcgccactcccttcgatggggcgcttcggtggcatcctcgtacactgatggctttgaggactcagagcagcgtcaaggatgcgggcggagagagaggaattgtgtgcggcgaggatggggggggt

SEQ ID NO: 39442 - DNA, 338 bp, Triticum aestivum
  Clone ID: PAT_TA_39442
caagaggtgatctacatcgacccaagaccggagaagcatagtggagtcaagattagagagagattattagcaataatcttgtcctaataaaaataggtttaagctaatcataatgagggtggccggtgattaggtgtcctagttgtatacggcttgcatgtcgtgtggtattttgagcagtagcctaatgggaaattaggagtccaagtactagacgtttagccatgtccgtgtaagcgtttgaagtccagaatactagtcggtttaggaggtccttgggtcggctcgtgcatatataagcacagcctaaggcgtgactttattgtatcaacatggag

SEQ ID NO: 39443 - DNA, 431 bp, Triticum aestivum
  Clone ID: PAT_TA_39443
tcgacctatcagaggctatgtgattttaagctagcgccgatatttattaacacacagaggcggcacaattgagacagtgttcacaaaatttagaacgtttcactgaaaattgtgaacatcttttaaataccgaatactttttagattccgtgaacaattttctagaacagaaacatttttcgaaattccaaaacagtatttggaaacaaaatcattttgtgaaatccatgaactttttgtaatacgcgaacattttttaaatccatgacttttttaatatgcaaacattatttgaatctgtgaacaatatttaaaacgagaacaattttttgaaaacttgaataacctataaaaaaactgtaacgcattttaaaatgagaaaatagtttgaaataccgaaaaaaaatcacacaagcaaattttgaaactat

SEQ ID NO: 39444 - DNA, 440 bp, Triticum aestivum
  Clone ID: PAT_TA_39444
attcgccggtcgactacagtcaagatgatgtcttttttcctggacaaaagaatcatggtgcgtagatatattcgcctttaccttgatgtatgtttgcagttcgctctgtgtcatgctacccagtacccactgctcgtctagtatgtaagccgtcattctttgttccagtcctgcactgatagtctgataccactatcttgggctctaaacattacaggatgctccgacgatcatcagaattcccttgagagccatacttgacatcgtgctagcagagctgggaatcccagaggccgaataccgtcgcgagatatgcgacgataacaagatctgcgtcaccgtgcttttcgacgcctctacaatcaaaggagcccccgcccatatgtcgatatccggaacatattccacggacgatgaagtggcagaggacacagctgctc

SEQ ID NO: 39445 - DNA, 344 bp, Triticum aestivum
  Clone ID: PAT_TA_39445
cttctacatgagtgccaagattttgggcaacgctggggaccggcaagtcgcgagttcatacctcgaaggcgtcattctagtgaaccccagataaggataacttcctcgtgccttgctttcccgagtaagtcatcccctcaccggcctgtaacatatgatttcttagacttcgatcgttcctttgtttctaacattctgtgttttgtgcagtgacacacattgcacactcatcctcttaagcccgaactattccatggccacgtatttcgactcagaccgtcaatctaagaaagactacacaaatatcaagaaatttcttgatgatgttctcccccggtatgcca

SEQ ID NO: 39446 - DNA, 330 bp, Triticum aestivum
  Clone ID: PAT_TA_39446
gggtccagcccgtacatcgaaaaggcatatgatacagtctataaataaattagtacctacatgattttgaatataagggtaaccttaaaaccaatgacaatcaataatgtgggataaagatgttaaagcaagaatggggcgcaaccagacgtgacacgagcattttgttttcccatggcctgagacaatggggcatttatgtctacgaacaactccatgctcaggacagacacaacatggggccaccattagtgttaataatcccaaaagtgaatgagtcatggatgacgtttttacttgaacaaaccataagtcgccaaccacaaagaa

SEQ ID NO: 39447 - DNA, 220 bp, Triticum aestivum
  Clone ID: PAT_TA_39447
cactaatcgccgagcacacatggctcgcggcgacttgactattcacgactcagaatgcatggtattcggaagcttatcctttaagccaagacattctttccttgatgcaggtaaaacgatgtcacatgcttggctagatcaatggccatccatcatctatcataaatcaaggtatgttaagccagacttgcacattcttgggacagatgtatcttttcat

SEQ ID NO: 39448 - DNA, 440 bp, Triticum aestivum
  Clone ID: PAT_TA_39448
ggtccgagatagcgggtcgagacgagagttagcgatctacagctggttcggtggactggtggtgacacgggcgggccctctactttatttgccgaatccaatcgatcatgggcggccctcttcgttcacagtctttctttcctttcgaatccaattgttccaatctgaccaaatagcaattcattgaaatcattcgggtcacctcttttttaagcacttgaccaagcctatttctatagaaaaggacaggaatctattgactttgagtctgtctcctactacgaaattggaactgaatacaggatggcaatagtgagaaaaaaaatcccctcgtactacgtcattatttattcgattttccctggtaagtgctccagatgcagttgctttagttgacgtactgagtgggaactaattatatgtgtccttgaataccagag

SEQ ID NO: 39449 - DNA, 417 bp, Triticum aestivum
  Clone ID: PAT_TA_39449
atggtcctgcacgcgatactggaggaggacgatacggaagaaggtgcgccacttggagaaattattctcagcaggatccagtttgaacttgacatagttggagatgtgatcgttgtggatgttgagaggggagtggctggaggagggagcagcggaggaggagagggcagcggtggtgatggaggatgtagccggagcagagggagaggtcccagaggagagggcggcgaaggaaggggagtgcgccgccggtgagggaggtgggttgaagagatcctcgaaagccatagcagctgataccaagttatgggatgaattatgtgtacactcgcattagctcacagagagattacatataggagggagacctcaacggctccaggaagttaggcacgtcctaagcgtgcatggctctat

SEQ ID NO: 39450 - DNA, 420 bp, Triticum aestivum
  Clone ID: PAT_TA_39450
ggccggtccgatattacgggtccagaccactggccaacttgtctatgagcttggaggcattgacaggcgtgtgatcgagaggttcgaagatgaatcagctgagatgaagaaatgtggcaagtacgcatgggtgcttgacaagctgaagtctgagcgtgagaggggtatcgccattgatattgccctgcggaaagttcgagaccaccaagtacaacttcagtgtccttgacatcactggttacctcctatggcgactgtgcggtgctcatcattgattcctccactggtggttttgaggctggtatttccaagggtggcctgactctggagcatgtcctccttgccttaactaccggagtggagcacatgatctgctgctgcaacaaagtaaatgttttgacacatcatgcttgtttttac

SEQ ID NO: 39451 - DNA, 279 bp, Triticum aestivum
  Clone ID: PAT_TA_39451
cgggtcgaggcgagggatagatgatgatgacaggcgaatgaacagtcaggtggttgcactttatccatcctgccaccatattacgttacgtatacatactctatattgactgctgagttcagaatcgcagttgtcaaagttgacagtacagtatgagattttgactaagctgaagtcctgcgggggcaagtggcaatcttgcatgtcctcaggatgtctccactattgcatatgggtccaggccccagtcaatggctacatccacatatgcatgcatga

SEQ ID NO: 39452 - DNA, 401 bp, Triticum aestivum
  Clone ID: PAT_TA_39452
cgggtccaccaggacaccctcatcgacctcatgctcgctgccaattacctcgacatgcagagcctgctcgacctgacgtgcaagacggtggcggaccagatcaggggcaggaccctcgaggagatccgcaagaagttcaacatccgcaacgactacaccaaggatgaggagcaggaggtccgcagggagaactcgtgggcattcaattagaagccgtctagctatttgcttgtccatttgatcatcactgcgtaggctatccatcggtcgatccacggctatgatgggcctggttacctgatcatatgcgctttctcactcttataaagcaatcaacggggccgaaatgcctacctggatgtacaaaaggggccgccagacggcgaaaagaaaagcggccc

SEQ ID NO: 39453 - DNA, 444 bp, Triticum aestivum
  Clone ID: PAT_TA_39453
cgggtccagcctgctacccaatgcatgtcgttaaaaagcattaattgtaaatttttttacgcctagacttagatgaataaggatctctatttaatagagatatttatatttgtccatacctttttgtaatgagtttataatcttaaaataaaatatgctactgagttggttaccttgaatgtggtgcgcaccgtgagtaatggaatacatagttccagttccaaaaatgggaatccacatacttatcccatatttttttgatagaattcttttaactatactcttttaacaagtagacgagatatattaacgatctatttaaatgagcgatgtatacttctgaaaatatattcatattttgcacgtaattttcacataatatctacaatctaagataattataacataattattgtcaacaaaaagttaagtacaaagtatttc

SEQ ID NO: 39454 - DNA, 451 bp, Triticum aestivum
  Clone ID: PAT_TA_39454
gggtccacgttgcattggtatgtgtcagtaggtttttcaagaaaatatgttcttatgtcacctccataagtgatatggagaagctagaggagaaaacgctgagacgttgtgcactcttgaggccatatttctgtcatcattttttgatcttatggttcatcttttcaacccaagtgaggctaggagggccaataaagtacaacaacatgtacccgatagaaagatcatccatgaacctattttcttggtgtcctatggtttcttccttatctcaaaaataattcaatatatgttatgtatatattatataggaatagtatgaggctaaaggggtttgttcgtaccaaaagccatcctgaggggtcaattgcagagggctatcactttgacgagtccattacattctgctcgcattatttacaaggatgtgagactagatttaacaaaaatg

SEQ ID NO: 39455 - DNA, 365 bp, Triticum aestivum
  Clone ID: PAT_TA_39455
ataaaaaagaaaaaaatggaagaaaaaaaaaaccgaactagaaacatgtttttttcttacttctttacctatttttctctttacgagaggcacctcccgcggaagcaaatctttgcctccacgagaagcaaatatgtgtctcttgcagaaggaaaaaaaactctgaagcacaactgtgcctcttgcggaagcaaatctgtgcctcttacagaagctacaaacatatgcttccatgaaaagtaaatttgtgcctttagcgaaataaaaaagatgtgtttgtgcctcaagcgaaaggaaatcggcgcctatcgcggagtaaaaaaaagtgtttttccatgcaaaagaatcatttttcgtccaaaatg

SEQ ID NO: 39456 - DNA, 421 bp, Triticum aestivum
  Clone ID: PAT_TA_39456
gggtccacgatgtatatgtagtatgacgaggtggccttccattgccctagaggcgctgggtcttggtcgtctcctgcattggcgtccataccgtcgatgtcttcagagtcgaagtcgagcatgccagttaaatcatcgacagtggctacgaagtgagtggtgggtgggctttgaatttctttgtcgtccgcatcccaaccttgctgaccatagtccggccagggctctcctaataaggagagagactttagtgaattcagaatgtcgccgaagggcgagtgttgaaagatgtctgcggcggcgaactccatgatcggcgcccaattgggttcaatcggcaggggcgtggaaggttcggagtccggaaaggagtccggcaccttggagtcgcgagcttcgcaaaagacaagactggtgttcg

SEQ ID NO: 39457 - DNA, 179 bp, Triticum aestivum
  Clone ID: PAT_TA_39457
ggtcgagtccatccgtcagatgcaaagcacccagtagatgagaggcaggaagatacatgggagagtggtttgccccagacgagtgtgcaatgcctcttcatcggacaataactttttgctaaggaagcaggtcagctcaaagccatttattggatgtgtccagatggtgggctcacatt

SEQ ID NO: 39458 - DNA, 431 bp, Triticum aestivum
  Clone ID: PAT_TA_39458
ggaccacgaggaggaggaggagcagcctggccatgtggactagcttgccccgctggagcgcttgcaggagtagaatgccaatatgaagacgacttggcgagccgggagccactccgtggtggttatcctccagccaaatcgacccagggcgcgctcccgcggcgaagcgtgtggcacgaggagcacaataaaatgggatcggctaggtgtagtcaactgaaaattatatttccgtgtcacttgtttatatgtgtgaatgatgcgcagccacgaaagaacaaagcctgccggacacagctatgctatgccatgctactctcttgcgatttgctgtaattttggagggagaaagcgcgaggagagagagcttgtgagagagaccgtgttgtgtacgtacatgtcagagagatttaatgagagagagggagaga

SEQ ID NO: 39459 - DNA, 106 bp, Triticum aestivum
  Clone ID: PAT_TA_39459
cactacgaggcgtcaatggtgacttcgtaaaatctcaaggccatatgccggctcagtctctcggaggtgctcatagtccagatgcagaggccgggggtcctcctcc

SEQ ID NO: 39460 - DNA, 188 bp, Triticum aestivum
  Clone ID: PAT_TA_39460
gtcactgattcatcaaatgtggatgcctcctgtgacgagattcgcctggatcgatctggagccccatgcacgccactggtggcagatccatcatagatcgccgtacgcgcacgctaaggacaccaccaggcacgggtctatcgttgaggatgatggtccctgtctagtgaatgattatttcctccagg

SEQ ID NO: 39461 - DNA, 371 bp, Triticum aestivum
  Clone ID: PAT_TA_39461
aactaatttaactgcattgacaactaatcatatttgcgcacacgttacatttaattctatcttggtggttgtttggataactagcatttggaacaagttttagcaaaatcagttttaagaggatttttagggaaaaaacagtttaagttgttggtttgtagagtgctttgtttgggcttaaaaacttcaaatatggtactagtttgggtgagactagtattgaatggattttcatctcacaaccgaatgtccacgagctcctactcggcctcctggttcccgaggtcgtgctcggcctcctgttcccgagctcgtactttggcctcctgtcctggagctcatactcggcctcctgttccacgagctcgtac

SEQ ID NO: 39462 - DNA, 333 bp, Triticum aestivum
  Clone ID: PAT_TA_39462
actgaggaatgaaggctggctgtcacccccaacttctctgttgatttcgggacctagcctgatggtcgctccgtgggccatgatatgagacatcctgctggagactgcacctctgacagatggatctaagacgaagggtctccgacacaggcagctgcagatccatggtgttgagctcactgtgactaaaatgattgctacactgcctgcggtgttgtaagtgatgtggcatcacatggaatcagttcctgataggtcctctgacattggcatcatgggagcttgtaccgtaatgacatttgccgctgagtcagactctgtctatagcatgca

SEQ ID NO: 39463 - DNA, 425 bp, Triticum aestivum
  Clone ID: PAT_TA_39463
cacacgctcgtagtacatctgaagcgcgatctcgagctccaagttggctacttcatcagagatcaccagctcgaggatgcgacggccatgttcctctacttcgcccaggtggatacctgggccaaggaggcggtcgagcctacggaccagcgcgttggcatccagcgggccgtggacaaggcgaacggcggcacccatgcgaacggcaggcgtccggtgcaagtacgacacagccgacgtctggtgcaagtacaacactgagggcctctgcccactcctggcgaggaatgggggtactgacgggacgtgtacccagccgcgacgccgtgtcgatagcaggcaagcgccgatggatccgctcttgctgttcggcgtgctgtacctctcgctctgcggcgctccaacggtctcgccgggcggcgagc

SEQ ID NO: 39464 - DNA, 398 bp, Triticum aestivum
  Clone ID: PAT_TA_39464
gggtccacaacgccgaggaagagaggaaggcgatcatgtgggaagagacgaacgggctggtgagcgagtacgcgaagatccatcttggacagcactcgtcctgggaacccgcggttcctccccttggatccatggtcaagggaagcctcagtccgttatgacgatctggcgaagtaatttcgctgatattcaagctggacgacaatcccccttggaaccccccgtttctcctcttgaagtcaagggccaacaagaacctctagccctttgttaaagctggtgaccgcaccatcggaggattgctatccttggatggtaattgttagtgaattgtaggaattcttttctttgccggagccataaggaggtggtgttcgttcaatgggggctaaaatttt

SEQ ID NO: 39465 - DNA, 243 bp, Triticum aestivum
  Clone ID: PAT_TA_39465
atgaatagcatactctagcctgcggaggaagtgacagataaagtacactctctcgatggattttggtgtggggataacatgccctttattacggagcctgtgggggacttcagcagtcaggtacctcgccttccagagcttcgtgataacctcctcagtgaccgaggaggctgcccacctaccttgggagatggatcccgacataactagagggtccggtaacaatggaagaaatctaatcct

SEQ ID NO: 39466 - DNA, 422 bp, Triticum aestivum
  Clone ID: PAT_TA_39466
agacgacagaagggcagaaagaccacaatagtcattactgacatccaaaggctcggcttggctaacctcaagtgaaaacatgaacttccggagtatgtcaatataactatattaaagaatgtatgtatgccagaggaagaaaccaaagctgacatgtcctaatttgacagtcaaagtaagtcaacgcattagaagacaagcataaggatgacaattatcaagactgccaaactgaagactgggcgggcatttatacggtgttgttagtaaaatacttgctcacttcagcacatcatgtctggaccctcagtttcaaggtttatcaactaattcaatttcaaaaatgaaattactataattttaacctattcattaaataatctgatccacgtgccgaatatccaaatttaatgctctcaaaa

SEQ ID NO: 39467 - DNA, 133 bp, Triticum aestivum
  Clone ID: PAT_TA_39467
ttcagttttccgcatcagcgtctaatagctgcaatgcagttgctaatcaggtactcttttatggtcgaggtttgtgcagaatagatagatcatacagtccagtatgagaaataatgcatggcttaaatgcaat

SEQ ID NO: 39468 - DNA, 443 bp, Triticum aestivum
  Clone ID: PAT_TA_39468
ggtcgacagccataagagggagctagtcaaattgttttgcatatgtcacagtagaatggaggatatcattccaaaagattctcctgtgaggcttgtagcattcaatctgggctaccttccaggaggagataaacaaataatcacagtacctgagacaactgagctggcactacaagctgccagcagaattgttggctcagggggactcataagtgtccttgtctacattgggcatctgggtggaagggatgaactcgatattgttgaatcatttgcgtcaagcttgcctgctgatacatgggtgagctgcaagtttgaaatgattaacaggccaattgctccagtactagttctcctacacaaaagatgatcacaatcccactgaagctccacaagtttgggactcgctattctggatttccggttgatgaatgaaattgcgc

SEQ ID NO: 39469 - DNA, 207 bp, Triticum aestivum
  Clone ID: PAT_TA_39469
ttcccgggtccacgcggccgctttattttttttttttttttttttttttttgcccggacgcacttccttgcgtgcgaagatgtagctggtgggtcccagcagtcagggggaaatgtttttttcgcaaaatatagtggcccgtctggtgggtccccgctgtcaggtggaggaataattattttgcgtgtaataaggaggcacttcctt

SEQ ID NO: 39470 - DNA, 433 bp, Triticum aestivum
  Clone ID: PAT_TA_39470
agcagtcgtcgccccgccaaggtattggttccgcttcccgcgccgtccccagtactgagattcgactgaaaactaggttccggttcataaggtggttgcgatagggtctgtatagtcgaggcatttgtgatttgatcgtgcactctgatgcgacttcgaggccgtggtttaggtctagtgacgtcgttctgattttatggcaatgtttggttccttgagattacaaagttatattcagtttccattgtcggttcgccggtgaaaatagagttttgatctgtatgtttacgattctagtgatctaatttatgctttgtgaattatgagtcagattaattgttgtttgacgactgttcgcattattgtttttctgaacttgtagtacgttgcaccgtcaggggtttgatttatttattttataaaccgtggagta

SEQ ID NO: 39471 - DNA, 346 bp, Triticum aestivum
  Clone ID: PAT_TA_39471
aacttcaccagtgcatccagagcccgtgatatgatacgctctgtcacacatctgactcctgtagatcgtcctcaaatgagccaccacacctacctattatgggatttccatacccatttcggaatatattggcatgcaactttcgaccaatccgtttatcaagacacattcatcactgtcatattgcttaccaggatcatgtacttgacatagtatttgtcggtcagccatcgtgtacaagtccttcaggcatgtcactcgtggatcagtgcttatcacggttcagtgccggatgcattcataaatagtcatctttggtctattatccatttgtatccattgagtt

SEQ ID NO: 39472 - DNA, 189 bp, Triticum aestivum
  Clone ID: PAT_TA_39472
ttgaacctaaagggccgcacacttaagggaaggaacctattaggcttgatccgattccatgagtcacatgtgatcctactcggactacgatccgggtcgaacatgatttgggatttaggaactacttgaggcccaagtgttgacccaaggacccttcccaatcaaaattgagggtgaacacacaccatc

SEQ ID NO: 39473 - DNA, 363 bp, Triticum aestivum
  Clone ID: PAT_TA_39473
attctccaaaaagaaaccaatgagtgagctttcccagttacggtataacgtagcagtgatggtgaacgtagcaccactgtaaaccaccatggtggacaggatctctagtcatacggtggacctgctaatagcctacgtagacttgcgcagttgaactctaaggttggtcttcaaaggtaactcagcaatctgaacacgtgctcttgctttagtcgcgatgatatctcatgcaggtattgatcatcatcgtagcatctggatggtcattcgaaagtgacattcgatccgcagcagctacgtcgtcgcggtagatactgccactgaatctatgatgagtgatctagtcgccatggctagagatga

SEQ ID NO: 39474 - DNA, 414 bp, Triticum aestivum
  Clone ID: PAT_TA_39474
ttcccgggtccacctatcatcactgactatggtgttgcgacgacaatttgttcaagtgcaaccttcagtttgctaaagcatctgccaaagagaacaagaaatcgcttgggttagacttcaacccaggtccatctgctcctcgggatgatggcacccatgatgctgaacccaatattatcgggcccttctacaaccttgaaggtctcatatcacacattgttgttcagggggcagccgtggagcactctgcagatgacactgattctgatgaagcgcctgctcctcccaagccatagaaacagaagaaacaaaggcttcaaaaccctcctctgcaccaaaagcttcgcatgttaagcctctagctactgcacctcctggaagcagtgtgcagtccgaagatctctcatgcatctc

SEQ ID NO: 39475 - DNA, 286 bp, Triticum aestivum
  Clone ID: PAT_TA_39475
gggtccacagacaatttggaaggataggatcgatgctcacagcagattgatgaggcactattttgtggagaatctgacataccccgagtcgtacttttgtcgccggtttaggatgagcactgagttgttcaggcgcattacagagaaactaacgagccatgacccgttttttcagcaaaggaggaatgccgccagagagctcgggcataacacctttcagaaggtgacagccgctttgcgtatgttggcatacggtatcccggctgatctagttgatgatcacttg

SEQ ID NO: 39476 - DNA, 393 bp, Triticum aestivum
  Clone ID: PAT_TA_39476
gggtccagactgcattagaaacgtatccttcactgccaccacagtcgatataaattagctgtccggcagactttccaatgaatccggagaaacacggattaacactttctacaactggtagcgggatgattctccatcttagcccttctgcatcaactattgccaacccaaactgacctaccagcaagtggtgtatagctaacaaaattatgtcaaggagtaaggatataaccgtaggtaattactagtaagagatagtagaacagttcaatgggtatgcaaggttttagtaggtgatatgcatcacattattcagcggaacacacattgacaatagaagttacatgctaagagcagtatataaccaatcgatgcagcaaaagtagttcaacc

SEQ ID NO: 39477 - DNA, 229 bp, Triticum aestivum
  Clone ID: PAT_TA_39477
agcatgaagccggagatgcgtgctagaagaattaagatctatgggatggccttgcgccgaggagatagcctggagaacggaaaacacctaatatatacaaccatgcatgtgtttgtattgccaatgaaaccacatttcaatggagactatgtgtatttttctttttggacaattaaagtacgatacgtggcgattgagaataaaaataaaaggccaacatttttatttc

SEQ ID NO: 39478 - DNA, 421 bp, Triticum aestivum
  Clone ID: PAT_TA_39478
cgggtcgaggtccatcaatattggttgtagatgtgagttgttgctgccatggaggcagatacttctgggcctcttctctctccgacactgtgtgcacgtgctcatcgcctttctagccagaaagattgaacacgtttatttctagaggctataaagtttttcttcatccgaattgatctatggcattggaggacacgtggtttcccaatccctgcaaaaaacgatatctaataacctcctccttgacgatctgccatggagcttttaaaaaaggactactatgctgctaataacaaaaattaaattgcattaggattcatgaactacttattttcatcttatatatgctgaccttctccttcttttagtgaaaaatcatgcatgtgcccttcgtgttatattactgttacctttcatacac

SEQ ID NO: 39479 - DNA, 434 bp, Triticum aestivum
  unsure (1)..(434): unsure at all n locations
  Clone ID: PAT_TA_39479
gggtccagtctcggtgagaatggacattcacttggaaagatgggtggacagattaatggacacttgaattatggatttcatggggttggagctttcaatccacattcccttcctgactttcgcaacggccaaagtaatggtatttcttgcaacttaggcacaatatcacccattggagttaagagcaactctagaactgctgaaggaatggagagcagacatctttacaaagttggttctgctaaccttggtggtcattcttctggtcataccgaagcacccgggttttcaagaactggaagctgcccccttcatggccaccaagtagcgtggaataattcanataactcgcatcaccatacctcctctcgcatgctatggacgaactcaggatcatttatcaataatataccatctcgacctcccatgcaagc

SEQ ID NO: 39480 - DNA, 423 bp, Triticum aestivum
  Clone ID: PAT_TA_39480
ttcccgggtccacaaaagtggagccaaacaggcccagaccaacaacatgatacacaaaaacaaacaatgacaagcgaggcgggagatagagcgcttacacgaaaattatgaaactaaatcaaaagaatgacaaacttagacgagacatcgtttaaaatagttgtggatttaaaaatacaatatgaaattataaaaatcaaggattttacgaccaaaaaagaaacaaaatacagaagtttaaaacccaagagaaaaatttagaaaaaacagacaagaaaaaaaacagaataagtgagtatagagagtggcgaaccaggaaatacttgaaaaaaatgctcgcctctgacacttccaattctttcccgaagcataaagacaaaatatgcctactccccaaacatacatagacaataaagaccagcc

SEQ ID NO: 39481 - DNA, 434 bp, Triticum aestivum
  Clone ID: PAT_TA_39481
ttgaataaacggtcgatttccgattaatctctattcctcggctgactgagacgctaacaataagcgatatcctcaatattgacgtaaataaataaccgcacccaaaaacaggaacgggtgtggcctatggcgtcgccccattacttgccgcccgcgggcagcatataggattggaccgtattaaaggcattttctatttgacgcttcaggcgcccattactgtgtatgttgcaaacaggcacacaccctcctctgcgctgcgctggcccatttagcctacccaaacttgcgactaagtccatcaaaccggagatctccttgtattcgataaatggcactaaccacccagaccccaatgcctattgtgatcacttctcctttttcttccttttcttccttttttccttatttttttacttttactttacattttc

SEQ ID NO: 39482 - DNA, 440 bp, Triticum aestivum
  Clone ID: PAT_TA_39482
ggtccactgcatccagagacttcaaccttctgacgctcaacaccatacagacagccatagccagggcatacaaaactcatttcgagcaacttggctaatacaaagcttatgcgttatccgaatcaccttcaaagcgtacgacaatagtgcaagtaactatctgtcattcgctatccagtagattaggtgtcacgtcattgacactatcactgccttcatgtcattgctgctagaccgcacattacatcatccgtgatatatcaacagtttgctttattcacatcgctcgaccttacgtcacgcacgtattcttccgcatgaggtcgatgaactaccctctgctgcctcacagaaccagcggtggcactcctagatgtatcctcagataccgtttctgcaagcacattgaaacttgattgcccctgacctccttaggacct

SEQ ID NO: 39483 - DNA, 212 bp, Triticum aestivum
  Clone ID: PAT_TA_39483
ccccggtcgacctatcaaaggcaactcatgtctaataagtggatgtcatctgtcccaccggtgacgcagcacctgtttcctgcatcgattgagcagtttacaagtgccaaatccccactggctccggttgttcacaggttatctgatccaatagccgccgcagcaccctcccggtctacgctaatgtggaacgcccgctgtacgtcatcctg

SEQ ID NO: 39484 - DNA, 331 bp, Triticum aestivum
  Clone ID: PAT_TA_39484
gccttcaagctacagatgacggggaggcttcctgttgtgctgatggtcaccgacctgcaactcgtcgcccaaccaagacctgttgtgcgtgacgaccgaaaatggagggcgaccttgtgggcggaagacgtaccggagattgaggatagcaggggatccagtgggaaaaaacaacaaaaactacgaaagaaacaaataaaactcaataaaaaccaaaaaatacacaaagaaataaaaaaccaaagaaaacaatgcaacataatgaaaaaatagcgaaaccgataaataaacacagaaaaacataaaaaccagaacaaaaacgactataggg

SEQ ID NO: 39485 - DNA, 397 bp, Triticum aestivum
  Clone ID: PAT_TA_39485
cggtccaccgtccaaacagagtgtgataggggcttttgatcttgaccacttcaaagttcaatgtttctgccctatagtcatattcattgccaaaagccacttccaaggctatcttaccaactggatatgctgacttaccaggcaccaccccatgaaatactgtagaggacggcttaagatctttgtcggtcaaattcatacggtgaaaagtatcatactaaaggatattgatactactgcctccgtccataagcaccttactgaacttgtagcccccagcctgaggggctacgtaccaccaaagccagctgccccggattgccaacctggggccggtgatcctcacgggtccatacaattggctgctctgaccatcgcgggtatcgaggcactgccg

SEQ ID NO: 39486 - DNA, 144 bp, Triticum aestivum
  Clone ID: PAT_TA_39486
cgccggtccacgatatccactcaaatgggtcgtctcccgtgctgatcgcgagctagccgcaattaaggtctcccccgcggctttacatgacctatgactgtgcgcatctacccattatagcaactatgtgcagcgtgaatctag

SEQ ID NO: 39487 - DNA, 406 bp, Triticum aestivum
  Clone ID: PAT_TA_39487
ataactaaaactccaggcggttaaaccaaaatcacatagaacaagggattacctcgctttgataccaattgaaagtatgttatatcgactagaggggggtgaataggcgatttttatgaaagtcttcaaaacatgggagttttgaagacaaacgatagaaatgaacctataaccatgcagcggaaggtagactaccctagacaagccatgatcaagtattcaatgaagtgaaagcacaaagactaacatcagctaggcagtacggatcaggatggaagataatatgaaaccaatctgaacaaacagtcacacagtgaagacaaatggacaatgcaaataggcaatgacttcacaaggaccaactgtaaataaagagatgggaaggatagaaccagtgaacttggtg

SEQ ID NO: 39488 - DNA, 316 bp, Triticum aestivum
  Clone ID: PAT_TA_39488
agaagacgacagaagggctggatcgattctacccaccggctaaacgcgtaaatgtacgcatgtacagacgtgcttctgatctattcccggtgagaaacacacgcgagacacacaacacacgccatgcagaagaagttggcgaggacgatgcctggaacgaagcacgggacatggagatcgttggcggactgggcggcgagctggagcacggacaggagacggtggagctcgtacggggcgggagggactacatggccgcggcttgcaggtgagcacgtggcagtcattaatttgatctaggtcagcactcccagcc

SEQ ID NO: 39489 - DNA, 349 bp, Triticum aestivum
  Clone ID: PAT_TA_39489
tagcgtctagaattctagggtcgacgggtctgccctaaattcaagcattgcacacttaggctacccagctgtcaacgacgggacatggcatttttgccaatccgagatgacattaagtgacgttgaccggaatatgtcttaataagctgccaccagtgaacaccgttgaaccgtttccaacaacacaggtctcgacaatgattcaacggtgggcagtgaaaccgcagaagcccaagacgcaagcttcgccaacgcgtgaccggtgacaagaccgctcgggaataaacgtgtacgccctgacagctgacacggcttcaccgatgggaagggggagcacaggcaagtggcc

SEQ ID NO: 39490 - DNA, 298 bp, Triticum aestivum
  Clone ID: PAT_TA_39490
gggtcgagacacataacgaggcaaactgctaggctcatcaacagtttgatggcggaacgcaagtcgtacgagatcctcctcttccctgatgataggcacatgccacgccagctatacgaccggatctatatggaggagaggatctgggattttgtcgacagaagcctatgacagtgggagaaaattcatctgtacaaatctgctgttgccctgtgtgactttaaggtggatagttgggatgacatcgtggacgtcatttcagttcccagcatcctgtatttatccgcaagtgcacgga

SEQ ID NO: 39491 - DNA, 431 bp, Triticum aestivum
  Clone ID: PAT_TA_39491
tcccatagaaaatgataggcaccatctcattgaaacatcgggacaccctcgcctctatcaagtggtatcatatttccaggttgctcagtaagattttatggtttttcgtagtttagatcaagtttgttcttcatacctacagtccacgaaaaaagccaaaaaagtttagggttagttcatcaaatctgaaccaatctgagcctttgcattgtccttttagacttttgctttgttgaatttgtggttgcatcatcgtgtcgagttggtggtcatagcgtctagtcccttagagtttcacaggttgtcacgccgccaccgcaccatcatcaacatctttgccatatactaccaccccaccatatacaacgccgctgccatatacaaccaccaatccgagtccacatatatcatcgccatatacaaccaccaat

SEQ ID NO: 39492 - DNA, 318 bp, Triticum aestivum
  Clone ID: PAT_TA_39492
cgggtcgactcattttttggctcaatcgaatatgtgaccccatactcattatagttgagcggcaaggagggtgaaatgcaccatttttcatctctccaatgattgacgtgtttgccgaatcgcaacccgagcctactcatgtgtcgtcctgacctgacctaaaacgtgcgagatctatcacaagcattggctctggtggattggatgttcatttccgggcccaacccgacatctcttaccgatacgtccagtgtcagctttgccacatgcaagctaatcagaagcatcagaacctgtaatgcataatgatcggcagtg

SEQ ID NO: 39493 - DNA, 393 bp, Triticum aestivum
  Clone ID: PAT_TA_39493
ggtcgagcgccgaagacgacagaaaggtgcgtcctttcaggggtggctagaggctgtggatggcagaagattggtgcttggatcaatcttggtgcctactatattgtcggcatcccctcggcctacctcatagccttcgtcttgcaagtcggcgggacggtacatcaaatgataaataagaaagaatcccttttcctgccctgaatttgtagtgagttcatatgtgccagtggtttttgagtgactgatgctgtgggttttatcggtgaacacgaacagggactttggctgggcatcatctgtggcctgatggtgcaagtcctgctgctcatggccatcacgatatgcacagactgggataaagaagcgggtaatgcaaacgacagggtattc

SEQ ID NO: 39494 - DNA, 431 bp, Triticum aestivum
  Clone ID: PAT_TA_39494
gggtcgaccaggccatcgtacggatgtcgcttgttgacacagacgcggccttgccggcagacaggcatcctgagcgccgcctcaaggcatcattcaaggcatttgaagaggcagagctccctaggctgaaggaagaaaagccaggcctaacactgaaacagtacaaagatatgatatggaagctatggaagaaatccccagacaaccctctgaacaaggcaactgagtgaggatacagtcccagtttcgtaccgattgatatggattctaaggcatccaatggaacagaactgcagctgcctcagtatctttgtccgtggagtgaaatgatgtgtggcatagcttgaaccaaatactcaagcttctcagctaataatcaacagatcaatgcaatgtatattctgagggtttgcttttgattagagagattt

SEQ ID NO: 39495 - DNA, 371 bp, Triticum aestivum
  Clone ID: PAT_TA_39495
ggtcgagtctgaaaaactcagaaatggtgagatccagtgaaagacatctcatccttgtgcgaggttaatcaaattcaatctaaggagaagattctgccatgacaaagccaaaggccacacaaatcccatctcaaagaaatatccggagaggatgagctgagcacatgcgcctgcattccagatgctcttaccaatttaccatgcaactcaacgaccttgaatccttgatagcacctacgagagagctacccatacaatccaatccaatccaatctgcggctaaccaactgcgcgaatattttctacgcttcttctacaatctcagacggatcgctctgcaacaaggatcgacataactggcgtggggcgat

SEQ ID NO: 39496 - DNA, 341 bp, Triticum aestivum
  Clone ID: PAT_TA_39496
gggtcgagcgtaaagttgacgcaggagctaacccaaagaagaaaaaagatgcagccagtgccaatctatagagcacactgctagtgtgtgtccactcaggctgctgttattcacattcatcgtttgtaactttgggactaaacaggaaaagaatgctgggttttgagcaatgttgggactaagtacagcacattcagcatgtatgctttctcatatcgaatttatgcgccgtggattaattcactcactgtgataagaacgttgctaattgtgcctttggtggaacagggttactaatttaattgttggagaattgtatttccaagtcgctccgaagtgtg

SEQ ID NO: 39497 - DNA, 451 bp, Triticum aestivum
  Clone ID: PAT_TA_39497
attctagggtcgactcatcgactcgaaaaccttgtcggcaatataatccatgtggtgtcaatcagcatgtgggaaacaatgtccatgtcctataaatggggcatgctgtgagaaatattgtgggggacaatcccaacaacaattgcaggtactttagcgttgtctctatgattcatgcatgagttgctggtgttgtcattttcaattcagtgttatatcatttaacaatcacaatccagtcagtaggcctggcggaaaggaattaagatgtacactggcaagaagaagatccagaaggacaagggcgtcgagacctctgaattcgaggataccatcgcgcaggggctcaccacaaatcacttgcaagaagggctcagttcgaaaactaaggttatgcttcaccaaggatttgaagggtccctcgccgtgccgtggacacgattcaaccatg

SEQ ID NO: 39498 - DNA, 357 bp, Triticum aestivum
  Clone ID: PAT_TA_39498
caagccagttactagcgagtatacccaagatggcacgtacacaaattggccaaaagaagaaacaaaagtgccttggccgagtgctacagcaaggaacggagactatgaaagctagctagatgtgatttggagttgagattagctagtactagtcagccggcggagatttttggtgtggcgcgtggtggcagactaaacctgtgagatgtctggtgcctcgcgtaacgcaaagcctggtagtagatggcaaacacgcacagcgtcagacacagataactgtgcgtctggtcgttcgcgtaacgcctgagtgcggtaatgtggagagcgatcgtaatcaacacctggctttttttttgg

SEQ ID NO: 39499 - DNA, 433 bp, Triticum aestivum
  unsure (1)..(433): unsure at all n locations
  Clone ID: PAT_TA_39499
ataggatgtttagtatggtggatctagccgctgattgtaatctatctatctattatatataaaaagtgcttgatgggttactcaaaaaaaagataaataagctaaaaattactaaaataattagaaacatctgatcgttgatttagtggacccataacttaaaagacgtaattaatggattagatctaagagcgttccatctcaaaagaaaaatgcagctatccttagcctagcatgtacgtgccgctccatactaaaataaagatgacgtgcagtaactacatacaaaactggtggatctgatttatcctatgtacccatcttagattaataagctagaaattaccacagtaattagaaacagctggttgaaacaaaaaaactactagatcaaacgttctacangagaaaaagagaaaaactaccacatctc

SEQ ID NO: 39500 - DNA, 386 bp, Triticum aestivum
  Clone ID: PAT_TA_39500
aaaagtaacagttacaggaaatggtgaggatggaatccgagccgttgatatctctagcgctcatcttgaccgtcgcttctctgaatcttcggtggctgcatctcttcgtcagtaaactctcggcttgggtcctgacagtggaaatgaacgtcccggatggatttcaattcaaaactaatcagtttcatctctactgtatacttagaagtactattaaaaaggagtccgcggttgtgatggtcgtaatggtttcatcacccctcccgtcccaccttgcttttcttcatcgaaacggttgtgcacatgaaagagtgtgcatgatggccctatctagtggtgagtggactgtctattgccattcatggatagcttgattggtttgtcgt

SEQ ID NO: 39501 - DNA, 432 bp, Triticum aestivum
  Clone ID: PAT_TA_39501
tccagaattctagggtcgacgagcagacgacagaaggggcttccggtcaccatcggagccggcgaccggtggcagccgcgcggggacgccgcgcgatctcctacccccacccccatcccagtctaccacagcgacaccgtgtgagatccgtgcatcatcggtaggctcagttggtgccttggtggactagtgaagtgaaactgtatcaatatcttcaggctctggttcaatggcctacgagatcagtgagatcaaaaggatctgtacctttcttccttggtctctttcttcgatttgtcagatggcctgttgctggtataatcctggaactgtatggatcttttgtcctcttcagtggttacggggctcctatccaagccttcctatatcagattccaatcattggatggattctgcaatacccctttcagc

SEQ ID NO: 39502 - DNA, 413 bp, Triticum aestivum
  Clone ID: PAT_TA_39502
attctagggtcgacacgacagttttggatttcatccgaaaaaatgaaatttgaacgaaatccgcccatctcgtttgggcccggtactaatataatccggtcaaaatttttggccttattcgaatttgctgctcggcccatggtccaaaaaagctgcaaccgagcctttctaggggaactcctatacgccgcattttgcggcgagtagtcgccctttcgcacagagccagctcacctgggccggcccatttgctgtagggatgggaaatcacaaaaataaaaaggctccagcaatacgactcaaacacacaacctttcagtaaggtgcgccttgcgctagccacctcaactgactacctcacatgtaaacttggcatcgcgaatattaaagaacctagctataaaacttaaaaa

SEQ ID NO: 39503 - DNA, 345 bp, Triticum aestivum
  Clone ID: PAT_TA_39503
cacaggtctaggactcgcgggtcgacacggctggcgaagatgagtcatgggaatgtgcgtgtgggagacacataggcacatatatatatgtgcgtatagagggctagtagagaccgtgcgtgtgtatatatgcatgtgagagaaatagtgttttccaactaagattagttaaaagagtggtacatagtagtcagaaagagagtgagagagagggatacagagagagcatgtgcgtgagactccccgacaccccaagagagattgtgagcatgtgtgaaagagaaatgccggtgcatataaagtgtgtgcacttatgcggtagatagagagatatacaacgcgttt

SEQ ID NO: 39504 - DNA, 240 bp, Triticum aestivum
  Clone ID: PAT_TA_39504
ttctattctcattgcagctctgcgcgtggtgggtaacattgccactggtgatgatttgcagactcgggtaggctaatttaagtgatgttcaccttttatatatgacttgttgttacttaaacgattaaagttgtaattcctggttgtttccatgtgtagttagtagtaccttgggtatttaaccatgtgtgctcgatttctataattgttaaaataacttgcagcttgtaagatgcgttt

SEQ ID NO: 39505 - DNA, 388 bp, Triticum aestivum
  Clone ID: PAT_TA_39505
ttgcaactgggatgaaacaagctatgagcctgttccaatgaaaaggtagacttgcaactgggatgaaaaacaaaacacatgctctagttgtgagtagagggtgagcttgcaacttggacaactacgagcctagtcttgagtcgagagggacttgcacctgggacaactatgaaactacaagtcagttacgagtcaaggtcgacatccggcaagcggtcgcagcaatgcccagtagaagtctgaacagagcagacctagagtatatgactagaaaggaacaagtggatggggaaagaagagcgagaaaaaagatggtggcttgacttgttggctgtgtgcagcaaaaattactagaaaatgatccagcagaataaggacaacttccaac

SEQ ID NO: 39506 - DNA, 416 bp, Triticum aestivum
  Clone ID: PAT_TA_39506
atgagatttggtgcaggtgaccgatgcaggaagacaatgcttaagtgccacttgctggaggaagttgtcgaagtgttgtttgccggaggaagatgatgtaataggggtactctgaaatctaaaggacaatgaatttttgagatggtcgaagctttgcatggggaaagtagttgaccacacttgcttgatggaaagagaggtttgcttggatgcggagagattttatctatgtacgtgaacctgagattttgtttatatttggagagattatgtctagattttatctatgtacgtgaacgtgagattttgtttatgcttggagagattatgtctttgtaaaatattgatagagttcggtcatcgcgtcaagattgtttgaccttttcttgggacatgaaggttatatatttttaaat

SEQ ID NO: 39507 - DNA, 429 bp, Triticum aestivum
  Clone ID: PAT_TA_39507
aaatctcgacccattccgagaatgtttttctcccgctcacgaaacgagattagaggggtgcaacgggtgcatgtgggagtgtcggattgcgacacggacaatgagaaaaagaccggatgcatgagatgaacacgaatgcaaatgagatgcacatgatgacatgatatgaaatgcatgacatgaacaaaatgcaaaatgaaagacaaaaacccaaccacgaaggaaatatcatatcacatagccggaaatggcaagagttggagttacaaataaggaaagttacatccggggtgttaccacactccaccactacaagaggatttcgtcccgagatctaggactgaaagaactccggatatttataacagatctgatcctcgtgttcctaggtggcttctcggtcgaaatggtgtgaccacttcacgttca

SEQ ID NO: 39508 - DNA, 308 bp, Triticum aestivum
  Clone ID: PAT_TA_39508
atcgatggttcgttcagtgggaaatcgatcctacacctagcctaacggcctaaccaccgagctaacaaagggggaggggtgctgcttaccggcatcggagacgaggacggcgtatggggagccatggcacagacaatgtcgaacaaacggtggccaacagcaaggggagcaccagatccgccgcaaacaccgccgcctcttccgccgccgccgcctctacgttgatctaaaatcgcagcccgggccggtggtaaaggagtaagaaaaaaagggggtactggtaatggtgagccaattgaaaaaggggt

SEQ ID NO: 39509 - DNA, 389 bp, Triticum aestivum
  Clone ID: PAT_TA_39509
taagaaaagcctactagcctcaaaggatccaggatattcgacatacgcggctcgtgtgcctgaggggaagtgctacgtcgagacatggccagcggaggtgttcttactgcggtttgaccatatctttgagatgtttctaacaaggcggctcgattttacaatcgtccgcctttttgtgctacatatgaccttcgtcatgaagagtgaagaagtcccgcaaatctgtgtggcggatccgtactacatgcacgagtctttcttgagtctcggcgactttgagcgtgaaactgctagggagtacctccaaaacatcatggtacagaataaggaccgggaaattgtcctcgtgccttaacatccaaagtaagtcagttcaagacaaccctttc

SEQ ID NO: 39510 - DNA, 328 bp, Triticum aestivum
  Clone ID: PAT_TA_39510
agaaatctggtggagctaactgtgacctgcttgttgtggccctcccatggtgctcccggttgccacacgtccattcggattcttggggggaccacttctccttccgatggtgcggcatctttttgatccggacggatgtcaatgtgcccatgttattcatcagtcatgagtggacttgggctctcacctttcacattggtgccgccaacaggttttgtgctgcgtgtcgagtgcgagctgctttggcggacgacgacctcgatggatcaagctcatttcttcggttcaccttgagagttgcttgtgttgtactcggtctgcacacagg

SEQ ID NO: 39511 - DNA, 370 bp, Triticum aestivum
  Clone ID: PAT_TA_39511
catcacatcgagggattcggaaccgcgcctcgatcatgtggcaccacatttccatgttgctcggtgatatttgacagtttttcgtagtttacatcaatgcagttcttcatagctagagtcgatgatcaaggcaatcatcattagggctagttcatcccatccgtgccactctgagcattgcgggatcctttctgtagttgctttgtcgaatttgcggttgcattctcgtgttcacatgctgggctgacagtcgaggctgtgatactttcaagttcagtatacaggttgtaaggccatcgctgcagtatcatcatctgggatgcgatctatcaccaccgctccgcatccgtatccatataccaccaccaat

SEQ ID NO: 39512 - DNA, 242 bp, Triticum aestivum
  Clone ID: PAT_TA_39512
gaccaaatcctcagcatggagatctacatactaaatgagatgcatcaatatacaggggaccactagtttgccccatcatgagtgttcaaaacctcttcttctgacaatcagtttgtgtgttccgggtgactgagctctaaaccttttattgattgggtccacatggctggtcacattttggtggtcttacgtatttgcaacaactaacttcatgcatcagttgcactcatcctctttggttc

SEQ ID NO: 39513 - DNA, 418 bp, Triticum aestivum
  Clone ID: PAT_TA_39513
atcggcgtgcaaatcaccaacttcaacgactcactagacagtggtagcaaagtcatatcgctcaggctcccacgagcaatgtctgcatagggcagttaacaggacacctgggtcgaagacggcctggatgcgcctccagttggttcgccgtaagggccagtactcatcgaggaggcgacccttggcatgcatacaattgtgcttcttgccgctcgacattctggcattgatgctcactgtgcttgtgcacttggccttaaacacacttgctccatgtgtcactccagacatgacagttagcattatcttgcatgctgacctcaaagtacttgtaggtagagtcctcattcacccactaggagttgcgcacataaataccactcaacctgagctcagctctctcctcaacagtaaacct

SEQ ID NO: 39514 - DNA, 443 bp, Triticum aestivum
  Clone ID: PAT_TA_39514
tccgggccgacatgcaactcgacaaaggttggcccacagttgcgagtcgaaggtggacttgcaacttggaaaaaaagtctagccccatttgtgtcgagagcgggcttgcaaaaaagacaaaaatggttggggcccaattaagaatcgagggtggactttcaactgggacaaaaaaggtcggagccccgtcgtgagtcaagggtagacttgcaattaggataaaaagtgtcgagacccggttgtgagtcgagagtgcaattgcaacagggaaaaaaggtcaggccctagttgcgactcaagggtggacatgaaactcgtacaaaaaaggctagactccagttgcgagttgagggtggacttgcaactgggacaaaaaaaagtcaggtcctagttacaagtcgatgggggtattgcaactgggacaaaaaagttcgggccccaat

SEQ ID NO: 39515 - DNA, 440 bp, Triticum aestivum
  unsure (1)..(440): unsure at all n locations
  Clone ID: PAT_TA_39515
ccgggccgagacaggtcccagactaggcgggatagaaggtatcctgaggatgagcgcgacagtcatcatcgccgtcgaggagaagagcgtgctgcccacgacggcctctcacgctctcggttgcaaggtcggataaaacttccaggggagacatcacttgacagacttggcccacacccacacctagagaaagagagagggcatagagacaggttgtctccaccaaagcaaacagaccttcgagcaaagcttcatgataggctaaaggctagatcgaatgaggaggtccctggtaacctgaagagttcagtggtaaaagcaagtagtggtgaggatgctggggtggtgaacttttctggtccaaagagccttgcagagttgagagcaaagaaggctgcttacagatcaggaganaacactgtcaagaatgctggccgtgt

SEQ ID NO: 39516 - DNA, 383 bp, Triticum aestivum
  Clone ID: PAT_TA_39516
tggattcacaacacaggagtgacacatgccgtccacgcgcgcagttggcaccaacggatctctgcatcgcctgggtccactgtccggttccatgtcgcgcactcgctcgggattggataggacctatcattgcgctccggcgtatttacatagcaacatcgctcatgtatcacctgtcttgcaatatgcacgcacatcgctcggtcactgatcacgcaccgcttccttgcctgtcccctaatactttgtactcactcgcttctgattccatgtcatccgtcgtgtactgaccacggattcacgtctaactgcgtctccggaccgcccaggatgaaaatcccagtttccgtcatgattcattgtcacataagtttgcacgcacc

SEQ ID NO: 39517 - DNA, 454 bp, Triticum aestivum
  unsure (1)..(454): unsure at all n locations
  Clone ID: PAT_TA_39517
ggtacttgtctaggcttcccgggccgtaacctggatggacctcgccgccgccagggactccgacgacatctcccacaccgtcagctacagcgacatctacaggatagccaagggtgtagtagaagatccgtcccataaccttttggagtcggtggctcaatcgattgccaacaccacgctgctcaagttccctcagatctctgctgtccgagtgaaggtcgggaaacctcatgtcgcggtgcanggcgtcgtggactacttgggagtggagatactgaggcacagaaaggcatgagcttgagcagaacttcatttgggaaagcctggccaaaatgccccctcagaattgcagttgagctgatttctgtgtctcatctataaacgtgctgttgattgtcctgttactcttcggctgatgctgaaattgccgcaatcacgggaaaaagattgatag

SEQ ID NO: 39518 - DNA, 439 bp, Triticum aestivum
  Clone ID: PAT_TA_39518
ccgggccgacgtcaccgagggtatcactagatttagtttgatgatgtgtgtggtgggtaatgttcactcagtcccaacctgtgtgttggagtgggtgagacaagattttaatgactaatgactacgtgtttcattaataaatatacacacagttttgataaaaaaatgaataaatatattttagcatcagcagaatggtaatattatccatgatattttgctattccacacttacatctgtctgccatgggttcctgaaagacaaacaattgtgattgaacagaggaagagcacatcactctcactcaatggctggctttggcattctttacactacacctttgaccaacaccatcccatcgtttctcaaattctgtgtagcaaaatttgctcgttgtattggtttactctaatatctcggtaaaaaaagggtatggag

SEQ ID NO: 39519 - DNA, 416 bp, Triticum aestivum
  Clone ID: PAT_TA_39519
tcccctacggattctggaatattggggtatttatagaagaaagagatggtcccggggggcacccgaggtggccacaaaccaccagggtgcgcctgggcctcctagcgcgctctggtgggttgtgctcccctcggggaaccccccaagcgcagccagggcccgtcgtgttccttctggaacataaaaattctccgtaaagtttcatggcatttggactccgtttgatattgattttctgcgatgtaaaaaacatggaaaaacaaaaactggcacttggcactatgtcaataggttagtaccaaaaatggtataaaatgattataaaacatccaagattgataatataacagcatggaacaataaaaaattgtagatacgttggagacgtaccaacatccccaagcttaattcctact

SEQ ID NO: 39520 - DNA, 272 bp, Triticum aestivum
  Clone ID: PAT_TA_39520
gacgcacgcctcaggtctgagtcgcagttctcaaccctgagaaagaggtcgctcactctgggcggggagacacagagcctgggatggggaccattgtcgtagggatcgctgagtcgcgtggggaggcggagacgtgccgtgggcaatcctttggtgccttcagtggcctcgagaatggttccctctttgccttcagaatggctgtactgctaggaagctggatgtaaaaggtagtgaggccgttagtactccatggctcagtcccatactgt

SEQ ID NO: 39521 - DNA, 400 bp, Triticum aestivum
  Clone ID: PAT_TA_39521
acgttgtaccacgcagctgcaggtaatcacaggggcatataatttgtcaatccgcgccgtgggcaagatctgcgtcctccatcattgccattcatggacttgggacagagcttgccaaatggtcaccaacggcaatcgtgaccttcaggtatgagcctgacatacgtatcaaccaagagttcatggttacatatacacatctagctaactaccaccgcgtggagaccagccctactaccatatttgacattgctcgcgtcactcaacatgtagcgattgtggtcccatctgcatacacgtactgacgataagcgtgctcagacatgacatatgtcaaggctgaagtcagcaatggcatacatctatgccaatgaggacagctttgatttcactgtcaaga

SEQ ID NO: 39522 - DNA, 437 bp, Triticum aestivum
  Clone ID: PAT_TA_39522
tcccgggtcgtaagcgatgggctcagtggaggacttgacctcttttgatccaaagaggttgaagtttctctggaaagttttaatttatctcatattgatgtaaaggtcgggaaagataataagaattggtgttttactggtttttacggtgagcccagggtggccaataggcatcacagctggcagctcttacgtaccttattttttgtccaacacgaagcatgcatctgtatgggtgattttaatgagacgcttcagggggacgagcattttggagccaacgcaagaccggagaggcaaatgcgtgcttttcgggaagcagccgcggactgtgcactccttgatgtggggtggcggggtgtccctttcacatgggataacaagcagcaggggaacgcgaatgtgaaggctagactggactgtgctatggtcaactc

SEQ ID NO: 39523 - DNA, 302 bp, Triticum aestivum
  Clone ID: PAT_TA_39523
gggctcaccactggtttcaccaagagaaaggaagggcactgagggcctggtgaggtgaagcgcgcagggcataccgcgggccagagctcagccactcagatttgtcggcgttgcagggatggacccatgcgcaaacgcggcaccagcgcgagcggctcccgtggtaggtggcaattgagtaggtgataatcataggcagattaagcatgaagggcaatcagctcaggtaaatgtggaatggatacatgccactgggtcaagcccaagcggcttggggatgatgcagcccgaggggcgccccc

SEQ ID NO: 39524 - DNA, 415 bp, Triticum aestivum
  Clone ID: PAT_TA_39524
tataataaaaatgaaagaatggatggatcatgaatggatatcaatatagtgataccataatacgtgtctgcaacttcactggagagtgtcgtgtggcacgacaacataaattcatgctaaaccatctcttttcggattgttggttgtttcattgttattccctacggtgtagttgttcgcctgatgtatcagttcaagatgtttatgtgttctcttaaattgaataaagtgttgtctcaattgtgtattatatgtcatactttatttattttgtaccatcatcgtgtgacgcctacacctggtaaaggaaaagaaaatcgtgtggcaccaaattaaattcaggaaaaatactcacgcgtagacatgaaaaatatacgcatgcttgtagaattatacggtagaatgaaatgtacat

SEQ ID NO: 39525 - DNA, 285 bp, Triticum aestivum
  Clone ID: PAT_TA_39525
ctgacactgttcgtaaagagaggacgattcctgagggacagactggtggttttgatcagtcggaagagcactttcccgagatcatgcaacgtgtctctatcttgcgtggcagcgtcttattatggtgcaatgctgggatcactgcgatcttcatattgtggttgctcatagctattttcgagagttgagtctgtcgtacaatagatatctccagacatgcttgatgatgtgatttgatgaacctgcattgccaagagagcacagctgtataacctgaaggaaagt

SEQ ID NO: 39526 - DNA, 401 bp, Triticum aestivum
  Clone ID: PAT_TA_39526
ggaaccggtataggattccctggctcgacccactcctcaaaggtagcgccggtgtaacccacgctccatgctctccccaacgctcctcttgctgttggggtttctctgcgtatttgctatcacacgactaacctgccctcacgccagatggtctagcgttttccacagtggttccactgaaaccgtcctatgcgtccggggagcagatcgtcttctcctgccagcctgtctacgtgtcgcggggaaggatccggcagtttacatgccctctcaaaggactctggctcatcagcactctgaaatgcacgcccatattatgtcgttttggctgggatgttagtcccacctgacggtacgctatactgcgtttgcctatcgcaacaccatgcgcttttcttgcc

SEQ ID NO: 39527 - DNA, 361 bp, Triticum aestivum
  Clone ID: PAT_TA_39527
tataactcctccatcctttctgtttttccagctgaagcatgcgaagtaatcagtggatacgcttgttctgctgatatttaccctgaagtcaagctcgatacaaatcccgtctcacgtcccgtggcttcagagcccgttgacagagaatacgaagagtataacagccccaaaacggttttccgtgaagaggcctgcgatgatcttggaggagaattctgtgaacctgactttcaaaaagatgccaactagaagaaacaagattttatgtcatgtgaatatgtgtttgtatttctacaagtctttgtaaccactccttaatttatgatatctagcttcactacttaatcaagattgatgttat

SEQ ID NO: 39528 - DNA, 461 bp, Triticum aestivum
  Clone ID: PAT_TA_39528
cgctgcagtactggtcagcttccgggtcagccctatgggtttcctcaatacaaacacgtatgactgtgacatagatatgatgagtcaaccatatgacgtatcgggctatcagcatgctaatgaggatatggatgatatgcgccggtaggaaggtcgttggaaggattgcaaaaagtctctcttcatgaattcctcacagaacacgcctggagatgccacctcaacacaggctcaactagccgggggtcgtacagtgcttagcctgggaaccctggggtaagggttaaggaagggtctggaaggtgtgcccaagaaaaaggagatgaagagattgcggaagataactgcctccaaacaagccagagcacataacagccagaagattgattctgaagagcgtgcacccgtgaaaggtgcggtcatgttccatctcacgggcgagccgatgctaccgccgaaac

SEQ ID NO: 39529 - DNA, 218 bp, Triticum aestivum
  Clone ID: PAT_TA_39529
cccaattcccaattctgagtcgtcttacaaccccctgtcctcgcttggggatcatttctacaacgtatccatttcccactgatcggctttactactctctcgctgtacgcatagcgcacaggtgtcctctcattcctgtactctcagatttgggcgttccactccaactgcgacgtctggttgtctgagaggcattgatgccccgagtttgccccggg

SEQ ID NO: 39530 - DNA, 309 bp, Triticum aestivum
  Clone ID: PAT_TA_39530
acctacgcctcaacttgcattcggcttggcacccttcacaatatattattccagtggtcgctacacttcacctatagctactccatcctgtcgttatctcttccgacgggtgcttcctcggggggtctcggactctgagttctattcacatccgtgtttagatgtttctttgcgtgttcacttcatcccgccactttattttccctcatcaggagacaattgcactatcactccctagattccatccttcttacatctccacttccaatagtcttttgtcctacccaatacgttcagatacacttctgt

SEQ ID NO: 39531 - DNA, 353 bp, Triticum aestivum
  Clone ID: PAT_TA_39531
ctattcacatcaaacatcacggcaccaatatcagctacttatcatttttcctttcctgcagtgaatctactcatgtcatgtgtaacatcggtactatgggccaacatggctcataatggatgcacacatttgcagcccaatccgacacaactagaccatatccgagcttctaggcaaggaagcagctgctgtccacaacaagcatatttaacacctgatgagcaacactactcaagtccacattccgaatctctacactatcttcacttacatcgttaatgcaccccctaggagagctgtccaagcagtcgatctgcttcaagctcaagttgaaaccttgctgtgacgcctcc

SEQ ID NO: 39532 - DNA, 433 bp, Triticum aestivum
  Clone ID: PAT_TA_39532
gtcaagcattcccgggtcaacgcagcctaccatagggcccatcatagagagggcaaggtcgacgacgcacaggacgctgtcatgctgcaggtggcgtcagtgtggctgccatcgtgggtcatcacatgggagggcgatcgaagggagctgctcgctcatggaatctgggctggcctagatgtgacgaccagttggctcttgcggtcggctggcaggagtcctagggccttctcctgtgcttttgaattgctgtttatttgaatagacaactgcatgaaattagaatgacaaggtgctaagagaagatcatgatacatatatggatatccctgcattctatgaattatgaactgtttgatcaaattgttttgcacttttttacaggtataaacataactcaggtttgaacttagttcaaacttgattcattttt

SEQ ID NO: 39533 - DNA, 452 bp, Triticum aestivum
  Clone ID: PAT_TA_39533
acggggcaaatccgggacacactctggacaattccccatcccgatccgatctttactgcaaaccctacccttcctgagccaccatgtccgcctcatcgtcctcctctctcccagttccgccgatttccctcttgatctcattcggtgtcccttctgtggcgtggatctggaaaccaatgtggcaaggaccgggagcagggcgggccagaggttctacaagtgtgtccgctatgatgtaagttcctctgttttctaccaaatctcgattagttcctttcccgttcttggttcagttctcacacctgcatctcgcatgtttcttgctaattttctcgcaggctcgcgagtgtaggttcttcgagttccagaaggcatacgtcaggaggatgaccacctaccagatcgcccgtgctcaacagcaggcgggggtgctccacctccagatgcacgca

SEQ ID NO: 39534 - DNA, 360 bp, Triticum aestivum
  Clone ID: PAT_TA_39534
atacgcactatcattgctattggacgacaagtattcccagcgtcctcttttgccgcaacaccttacaaaaaatgccctgaatatccatataccaatcatagcacgttctggtatacaacctcttcagaaactcatcttggcatagatttatcaatcataacgttggaacaggggagaacatcccgtgggtccaacaacagattgatatacgtttcacacctgttgacaacatgataaaaggctgtgcagagaagtttgctatggcgagatgaagtccactctggcagacgtattccttgcaccccagatttttgctgcagtgaatcgttttcagatcgaaatctcaaactatcctatgct

SEQ ID NO: 39535 - DNA, 402 bp, Triticum aestivum
  unsure (1)..(402): unsure at all n locations
  Clone ID: PAT_TA_39535
ggagcatttttacatgtaaagccatcaatggtggtatttattagcaagacacaccatctctagaatagcgtcatcctgatgatcatatgcgcgaagcgatttcctctcggcgactcggcttctcgatgtgaccacaacgggctagtgacaggggtgtctccgacgaggacacacaagataccaagcattgatcacggggtagcctggcatgtgagcgcagaggagaccatttcaaattgctttaccatctatggagccaaattgcagtctggtgatgcggcaatgggcagactaagttttaatactaaagtaggatgtcaataaaagcacatcactaaatatataagatagaataatcagttgtaatttctaacatgtanttttcaaaaatacatgaatttg

SEQ ID NO: 39536 - DNA, 457 bp, Triticum aestivum
  Clone ID: PAT_TA_39536
ccgggacgactacatgacacttaaccatttatatgggcctaggaggaacgcattgggaagtaatacagtagatgatgggttgcctacaatgacaaacgcctaaatccgatgttatgagttgcttcgtttggggctgatttggatggacatgtttcatgcgaaggttaagtttaccatcatacttttgttgtaattgcggatgcttgcaatagaggttagccataagtgcgatgcatgtccaattaacgacatcacgcaggcaccggtccacccacatgaccatcattaccaatgtaacgaatgcgaatcacatgaatgtgatgaaaactagcatgacgatattctcatgtgtccacgggagcacttttcactatataagagtttgtcgaagcttgtccttttctacagaatggattgggacagcttgctgcactttaattacttttgttacatgttc

SEQ ID NO: 39537 - DNA, 256 bp, Triticum aestivum
  Clone ID: PAT_TA_39537
gccaagatcgtgggcaagactggcgacgggcaagtcgcgagttcttaccaccaatgcatcattctgggagcagcacgaagacggtaacttccacgtgccggactttcggggttaagtcctccccacaactgggccgttcacagtatgaattcagaatgttctactggtcctcgtttaacattccgtcgtcttctgcattgacacacattgtacgcctcatcctcctaacccctaaacattccatggtcacatattt

SEQ ID NO: 39538 - DNA, 402 bp, Triticum aestivum
  Clone ID: PAT_TA_39538
attctcgggcacaagtgattcgtaaaaacaatgagaacttggcagagagacgatatattaagcgtatcatggaaagtgtgttccaacacatgttaccagattgttctctgagattatatgggtcatcctggatcaaattgggtttcaacgtttcggatacatacattgacattcaatttccaaccattatgtctcacccagatgttctcttacttgtccaagaatgtttaaacaacaatgactcatttattgatgttgatgcaaatttccatgctcgggtgccaatggtggtgtgcagagaaaagcagaatggtcttctttgtaaaatgattgcacgaaatgaaaatgcatgtctgacaacaaatcatttaactgcccttggaaaactacaatcaaatctgg

SEQ ID NO: 39539 - DNA, 301 bp, Triticum aestivum
  Clone ID: PAT_TA_39539
cgtaagtgaaatcgagtctgttcttgagacatatagcccacatgacgtgacacacgtttcaagaaggagatgtcactcatatacatccgaatcggaacctttacacatcctgtttaggattttgctttgttgccattagccgctacaacgacgtgtctaaatcctgatcggaaagtcaattcttttaaattttctagtgaaggcaagaagttgtcacgccgcagcggtaacagcaacatcgcccctgtcatctacaaccaccgcctagacaccacagtgacgaatccgtatccaggattaa

SEQ ID NO: 39540 - DNA, 467 bp, Triticum aestivum
  unsure (1)..(467): unsure at all n locations
  Clone ID: PAT_TA_39540
acgcctgccgtcaccggtgccgagattcncgggaccaccctcacgtctccaatgcacaacattccaatcacttctctttttgaaaaagtttttaggcataagaagcaagtattttttttggtattttcattttgtaaattttttgtttgtttcacccacaactaaacaaaaatagaagggaagacaaaaactacttagtgaagaaagcaaacaagcatacacgaaaatatcaacctcacgctattgctccccggcaccggtgtcagaaaagagcttgataatcccgaagtgcaaggaatcatcatagcaatttccaaaggtggaagtgataagtatggagtgtcgaacccacaaagagctaaaggtaagatcaatattctcccaagtcctatctgccaccgatacaactgtacgtacaccgaacgtttgctttcatctagaaacgagaaatacaactacattgtggg

SEQ ID NO: 39541 - DNA, 474 bp, Triticum aestivum
  unsure (1)..(474): unsure at all n locations
  Clone ID: PAT_TA_39541
acgcctgccgtgaccggggccgaaattcncgggaccacaataagaccaaccaagtgtgtgcatgttgacagagataatctatacaaagaagttcaaatattattgccccgcaggtttttcatgtcttcacaagatgtaccactattttcttcactctcaaaaattgtgagttttcaacactacaacaattcaataccccaaagaaagttatgggaaaaaaatatagaaagtctagagaggttggggacaaaaggatttctgtaactcaggttctcacatcaatcgagaataaagcccagaagttcaatttgaaaaagcggagcagtttgatatctatttgaaaaatcatatttttctagttactaaagaataaaatcaataagttcaatttcaaataacaaagaagttcgatgtttctaaaaaacctactatttttcaaatttataaaaatacacaatgaagttcaaataaaaa

SEQ ID NO: 39542 - DNA, 437 bp, Triticum aestivum
  Clone ID: PAT_TA_39542
cggtccgacattcccggggtcacctgcccaggtggatgcagtccgtcgtgcgctctgagtggactgcggaggtgtttgacatggagctcctgaggaaccagagctccgaagaacagatgattcagcttctacaactcgctatagactgcgttgcccaggtcccagacgcccgtccgacgatgtcccatgtcgttgtgcggatcgaggagatcaagatgtcaggtggaagcaccgaagaaactaatcaacaacagagcaccctgatctctaatggcatgagagaaaggagccggctgcctgttgctgtagccccattcattccgttcatagacttgacgaatgctatcttcttcgacggcggagccggctgttttttcacctcttccttttaacgaacatcggattcgttgtcgtcgtcgtcttggtgttgttgactg

SEQ ID NO: 39543 - DNA, 212 bp, Triticum aestivum
  Clone ID: PAT_TA_39543
tatggtctagcattccgggccaaccgcgaagacaccgtggatgtcaagttccttgtcgtgaccctgaacgcctacggacgtgtacgactactgttgcccgaagaaccgtggttcacaagcgtcgtgaatgactaccgttgaacgtggattcgtcaagttcctcgatgaccatgtaccactaccgcttcgcgaacaaaaacgactacttcccc

SEQ ID NO: 39544 - DNA, 245 bp, Triticum aestivum
  Clone ID: PAT_TA_39544
ttcagggctgtcgttgaactcgatatcggtcgcgacaactatgatccgcaaaaggacaaccgtatcaccggcgctgtcaacctgatccatgtcccacgcagcaggatcacggtctgcatgcacggtgacgcccagcatgtgagagaggctgaaaagacgggtctatgatgccatgcatgttgaagcgcctatgacgatgacgaactccgagaagcatgtcaagaggcttgccaggacgtaccatg

SEQ ID NO: 39545 - DNA, 346 bp, Triticum aestivum
  Clone ID: PAT_TA_39545
gacacgatagtgggcagcactggggaccggcatgtctcgagttcttacctcgaacgaatcattctggaacacgaagataatgataggttcctcgtgccttacgttccccactaagtcctccactcaatcggggcgtagcatatgaactcgtacatttcgatcaattttcttttaaaattcagtgtcttcagcagtgacataagttgcatgcgcaacatcataagcgtcatatatttcatggtcacgtatttcgacacggagcatcagtcgatcgtagactacacatttgtcaacaatgttcatgatgatgttctccccggatacgctaaatgtagatggaccttca

SEQ ID NO: 39546 - DNA, 355 bp, Triticum aestivum
  Clone ID: PAT_TA_39546
tacttgctctccacatgccaaatgacatgcattttccatctgggaggaacttacatgtctccccactccaacctgatttttcggggggtgtgtcgtcacgctcacctattggtcaaccataaccatcccaccctgcataaatgctgttaaatggttgtgcgtagtatatagttgcgccaccaaaactctcagctcaagttctcgtctaagccggatgtcttcctcgacttcctctgtctctctggcgcatatgtcgtcgtcctcgtcgccaacgactcgcatttcccttgtgccggtgtggaaagaactctggtcctgtcgtcgtcggtctcactggccttggtctatccccttc

SEQ ID NO: 39547 - DNA, 432 bp, Triticum aestivum
  Clone ID: PAT_TA_39547
gggccaacaaacaagggcatacataagcaatcactcaatcgaaacacaagaaaactcgagaaaagatccaaatcgtacacgaaacaagcaacgacttaaactaacaagagtcaaaacctaacaacattattaacatgtgaattagatcttaacagaaagtacaagtgatccgctacgattcgcaaagagattcaactcaaacggagcaagaaactcaaaatacgaacgaaataagatcgtttactaatttggactgatgtcaaattttacattaccaaaatcatgttcatgttgattaaatgaaaagagggcttcaagacgaaaattttggcgttggtttcaactaatttggataaacgagtaaaaagttatactagtttgaaaatcaggggctgaatcgcgataaaaataatcgcagataagtccctaacg

SEQ ID NO: 39548 - DNA, 247 bp, Triticum aestivum
  Clone ID: PAT_TA_39548
acgcgtcaagaggcggttctggttccactgcccacaccccgctctcgcaggcagacatgaggacagagagaatgtcccccctcctggctctggggatcctggtggctgggctctgcgccagggtccactgtctcccagagaatgtgtctccagaagaacagcacagagtgacatctgtggatgggcactcattaccctccaccaacactgacttctccttcagcctctagaagcaatttgctttttt

SEQ ID NO: 39549 - DNA, 359 bp, Triticum aestivum
  Clone ID: PAT_TA_39549
ggtccatgacttcccggggccactaaatgtgtgtaaaatatcatcacgaaataatttttgatgtgagctgtgcagaaagaagtcatgtcgttttatactgaatagtacatatgcttgagatatgtgatttcgtcaggtttgcgtaggtcgcataaaacagtagttcacgaggaaaggttgtaggcaagtaagagaccatcgatatgtatgtgtggagtttttttttacctaaagattaagtttttcagaatttcagattgaggcctccatggaacttgcgctctaatagggattgcctatgcatgttgttactttaattttagaccttttccctaacaagtccaaatgtcgcaatcttt

SEQ ID NO: 39550 - DNA, 247 bp, Triticum aestivum
  Clone ID: PAT_TA_39550
tacagtgtcgtacagccggccgtgcatcgacacaagaagtaccactgagttcagaccaaggaatccccaactgatgacatccgtcattccgctacgtcattctgacgcaacaccaggggggatgactcaaacgatttcagcctgtcacatgtggagttcagtcatcacatttgtaacatatgactccatctctagccatattaagtgagactgacaggcttaagaacacttggaacggtcacgcggt

SEQ ID NO: 39551 - DNA, 222 bp, Triticum aestivum
  Clone ID: PAT_TA_39551
ctcgtgggtcgacactacgctctaaactgaatcgtcctatgccagtcttctccgcatagccggccgctgagtccgacagcttatacctccctgccctccaatcagtccatggcgagcgtccccgcaaggtgaggaaggagggatcagaagccataatctctcacctcgagcccctgtacatagcggattcaggaaagaccgaactgcccgctgcatccaatc

SEQ ID NO: 39552 - DNA, 401 bp, Triticum aestivum
  Clone ID: PAT_TA_39552
attttaccgagtggcctcactgactcggcaagatcacccaggtcgatgtacgtcgcttcacattgaatgaccttggttctgtccaaacatgagctgtatgaaaatgatataacatgaaagaatcatgtctactaagtaaaaaaggaagaactaaaatgtaagcggatcatatctagaaagtagaaaaaaatatgaatggtagaaagagcaaagcaaaatgtggacattacgctttcagctccttcatgtgcttgctgctggccctcacatttccaaatcgcttgacaatatcgtacagttgggtctgctcctttgtggccctgacttcaggctcatagtcttccgtgggaggtgggtgaactaccctctgctgcctcacagaactaggggtggcactccta

SEQ ID NO: 39553 - DNA, 439 bp, Triticum aestivum
  unsure (1)..(439): unsure at all n locations
  Clone ID: PAT_TA_39553
ctcgcgggtcgacgaaaatcacaaaagggattacatgctaggaaaatgtatgtagtctcttcgtaaacaaatagaagagtatttagatcactggtgggagtaattaataattcgctaagcatcgacagcacagtgcacacggaagaggagagtaataatctatttttttgaaaaggatgttgaaaccccgggctctgcatcaatagatgtacaccgccatcattattaaattattcaacaatggtctgagaagaacatacatcaaatgactcgaaggcaccactcacgcctacaaactcgttaataaggatccatcgctcnccaccgttcagaatcggtatcaccgtctattcgtccgcaaacataccacacaggggcggagccagaatttgaacatgagtggggtgaaaagccaactttcacaaaagtcacgaaacat

SEQ ID NO: 39554 - DNA, 358 bp, Triticum aestivum
  Clone ID: PAT_TA_39554
accctaacattatatacagggtcaggtgaggtcggtacaagcatatcaaggggctcagcgtggccattaatggctgttttgtgcgtgtacgtttcacggctccatgcgtccaattaacgcagtaatgttgggttttaatttcctgaatgagttctccttgcattcctctttaagtttcgtgttggtggaaagtcggaaagatgtctgtggttggcactagagggagaggaagaggtggaggtgccatgacagtcgctctgtgttcttcctgaacattgaacgaacagagaggtagacgaagaccagcgcatgggccggcgctaagtgaaagagagatgggccttagtgggaaaggtgg

SEQ ID NO: 39555 - DNA, 404 bp, Triticum aestivum
  Clone ID: PAT_TA_39555
agcttgtgtggtcaacattggtgctcaagttacacaagtagtttgtgttgaggatggagtagctttgcctcacacagctttggcgcttccatatggtggagatgacatatccagatgcctactttgggttcaacaacgtcatcgcacatggccaaactttaaaaccgatcccatgaagaagcctatagatatgctaatgctcaacaagataaaagaggggtatagccagataaggagcggaagttatgatgctgtttctgttgttcattcatatgagcatgaaaagtctgttgggcatcagaagacaaggctgtcagctctcagtgttcctcctatggggcttctttatccccggcttctcattccagaagagttccctccacctccccgaccttggttccacg

SEQ ID NO: 39556 - DNA, 371 bp, Triticum aestivum
  Clone ID: PAT_TA_39556
gggtcgacacgtggctgggcccaacggcggcccatatatgttaataaggccggcccaatcaaaggcccgtagaacttaatcacgtactagtgggctagcccaataacggcctgcttaataaaagcccatttacggcccgaaaccagatctggaccgttaaatgttcgcccaatatttgggcccatttacgaaccgaaaccagatctagcccgttaattgttcgcccaatatttgggcccatttgcgggccgaagccaaatctggcccgttaattgttcactgaataatccggcccaactacagcccaaccccgaccaatgtgaggaaaggatgatggaaactatgattccctcacaagttgggatgagact

SEQ ID NO: 39557 - DNA, 158 bp, Triticum aestivum
  Clone ID: PAT_TA_39557
cgggtcgacaccttcatcaaaaacgtttctcactacatctccttcgactcgggcgccatcgtgcacgactactactcccacgtcgttccagccaccatcaacttcagctcccatggagactgtcatctgggcacgggacatcgagcgcaatcggatac

SEQ ID NO: 39558 - DNA, 298 bp, Triticum aestivum
  Clone ID: PAT_TA_39558
acagacaattccatccgctgcaagtttgagaacctcaaaatccaatctagagccctattctgacatcttgttggaggggaacacgaccatggaggggttcatcatcctcattggcgctcctccgaagaggcacgaataattcaccacagaactatgggtccgtaagcagtagctaaatgggtgcgtccctctttttaatctcagtagaatgtgcaactctatgttcttggagatctacttcatgtaatgacgttttgcaatgcgttttttgggattccagtgaattgtggagtttacg

SEQ ID NO: 39559 - DNA, 410 bp, Triticum aestivum
  Clone ID: PAT_TA_39559
gggtcgacacccttggggattctggatcattggagttatttatagagcaaagaggtggtgtgggaggccaccgaggctggcacaacccaccagggcgcgcttgggcccccaggcgcacccaggtgggttgtgcccccttggggcacccctttggtacttccttggcccaacttgtgtcttctggtccagaaaaaatcaccaaaaagtttcactgtgtttggactccgtttggtattgattgtctgcgaagtaaaagactagcagaggaatagcaactgacactgggcactatgtcaataggttagtcccaaaaaatgatataaagttgctataaaatgattggtaaacatccaagaatgacaatataacaacatggaacaatcaggaattatagatacgatggagacgta

SEQ ID NO: 39560 - DNA, 439 bp, Triticum aestivum
  Clone ID: PAT_TA_39560
ctcgcgggtcgacacggttcacgacagtggctacacttaggtgcattggcatgcttggaaaaggtggatgtgctacaggctgcgcttgttgcctccatgcatcgtgccacgccgtgcctagtttatgtgcaatatcgctgggtggcgggaaacaggtgaggaaatggcaggaaatagtggcgtgttcaattaatggcaggaaacaacatcaattaatggaaacatagcatatataaggaatatcgagctagcacaagaagtagatgatgatgagatgaacacataccacactaaggaacccatcggtgaagaattcatcaatcccaaatggttgtacactagcaagcatttgcccacaacacacacgggttatcccatcacagacaggtcagatggattaactgtatgccatgtatacacattgttcaaaagtaatgca

SEQ ID NO: 39561 - DNA, 415 bp, Triticum aestivum
  Clone ID: PAT_TA_39561
ttcgcgggtcgacataaaataataaccttcgccagacgggcacaacccacccagttgataccctgctcctctgaacaacaacaaaaacatcgctcaagaaaaactgtgctcacacctcagaaacaaaaatactgctagatctgctgggtcccagttgtcggccgctccttgtgcaattctctcgtttattgactatataggttgacgatggtgtgggaccgtgatgtcaggaaaccaggatgaagcaaaaaaattatagttgtatataataaggacgaacttgcgtacatacggctatggccctggtgggtccctactgtcatccttgccaagtgatctcctgattcctcatgttcgttgaccatgtttaaaatgctcggtgccacggtgagcgcaacaactcgaaggacgacgg

SEQ ID NO: 39562 - DNA, 273 bp, Triticum aestivum
  Clone ID: PAT_TA_39562
tcgacacatcccactagagtgcgtcgtattacgggtccctcacaatcatgaagactatgaccgactttattacctatatatagctctggaaggagcacacccactccgatagtcgtgttagcggccctgatctcgggggaatgtatcagcagatgcatgcattttcacgccatcatgaggatgcgacaggagcaaccgatattgattacaccacacccagtagatccagtgaacacttagctgcagatgattccaatcttgatctacagaact

SEQ ID NO: 39563 - DNA, 338 bp, Triticum aestivum
  Clone ID: PAT_TA_39563
gtcgacttccatcaaagcgatattcatcatatcatcgaaagacgggacacctttgcctctatcaagtggtatcagatttccaggttgctcggtgagattttacagtttttcgtagtttagatcgagtctgttcggtcatacctacagtccacgaagaaagccacaaagaaaattagggttagttcatcatatccgaaccaatctgagcctttgcataatctttttaggatttttgctttgttgaatttgcggttgcatcgtcgtgtcaagttgctggtcttagagtctggtcataagttgtcacgccgccgccgcaccatcgtcatcgctttgccatc

SEQ ID NO: 39564 - DNA, 298 bp, Triticum aestivum
  Clone ID: PAT_TA_39564
gtcgacgggactgtctcctctaactgatagcacatcgccggaaattttgaaataaatccagaaataatgcaagcaccaggacttgaacactggtgggctggggataccactgtccctctaaccatccaaccacaggttagtttgcattagaaaaaggttgttgacatatacagaaaatgtagaatgaaaacaaagtagaaccaagaacatcaaaaaatgggaacacaacaagagacaagacaaacctaacgacaatgaatacaaacaaatgtggaaagaagaaaaatggagtgaaaac

SEQ ID NO: 39565 - DNA, 395 bp, Triticum aestivum
  Clone ID: PAT_TA_39565
tcgacgtcgaccactacaatgtctaccatctacatcgatcgacgggacaccttggcctctatcaagtggtatcagatttccaggttgctcggtgagattttacagtttttcatagccatatactaccaccgcgaggaccaccgctgccatataccagcaccacatatccaccatcaggctgagttctttgcttattaggtttgttttcgggatccatctaaattccgagtcgtgtttccatgtcggagtcaggtagccacgctccgtttatgcccaagatttttcgaaaacgcatttttcgaacaaatttctggctatcctatttttacgtgtgtctgagtgttttgagacacgtgccactatatgaagttttttgtgacccatttccagttttt

SEQ ID NO: 39566 - DNA, 381 bp, Triticum aestivum
  Clone ID: PAT_TA_39566
tcgacccgcttctcgagatcgagtcttagtaccactatctgatggtcatggtgctttgtgttaggccattttttttagaatcgcgttggaccacttaactttgccacaaggatattttgtttgtaaagatgagtatatcaagccattgcatgctatttacatatctagcatctaaatcaggttatcgacatagttgcatcaatcagactagcaaatcgtcactctggatgacatcaacatcttatcacaggatttaagccccatatggatgccggtatagccacatgcattgtcaagactctgtgtaagggtgcaaaccaaaggatagctaaccgtccattatccaaagtcctagtatctgtcactagctctaataacatt

SEQ ID NO: 39567 - DNA, 450 bp, Triticum aestivum
  Clone ID: PAT_TA_39567
ctcgtaggtcaacacaactccctaaagtgagtcctaatatcactgaaacaaccatggagtctggtccatgttgtggccgagtaaactctttgtccctcacttgtgttgtcaagtggtgcggcaggtcgttgttggtggactacataaaaggaaatagtgacatacatgtttctcgtgttcaagcagtttcttgcaataattgttatccgtgatataaggcatgcaactgacatttggtaaatcatggtggcgttagaaaactatttctacgtcttttccacttctcagtgacggctataggacgaagacctcatcccttctaggctcacctgtgcttttttttttggcgaggtaggcccacctgtgctttgcatctgcgctcaccacaacacagatacaagtaacaggtgaccaaatagcaagcagaaaaatccacagtgatgccaggcg

SEQ ID NO: 39568 - DNA, 436 bp, Triticum aestivum
  Clone ID: PAT_TA_39568
acagactccactggctcactatagcatagcaccctcacaaatgggaccctatagatactcgatccgtcaatctctggtggatgctccatcttggaacgatactcccaccaccgctgcctcacgataggattcggtgaatttctttgcaccatggcccagaggagcagctctatgtactcccgcgcgactctcttcgggagtatagccaccttttcgctctgttgcagatatttggccatggatgtcgccgtcatcgctagttggtccttgttgtcaaaccaagactgtatctccaacatcctagctagcttcacaaggtcgcgttctgcaatcctcatgtatgtgttgtactcctccatcgatctacttctccacagcaccttcactcgccggtggtggtttttgaatgggatacgagaggagtggtgctggtttt

SEQ ID NO: 39569 - DNA, 303 bp, Triticum aestivum
  Clone ID: PAT_TA_39569
tcgacgaaagtccctataatgagtcttgatacctccgccgtcctcgccgtcgcctccaacatcgtcacaaccatcatccgcaaggctcatgcctatatcatggttcatctcaacggttcaatgcccatgtcattggtaggtactcacgagcctgcaacctaatgcgaactggattccatcagatggcctaacgcttatttttacaagatgctgaacgccagcattgcttccatcctgtagtccaaactgtccatccccaagtcccgcttctacctcaagttccaccattcaaatcgctcatac

SEQ ID NO: 39570 - DNA, 310 bp, Triticum aestivum
  Clone ID: PAT_TA_39570
tccacacgacaggatgttgatcgcaagcacctagtgacatgcgtcagggaaatgcaccccagtgctcatatctgccaaatggcgatcgacattaccatgcgtacttgctgacgaaaccttagccagcgtgagcacgggctcacaactccctcgtcaatcctgatctaaggaaccacacctcaggcgcaacatgggccatgcccttaacgttcactctactccttcattactatgtgaacccgaacattcagatgcagacgatagttacggaattcacctccacatgaatctgccgcacgcgttgactcaa

SEQ ID NO: 39571 - DNA, 122 bp, Triticum aestivum
  Clone ID: PAT_TA_39571
tcacacatgccactaaacgaagtcattgcagcatcccgaggggaagtcggcgtcgcattctggaccatcgaccttcatcgctgccccgtggatccccctcgcgattgcctgcaatcttctcc

SEQ ID NO: 39572 - DNA, 343 bp, Triticum aestivum
  unsure (1)..(343): unsure at all n locations
  Clone ID: PAT_TA_39572
accaggccgtacctgtaaacttcagattatctacaagatgtgaacagaagatacagatgcaaccgaagtgaccaggtgacatactactccaggtggaattaaaggcaagtgtggttacgcaccaccatacgtgcaacagtagcaggtancgttgtctggacacaggagtagtcttggtggagtattacgatgcaacgtgcagttggggacgcgacaggcggaaaggcggcaggcgcgacaatcggcaacaagtgaaacaggctgatgcaatcttgctttgtttttctcagattatgaatgagcttgcgatagaaaaagtacggcggacaaaaacagattgatc

SEQ ID NO: 39573 - DNA, 409 bp, Triticum aestivum
  Clone ID: PAT_TA_39573
cgacgcgttctttttaattttttattttttttttttgcggaacaggcaaccggaagtgggtcataaattcattcagcatcatccaggacattttcccaaacaaaaatgtcaagcttgtccctatctgtctcaggagaaggagttcctccgcagtaagtaatcctgttattgtcttcacaacacagtggccacagctgctattccaatattccaactggcactactctaacggtcactagggagctaaactaaactaccagtacgtactagtttatcccccatggatcgttgggtcgaccatactaatcacaccaccagctccccatttcctcaatcatcagggggaccaaaatgtcctgccgcattgaaagttgagacagctagccgtgactagaactgcagattacac

SEQ ID NO: 39574 - DNA, 396 bp, Triticum aestivum
  Clone ID: PAT_TA_39574
ctcgcaggtcgacgacatacccgacattgtgtcccctgattgagagatcaaataccctgtgaacactgtcggcatcgacacggatccttcccctgcttgggaagaccatttcagagctctctagctagtaggactgcacgaggaatttagtgaggtatgctggaagtgcctctgataagttcaacagacccccaaaaaaccttgaaactaactcagacttctgcggtgggggtagcgagctattgaacttcgtaaaccgccctggtgatgcccttatccttcccgcttgtgatggtagctccacatcttgcccccctcatgcacctcatatccactgccctgttgatcagaaaaataaaaacaataatcacaagacagaaaactggtctgaaaaat

SEQ ID NO: 39575 - DNA, 225 bp, Triticum aestivum
  Clone ID: PAT_TA_39575
aggtcgacacagatcccaatggttcatcatatcatagcaccctcacaaatgggagcctatacatactccatccgtcaatctcctggtggatgctccatcttggaacgagactcccaccaccgctgcctcaggataggattccgtgaatttctttgcaccatgggccacaggagcaggtctaggtactcccgcgcgactctcttcgggagtatagtcaccttttcg

SEQ ID NO: 39576 - DNA, 257 bp, Triticum aestivum
  Clone ID: PAT_TA_39576
ctcccgggtccacatgaaccacacaagtacgccggacatacccaagttccgggctctccgcagagataacacccctaatcgtgccgatcgtggtttatacgtggatggtactagcttgctcctagacttgttttggggacgaatgaacacattccactgcaaacgatgcgccttcttcctgcatgtgtgtctgagtgtatgccaaaagtcctaccgtactctctccgtacctgtacgcctcccagggggttttatac

SEQ ID NO: 39577 - DNA, 420 bp, Triticum aestivum
  Clone ID: PAT_TA_39577
gtcgacctcctccagcctccacccgcgactgttcatccactggctcctgttcacccagcctccatcgcgtgctactccatgggctactgttcaaccagccctctccacgggctagtattcaaccacccctccacgggctactgttcatccagccctccaccggctactgctcaaccagccctccacggggttgtcctgttcattcagccctccacggggtcttgttcatccatccgcaaccggctcgatcggggtcttgttcatccagatgtaacaccactatgtcctgttcatccaacctcaccgggaactgttcatccaccccccagcaacgctcattgttcatccataggcagcatcgatcggctttagttatcatcagtagcgaaggaatcgctcgatcactcgggttcagtaacg

SEQ ID NO: 39578 - DNA, 446 bp, Triticum aestivum
  Clone ID: PAT_TA_39578
tcaggaggttttacgcattccctgcatgattagcataacgaatatatttcatccaacagacaagatcaccactcatcatacccctcatgccatgccggacacactcgtctcgacgaggaactggggacaagctcgggtctacccaagacagagactttcccgttttccttccggtaggcacgaaaggcacacgaggatgatcattatcacaagcatgtccatttccaacagcaaagaagtttccaataagcatgcatgcaaatgatcacatcaccacatagaatagcgagttctacgtattgaggtggtgtcataatcgtgtcaaacaatacatgcaaaatattatgccagggttcagaatgcttgccttcaaggtgtggaaatgcagggtgcactccaaaacttttgaaagctttctcctctctccaaaaatcctatttagaatg

SEQ ID NO: 39579 - DNA, 311 bp, Triticum aestivum
  Clone ID: PAT_TA_39579
tccgaggaactcactgtgggtgaacgcagtctcatctccggcggatataaaaatgtcaatggagacagccgtgcctcacggcgcatcatgtcctcgattgaagaaactgaggaaagacctggcatccatgaccgggtcagactcatcaaggaagaacatcggaagatatagactgagcttaacaggatctgtgatagcatcatcaatctgctcgaaacccaccttataccgtcatccactgcccctgaatccacagtcccttatcgatctatgggtgatgactactactcgtatcgtgcccaattcatgag

SEQ ID NO: 39580 - DNA, 436 bp, Triticum aestivum
  unsure (1)..(436): unsure at all n locations
  Clone ID: PAT_TA_39580
acatgcattctggtcagcttcatcttggaggctgcggtgacgtatgcgacgctcgtctagtggagctactgccgatggtcgaggcatcgttggcagtctgcgccatcaagttcggggtgctcaggggggaaccccagatctgggtcttccggatcggatgatgatggcgttctatcactttcccttctgggggcatcgtcttggagcaagtgctggctggagggatggtggagcggtgtttcatcccaaactttgatggcggcggagatcgatggcatggcgctgtggagactcggcgtccaacatgcggagatgggctcgcgcaagangaggttgctgtctggcgtcatggtgacgtcgatggcagaatggccagacagggtanaagccctaatatgatctngagacatgtggaagatggcggccacgacacacg

SEQ ID NO: 39581 - DNA, 431 bp, Triticum aestivum
  Clone ID: PAT_TA_39581
atactttttgcacttcagattcattcagctattaacatgtatttctccatcagctgctgtttagagcatctaccattatgatagtcatcatagtggattgctgtagagttttatgtacatgagattggattgttaaatctctttcacacgccaagtagataaagcggagcaaattattacatccgtttgaatatctggactgcgcttatgtattttctgagacaacttatgtttgcttctcacactaatgattttgtttgtttggggaaacaagttaccatagccgccttgtcacctaagtttgctctgtattttgatgaagccttggtttcagcaagaagttagaggaggaagaagtaaagcgagcaatagagaatggatggattaaagactcaataagagatgttgaagaaatctgctgatgcatttat

SEQ ID NO: 39582 - DNA, 412 bp, Triticum aestivum
  Clone ID: PAT_TA_39582
attcgacgcaacgtgcgccaaagaggattttcgagacctcctatttgacaccttcagcgcaaggtaagttgtacaacgctcacagctcaccctcgtgggctaggcctagcggcgttggcacgctcactcacgcgtccgcctaagttttttctttcatttcacggtttggcggttgacacattgagcagttgacccgtttgatcagttgtctagttgcatgtttgactattgtctctgagagcagtttttttttgcgggtgtctcctagagcagttgacaattaacttttctttaaaaagttcatgaaatcaaaaaatgttcatgcatttgaagaaagttcacaattttgacaacaaagtttgtgaatttcgaaacaagttcgcgattctcacaagaggttcaagtttttttt

SEQ ID NO: 39583 - DNA, 127 bp, Triticum aestivum
  Clone ID: PAT_TA_39583
ctttcaacattgcagcgttttaactctggtcaagtccctgatgttgatcgctaccaatgtgtacaatcgtgagctggatatcgaaactgttcatcttgttatcaactatcacatcccagggtttcca

SEQ ID NO: 39584 - DNA, 446 bp, Triticum aestivum
  Clone ID: PAT_TA_39584
cactgacagtacaacatgggatactatcttaccgatggtatctatcctcagtgggcggcatttgtgaagaccatatccgagctacgtggcaataaacagagccactttgcaacaatgcaggaagcggttaggaaggatgtggagagggcatttggtgtgcttcaagcttgttggggaattttatggagcgctacaatgatgtgggaatcagaaactttgtggcagctgatgacatgttgtgctattctgcacaatatgattgtcgaggatgagggtgatggtgtagcccaaacccatgatttcgaagcacctagagaacaagttgaaatccccgaagatcaagatgtagctcaactgatgaactttctgcaaatgcatcagaatcttcaagatcagcaagtgcatatgcaactactcaatgatcttgcagagcacatgtggaccca

SEQ ID NO: 39585 - DNA, 271 bp, Triticum aestivum
  Clone ID: PAT_TA_39585
tgggaagaagccacctctctgccgtagtcgaacggcgccacctctgtatcactccatggagatcccccatccagcatgtcctcagtaacaaattcccggaagcaacagtccttattaagattattccggaagaaattccctcaggtttagcttttcaaatctggcactgatttttcacatgtttccggtactcagcagattcagactaaataagccacctgctgtaaaaaatgcaagaatgaagttgccaagttgcttcccttagtacacc

SEQ ID NO: 39586 - DNA, 156 bp, Triticum aestivum
  Clone ID: PAT_TA_39586
ttccaccaaagcgaaatccaccatctcatcgaaagatcgggacaccccgcctctatcagctacccaccgttcattgtcataatcatagttgagatcattcacatcttcgcttgatcctatctgcatcttatctaggttgtttggaacgagagagag

SEQ ID NO: 39587 - DNA, 278 bp, Triticum aestivum
  Clone ID: PAT_TA_39587
ccgtcattaacaatccagtagtcgcgcagagcgctcctgtcacacccacgatgcgggtatatcccccacgtgtcgatgcaccacttagatgcataaccgcattgggggtgttacaacttggtaatcacagccatccccgacttatgacccccccgcttgatcgaatcactgacgttgttgagtccagaaccaaatgccttgagtcttaagattatacatatccgccagtacgactctttttactcctcattcccttccgcgcccctggcgacgccccc

SEQ ID NO: 39588 - DNA, 339 bp, Triticum aestivum
  Clone ID: PAT_TA_39588
tcttcggccgccgccgccttctcctcgcggtttctcctccaatcgagtgcagctggtgtggatggtgggttgggggagtaatgaaaccgcgagaggagcgagtggcgatcgcgacggcagttccaccacacgccccgactcgcaagcgctgagctcggaggaaaaaccggcgtgcgggcgagctacctacacaccagacacggggcttgtcctacgtggcacaccaaatccaccttttcgcaagattcgtgcaaaagacaatcaacgacgattcacgcgtgtgggcgagttggtcaagtgctaccgcgtggacgttagtttttccgataccatgacacc

SEQ ID NO: 39589 - DNA, 347 bp, Triticum aestivum
  Clone ID: PAT_TA_39589
cacaaagcgggactatcgcgcgtccgcctcgagagcatcaggaccgcttactgtttgcccagcacatcctagaatttgcgaacggcaacaccattcacatggtcgtagactcaactcatcgaggcggtgaacaaagttggtgatagttgtgacatctcaaactacaccatcgacttgctgcattcaggcgacgggcacgtaaatgactacggcaagccagggcataagtatagcggcagcatgtggatgagattgatctgtacctagtgttgcagcaagctgcagctccagtgtgataagtatagctgcattctgatcaagccgtaccacactgagcagatgcacat

SEQ ID NO: 39590 - DNA, 446 bp, Triticum aestivum
  unsure (1)..(446): unsure at all n locations
  Clone ID: PAT_TA_39590
tgcggtctccactccggtggatggtggttcgggcggtggtggatctcgccggggagggctgcaatcgtcaaattgaggctcgggttagaggagtgggtgtactangaggcgactggcacggtctgggaggcgggggtggtctcaccagagggaatcgtgccggagcccgaagcggatcggggcggtcggagtcggggaagaaggcctcctcgaggtttccctagtagctaggcgtggctctggtgagatgtangagtggtgctgggtcgaaggcgagctcgaggcccctttttatagccggtccgaggcggttgccgagaacgggataactccggcgatgattacggtgaggcagtggtcgaacaagggtttaagggtcggggcagctgcggattggatcactagcttcaacccgttgctaaacttgggcagacttgggcgatact

SEQ ID NO: 39591 - DNA, 437 bp, Triticum aestivum
  Clone ID: PAT_TA_39591
ttgttcaagaggacggtattctttgtgtcgatcgggagcaacgacttcatccactactacctgcgcaatgtgtcaggcgtgcagatgcattacctcccatgggagttcaatcagctccttgttaatgcagtgaggcaggaaatcaagaatctgtacaatatcaacgtccgaaaggtcgtgctgatgggccttcctcctgttggctgtgcccctcacttcctctcagactacggcagccaaaatggggaatgcatcgactacatcaacaacgtcgtgatcgagttcaactatgggctgagatacatgtccagcgagttcatccgccagtacccagactcgatgatcagctactgtgatacatttgaggggtcagtggacatactagagaaccgttgacgctatggctttctgaccaccactgatgcttgctgtgggct

SEQ ID NO: 39592 - DNA, 440 bp, Triticum aestivum
  Clone ID: PAT_TA_39592
aggatttggtcatttgcatggttagtcatgaaatcctacataaaacttgtggatcactgaatatgatatgtttgattccttgcaatagttttgcgatatagagatgataatatgtgggaagtactagtaaaaagttgtagttagtaagaatattggtgtaaaggtttctgattcccgaagcatgcacgtatagtctctagttatgctatgaagttggagcatgatttattattgattgtctccttatgattggcggtcggggacgagcgacggtcttttcctaccaatatatccccctaggggcatgcgtagtagtactttgcttcaaggtctaataaacttttgcaataagtatatgagttctttataactaatgtgagtccatggattatacgcactcctacctttccgcaatttgctagcctctacggtaccgtgca

SEQ ID NO: 39593 - DNA, 446 bp, Triticum aestivum
  Clone ID: PAT_TA_39593
tttgacgatcagactacgaacgtgcaaggacatcgcgccttagcaatcactaaaccaacttcgagaggttattgaccatgccggagcacgatcaacctgaccacgaaggtctatttcctgcaagcaaacgaagaacaagcaagaaactaagatggcaatctggatattgcgaatataagaggaaagctttattaatgaaggtggggttctgtgacgcctttgtctggtcgttgaacacaaacgaagtacacgaagttgcagctatggcgaactttttatctaaacaaatcccaaagtctaaacgacgccctaagggttgtatatatggaggaagaggggggaatttcgtggcccttggggaaggggtccgaaaccaaccctatctcttatttcccacacttacggactctaaaaacaacctatacttatgtatttcgaaattacat

SEQ ID NO: 39594 - DNA, 223 bp, Triticum aestivum
  Clone ID: PAT_TA_39594
aacaaggcgacaaaaggggactctattatcacagaagtacatgcattcctcgacgcgcacgagtactcatgaagacacccatgtacgtatccgacttgtgtatgacatgttctaaaatgtgactgtgtgtctctactggatctcaagactgtggaccatcacatggacctgccgtgagctgcatatcacacccactgcgacccaaggctgaacgcatcgcact

SEQ ID NO: 39595 - DNA, 239 bp, Triticum aestivum
  Clone ID: PAT_TA_39595
atcgcgagtacaggggcagacgttggcgccgccgtgactaatgtcgccatccgcgccaagactcaatgctgcagtccgccgcgcgagataaggccggcagcgctgggaatcgcgcgaggcgtcgaggaggtctggcctaatcgctctgttagggcaaggtgctgataacgtgtaaagatgaaaacagagagcagagagaataatagatgagcagttattctattgattgaagattgggg

SEQ ID NO: 39596 - DNA, 425 bp, Triticum aestivum
  Clone ID: PAT_TA_39596
aggccacgtgaacatcacactgacccaggccggcaccgttggattcctcctgctttaaaaaaacacctataattttattcatgctcgtaacaattacaggtacattgatttgcatctaaaatcgaagaagacataaagtaattcctctgactaagaattataacgaagacttggaaacagcttctgctagaaaaatatatttcaaagagttccgtaaataggctgcaattgactggagcaacgatgttgtcactcattcatctgctatagtaccagccaagttttttttacaaccggtttgtaacattgaggtctgctacattacgtgtggttgttgatctggtgctttggtcttttggggacttagcacgatgattctccgattgtctaatagaataagttgtccccggctccggcaaaggaag

SEQ ID NO: 39597 - DNA, 426 bp, Triticum aestivum
  Clone ID: PAT_TA_39597
aacagtgcgaaatatcacagcgacaatggaagtacaaatgcgatcacatggagggcgtcgcatgccatccctccggtccgccaaaactggtaatttgttaacccatgcctaggatcattttctaatttacaccgcaaacgactatatatcagtggtctaccagtccatgtgaacgtggcaacatgtcgtttattgtcatcttgtgatactaattggcaccaaacacttttaagtgctgaaagatactcgattcgtcccaaaatctaaggcatgacgtaaagccaacgttttactttgaccaacaatttcactaacaatttgtaatccataaagttgaactttggcctaatattttggacagaggccgtgatgttcctagcacttgtccagttctcgggttgatgaaaaaagatctaattgtattgg

SEQ ID NO: 39598 - DNA, 440 bp, Triticum aestivum
  Clone ID: PAT_TA_39598
tttttcctatgttaggagacgccacgggtgaattgctttacttcaaagacattgatagtaacttttatagttctaaaaaatggcctacctagaatgataggtgcagtaggatctttaggcatatcaactataacaaagatcaattataatgaggcaatcattaatttgaatgattactccatgattaattcctactggttgtgtaaagatagaataagccataaaaaaaccaaggaaacatgaaaaccaaaaatgatcgtgaataaaatgacgaaaaccggtgaaaaacataggaaaaaacttagaaaaaacagaaaaaggagagagaaaagaacagattcaaaacagcgataaaaaagggtaaacgggccagcccatttgctatgcgagataagaagttcttcatgcgacagaagcaaccctctcggtgcgcccctatg

SEQ ID NO: 39599 - DNA, 442 bp, Triticum aestivum
  Clone ID: PAT_TA_39599
aaactccttgctccccatcgacagaacaacaaggtccaaccatacctcattgtatatatttttcaacacatgtatgtttttttaattcacaattgacatttttcttatatttgtgcaacatctttttgatagatgttgaacatttttgaaacactatttcctcctccaagattcttgctttccttctacaggctcacgtatgaaaaatgtgtgccttatagagggctaggccagaaatacatagcatagataacaagggtttcgccaaagtagacgtacaagcgaaacattccacttatcgaagaaggtaggtatttcaagttcaagaagtaggcatcgatcccaaagaatgtagtgaaaatctagactaggaggaatgcatcaaagccaaggtcaagcaaaaggttgttggatcgttacgttggtcggaagttatttcctt

SEQ ID NO: 39600 - DNA, 429 bp, Triticum aestivum
  Clone ID: PAT_TA_39600
gcgggtcgacagtaccatcgaaaatatcgatatttgctttttgaaccaaaatgttttcttaggaatccttttgtatgaattgctcgaaaagtttttgtgggcgatttgtggtctaccttcagagactgctcgcagacgagagctcatgtatgaggcccgtgggcgtcaaacagggagtcttagctggaaacccggttgttgttttttaggagctacatatttttataacctgttaaaaatagaaaaatatatattttttaaaaaaaattgttccttatgtgttatctcataatatataaacgttcggtgtatataaaaagttcaatgtataataaaaaagttcggagtgttataaaaatgttccatataattgagaaaagttcaccttatattaaaaatgctcaatgtacataaaagcgtaaaatgttc

SEQ ID NO: 39601 - DNA, 380 bp, Triticum aestivum
  Clone ID: PAT_TA_39601
atgtgtcacggaatgcactctctcaatgaaatcagtggctctgttgtcgctgggttccattatccatccatagcaggtgccttggctgacgacaacatgcttggcatctgctttgatgtctgtgatgtcgttctgtaaattgattctaatcagatgggtggcggttaggtcatcccaacagtcatcacggacatttatccttctcagctcactgctaagcccacgttgctgcatcctgtatacctgcctgatatacaagcaccagataatgcacttggcggtacctaaggtgttcttaatcataagataagagcacatgtttgacgacatgcatatagctgttaccccgctgtacaacatcgacgcttacctcccggtca

SEQ ID NO: 39602 - DNA, 426 bp, Triticum aestivum
  Clone ID: PAT_TA_39602
acaggaggttttagtattccctgcatgattaccataacagatatatttcaagcaatgaacataatcaccactcaccatacctcatcatgccataccggacacaaccatctcgacggaggactagagacaagcccgtgtctacccaagacagaggctttcccggattccttccggtatgcatgaaaggcatacgatggtgattactatcccaacgtatcaaattccaatagcacggaatcatcaatatgcacttatgagtatgttcatatcatcgcataaaataatggaaactccgagacgatgggtgttgtaaccgtatcaaacaacacacgacaatattatgccagggttcagaatgcttgccttcaagttgtggagaggcaaggtgcattccagaacttttgaaagttttctcctctccccaaa

SEQ ID NO: 39603 - DNA, 116 bp, Triticum aestivum
  Clone ID: PAT_TA_39603
gtccacgtccaccacctagaaaaccaccatctcatctaaatactggacacctttgcctctatcaagtgctactatatttccacgttgctcggtcagattttacactttttcgtacc

SEQ ID NO: 39604 - DNA, 402 bp, Triticum aestivum
  Clone ID: PAT_TA_39604
tcatgggtccacgtgcctcgatatattgagtcgtattattacattgcgctaccatggaaaattctcatcaagaggccatagacaacggcttgttgtcttggaaggacttgttctacaagaatacaagaatgggcagaagcaacaaacaaccgtagccgtgcaagtaaatgatgcaaatgaaagtaatgaattaacagaatctaagcacaatgattatctggttgcctcccgtattcaaattatctatccacatacaagactatttattataattgcaatgacaattacgccaaactataccatttgtggtgtgttattcaaaaaactgtgaaccggtctattggaactacattacttatgcatggtgaatgtaaatcatggcaccacacatctatcatccta

SEQ ID NO: 39605 - DNA, 292 bp, Triticum aestivum
  Clone ID: PAT_TA_39605
gaccaaagggatgactcaacataaaagtaaagagataagcccttcgcagatggaatcagggatttgtacaggtgctcgacctcgattataaaattgatattgagtattatgtgggggggcaaacttttattgtcagtacaatgacggttagatggccgtatcggctacaattttggcggtattacatgtttgcttgagcttggtcaaggttcattttctccaatcagcatcaagcataaatccatggctttcccaaaagatcgaggtttacttacacatgacagccccgtgg

SEQ ID NO: 39606 - DNA, 332 bp, Triticum aestivum
  Clone ID: PAT_TA_39606
gctgtcttggctgacatggattctattggacatgaagcacagctaagacgttttgaacttgccaaagctgttactcttgttgctgaacctttcacactacaaaatggtggcctcaggctcacgtccaaggtcaaaagaccgcgagctaacgcctacgtcacgaaagagctcgcacatatgtatacataactccgtgacacccaatcagctacgcacacgttgttcctactctacaaatgttcacgactacggttcacacctctccaggacaggctcacaccactcagcaccgatctctcatctgccttctcctcttgactactcttcacccc

SEQ ID NO: 39607 - DNA, 316 bp, Triticum aestivum
  Clone ID: PAT_TA_39607
tcccctatatcgactcggactacgttcacctcgtcaagctctgccacaatctcgtcctaaaagggttcaacatgtggacattctggcagacatcggattcgtcgtcatgaggctacggagggttcttcgtcaaattcatcttcatcgttatcaacaatcatcatcgaccggtccggatgatcacgtcttcgcagatttcaggaccctttatgaaaggaaggtgtacactcaatttagccgttcaggttatcttaatctcagtccttaaaggaattcatttatgatttcaatgtatacgacagttcccttgtgtttt

SEQ ID NO: 39608 - DNA, 421 bp, Triticum aestivum
  Clone ID: PAT_TA_39608
tttctctgtaaatatcactctccgcagatacttatacacctgtgtacacgcattgacgcattattcgcttaacccataactcttcagcaggctatcgtcactatggggcacgacatgcacttacactcgccccctttgtggcgattgttgactctatacgttaagtttgcaccggggattaacatagcacgtgtagataatgatattgacgaatttgattgcaagatatagaacatctcccccggaagatgtgcatactgacgaatttgcttttaattcatggcatacttgaagacttcaatcatggtcattaccttctatatcttgtgattcatacacgcatttaacatatgatatgacgaatttgaaatgcatgattgacatatggtgactgatgtaattcagcatacgtgcataacca

SEQ ID NO: 39609 - DNA, 157 bp, Triticum aestivum
  Clone ID: PAT_TA_39609
tcacggggtcacgcaatcgatgatatagacctctacaaggtcaagccattggacctcccggcaaggtcgcgcctccgcagcctcgactcccagtggtacttcttcagccgcctcgatcgcaagcatgccaaccgcgggctcagcaactgctccactg

SEQ ID NO: 39610 - DNA, 200 bp, Triticum aestivum
  Clone ID: PAT_TA_39610
cacggggtcacgatctggtttttatttgttaggaaccgtgtccagaattgtctggccgattcgactagctgctgaattatctggcttaagtcgtcagtatccggcggtcgcacgtaagtgccttggaaattcgggagaaatgccgcgtctagctccttccatgagggggttgactttgccggcacgctactttgccagtg

SEQ ID NO: 39611 - DNA, 299 bp, Triticum aestivum
  Clone ID: PAT_TA_39611
cggtccattattcacggggtcacgtaatcacggtcatctcagccggctagttcatccgcaagcatctggggcgccagtctgggtccaaggcagcgatcgctttaagcattcttattccaagcactgcaaagtattcacactgcacgggggttcgtcagacgttcacattgcacagttcggggagcttaatccggacctgctgttctctgcaagtccactacgagaagcacaagtctatgtgctacaggctccatgtctatgtcctccctttcttcaggttctataggggagctcagggc

SEQ ID NO: 39612 - DNA, 323 bp, Triticum aestivum
  Clone ID: PAT_TA_39612
taccggtccttcattcacgggttcgaccgtgtatataaagggatgacccggcggcggcttagggcaagaaacaacagattgagagccaggcaaagcgtatttgctccctggtaatcgaaaccctagcaataccacctcaaactggactaggccttcaccttcaccgcaaggggccgaaccaatataaactcctcgtgtcctttgtcccgtttaacccctttaagctaacctcgttgtaatggctccacaactaagtccttccatgaggacatctgccgtgacacttccacggcaacttcaatgcacatgttatgaaacaattg

SEQ ID NO: 39613 - DNA, 218 bp, Triticum aestivum
  Clone ID: PAT_TA_39613
cctagggtttatggaatattggggtatttatagagcaaatacgcggtgctggacgcacctatgtgggcataacccacctgtgcgcgcctcggcccccaggtgcgccctggtggttcctgcgggccttggggcatccctctcttccctcttcagggcatcttgtgtcttctggtccactatctaaccacacctagttttgctgcttttcgactcccttt

SEQ ID NO: 39614 - DNA, 199 bp, Triticum aestivum
  Clone ID: PAT_TA_39614
ggtggtggtagtgccattttcctattatacataagcattgattggatagagttaattaaacatcaatatttgttctaacgcaagcattcatcagatagagacaaaacatcggatagagggaaacataaatcgtccagaataagaatatctttctggctaagcttacttacgaatgttgttgattaaaacattatacatg

SEQ ID NO: 39615 - DNA, 157 bp, Triticum aestivum
  Clone ID: PAT_TA_39615
gattgggccggggatttttctcatggtacaacgtaatcaccttaatttgctatatattcattcatcacttaacgcaatccctccgtcactgttaatcaatagggggggatcgctgttgcatcatttttgttctagcttattcttgactgtttcattc

SEQ ID NO: 39616 - DNA, 187 bp, Triticum aestivum
  Clone ID: PAT_TA_39616
tctacatctaaagacggtacacctttgcctctatcacattgcatcatcatttctaggttgctctgttacattttacaatttttcctactttacatctattcggggcttcagacctatactctactaaaatactatggtcaattctcttagttcatcacatcctactcaatctaatcctttcaatttt

SEQ ID NO: 39617 - DNA, 139 bp, Triticum aestivum
  Clone ID: PAT_TA_39617
ttccgtcctgggtgcccgtcctgtcgcctgggctgggggttttgttgttctttttggtctgtggcctctcggggcgtgtgtgtgtcctgtcctctggcgtgcggcgtgttttggctccttgctggtttccgcttgttgc

SEQ ID NO: 39618 - DNA, 169 bp, Triticum aestivum
  Clone ID: PAT_TA_39618
ccccatcatcactatgtcagtcctgtgcatcgttgccttcactaatatctacaatctctgtcacccacttgttgctgctcgattcttgggacggggatctgtcgatctcgaaaacattagtgtcgtctcatttacttacccctcttatacatatccttctggttttgtt

SEQ ID NO: 39619 - DNA, 203 bp, Triticum aestivum
  Clone ID: PAT_TA_39619
ctctcccgcttgctccgccgtggccccccgtgctgtcgtgctcctgcgtgcccttccgccgcgcgcgtcgtctgttttcttctcgcgggcgtgggcgctgcggctttggggtgggggcgctttctccgttgggtttgtcgtggcggccccttccctcgggtgcccgttgtttcttccgctctcgtccttgggtttcttttttc

SEQ ID NO: 39620 - DNA, 280 bp, Triticum aestivum
  Clone ID: PAT_TA_39620
tgtggcttttggctgcttctgcggcctgcggcctgccgtctggcgtgcggccgctggtcgtcgtgtgtcggctcgttccgttcgttgtttgggcttctcttcggggtgcgggtgtcggtcttgccgctgttctgtggggtttctgcgcccttctttcgggtgctttcgtggcgcgtctgtcgctgtgctgctgcgtgttctgtgtgctcttgttcctggctgtcttgtggtctcctgtttgctggtttggcgcgttttcttctgtctgtgtgctgctcgg

SEQ ID NO: 39621 - DNA, 325 bp, Triticum aestivum
  Clone ID: PAT_TA_39621
tcacggggtcacgacggactgaacactgcccctcctcaccttcatgagcggacgggggtacatccggctctgtaaccatcggtgatgatagaaatccactgttttttgaacggagagataaactgttactaccccggggcttttttagatcttggagacgataagagtgtgtgaatagagcaaccctagcaagcaagcgcggatgctccgggctatatatacataatggggtagttttcctttttcactccatcaaaacaaatcgtttacaattgtgtactactacatgccacgtccgtggtttttttagatgttgattgctttt

SEQ ID NO: 39622 - DNA, 275 bp, Triticum aestivum
  Clone ID: PAT_TA_39622
gacgaagcgccaacggcgacttcgtaaatttaaagatgatatgccggctcagtctttcggaggtgctcatagaaggaagggtttccttgtgtgcatccaaaaaggtgagtgtatgcgtgtgtgcattcatagaggtgagtgtatgcgtgtgtatataaccccttgtgtctgtactaatgttaaaaaaaaagtttctgaaaagtaagaaataaacaaagagtagtatattgtgtacatatgagccggacacaccagcgagggctcccaaagccaac

SEQ ID NO: 39623 - DNA, 261 bp, Triticum aestivum
  Clone ID: PAT_TA_39623
acgcctccggcctatctccatggtatctcggctacctgtttccaaggatgagctctaagctataacattacgcacagttcgctccagccctcgctcgagtggcagctcgtttcatagtcccggagggcctagcaaccttacatcattaccacgtggggctttcaatctgctgacttttcctctcccagcagtgagggcgagaggattcttaagccttgtggaatattgtgatgtattggatggaacactggagtgtcactt

SEQ ID NO: 39624 - DNA, 215 bp, Triticum aestivum
  Clone ID: PAT_TA_39624
gcgtccggaactaggcagcccagtatggggtcctggctctgccctcctcattctggtcctcctgcgtatactaagtgtgcagatctggcataagttttatctctgggatctccagcactgcgcgacggatttgactgggaagacagcaatggtgactggggccaacagtggcattgggaacgctgtgtcccaggagctggcccagcgcggggccc

SEQ ID NO: 39625 - DNA, 200 bp, Triticum aestivum
  Clone ID: PAT_TA_39625
aacagacaagtacgaatctcaagatgattcctcataacacgaatcagtacgtacttcgtacatcaagttccctaggtgtcaagaaattccattctgggaggcaagttcgtcaatcaaatttgtttagaagtccaacacaattagaccatctaaacaagccgcacagttggctcaaatactaatgttctagtaccagaatt

SEQ ID NO: 39626 - DNA, 378 bp, Triticum aestivum
  Clone ID: PAT_TA_39626
tgcccagcttcctggtggatctcatggtgtactggacaaaccccaggcctgcgaaggccctgtaacccaagactggggtgcattgtagggggtagttgcgtacagaatggggataggatgcatcgggggacggaaatatagtggagaatggagttttcatgtcaccaggacacctttccatctcactcccatctcctccccagtctccttttgggacattacgtacgactcgaggatacaaggaaaaaccatgttttgtactgagaaactgagatcagtagctcctacctggtgtcctgttccttcagtcagcctctcaaggctctgagccctaatgccctcctgcaaccctgaggaatccatacttaaggggacggt

SEQ ID NO: 39627 - DNA, 444 bp, Triticum aestivum
  unsure (1)..(444): unsure at all n locations
  Clone ID: PAT_TA_39627
ttcccgggtccacatgctcccgtgnagaggtgtctgtaggatgatgagttcgcctgcttaacactcaccacaggatacgaacggaatcatctcacactgtgaacgagatgcatgctgatccttcacagtcgcgactctctccatgtgaggtagaacgagcaccatgcatgttcatacaaaggcttcctgtcatactagtagcccgtggacgtggacgaatgtaccttgcagctcagctcactctaggaggaccccccggccgggtgccatcacctgtgccacaactacatcggcggctatttctgctcctgccgtccaggctatgagctccagccggatgggcgttcctgccaggccgaatgcagcagcgatctgttcacggagccctcatgctacatctccagcttggagtacccccggccctaaccccctgacctgccctgc

SEQ ID NO: 39628 - DNA, 375 bp, Triticum aestivum
  Clone ID: PAT_TA_39628
attcgcgggtcgacttccaacaaagcgatatccatcatctcatcgatagacgggacaccctcgcctctatcacgtggtatcagatttccaggttgctcggtgagattttacagttttttagtactttagatcgagtccgttcttcataccgatagtccacgaggatgtcatgtagcgaagtttatggttagttcaccatcgcagaagcacgctgagctttgcttgatctatccagggttgtgctttgtgcaccttgaggttgcagcatcctgtctacttgcaggtcttacagtcgaatctctaacatcttcgagtactgcttgtaagttaccacgcagctggagcaccatcatctacgaggcttccatagactct

SEQ ID NO: 39629 - DNA, 421 bp, Triticum aestivum
  unsure (1)..(421): unsure at all n locations
  Clone ID: PAT_TA_39629
tatctccatgaagtccgtgatttcttcctcatggccaaggaagtctgcgcgtgccttctcctccagttccagttcgcggaacaaaagcttccggtgtgtcttcgagttacggcgagtctgaatctctcgtttcctgagaagacactccaagtcctggatgtacgagagagtggaatcgtcctcaatggtacggatgatatctccattccttgccctgcgagaaaccatggcgaggtctgagtgatcgagctcggccctgtactcctctcggagatgtccaagtgctcgatagatcgccacgtcccttccgatgatccagttgaactcggtgaactcaaagttgataggctccgtgtgtcctccaaaggttctccctgggatatgcacttcaatcctgtancgggtgtccgtcggaagtgca

SEQ ID NO: 39630 - DNA, 413 bp, Triticum aestivum
  Clone ID: PAT_TA_39630
ttctgctattctccctcgtcatgtttgagatagcgccagccagaacagggacatgactggattattttgcgtcagcaggtcctaaactcttcattctgaaacagtgcaagatcaactgcatcttatctgatagtagcaggttacggaaatacatacatggaattgacctgaaactttccaggacagtgtacggtgggtccttgggtgtctctaccatgttcctagtcaatagttgcaaagatcgtgtggaagctagagaagatctcgaagctcgtcgatcagcccccacacaggaggcagcggggctttttcccttctcccataggacgaaaagcggttcttcttctctgaaaaagagagacaaacctaggccctgaaggatcgcatcccgatctagccttgtcgcctccgcg

SEQ ID NO: 39631 - DNA, 352 bp, Triticum aestivum
  Clone ID: PAT_TA_39631
acggtactacattcccgggtccacgctgtgagtcgaagttctgttgcacaggcggtgaagcctgcttctgagttatgacctctgtcggacgtttatccaagacagggttacagtgtgtataggcccgagtgggcaggagtcattcggtgctagttgaccttcgtcgacgtgcagtcgaagttccatcacgacacctgcaattacgatacctagcacgccttcgtcgttcatgactaggactaccacacctggtatgctgccggattcctgagcttttacccgtgcagtactgttcctgactcttctgtgtatatgaacgtgaccaccattctggactgggttcggaacatca

SEQ ID NO: 39632 - DNA, 410 bp, Triticum aestivum
  Clone ID: PAT_TA_39632
cactggaaaactagcaaatcgcattttgtcaggtgaatttgatataggaaaagtttcttaaaagcatgcaaaaatatcatagaatggtgatctttttttttaaaaccctccgttctagtcattttcaatcatggcagtacaacagacaccataaatacgtattacatccagatccgtagaccatctagcgacgattacaagcactgaagcgagccgaaggcgcgccgtcgtcatcgcccctccatcgccggagtcgggcacaatttgtagtcctggacagttgggaagtcgctgtgttacgacaccatagagacagcgcattacaagagcatctgccgccgatgagcaatggcaggccgatctacctcgaagacacattcagctcgacgagacacgaccatcagagctac

SEQ ID NO: 39633 - DNA, 414 bp, Triticum aestivum
  Clone ID: PAT_TA_39633
gcgtctggaggctcttgttgtctgggttctgctccagggtccactgcctcgcagagaaggtgaccccataagaacagcacagagggacgtctgtggatggccactcattagcctccagcaggggggacttcgccttcagcctctacaagcacttggctttgaatgaccccagtaagaatgtcatcttctcacctctgagcatctccatagccttggccttcctgtccctgagggctcatgaccacactgtgacagagatcctggaaggtctcaagttcaacctcacagagaccgccgagacagaaatcgaccagggcttccagcagctcctgcagacgttcaatcagcccagcaatcagctgcagctgagcgtgggcatcgccatgtttgtgtcagatgagctgaagctgctgg

SEQ ID NO: 39634 - DNA, 413 bp, Triticum aestivum
  Clone ID: PAT_TA_39634
cactcctcacaagtaactgatacagacttcagtcaggatctcatagccaggatatgctccacatctgataagttttctcacgattagttagggtatcatgctcagatgtgcaccgtcttatttgtggctggaactctcgtgatttatgctgtctggcatgctcttattgttgttttatgtccagcttctgaaccgcatggactgtcagtgagatcattaattgaggctttacacccttccagtcattcggcacctccactgagagtaacgttgtagtccagctgatgatgggagtgatttgcctgtgattgttattggccagcatatgtctgttgtaccgaccgtagtcacggaggatgactgcgaagataccgtgtgatcaggtccgacccgttggtcgccataggatgggg

SEQ ID NO: 39635 - DNA, 217 bp, Triticum aestivum
  Clone ID: PAT_TA_39635
gacctcaaggaagaaaagaagaagatatcggctgctgtcaagaaaatgtatgatattcaggctaagaatgttaagatcctcatcaggcctgatggcacgaagaaggcgtatctgaagcatgacaccagcctacgatgctcatgacttggcatcaccgttggggatcatcttaccctgagggagggtcctgtcatatctgcttgagctcgtggtgaca

SEQ ID NO: 39636 - DNA, 455 bp, Triticum aestivum
  Clone ID: PAT_TA_39636
ctcgcgggtcgacgctcttctggaaagagactcatatcagtaagacaacccaagaatggcgagatgctcttatccgtgcacgggtcacctcttggaatgtacaaagaggaaaatctggcagctattaccgaatctggaaacggaagcgaagagccgcctcacgatgccagtggccatcaatagtagtagtagagcttaaccggccctcaacataaaaggctaggaatttgatgctgcatcttctcttcaggccgaagctgggacaccaatcgaagctccaaccaccaattcagtgtgcttgcagcagcatctcgagtcccagcgtcagctgagagtctccgacaagatgcagtgcgtgtgtaggctatcatgtttgatataagatcttatcatgtttgatgtgttgcaagtgcaagcatctgagtcatgtttttgtttgctataaatcataccat

SEQ ID NO: 39637 - DNA, 438 bp, Triticum aestivum
  Clone ID: PAT_TA_39637
actacactcgagaaaatctcgtctttcctggagccaccaccgatggacgtgcgaacgagttccagcaccccactgataggcccagggcccccctgcatcttctccaccgccgcccaccggtgcggggtcggtggcctaccggctgcagtgatcagcatcccaaccctgctctcctcgtcgtctctcctgatcatcagcttcatcttatggaaaacttgccgccggttgtcccgggtcacccatccccgcctgccatccacatgaggggcccaggaatctgaattgtggaatgtgacacccacaaatggcgctgagttatattaatgcctgcgaacctctgctgctgaggcccctggagctaccctgctcctttcaaagacccattcatcaataatccttttgattctgaaagtccttgcaatcaagtccccagacttt

SEQ ID NO: 39638 - DNA, 162 bp, Triticum aestivum
  Clone ID: PAT_TA_39638
ttccagggtcgacagaacaggtgtattggccacgccgtcctatgattcaggactgctgaaattattgacgctggatgtagtcgctcttctgacattcatctctgtaatgtgatccgtggacgaagcatttcatcttagtttttttcgcaatgagtcgatgac

SEQ ID NO: 39639 - DNA, 439 bp, Triticum aestivum
  Clone ID: PAT_TA_39639
tccacaagccgatcctaaacactgactccggcataggtattcctatgctctgctctgctctctctctctctctctaatgccactgggccgtgttactgtccactcgacgtataactgatgcttcaaatgttaggcatgatataagtaaatcctgtttcctttgaagagatagattttcacatgaaggatggcattacggcagtaggaacactctcttgtgttgtttgatgtaacatgtcgggtttccactggcattatacatatttggggctggcgagcaaatttatggtgaacaatttttgtatacacctttacccagctagcaaaaaaataatcttttccatttagtattcctatgtcaacacaaccatgagtgtaacttcttttggaaatgatgttatttactacaatgctaccctcccatctcctcggattgggg

SEQ ID NO: 39640 - DNA, 413 bp, Triticum aestivum
  Clone ID: PAT_TA_39640
ccgtaatcgtgaacgtcaacggcgcaacgactcgaaacgcgtctcccgctggactcgctccacgtacgccatctcgtctcgtttatcatcgtctcgccgcgtaccggtttgccccaacgaacgtccctctctccaccaatccaatattcgaaaccgctcgagaaagaaagcaccatgcaagatcgagatagcctctgtccttgcttgagccaacgtacggagccgcgtaaggaggaaggaactgcgaaactgtagtatctgccttcctaatgggcccagcaggtctcccatccgatctgcccatataagttgagcacccgagccttttcggcccatcgtcgtcgcctgtcccagttcccctgttcaatactgcgaaactgttgtatgcagtgctgtgcccgttgtacatctac

SEQ ID NO: 39641 - DNA, 423 bp, Triticum aestivum
  Clone ID: PAT_TA_39641
atggatcgatgagcaggacgcgatccctgacgctgatgggtgacccagatggtgagagagaggccgagtggagaagagatgtcgggaaataatacatgaatagatacctccgcccaccgtcatcataggtcctcctcctccttcgctgttgtagttcatgatcaccgtgtccgccatatgaggtctgttacctcgttgccttaatggtctccactgaaggggacatagatgtgtagcaaattgataaggtggaaggagcagaggaattttccatggaaagacaacgaaggagcggagtgtagcggcggcggtgtgtaacaggggaaacaaaggaagcagtgatgtgggagaacttcacgcttccattttggttaggtcacgtaataaaggactaatgggcctaagtgggctgctatgtttttt

SEQ ID NO: 39642 - DNA, 416 bp, Triticum aestivum
  Clone ID: PAT_TA_39642
tccacgtacctcgctcaacattgaatgactttggttctgtccaaacatgagctgtatgaaaatgacataacacagaagaatcatgcctaagtaaaaagatatatgaaagaactaaaacgtaagcgcatcatgtatagggagtacgaagaaaaaagatgaaaatgttaaaaaaagaacaaagcaaaatgagtgattatagggtgtggtcatttacgctttcaactccttcatgtgcttgctgctggccctcgcatttccaaaccgcttgatgatgtcgtacagctgggtctgttccttagtggccctgaattcgggctcgtagtcttccgcgggaggtgcgtgaactaccctctgctgtctcacagaaccaagggtcgcgcttctgatggtatcctcagttgccgtctccgcagtca

SEQ ID NO: 39643 - DNA, 384 bp, Triticum aestivum
  Clone ID: PAT_TA_39643
tcgacagtgcggcctaaattcactcctattaaggctgtcttcttcgggtctgttgggtggacctgaaatttgaccgtttcttctgctggcttgaaagaagtagatttgggtcatttgtccaggataacatcgtctctatccaccctggagcgtagtgcggttagttcttcagccgcaagggccttagataatgcctcgagggccaaggatgcggttttgttctcggtgcggagtgctatgtccggatcgctgacgagggtgattattccattaggcccgggcatttttagctacatatacccataatgaggtatggcttgaaagcgcatgaaggcctctcgccctaacagggcatggtatcccaaaaaaaagggagagcggggg

SEQ ID NO: 39644 - DNA, 435 bp, Triticum aestivum
  Clone ID: PAT_TA_39644
ctcgcctagggtatctggaaaattggggtatttatagagcaaagaggcggttcggggggcacccgaggtgggcacaacccaccagggcgcgcctgggcctcctagcgtgcctggtgggttgtgctcccatcggagcaccccccatgtgttgccttggcccattgggtgtcttctggtccataaaaaatctccgtgaagtttgttgcatttggactccgtttggtattgatttcctgcgatgtaaaaaacatgcagaaaacagtaactggcacttggcactatgttaataggttagtaccaaaaatgatataaaatgactataaatgattataaaacatccaagattgatagtataacaacatggaacaatcaaaaattatagactcgttggggacgtatcagcatccccaagcttaactcctggtcgtcctcgag

SEQ ID NO: 39645 - DNA, 414 bp, Triticum aestivum
  Clone ID: PAT_TA_39645
aaacatctagcatattgctcggcataaagtcatagttgtaactatatggggcaacgtgaggacaaagatgccatgtcatagtcaagtcagttctgttggtgcgaggcatgcttatttcttagtcgagactcgttgctgaagttggagctgattggtccttggcgtgtttggccgattgtttggtattagtcggcagggtttttgtgcgttggacgtgcatggtaaagtcagagtcgcttgctcgtgagaagtggtgacgatggcactttgtagacaacctcaatggtgttacttgtttcatcaatgtctgtggggtcttatggataggtaggtcaactgcagtgcattatcgtgcgggtgtgttggaatagtcttcgcatgtattccatatattaaaatgcaactctgttctag

SEQ ID NO: 39646 - DNA, 423 bp, Triticum aestivum
  Clone ID: PAT_TA_39646
tgcaccagataagtgtattccgtgccctcttttttttcttaggtcatcgtgtgtgcctagtccccgtgccagatttgaataacgttgactaagggagcttgatttgtacaggttcaagcctccactccgacgaccaaatcacccggatcccgcgtcatcttccactccggcggtggctcaactcaagtttgcagaacaccggatctgcccagggcaaggccctcgtccacgaatttggccgggtaaaatcattttcttcattgtttcggtcgggtgaggctggatcacacgtcaattacttgtgcttttctcctggttgatcatctgttccagatttgcacttcttttttggtgatttttagtttgttccatctattcctttgagaccggtgatccaactgtatggcttaatcgagatgcata

SEQ ID NO: 39647 - DNA, 432 bp, Triticum aestivum
  Clone ID: PAT_TA_39647
cgggtcgacaaaaatatgcaatagacgataatacattggtaaaaagcagcgctaatttttaagaactaaccacagcgccagatatgaataccttttcaaaaaaatgaacacttttcttgcaaagtgtaaagaaataattaaaaggcaagtattttttgaaagtctgaacattttgtgctagatgtgagcaaattccgaaattttaaacttttctgaaatgcgatttgtcaaaaatgttaacatcttttggagttctgaatttttttttaaaagtgtgaacttaacaacatgaacaaatattgaaatttcaaacttcttcccaaaatggcgaacaatttttgtagaaagtgaccattttttgaaactgtgaatttcttgaaaattctgaactttccgttcaaataatgaaaaatccaaaaaattctgaacaaa

SEQ ID NO: 39648 - DNA, 421 bp, Triticum aestivum
  Clone ID: PAT_TA_39648
tgtggacagcgaaaaacagtcttggaatgctctgtggaaagtgaaagttcctccaaagctgaaagttttcctgtggaggctggcccaacaatcgataccaacagttgatctgttgcaccatcgcaatatgtcaacaactacacgttgtggactctgtggagccgaggactcatggcaacattcgctattacactgtacggtagctaggtgtgtatgggctcttcatgatcaagatctagtggaagctctaaataacaccaaggagccggatgctaaacgttggctgtttgcgatccaggacatgctatctcctgaagagttcatcttggtagtcaccactttgtgggaactctggtttgcgcggcgacaggtactacatgaaaatattttccagagtcctctatcaactttacacttcatc

SEQ ID NO: 39649 - DNA, 437 bp, Triticum aestivum
  Clone ID: PAT_TA_39649
ttcgacattacactctagaatgactcgtatcaccacccatggagcttcctcctttccgtcttcaggtgagttcgccccctcctctctctgctcttgttcgtggccattgaggcattgttcttggttaggatttaccactgtttgggctcaattggctactgtttgaggtcaattttgtgtatactattaagtgttgattgtttcttgaattgaacagcaaggttagacatgaatttgttagtagaatagatccctgaccgaactgcaattgttagttgaattgtccaatcttgaatttagggagctgctactgaaaggtttttttcattttgtatgtcatgggttggccatcaattttattaaacagcaaggttaaccacgatcacacgaagccgaaggtgcacgatgaagaaaccgtacgtgcatactctatccat

SEQ ID NO: 39650 - DNA, 440 bp, Triticum aestivum
  Clone ID: PAT_TA_39650
ggtcgacagcacacactatgacccaatcttaatcagaaaattactcatatatccaacatatcgtccatcactcatgtcgagcccaaatgtggcaccgcatcatgtccatggctacttggcccgggtcggtgcgggcgagggagcctgccgacgtcggtggaggcttaaaaccttgcagtcaccctcgccataatagccgatgtccgaagcagagtgaccatagttgggaggcgcctggatggcatcagcttcaccaattatgttctcctcaacatgctctagctccaaactagcaccaacacccatagaaacctgaatggcagccatgtaacatagaaactgtatggatctcgatgacataggcaaatggaatccaaatgtaaaattcattttaaaatatgaatattgtggaaaatgtacacatgtctgagaaacaacgt

SEQ ID NO: 39651 - DNA, 428 bp, Triticum aestivum
  Clone ID: PAT_TA_39651
aggaccggatgacttcacttggaaattgacggaatcaggcgtgttctccacaagatcggcataccacatgcagttcttggggtccacgagatcacccctcatggcggcggtgtggaaggcatgggcgccggcaaagatcaagtttttcgcttggcttcttgccattaacaggctcctcacagcggacaggctgatggcgaggcaatggccaaactgctacttttgccctctctgcatgcgcagcctagagaccaacgtgcatctgttccaagagtgtccatgggctcaacgtctatgggcgacgggggctgaccgttttcagttaccctcatgccacccagataactggagcataacgactgacacaaccgagtggctcttgggtttgacgaccaacgcagcacacgccaagaaaggcgaggtccatc

SEQ ID NO: 39652 - DNA, 439 bp, Triticum aestivum
  Clone ID: PAT_TA_39652
ctcgcgggtcgacgacatgctgtacatcgagtcatgggacaggaacaggagcctcctcatcggctatgcatgtctcttccagagacactgaattcaccggcgcggcgcctccactggaggcagagttattgatgcctttctggctgctgccgtctgaaaaccccattatgcttctagccttacgctcaacccacttcaggctcaccctgataaaatttgtaagatcaactcggtacctcttggcatcagttgagctgccaccgcaggagattccatctccctcctcaccgcgttgctgcaggcttagcttctctgcaactggttttgcaggttcatcagggcccttgttctttctagcctgcagtctgttttcctcggaagaatcacccagcaaggcccttggtctcttccgtggaggagcagattttgcagattcatg

SEQ ID NO: 39653 - DNA, 424 bp, Triticum aestivum
  Clone ID: PAT_TA_39653
tacgtcacgggagcgctggaacatggagttgaaggcttttcagccggtcacatcgtgcgtccgagcacttggctttctcaagagaacagcataaatgctgtgtaatgctgtcagtcgtgcgacaggatagaagcccatgtgaccgtggaagctacatcataactctccaattcagtcacctatatccaaatcactgaccatcatttcagatcatctcgccggtgaatcacccgaagatatacaccgaaagcaccatacgctaaaaccacctatcgacacattgcgtcctaacaaataagctagcagctatagctattcctatcaattcgcagccgtataatgccatgggacactccctgtctcagtcaattactcgccgcatgtgtagtgagaacacgcaacattacagccacacattccagca

SEQ ID NO: 39654 - DNA, 431 bp, Triticum aestivum
  Clone ID: PAT_TA_39654
acaggtacagaactcgcgggtcgacattcgggtgtatggtgtgcctaaggagggttagcaactgtagggagctcctatcgtcttgtctattattaagtgctgtaagcgtcagttcgcgccgctgggcttgaactcctggcgtcgcacaagcgttaaccactggaccaagctcagtttgttgattacttgaggaaaacagagcgctttgacctttcattcggtacaaacactagacatatgctagtattatatatccaccatagattatttgaataaagaaaacataaatttgaaaaagcattcacatataccatgaattgaacagaaaagtttgcaaaaaatggaaaaaaattcaagaaccccaatagaattcaatcaaatttgacaagagttcaccaaatttgagaaactttcatctaagttttacaaag

SEQ ID NO: 39655 - DNA, 422 bp, Triticum aestivum
  unsure (1)..(422): unsure at all n locations
  Clone ID: PAT_TA_39655
tcaagcccccctagtgcgaacaatatcatcaccgtcagcattgtacgttgtcagcttgtatatcctcgtcttcttcatctgagacttccatgtagtcattctcaccctcagatccttcagcttcggcaccatttcgaattgaatcacacagaaaaactgcccttggggaaggctggtccaagtagaagagaactagctgacccttccccaacttgttgtctgcaacaaatttcctccatccactaccatacattgcgctctttgtgggccccttgtgacacttaacggtgtattttcgtttgtttgccttaaacttcagtgtatcccctgtcaagtcgttgaaaccaactctttcgttgaatggcacaacctgttatgtgttgaacacacaananagaacaacaacatgaacaatcatcaaa

SEQ ID NO: 39656 - DNA, 422 bp, Triticum aestivum
  Clone ID: PAT_TA_39656
atgacaagccaaaaaccttagaatggcaggatgatggaaaccctgtagaggcacctgttgtcaatcgtaggttatgcggtgagattcaacccagactcatttcctgcaggaggaaccagtaattgttgaccatcatgagattttcgatagttgtttagcattggcgacagcctgacagctaagaagacccagattcaaaggagcttatttgatgcaaagagtcctgagtttgtggaaaaggtgatgcgcttatcacaagagcactagtgtaagagtttacccacagaatatgagaagactgggaccgtcaaaccaattgatgggtgtatgagttttgttggaagtgttaccatgcttctgagggtggtagcaccccataccttgtgtggatgaatggattttcaaagagagcctccaaacct

SEQ ID NO: 39657 - DNA, 221 bp, Triticum aestivum
  Clone ID: PAT_TA_39657
acaggaccgagactcgcgggtcgacacagaaccataaacttctgctcaataacattttagtactcacactttttgctgatgacttcagatctgaacctaacggtaaaagtgccgaccttaaaatgaaccgccaaatgcctaaaccaaaataagaacaactgggaagccagtccgttgccacaaggggctttaaaccaatttttaagacaccttcaacaacc

SEQ ID NO: 39658 - DNA, 415 bp, Triticum aestivum
  unsure (1)..(415): unsure at all n locations
  Clone ID: PAT_TA_39658
gggtcgccagaatcccgcaaaatcagtcggagaaacctcgacacgccctccaacgatggtagaagcactatcggaacggggtagaacgtgggaaacattattcctactaagggatgtcgccgccgccacacagtcccaaccaaaacgctgaacctaacaagaacgagaacaaggtccctcccgctggcgtggggccgagatcctccacacctccacggcctataggccatcaaagatgtggcaaactggcggcggcgccgatgggaggagaagtgtttttcttgtcaaggaaaaaaatggcataaaagctccaatttgacacatgtatctgcactacttaatcattcatagttgttgggcctacaaataagaggtanggctgacattttgcaaaactgccctatagtaacccggg

SEQ ID NO: 39659 - DNA, 426 bp, Triticum aestivum
  Clone ID: PAT_TA_39659
ttcctccgccattggcggcgatgtatgcggtcatcgacggatgtgtgaacaccatgtgtcgcacgtccatcctctctttcttctcctatcgacatctactcccgcggggcataccgcttgcactcccggcgaatctacaatgtcatcgacaacgtccaagccaagcccaaacatgcacagtacttcaacaaccacatcgacgccgctcaaggccgacgaggcaagacggctagacgggcgtggctggagcaaaggccacgttttcgacggcgcgtgtaccactccgtacacggactctgccgccgccacacacacacaccaccaccatgcatgaggaacgcgaagcaaagaccgaagatgacgactacgcagcttaatcggatgtgtcccgcggtgctatctgcgggagtaattaaccgggggctt

SEQ ID NO: 39660 - DNA, 187 bp, Triticum aestivum
  Clone ID: PAT_TA_39660
gacaagacagtgtgcaaaatgctttggatcctttaaatgatacatgataatatttttccaatatggactttcggaaagattgacgttttgtgggatgggacatccatttcggagctgccaggttgtttccaataattgcaactgtataacttgtagcataacataatcgttgcatagaaatatcaac

SEQ ID NO: 39661 - DNA, 99 bp, Triticum aestivum
  Clone ID: PAT_TA_39661
cccggggccacattcctagccaaagttcagctatcttattttgttcgtgttacttttctggatggaggttatgagttgaaactaaatatttagtttaat

SEQ ID NO: 39662 - DNA, 99 bp, Triticum aestivum
  Clone ID: PAT_TA_39662
attcccgagtccacgcaggcgggacgacgacatcagcttgccgaggtgttagcgcggccaacctaaatagattgcctgcacgcacaacgtagtgcaacc

SEQ ID NO: 39663 - DNA, 408 bp, Triticum aestivum
  Clone ID: PAT_TA_39663
caccgacccacgatacgcatgtcatagcaggcgatgacctgacattaatgcagctgcaatgatgagggtggctgcaaacgagaaggcagaggctgataacattgtccagatcaaccgtgccgatggtgaagcaaaggccaagtacctgtcaggcctgggtaacgcacgccagcgccaggccattgtggatggccggacggacagcgtcctgcgcttctcagtcaatgtgcctggcaccactgcataggacgtgattgacatggtgctaatcacccagtactttgacactaagaaagacgttagcgcgtccaccaagtcctcggctgggttcatcccccatggccctggcgccgtgctcgacatctccacgcagatccgcgatcgtcttcttcatgggcagtctgcctc

SEQ ID NO: 39664 - DNA, 154 bp, Triticum aestivum
  Clone ID: PAT_TA_39664
ccgggtcgacagcgaagacgagggctcggcatcgtcaatgaaaatatgacacaccgcacatgtaacatttactgtacgattgaactgtgctttcttagacggagatcaatctttgtacagtgatgttagaatatcacttgaagtgaacatctca

SEQ ID NO: 39665 - DNA, 254 bp, Triticum aestivum
  Clone ID: PAT_TA_39665
cacaggtctaggactcgcgggtcgacgtaattcactaccagtgcactgcacatttacagaattgccactgtattattttggcaataactaaatatccacgcatccaaatagttcatgtcatataggtaaaatgttcagattttccagaactttcataatctgcaactttcatccatattgaaaatgtttaaatgtctgtttgcataaaggacatgctaaaatgctttatttcataactaaataaccgtagctcc

SEQ ID NO: 39666 - DNA, 417 bp, Triticum aestivum
  Clone ID: PAT_TA_39666
ggtcgacgctcgtcatgaaaggtggaagcaaatgcaagttcataccaaaagatcgttaacaacaataccaacttgcggacgacaaggtagtacaactaccaataccaaactactcctggccctagtgttcgtcgggtagaaaatcttgcagaggaccagttcccgctccttctcttgctccaggtccccgatgtggtactggtgtatcacccagttggtcctctgctggtcgaagttcttgttggtgtgcagcgccagaaccttttttgctgcccgtctgccggccgttgaccatcacaggcaaggtattgccggtcttgtgccacatcgcgtgcgtgccgcactccgactgtatctcgcgacacgtccacgtgccccttttgatcgccctggaagtgcgttggaagaaatgcttcc

SEQ ID NO: 39667 - DNA, 443 bp, Triticum aestivum
  Clone ID: PAT_TA_39667
actcgcgggtcgacagggaaccctatactgagtctcacgattttgttgtcatcgcacgcaacataagatggcaccgcatttgattcattcctttccggaaagatatatatagtttaagagatgcaacaaggagcggctagcactataaacttaagatatgatgatatatatggcacctcaccttggtgttttcgccaagaacaaagctgtgaggctggccggtgaccatggttgctacttccgcccacaacacacactttccgtcctgaacccatccaagatttttctcctcctcctgctgctgctgctgctgcgcttttgacagcaagtcgctcaccggcggcaaatccaggtgagcttgaaccatgctttcttctaagtgcggatttcgtttcttcgtctgcgttccagccccatgcgcctttgtttttccgtgtgccgtt

SEQ ID NO: 39668 - DNA, 419 bp, Triticum aestivum
  Clone ID: PAT_TA_39668
tctcccgagtcgtccgcctgaatgagtcagtatttgtaatagagatgggacttctgaagctggaaaatgcctacaagtttcccaacctgcgctgccgggggtgggcgtgcagaaccaagcttccatccaacacagctttgcgagggtttggctttccccaggcagggctgatcaccgaagcctgtatcacagaagtggcagccaaatgtgggttgccccctgagaaggtccggatgatacacatgtacaaggaaattgatcaaacaccctacaaacaggagattaataccaagaacctgacccagtgttggaaagaatgcatggccacgtcttcctacaccctaaggaaagcagcggtggagaaattcaactcggagaattactggaagaagaaggggctggcaatggtccccctgaag

SEQ ID NO: 39669 - DNA, 416 bp, Triticum aestivum
  Clone ID: PAT_TA_39669
tttcactgtgaatatcaaactcatcatcgacttatagaacctgtgtacactcacaaacatatctgtcccttaacctataagtcttcaatacaccaaaattactaaggggcactaaatgcacttacactttcaccaccttcttaagtgtggagttgttgcctatctagtgaaccttcgtcatttgtttcactccatccctctggatgtatgcttcgtgtttcagctcgagagatgttttaatgactcaccccgtgagttgatcctgagttgtttgatcttcgaggagatcgatccttctagagttttccctttcctctcgttgtcatgttggttggagttctcggagcaagacatcgagacaaagatggtgatcgaatcaacgttcttatgaagtggacctggattgtgaagattgt

SEQ ID NO: 39670 - DNA, 348 bp, Triticum aestivum
  Clone ID: PAT_TA_39670
acacatggaggctgtcatgctcgctgcactcagtcaccttgtgactgtgtggatcactgggcggtgactagctgcaattcacgaaggcataacattggcactcagttggacagaattggaccttgtggtagagagcgattgtgcggatgcgctacatttgatctctgctgtggggaaagatcggtcagctcacactcataaagtcatggagattagatccctgctagctcaagaaagaaggatccagttacagaagattaagcctagtgtaaatctcgctagccacactctcgcccatttgggacgtactcaacagcggactgctgtttagctgcgtaaccctcccga

SEQ ID NO: 39671 - DNA, 433 bp, Triticum aestivum
  Clone ID: PAT_TA_39671
tcgacctacatgaaggaaaatgaggaacactatcctggagtgcaagacagttttgttgcttgtggagttgcagattttgttgggcagaagctcaccaactaaaatgatgaactcattatacaattctactccatggcacacttctatccagatggtaggatagtttggatgtctgaaggaacgagataccagtcaaccatagaggaatgggcgagtctgatcaatgccccagaggagagtgaagatgacttggacatttatgccaagaagaaaatggatcataactcaatgtcacacatgtacaaggagatccctgatgaagcacttgagattttcaagtttggatcagttcattttcttctgtcagggctgcctacaatcaactaggtcttaaggcacactcctttgcccaaatcaggtgatcacaacatga

SEQ ID NO: 39672 - DNA, 422 bp, Triticum aestivum
  Clone ID: PAT_TA_39672
aaatggatgcaggacagggcatttgggacgcgtgcgattggtgagctcaacctagagtttgtagatgaactccctgtactggcattggatgttgtggccatcatcggtggcattgtgtatttgtctatcttccagccatcgcttccaagtgcttcaggctggttcctatccttctgcattgagacaaaggagctgaagaaggtctgccctatcactcgctctgaaacttcctacccctacgtaatggcgtggcctcctgttctggtaggcaataaggtgaactctctcggctagaaggtgctcaactagtaagaggaagaagaacactagaactagaagtcggtcattttgtctgtactctgtatattaccttttgttatcagatgatggtatgttgctatggttctatgcatgttttcttg

SEQ ID NO: 39673 - DNA, 444 bp, Triticum aestivum
  Clone ID: PAT_TA_39673
ttcaagggtcgacagagttctacaacttcaactctcagcggccgagcacccgctattgggtatttggccccgtcaaatttgaggtgttcttgcctgaccttaacacttggtttctgtatgatacatcagtgctctttgaggcaaaagtttctcgaccacacatgtttatagatggagcattgtatgtgcacacaggtttgcatgacattctggtcctggaggaaactagttctggcattccgccgtctcttcggactattaagttgccgcatgaagatggtgcctttatgggtaggtttggccaatgttgctttggccaatcttcggggggcttgcactatgcattgccagaggaggatgctcgtacgattcttgtttggagtcttgatgttgatgagccttatgagtggagcctcaagtaacgcctcaatatgagccaagcat

SEQ ID NO: 39674 - DNA, 423 bp, Triticum aestivum
  Clone ID: PAT_TA_39674
ttcgcctctcgcatgtgcaagatgatggcccgctccatccacgagttcaccgctgtcaagaagcacacggacgaccttgccatacccctccagcccgcgcgcccaggctcctcgttgcctaccaccctcaacggcctccaaggtgaagaactctttgaagcactggaggccctgcagctgccggaggtcacgatgaagaatgtgcacctcgaggccgtgctcgctgtgcagcgcctcgtcgtgcaagaaaccgttgacctgcacatccacgtctacgaggaaatcgtccacatagaccactacaaggccagcgaagatagaaagacgttggccttcttccaccggctggaatctttggacgaaattgttcgaaagcacattgacctggccacgaaagccgctgctacttacccgctgttcggc

SEQ ID NO: 39675 - DNA, 432 bp, Triticum aestivum
  Clone ID: PAT_TA_39675
acccaagcccaacattcgaagagttgtgtgtccagggtgtgcttgcaaccaagacaacaaaagagagatgggcttcgcagttgcatgtcggaatgcagttgtaattgggacaaaaaagatcaagccctccggttctgtctaaagagggtgtacttgtaattgagataaacatggatcgatctcggttgagtattaagtatggacttggccacgtagtagcttcgtttgcaccgttgtctaaaaaaaacttcatgtgcgccggtcaactgctgaaccaacaatcgttcatcaccagttgacttttaaaaataatggatctaaaaaatttgacaaattccaaaaaggttcatgattttgacaaaagattacgagtttgaacaaagttcatggaattcaaaaaaagttcctggattttcgaaaagagatcgcaaa

SEQ ID NO: 39676 - DNA, 443 bp, Triticum aestivum
  Clone ID: PAT_TA_39676
ggtcgacgctgtcgcgcgcgtccggtggtctgcagtacatgggacatactacccgcgattgggtaaagaagcaagcacgtaatagagcatatctcttgagcattctgtcggtaattattccctgtttgatgagatgagtttgcattgtgtctaaaaatgttggaaacagaagtttgccagagaagagtctgaagatgatgtcaagaaacttctggatttctttaagaaaatgcagaagataaacccagagttcttctatgattaagaagttgatgcagataaccgtgtaagaaatgtcttttgggtgaacacaagttgcaaaggatcgtatgaagattttggagactgcgttacatttgacacgatgtataaaactaacaaattccacatgccgctgggagtctttgtgggggtgaaccatcatctatagagcaccatatttg

SEQ ID NO: 39677 - DNA, 435 bp, Triticum aestivum
  Clone ID: PAT_TA_39677
aaacatccttatgaggcgaaaaaaacctggagagactctgacggagtagcaaaggtgcccaaacatcaacgtttatacctgacacaataggcaaacaaatgaatgaaacggtgcagtcgtttgaacctcaaaacgcagtcatttcagaatctcaagactgatgccttcgaccagctcaagaccagcggaaggagttggatcaaaaaagtgctctttagtttgtggtcggcatacaccaccatgtgcaggatcacacaaggaaatctgttggagcaaaaccttgccctagctcttcctcgagtctacctctccctctctgtgtcacctcactctagcataaactgattagagaaagaagaaagtgaagagttcttttgagaagtcgtttgggaatattttcggttctgctaaaggaagagagaatatcttcacctt

SEQ ID NO: 39678 - DNA, 415 bp, Triticum aestivum
  Clone ID: PAT_TA_39678
tccaatgaacatgtgctcctctttaattctcaccatcaaactatccttcccagacttcctacaggtatccatgtaccattcatgcaatctttgcatcatcgttgttagaggaggatgatcaagtttgacgagaggcttcccgtactcgtatctaaagatctctacctctaacatttcaaactgtacaagattgctcaggtaatcaccaagattggtaccgggcaatagccccggctgattagcgacgatatcctagacaccttgagcgggggacacaattgcttcacctgttcatcgagctggggaattgttttcccatttcttcgttctgctaatcttgcatcaatggaagtacttcccgatcgcttcgcatcttcatatgtctttttaatatagcgctcatagttggaattcg

SEQ ID NO: 39679 - DNA, 430 bp, Triticum aestivum
  Clone ID: PAT_TA_39679
tcccgggtcgacagatagtgttcattcttctctgaatggattcatggcatagagaagaagttcctggcgcaaggaaacggatggggatggcctccttcatcggggtcgaacaccggtgtcgatggagcaccatttctttgcaaagtgttttcgagagaacaaggaagggagaggctggagtttatgcggggtggaagaggaggtggaggtgcacaaaaaggaggggctgcagtttttggaaactgatgggatttatgggaaagagggatggctgtttctcttcgttaggtgtggctgtacgtttcttcgctgtgtgtctgtgtgtgtagagggagcggagggagcggtacagaaggaagaggaaggagaagatgcgctgggtgggaggaaaaggaagtggagagaaatagacgaaggaggaattaaagga

SEQ ID NO: 39680 - DNA, 433 bp, Triticum aestivum
  unsure (1)..(433): unsure at all n locations
  Clone ID: PAT_TA_39680
attttggtaaggtgtgtatacacgagataagtgtggcatgtctaccttgatgtgttgaaccttcccatcactaggccatccgagaatgacacattggtggagtgatggataaggctccgttcgtttcagaaagatgacaaaagagggttcaactcctagatggcatgcatagcttagtgatacgtccattttgcatcatgcttttatactgatatttattgcattatgggctgttattacacattatatcatagtacttatgcctattctctcttattttataaggtttacatgaagagggagaatgccggcagctggaattctggattggnaaaggagcaaatattagagacctattctgcacaactccaaaagtcncgacacttcacagagcttatatttggaatatataaaaaatattgggcgaagaaag

SEQ ID NO: 39681 - DNA, 429 bp, Triticum aestivum
  Clone ID: PAT_TA_39681
gggtcgacgaaggacatgaagacggcgaacgaggacgggggaatggtatagaagtcagcacgaacgaagagaattatttcaccccttcatgcgtcaccttaagtgcgacggagatcgatcaattcatcaagtgccttatgggaatcaaagtcaattccggttactgtgggaagataagcagatttctagacccccaagaataaaagcttcaactggatgaactcacatgactgtcacgtgatgatgacataagtactcctggttgccattagatggataatggagaagcacatccatgacatgcctaatggtctctgcaacatcttcgacattaactctcgatagtccataattgtgaagcagctccgaatgctatacgaagagatgagtgtcataatacgtgagcttgacatgtacgtactgcccgta

SEQ ID NO: 39682 - DNA, 315 bp, Triticum aestivum
  Clone ID: PAT_TA_39682
aagatcagtcaaaccgacgactatgcgagggatcacaagatcttcgactgaccccatcaccgtctagatacctcggttcaaggtcatccggcgcacacttcataggcaacgcaattacgtgaggatcgactgcaacatgttcacacccatggtgctgcacggattccacaagcacaaccattggttttgtcgcagcttgccacccatttttaccatgctgtgtatgaaacttggtgatcagtctctcatggagtgtatgtatgggctgcccttttacaaaatatcatatgcatgtttggttgatgactacctggg

SEQ ID NO: 39683 - DNA, 432 bp, Triticum aestivum
  Clone ID: PAT_TA_39683
gggtcgacgactacaccaaaagattccgaagatactcttcggtgttctcccaagaacatctgctcatcgcctttgcaattccctaccaccataatatccttatggataactacgacatacacttgccattcatacaatcattccccgttgatcttgttattacaagataccccgaatttctctctattgttccgagaatacttgtacctagtgccttgtagttccttgccacggaaatacccctatggacaattccttgcacttatcgagtattcgatcatcccccgttgatcgtgtgtttcacaaaagttttcgaaatatcattcggtcttccgaaaatcctgagcagcctatcgctcttgagattcttgcttgcttgcattatggttaatcccataagtctagtaatcttattggcaccctttgtcacta

SEQ ID NO: 39684 - DNA, 423 bp, Triticum aestivum
  Clone ID: PAT_TA_39684
actcaaataagtattgagtcgattgtcaactcccccatgaggcggctggggcggctcgtgcagggtggctgtgcgcaagtatcagggcagaggaactggttgtgcggggtggctgtgtgcaacgtttacgacacatcatcaacgttgtagatatagtgatagtgctcgccaggaaggtggctttggctgtttcatgtatctatttggtaaggctttgttagatagctacatataaaaacatatcaatcccacgcaccctctcaccactaggcaaaagaatttcaacatgtgatactagagcaccaatatagtacatgcaaccattgacctacaaaattttcacacataagtatgagttgattaatagataacacagaatcctaccacgaaaaacccaccacaacacggcattattaaataaaa

SEQ ID NO: 39685 - DNA, 422 bp, Triticum aestivum
  Clone ID: PAT_TA_39685
cattcgccggccgacttctcgctcaacagcccccttggtggtggccaacctggaagagtgaagcggaagaaccagaagaaggcctcaggtggtggtggtgatgacggcgaggaggaagactaaccgctcaccctcaacccgcaaacttccgttgcagaattgttgaaattgccttgtggttcttgcaacggaaattgatccaacctttggtccgtctctaagaaccttagtggtgtaaagctttcgttgcttcagaatcatttggcaatcgatcctaaatttaaccatatgtttgtgggtttcgcttggttagtgactaccgcacagaagatgtgaactcagtgacgccgcctcgttttgtgtaacccacatgtctcgtgatacctatttcacacgcctgtctcagatttatttcactctac

SEQ ID NO: 39686 - DNA, 396 bp, Triticum aestivum
  Clone ID: PAT_TA_39686
tgtaaaattttttaaatgagacgttggagtgatccacatacgcctgtcgattgcgtgtaagaacagtgagaaagaggcaatccgactgtatacgaccatcgagtcctacccctatgtatgcaagtttcatgtgaccgtccaaggttgcttggtaaaaggccacaatacatcgccccattcatcttcgcaacctctaaagcgcataagatggatcttgtgcgaacgccatgtgggacacttctcgggtgcataatatcgaccattccgccatcctcacaatggatcacatcattcaatttgtggacctttggaattgcatggcacagttccatcttcaaatggacgttgacgaccatatctcttaggtttgtggcaaatggagagtactccgtggcg

SEQ ID NO: 39687 - DNA, 428 bp, Triticum aestivum
  unsure (1)..(428): unsure at all n locations
  Clone ID: PAT_TA_39687
aactatgtcatcagccagggctaccaccatgatcccacttcaatcaaggacaatcatgtgccatgggatccaggtggtttaacatggcatcggcttgaggtcaagccgaattttaaggaaaggggaatgttagcgaccaacctactcttgcttgggctgggccatgggctgcgggttttgggctgcagtgaggcctcgaggaaactactacaagtacacacgaaggctctaagaagaactcggctaggaactggatggcttcggcctcctccgcattctgtctttctcttcctctcgtgttcctcttcttcctgtgttggtaaagcttgaggaatccatggctgtaatctccattgatgaggaatagagagtgtgttgctaacattattactanggaaaatgaagcaacggtgttaaaggatgggctg

SEQ ID NO: 39688 - DNA, 442 bp, Triticum aestivum
  Clone ID: PAT_TA_39688
gggtcgaccgctgaatatagatgggggaaggtgatgaagatgttggtgaagatgatggagttgttggagtagatcgctgtcacacaatgattaccccggcggtgttccgacgccaccaggagagagggggagagagcccccctccttcttcttccttggcctaccccctagatgggaggagagttccccctctggtccatggcgtccatggcggtggaggggcaggagccccttcgagattggatctccctctctcttcggttctatttcccgttccacagatctggccaaaaaccgtttcttaattatccggagattcgtaactccaattgcgctgagattttaacatgatttttttccagatataagtttccttgcgcccgaagtagatctccaacgaacgtacgaggagggcacaacccaccaccatgcgcctgggctg

SEQ ID NO: 39689 - DNA, 442 bp, Triticum aestivum
  unsure (1)..(442): unsure at all n locations
  Clone ID: PAT_TA_39689
ccgggtcgacactggctacaaagtgggtggtgggtgggctataaatttcttcgtcgtccgcgtcccaaccgtgttggccgtagtccggccagggctctcctgacaaagagaaagactttaacgaattcagggtgttgccgaaaggtgagtgctgaaagacatccgtggcggtgaactccatgaccggagcccaatcgggcttaaccgagagaggtgcgggatttacggagtccggcacctcggagtcacgggccttgcgagggactangctggtatccggctctatcgccgtagagattgcagtttccggggtggcgtctaaccatccgtcnccgattggcatagtgggctccgagctaatggtcggagcggacacctgagcgacgctctgggcgttgtccgatgacagagctaaatcgtgctcaacatgacagtgcggcgc

SEQ ID NO: 39690 - DNA, 413 bp, Triticum aestivum
  Clone ID: PAT_TA_39690
gggtcgacactgctccctaaagagagtcggggtacacagcccagacaacaccctatcctgcctcgcaggagcgccgagtcactcggtgaccaaaagatctactctcgcgaggttcggttcagtcttcgcagctcgagacatggcggaagagaatgccccaattgcagttgacgctcaggttgcgggacctatcacagttcttggagagcccatcgtcctgatgactgctctgcagcttgtgatgaacaggtcatgcgctcatgaccgtcttgtcaagggacttcgggaaactgcgagcgcgattgataagcatgctgctcacatatgtgtgcctgctgaggactgagaacagcctgaatagttgaagctggtgaaggcactgtgtgcagatcacaacgttcacatggtcactg

SEQ ID NO: 39691 - DNA, 425 bp, Triticum aestivum
  unsure (1)..(425): unsure at all n locations
  Clone ID: PAT_TA_39691
ccgggtcgactggcgcctcaagaacatctgagttgccacttgtagacaactttgaatgaaggcgttcgattgggtccctaatgatatgcttggccgcccgtgtattagtcttcttcaccctgcaaaaaaagaaagcatgtgaaaaaggtattaagaaatgaacaaaaaatatttgcaagggtagaaatctaaaaaagttgaagagtangtggaaagctagtagttgccatgtangtggaataagagttgccatgtgtcatagttagcagttgccatgcaaatccagcaagagttaccttgctagccaacttgaagaatgataaaaatgtctgatctgctaggaatgcaatttcaaaactaagtatgtgatgagcacacaagccaatgcaaagttggaagttgccataagggtacaaaaagagatg

SEQ ID NO: 39692 - DNA, 434 bp, Triticum aestivum
  Clone ID: PAT_TA_39692
ctcgcgggtcgactgtcgtcccgattatgtctcatcatagacaggagggctttgctgtactaaaatgagccactcattccttgcaactatactagagtacatgcttttgataacaatttggggaagcctgtcaatgctgaagatgggcaagtagcatgatgtgtagcgagctggtggggaagtgccctgtttttctctgggccggtgccgtggaactggaatcaatgtatcgaatttcgtcttgtttctttctgaatttgggccagaagcctttgttgtaaggatcctcctgagtagtatgctttcatttttcttttcttgaacataaccgccaaatttgccgaaaaagggttttccctcactttgtatacaaagcaatcaaccgaacatccaacgataggtgctggggcggaagcagcacagtcacgctcgat

SEQ ID NO: 39693 - DNA, 411 bp, Triticum aestivum
  Clone ID: PAT_TA_39693
ctcgcgggtcgacggctatcgccaaatcgagtcgctcagaggaatggtctgaatctggtgaccgctacgccggcgggacgaccgggcttcttagctgggccgtcatcctcgccggcctcctctgcggcggcgtcctcctcgtcgacaagagcagcgctctcgccggctaagagagcatctacgtgtaacacaaggtcgggtctctgcttgcatgcacgtctctgtaatctacgtatctacctcctgtgaatgtatgtcatcaacgatgcaaagtagttgattcgaagagatggtttatgtatgtacgtaacgcagttaccagatactcctacgtcctactttggaaactgtatcagggtatattcttggagcaaactgttgcgcgtcaacaacatctgaagacggccgctc

SEQ ID NO: 39694 - DNA, 439 bp, Triticum aestivum
  unsure (1)..(439): unsure at all n locations
  Clone ID: PAT_TA_39694
gggtccacgcaaggtgaggacatgtatgcaaccaatcaacatgcagatgttggttttttcctacataggctcagccaagcccaactgggacaagtatgcaaaagggaaaaaaacgatgcaggtaacctgtaacgcccaatatgcgaccatactccatacgtgtcgaggcacgacttggggcatagccgcatattggtatggtcacgagagtgtttgtatctttgcgcatctcatgtactgaatatatagaatacgagctttggcttacaatcgccacaatgtcacacaatatcatcaagttatacaatcattcaagatgaacacagtgtccagctacagacgaaatcaaatgaatagaaggcaaccacccaagctaagtcncgatcgaccctactgggcaacactactgatcatccggaaaggaaacatagtaacaacc

SEQ ID NO: 39695 - DNA, 397 bp, Triticum aestivum
  Clone ID: PAT_TA_39695
aaattacattaatttttatgcgtggagaatttgttggatcttatattgatatacatttatttttaaaatctgtttgaatgtgagtcgaaatttcaggattaaaaacagttcaaacttggtaatattatctttgtgaaagtgtgacaaatgtgctgatcgtgtgcgtcctgagaataataattctaatttttgtgcatgttgatcccgtggcactgatagaacgagcgaatgcattgcttgttttaagtataaatttctattaaagctaattaaatttaagtaaagtgaccactaactcctgttattacagtaccaatacagacccgctcgtgaaccgatgtgtggccgagggtgcatcttctagcctcctctagcctccacgggatactgttcatct

SEQ ID NO: 39696 - DNA, 436 bp, Triticum aestivum
  Clone ID: PAT_TA_39696
ctcgcgggtcgacatcatccaccatccacgagtgctactgttcatccacggttcacctccgccagcctccacctacgactgctcatccacgcactcctgttcatccagcctccagcactcctccaccggctactattcaaccagtcctctccacggggtcctgttcaaccaccctccacgggctactgttcaaccagccctccacggggtcctattcatccagccctccacagggtcctgttcatccacccccaaccggctcgatcagggtcctgttcatccagcggcaacggcctctactaccacggggtcctgttcatccaacccccactgggaactgttcatccaccccccaacaacgctcattgttcatcaagaggcagcaggttcgatcatcttcagttagcaccagtaacgaaggaattgctcgaccggg

SEQ ID NO: 39697 - DNA, 454 bp, Triticum aestivum
  Clone ID: PAT_TA_39697
gggtcgacagacgccgtgaaattcagtcctactaatcgtacttgccaaatgttgtggcatacagtgggaggggcggtgatatgtaccgcgtgcacgacccgttggcttgtatcactcacgtgccgcttgcgtcatgggccccgcctagcgcgacaggagggagtgcacgcatgaacgtattgttaaaattcacaacattttttagaataatagttggttttgtttcaaatttaacaatgttcataaattcgatttttacagattgaataacatatctgtacgtttaacaagaatgtttgcaaattcaacaaagtccatgtgtttacgaattcaaaaaatgttggcgtgtccaaaaaatggccatgaattcatacaatgatcatgtagtcaaaaaatcttcataaattggaaactcttcacggattctaaaatgtttgtgaaggccaattaattt

SEQ ID NO: 39698 - DNA, 400 bp, Triticum aestivum
  Clone ID: PAT_TA_39698
ggaactccctagaatgagtcttattatgcccagcaccatagacacaaccatagctggggccgacaaacctagtttagcgccacttggctaattcaaggcttttgaaatatctgaatatcctcctaggctaagaccaatactgcgagtatctatctgttttcagtatcatgtattttatgtttctcaaccatctcagtttcatgtaatagatagtggacactttaaaaatgttcataaaatgcaattttaaaaaattgaacacaatatctattcgttacacacatatgtatgcatattcaacagaataccatgtatatacggctgcccaaaaggttcgacgtttacttacgcttgcaagcaacttcaaacctcttcaagtgtttcaccaaatttcaattaa

SEQ ID NO: 39699 - DNA, 450 bp, Triticum aestivum
  Clone ID: PAT_TA_39699
tcgcgggtcgacgaaagttcccatattcagtctaatcaatgtttcgattttgggaaggttctagagccttttcacaccggtttttaaaaaaatcattttgggttttcttctctttttctctttttcatttttatttattttcattttgcggtcatctttaatattcgtgaactttttttgaatttgttaagattattaaaattttaaatattttcgaagttctgaacattttttgaattcgtgatttttttatattgtgatttttctaaaaactgcgaacaatttttgagtttgtgaatgttttacagaactgctaaaatttcaattttaacatttgttcaaataatgatcaattcttaaattcttgaaactttttgagattgtgaccattttttgaaatatgacaacattttatgattttttttaaattcaagaacattttttcgaatg

SEQ ID NO: 39700 - DNA, 430 bp, Triticum aestivum
  unsure (1)..(430): unsure at all n locations
  Clone ID: PAT_TA_39700
aagccgggcaaaatgtgttgctacttctacaatatcaaagatgatgagattctggtcttgctcgtcgaggacccaatcacagggctttctgtcgctgccgcaatgcattaggaaaagttcaagtttcctattagatttagttctattggaaaagggctgccctcaccgcgcttatccccatcgccggagggccgacgtgcaggggttgggccacagccgacacttccgttcgtgccctaccactgctcaatcttctcgcctaacccccttcctccccgatctgctactgatgtaccccaactaccactggagcttcggggagcactcctctgtccaagttgagcattgggcgccgtccgagtagagcactgcaccccgtccaagtcnccatctaatgttgaacgttcaattttgtcatgttgaataatat

SEQ ID NO: 39701 - DNA, 373 bp, Triticum aestivum
  Clone ID: PAT_TA_39701
gggtcgacgccacgagggaaataaagctgctgtcagaccatctcacatggggctggtaaatgtcggtcgagaaaattaaatttcggtcaaatttccgatatctcaccttggctaggtaatgtcattgtcggccgagaatatcaaatgaaactttgtaagttgtactaggctacttagactttgaactaatgtgtgatggtcgtggattgtacgtcttgaactaatctgtgaaggttaccttggaaggttaacttttgtttcgcttgattcctagaaaatttggaaaatttccatcatattttgttcaaaaactcaaattttggctctcatattccatctgtgatatctatttatatataaaaagtaaatgatg

SEQ ID NO: 39702 - DNA, 438 bp, Triticum aestivum
  Clone ID: PAT_TA_39702
gacgtcacactgtaaaccgtctccaactcactcgcttgacgactacttcttggtaattcagtcaactatctgcacatgtaattaagaagaccaagaagtgtacatggatctgaatggagaagaggatgaggattgcgaatgacttgtgcatcttccatgatcagaaccggatctgtttatttttgcgtgatggtcgtggtctcacttgtatggttgcatcgtccatggtcagaactggatctgtttatttttgcatgatggtcgtggtccgacttgtatggttggttggtagtctttgtttgcatggttacatggttgaatattgtacaatggactaattgtagtgtatatgtgttgtgtcatactgatagtttttgtttgcatggttgaatattgtccaaatggactagttacagtctatatgcttatataaatgat

SEQ ID NO: 39703 - DNA, 297 bp, Triticum aestivum
  Clone ID: PAT_TA_39703
atatcgtaccctatggtgagttcagctatagtccatgattgggaacatcaatttcacgccagttctgaggagggcaaatatagctgattcgatgtttccgatctaggtcatattacactcgtattagaggacagtaactatgacgtgtgtcatgtctcagtgcgtatgcacgatgggcatgtggatctcactgtctatgggacatatttgtgctgatactcgtgagtatcagttcacagatcatggttaaataatttccgaaacacttgctgtgaaactgggttcaatttcccgccg

SEQ ID NO: 39704 - DNA, 431 bp, Triticum aestivum
  Clone ID: PAT_TA_39704
tgcgtccacgcaaaacattgttcccttcccccagctgcgggaccaagccggttatgtgaccagctgtgtggccaccgtcgttctatgcttgtgaagagagcaacccaagtaaacaggcttgtaacttaggctcttgctaatgtatatatagtggttttctttttctctccatatcaatcattttatattgcgtacgtgtcattgaagagtgaaatgatggttgcttctcccgactaacttactgtgtgatttgactgctcctttagtggcccctacacgtactccccctacgtgtatgcaacagtcacacgtacacatagacgaaaaaaaacgcacgcgacgccctaatgcatgcatgtccgagcacactaggaacacacacggtcacgctcaagtgctcaacctacacgtgcatgcacacacatactcat

SEQ ID NO: 39705 - DNA, 423 bp, Triticum aestivum
  Clone ID: PAT_TA_39705
ggtcctagactcccgggtccacctgggtcgagcactccgtcgaacaggtgataggcaacatcgcgatgcagaccggggttgcatcatgggcgaccttgggaatctccagggccttcgtggtggagcaggagacgttggggacgagcatggacgaggtgtgcgtcatggttgacgctgccggatcgacaagcgaggtaaccacatgagggtcaccagcgcttgcaacacccaatagtgcgctcatctcctctgccttagcacataatctcttgtgataccacaacaactgctcgttggcaggcatggcatcccactccggaggtaagtcggcaggcatgtcgtcgtcgccggtgaaacggatgaatcggtgtgggagaaaaaatggggaaaattggatggtgaaaaggtggtgggctggctctg

SEQ ID NO: 39706 - DNA, 428 bp, Triticum aestivum
  Clone ID: PAT_TA_39706
gtcgacagacatgacagaccagatttgaccaaaattcaaaaaaactgacataattatttagtaacattaatattcttgaataattatttagtaacactaatactttttgaataagtagtttgaccatagtttgaccagatttaacaaaaataaaaaaaaaattaaaatttgagcataacttttttccttttagaacttgagaattctaaaaatttgcgaaaagggaatgtcatgggaatggagatctgccgcgccggtattagactagtcgattagttgaagtatgttcaacattatacctccagagtcggacaagctccgcttttatttgaagtatgtaggaaatgtaattccgtccagttagttcaaacagtggtccaaatgtatgtgggttctcttggatagacagctcccgcatcagtatccct

SEQ ID NO: 39707 - DNA, 291 bp, Triticum aestivum
  Clone ID: PAT_TA_39707
tcccacagaaaacgatatctatcttatcgaaacatcgggacaccttcgcctctattttccaccagattcatctccgccaccattcctagtccgagtccagtattttgttactctgttttggatttctagatcatgcgatactccaagtcgtgatagcgtaggactcccgaactttcgtgctacccgcagaagaaaaatagttccaaactaaaaaaactaagtatggaaaattctggctaggcagtttttggaccatttgtagactttttcggaaaaaaattgttgcagagc

SEQ ID NO: 39708 - DNA, 405 bp, Triticum aestivum
  Clone ID: PAT_TA_39708
gtccacacagcttgttgccagataatcttctgtgtgaaaggcatcaagcttccatgcgatggatggcttttgcaaacccgacatgcagctatgtggttcatgccaacaacaaatatgcacaacttgattcgtgctgatatctagactgagccatgtattttgctgctgtagcacgaccctcttttgttgggtattatgtactgttgttagtttgaagcactcatctggtttgaaggatagtagataccttcctaggatcaagtgcatcctcactcacctgcgtaggatgtactgataatgatgatggagatgttgtgcagaagcctaatatatatatatatcagttaggcttcaagtgcgtacttgttagttaaacctatgtatacattgtgacactaaatacga

SEQ ID NO: 39709 - DNA, 438 bp, Triticum aestivum
  Clone ID: PAT_TA_39709
tggaaggcgacctcttctaagggtgtccttgggtaaggtacttagatcaggtccatgaccctaccctaggtacgtgaccccatcacctctcacaaaaggaaaaaaacaaaaaaacgcatttttttcgtttctgagaggcacgaccgtgactctcgcgaaaaggaaaaaacagaaaacccattttttccgtttccgagaggcacgaccgtgactctcgcgaaacaaaaaccgtgcctcttgcagaagtaaaaccgtgactctcgcgaaaagaaaaaaataaaacgcatttttcacgcatttttttaccaaccatcaaaaaaatcgaaaaaaaaccgtttaaaaagtcaaaaacgcgtgtgaaaaaataaaataaaaacaaaatctggagggagcgtccagagcgtgacacgtggcgaatagctaagagcgcgccaagtg

SEQ ID NO: 39710 - DNA, 436 bp, Triticum aestivum
  unsure (1)..(436): unsure at all n locations
  Clone ID: PAT_TA_39710
tagccgtccgagattctagggtccacgctgtggcggcatcagcagctaactgactgaatcgctagctagctacttcgacgtactcacctcatcatggcgtcaaacacatgcctgaagtcgaaccagcttcctgttagaacaacaaattgtactattcctttgtactcccacctgccgtccttttggctttcggatgatcggtaccaggtattgaaaatatactattacggaaactaaatttgatgggccgtgtcctctgttgtccttctgtggacctcccattgattaatctccttctaatctgatcattggattcttgaagtggcaatgtcaagctctcatcatgtgagtactcagtcggtgattcnctctactagtggtattttatcncaaagaataacacaacgtactgtgcatcaggagcgtctacagatat

SEQ ID NO: 39711 - DNA, 440 bp, Triticum aestivum
  Clone ID: PAT_TA_39711
tagcttcttcgagtagactagcttattgagttgagcggtggagcgactagtcctcgactagtccagactagtctaggtttttgagtcgatcgactcaatttgggagggacaagttttttttagggaaatttgggaaagactagcaaaaaggcccgtgcgttgcaacgggagaaaataaatgacaccccaatccaatatgcatagcgatgggaatgtgtgtcgaggaataacatgaaggagaattgtgatttcagctagccaacctttgcaaaacggcttagaaatgaatgcattcttcaatttgtcgattaagttaaagatataagcatctcctataagatttaaaaaaaaatcaagcataagaataaaaatacatatagaacattaaaaaataaaatcaaaactgaaacataatttcttctgccaaaggaagatgacat

SEQ ID NO: 39712 - DNA, 440 bp, Triticum aestivum
  Clone ID: PAT_TA_39712
cactgggggcggagtgtacctgggtacaaacggctctagggtggacaacaccatcgtagaggcgagtgggcgtgtcggtgttggtcacaaacgtctgccgatgcctctgtggtggccgaagggcgtacaacagcggcggcagaggtgaaggctgcagatgaaaagtatgggaaaaaagggctaagtggaaggaaatgggaccgtgaggggggattgggtgggccggggtgtcgaagtcttacgtgtctgctgtccgaactcccgcaaagctcccctcactttgtcttcaatttgcgggagatagtgcgtaccgcccgacgaagcgatataggcccgtgttggataacttccgcggcctttacagtgcggccaggacggcttgaaggtcggcgtaggagatttcgttcgaacttactccctccgtcccataatataagtgg

SEQ ID NO: 39713 - DNA, 436 bp, Triticum aestivum
  unsure (1)..(436): unsure at all n locations
  Clone ID: PAT_TA_39713
aatgaaggaaggttatgggcaccgccaaaatccctcaggacgttctggcagcaccgcatcatcctcacaagtggcagtcggtggtagatctgtctgactacaccatcatgcactgcctcttgcttcgccgcccttgctgtattgtaggaccatagtgcaccacccgcgcgtccgagcggagaaccacctaacggatatggagatggttgccgccggtgaacctcagatcacgggatcgtagctccgacataacctgatctttgacaagtatgtcgtcggagtcacaacacgcaccagggaggtactccagggcaacactactacacgtgtgcaccatatcgagtcncctccctcttccagcgcacgggaatcccatcgtgtgagcgcggcggacgaccttccgctccgtctcgtcggcacgcgagcatcccgctga

SEQ ID NO: 39714 - DNA, 428 bp, Triticum aestivum
  Clone ID: PAT_TA_39714
tccagtgagatgcctcatccactcttggccggcatgaatgcagctcgggccaaaatgaatgcatgacaaccgattcgtgcaggagagggcgcgggcccgtgagaagttttcgggttgctcttgggtgtccaatgcttatgtggtagtggtctagacgcccgaaagcccccttgatttgcgttcggtttatggaaaaacggacaaccggaccgctcggtccacgattgcggacgatttaagggttcacgttgaagatgccctaagcatcgatctattagttgtactcatgaacctttgttcaaaacatacatatgagaaggacttgcaaagaaaaaacataaaacggtcaattggacaatgaacatcgctttttaaggccgtctacaacgctggccacttgaccagccgcttatggagagaaattcaat

SEQ ID NO: 39715 - DNA, 115 bp, Triticum aestivum
  Clone ID: PAT_TA_39715
gtagccgtccgagattctagggtcgaccaagcatggacataagagaggacacctctctctatcaattatagctagctaacacaatttatgaaacacctaattaaattaacccccc

SEQ ID NO: 39716 - DNA, 392 bp, Triticum aestivum
  Clone ID: PAT_TA_39716
gtccaccaccctattatcagtagtattcccccatgtatatagtagtagtctaagtattttgtaacggtagctagatcaattgtatgcccttgtttgaattgagtggtgtgatatgaatgtgtttgtcccatgtgcatatgggtagtgatttttttctccttagaccccactctattctaatctgtcccctctaaaacctatcagatgcctccgacacgtcaccccggatttgtcttcccaccgaagctcacccagttcatccagcagcataatgccttgatgcagctgctagtccacaaccaacgcaacaacagtaacaaccacaaccatcacaatccaccgccatcacttcccgtagatcacttcacccgttttctgagggttaatccgcc

SEQ ID NO: 39717 - DNA, 228 bp, Triticum aestivum
  Clone ID: PAT_TA_39717
gtcgactctccgtaggtgatcctgaagactgtagtcataatctattcgctacttaccctgcaattggcaccacaaaatgccatgagatttttccttgaatcctgttacccagctctgctgatgaaaaaccggtgattcggtggcactgtgagctagccagaatgttttgccctgtttgtttccccctgtagtttcgcttcttgcatgacaatggcaatttgttggagc

SEQ ID NO: 39718 - DNA, 443 bp, Triticum aestivum
  Clone ID: PAT_TA_39718
aaatggcatacgtaatgaaaaaaaacatggcatgagataattcacatatatgataactggatgaaaaacatggcattgcataatttacatatctgatatagatagcaaataggaggcattcacacaaagcatgtctaatctaagcagatggcatgtcaatgcaagacaccatatgcatgatatgagcaaaataacctggccaagttagatcatgcaccttggggggatatgactggtcatctgtctctgaatcctcccctgaggagctatctttaaccaacaagaaatctgcatcgacaggtgcactgactgctcagaagaccttgttttcactccagattttcccatgatcgactcaaatggctgatgcaaaggaagagtagatgaatgtataaacattgttgacaaatggaatacattattaaaaaaaaatggcacgatac

SEQ ID NO: 39719 - DNA, 434 bp, Triticum aestivum
  unsure (1)..(434): unsure at all n locations
  Clone ID: PAT_TA_39719
aaatggaatacgtaatgaaaaaaaagatggcatgagataattcacatatatgatgcctggctacatggcggtgcataatttacatatatgataactagctgaaaaacatggcattgcataattcacatatctgatatagaaagcaaacaggaggcattcacacaaagcatgtctaatctaagcagatggcatggcaatgcaagacacaatatgcatgatatgagcaatataaccctgccaagttagagcatgcacctcgggggggggggggtacgactggtcatctgtctctgaatcctcctctggggagctatttgtaaccagtaagaaatctgcatcgacaggtagcaccgactgctcagaagaccttgttttcactccagattttcccatgactgacttaatggctgatgcacaggaagagtanatgaatg

SEQ ID NO: 39720 - DNA, 425 bp, Triticum aestivum
  Clone ID: PAT_TA_39720
tcttttgtcctccgcgttatattacttgtgtgcacgttttcccctgtttccgtttctgttgagagggagtatgccaagtaaaaaattgtcacattatatttcttcttctattttagctatgaagtaatgaacacatgtgtgttgtgccatgcctacaagaaaatagtttcagttaatttctcccgtttgttcctgtgcctttatggccagcaggctaaactcttttgactgataagctcttcactgctaggtacagagtttatagttaactgaaatcggatagcaaagaacgcaggttcagttttgacttatgctatggtttgctgcagtgtggtatccgagccagcgtcaggtgcgccaagctcgccgtccacacgcctcctcttcatctgcatccgcagtgccaaatccctccccatccgagc

SEQ ID NO: 39721 - DNA, 443 bp, Triticum aestivum
  Clone ID: PAT_TA_39721
atccacataactaaaactccaggcggttaaaccaaaatcacacagagcaagggagtaccttgctctgataccaattgaaagtgtgttatatcgactagaggggggtgaataggcgattttcatgaattcttcactaaggaatttgctggtgaggaaattcctacgtgaagaactactctcaacggaataagtactcacaagtaaacataacagaacataagcatagtcatcatgatgaaatgaagacaagcacagagtacagaaaacataaacacaggataacacaagaaagaagatggacaggttgaagaaattgaactggggaaattgagaaagtcttcagtcaaagtcttcaaacggatatgaacaggcacacaacaacagacatgaggaaatgaaagagttgaggaaatagaactagtaagctcggtgaagacaatgat

SEQ ID NO: 39722 - DNA, 447 bp, Triticum aestivum
  Clone ID: PAT_TA_39722
gtccacgctgcgacatgacgacagacgggtaatgactgggggctcaggagatgacgcagaaacagccgtcgagcgaggcgatcagcagaggctgcagctcccacaactcgcgtttctgttttggcggcgtgcgctcgcgtgtggatggagctcgtacgccaggaagaactggcgtctcgatggagctcgtatgccaggaagaactggcgttcgttcgacctcgtcctcgttcgtgggttgcggagctgtttttttattgactgggggctcaggagatgacgcagaaacagccatcgagcgaggcgatcagcagaggctgcagctcccacagctcgcgtttctgttttggcggcgtgcgctcgcgtgtggatggagctcgtacgccaggaagaactggcgtctcgatggaactcgtacgccaggaaaggctggcgtttgtttggacct

SEQ ID NO: 39723 - DNA, 213 bp, Triticum aestivum
  Clone ID: PAT_TA_39723
ttcccgagtccacgcacgaggctttagccccctagtagaaaagatgtgcccaaatgactgttactgcgtctgcgattgcatcatggaagtgagcccgaggtccgcaatcatatcacgtagctcgagcggcatgtcttcataacacaacatgttcgaaggattgaacagcagctggaacatgtactccgccttccaatcttcaacaggaggccg

SEQ ID NO: 39724 - DNA, 440 bp, Triticum aestivum
  Clone ID: PAT_TA_39724
cgactatgcggcccaagtcatggccggtctcgaaagggtcctcgatgcagatcagatggcggtcgtttccgatgcgagtcgtccagttcttctccttcttgctacatgtcgttgcgtcatcacaccaggtgagaaaaaatgtttaaaattcttataacctagatgaattaagtcgatattgaattcttggtttggaagaagaatgctggtccttaattacctacctgattatctttcccatacggatggagatgacatctttcctgtaatcgtgctggaatgcccagtagtggaaaaatgcccagagtaactccgcgatggtctccttgttttcagccccaaaatcacgaagctgatgaacttcgtcgaaataagcgcattcagtgtcatcaacaaccatggtatatgtgggctccatagcctgaaaatgtggggaaatg

SEQ ID NO: 39725 - DNA, 432 bp, Triticum aestivum
  Clone ID: PAT_TA_39725
cacaatgcgtgtgtatgaccactgacgaggtcaactaatatacaactcggtggtggctgaccgaagagagaagagacccagcggacatcgcatacttgagttttctgcctacaacatggcccaaagtcgagaatgcccccaaagactttctatgtcgttttttagcaagacacctttttacttcgcataagtcattactacgtgtatatgtagtgaatcacttcatcattttgaatttttttataagatcaacctgcccgccgttattactcaaaaggtgtgtggaggtactcttacaacgcagatcataagatacaacatgggccgagaataagcctaacacctcgttgaggcccaaccgacgatggctgaacttcactacaacacaccaatgatggcgacggtggaaaacattgccgccacggtagctct

SEQ ID NO: 39726 - DNA, 293 bp, Triticum aestivum
  Clone ID: PAT_TA_39726
tccactgtggccaatggagtgatgaagatgtactgtagagtacatattcaagggaactgtgaggtgacttagatagctgtaatgagctgatggagcctttgacctgaagttatatttgtatagattacatgatttgttgatgaagataagaaagaagaactgatggcaaacaaaccgaggaaagtcaccgaagaatgaaggtgggtgcgatgccacatcagaagggatttaagctaagggtgaattaagggccatggagccaacccataagaaggtccaataaggtgcataca

SEQ ID NO: 39727 - DNA, 420 bp, Triticum aestivum
  Clone ID: PAT_TA_39727
ccgggtcgactttgtgttgataaccgtccagtaaacaagaagaccatcaagaacaaatacccacttcccaacatcaatgagctgttcgaacaactcaagggtgctcaagtattctccaagcttgatctccgtatgggttatcatcagattcgtattcgtgagcaagatattcccaagacggcgttcagaacaagctttggttcatatgaatacaccgtcatgtcttttggcctcgccaacgctcctccgacgttctctcgcatgatgaacttcatcttcaacccctacaccaatgaattcgttctggtctatctcgacgacattctggttttctcgaagaacaagaaagatcatgccaagcacttgcgtttggttcttgacaagctcagggaacatcagttctacgccaagttctccaag

SEQ ID NO: 39728 - DNA, 420 bp, Triticum aestivum
  Clone ID: PAT_TA_39728
gtccaccgggccggaccaaacacatgcatatgcaaagtcagtgtacacgtactacgcaggaagacattgctttctggatctcctaaatattttgttgcatgcctatgcttacgtacatagttggtcacatgcatgggtttcccggggaacaagaacaaaacataatctactgtaaaatgtttaattttagtcggcagtgccggtgtacgtacgaacgagcagcttgcttgctggtccctccttcccacaccaacgcctgcctgcatgcatgcatgcatgcccggccacccggtttttgtacatactacaccgtggaatgttgctcaaaagattttgatagatcagtgtaggtatatatcaagagagtatataacacaaaactcgtgcctttcatattagaaacagtgtaggtatccccgc

SEQ ID NO: 39729 - DNA, 398 bp, Triticum aestivum
  Clone ID: PAT_TA_39729
tccacgaagttgtcggaagaggttgagcattggtaggttgacatgattggcatatgtggatgtgctataagatgtgcttgatctcctccgtgcgtcatacacccccagtcgtcagtggtacacgagttgcgataaactggtgacgaaatggatggaaaccactgtgttttcaaaaatcgccatcaattaatggaatcttagcaaccagcaccataagaagtatttgatgattagatgacaatggtgcacactaaggaacccgtccgtgatgaattcatcaattccaaatgtttggaaactaccatgcgttttcgcccagcacacattgactaatctaacacacacaggtcaggtggatcaactgaatgccaagtatcgcacattgttaaaaaataatg

SEQ ID NO: 39730 - DNA, 423 bp, Triticum aestivum
  Clone ID: PAT_TA_39730
cctgccgtacggcctcgaaaattccaggtcgacacgcatcatcggaaccacatctatcgagagggaacgagtaccggtaacatagaaggaacataatcaatgcaatgaacaagtaccgaacatgtcagcgcaagcgttgctcgagtttgttgcacttgtcgataggatgccggatgtggtcctcacataaggcacagatgacatgatttactaggctcgggagagcatggggcagttctctgttagatccgcatatagggcattcttcgctggcttgattgagtcagacggtgccacccagatttggaaatcgagagttccaaattcttggaagttcttcatctggctggcggtaagaataggtgttggacggcggatagagtgcaaagaaggctacttcctcacccctcgacatgtcccttc

SEQ ID NO: 39731 - DNA, 411 bp, Triticum aestivum
  Clone ID: PAT_TA_39731
ccgggtccactgcacggatgcaaaggcaatagccgccttcaggcatggtatctaggacaacaccgctttaacatcgtcccccagtatgcatatctgaagctcaagattcctggacctaagggtgtcattatcgttaacggtaacattgagcccttgctccgaactaaggagcacacagcggccctggcagccgaagtccaggccggcaaaggggcacgaaaacccaggaacacatcaaggtgctagacgcacacaaacgagcctgagctacaacaccgcttcaagagccttctcgcgctcaccctaaatagggatacgctccccacaacacggcttctccagccacgaaatacgtacctcgggtacacaatttcgcacttaaaattccatgggcagccgtggggacaaacg

SEQ ID NO: 39732 - DNA, 396 bp, Triticum aestivum
  Clone ID: PAT_TA_39732
ctcgcgggtccacggaagcgtccaaaatgtgtcgtcatgaaagatagaagtacacagcatgatccagcacgtggaccaaagaccattccgcagattcccggtggttcatggctatggccactcgtagacaactgcacatctatacctgacgttcccacgtacgctagtgtgcaaatcatattctctacgttccagatgcaatggtgactgcggggagctggtacacacggcacagcatagcatgatacgggaaaggcctgcacgatctgaacagctaactgctgcctgtatcactagtatacacgctgaccataacctgtgtcgcctgcatccgcatccccaacttcagcatcctctacaggctggacaatggctccttcattgaccacctcccaa

SEQ ID NO: 39733 - DNA, 413 bp, Triticum aestivum
  Clone ID: PAT_TA_39733
ccactgcgaccagatctcagagatgcctgatcttgctttcaccatagcaaacaagactttcaccttgacgccagagcagtacgtagtgaagctggagcaatcaggccagaccatttgcatcagtgggttcatggcgtttaacgtgccgccccctcgcggcccgctctggatacttggagacgtcttcatgggcgcctatcacaccgttttcgacttcggtgagagcaggattgggttcgccaaatccgcgtgatttggtgatcccagtatctccagtgtatcaaggctcaaggccggtattgtacataatccaagcacgtgtaagttgccaggtcaacaagaaatttatcagtagaaaaggaacaaaatgaacttgccatcggcatttcacatttgtatagctatttgctgtg

SEQ ID NO: 39734 - DNA, 422 bp, Triticum aestivum
  Clone ID: PAT_TA_39734
actcgcacagaaaaaatagccaccatctcatcaaaactttgggacacctttgcctctatcaagtggtcttagttttcaggttgctcggtgagaaattctagttttcctagattagatttattttctcacctattgtccaagaaaaagccacaaaaaaagctagatctattcatcctttgtccaagctagtctgagcctttgcaattttcttttcattgcttgcatagttgaattatcggttgcatcgtcgtgtcgagttgctggtcttagtgtcttgttcgtttagagtttcgagttctgttcacattagtcacgccgccgctgcatcgttatccctttcgctgtccaccacccattcatcaatttccaccacgtgctacccatcattcattgtctaaatgatagttgaggtcgttcacatc

SEQ ID NO: 39735 - DNA, 354 bp, Triticum aestivum
  Clone ID: PAT_TA_39735
tccaccatgacgtcttgacatcaaaacatgggggtggcttggaccattgctgactgccttgactgcttagctggtactccatgtacgataaggggtgggaccttaagtagggttaaaatccactacaacaacaacacacatctaagtttctctttctaatctataaggcacaccccgatgtcaccttaagtagtcccaaaaggcatactacacaatcacctcatgatctttatcgttctaatctcaatccacaagtcatcccattgccactatattctccaaaattatactacatatgaatcacataattcattgattccctaaaacaaacacataccgttcaccaaaaatcgg

SEQ ID NO: 39736 - DNA, 417 bp, Triticum aestivum
  Clone ID: PAT_TA_39736
tccactgtgccgacgcaaaagccttagcagctttcaaacacaatgtccgagacgaatggctcaccagacaccttggccaagaaaagccaagaacaatggccgcattaacaagcctcatgacccgcttttgcgcgggagaggatagctggctggcaagatgcagtaccaatgactcaagtacatccgaagttagggatggaaacaggaaaccgcgacgcagcacggacgaatgtcggaccaagggcagcatcccgaagagcacggcagtcaacgccggatttaaaagctcacagcataatcatagaaaactgccccctaaggataacagggaggagctatctaacttaaacaaaatcttgcacaaggtatgccaaatccacagtacccccgggaagcccgcaaatcatacccacaaag

SEQ ID NO: 39737 - DNA, 390 bp, Triticum aestivum
  Clone ID: PAT_TA_39737
gtcgacactggtgtcaatagtgtgtcgtcctatggtaatgtaacaccgtctaatttgctgcacgtccatctcccggtcgagggtatgttgcattactcaaataattctcatcatcctgcaagccaccattcttgaggtagatggacagggtcatatgccatcttcaccttgtcacgtaggcatcttcacatgtcaccagtctaccggatataccttccccataatgccagtccacactctctccgttctagttaactaggctattatatgtgttgtgatttaatgagagagctttattcatatatttatcattctcttgtgacaatctacacaaaagactggtcactcacgcgtcgaagtactcctcagcaaacaaaatccttgaatgca

SEQ ID NO: 39738 - DNA, 354 bp, Triticum aestivum
  Clone ID: PAT_TA_39738
gtccacacaagtctccaaagttcgtcttcctctacatacagcttcgctgtgaagataccgactgggcctgatatgcccagcgatgtctcagacgacaaacaagctgagcacgctagcatgaacagaggcagtcgagcacatggatcatctttgattcttttcattccacattagatcagggttctggctgaaaatcagttgagacagatcagcgacatctacagatcagatttgccgtcagttgctcaggtcttatcatgccacaattcgtcaagttatcagaactatagttcgacaagatacacacttcacatcagatagactgacttatatgcatagtccaccttttgacaa

SEQ ID NO: 39739 - DNA, 433 bp, Triticum aestivum
  Clone ID: PAT_TA_39739
gtcgacgccgcttttttattttttttttttttttttttttgcaggatcagtttaacatgataaatccaaattaaactgggggctaatgtcggggatattccccgtagtataacccggcctgaagtatgacttagccggacttggcggctcactagtgacccgccctggcttggccactcactagtgacccggccgagcctagcgactcatgggtgaaccggcaggcgggtcagatgaatgacaaggcccaaggcccagaaggagacttatgagaaggccgactcaaggtacggtatcaagtgggccggcttgagatggaagacataaggaatatttcccttacaagggaacctggactaggattcaacttgtaatagagtagtcctaatcctactaggactagtcatgtgagccaccccttcaacttatctaa

SEQ ID NO: 39740 - DNA, 456 bp, Triticum aestivum
  unsure (1)..(456): unsure at all n locations
  Clone ID: PAT_TA_39740
ggtacgcctggcggtacggcgtcgagnattccaggtcgacggacacgtccgtaaccggctcagacatgatactcaccttccataatcccgttctgcacatcactgctcttcctgtgggcaccgtcttggtctcatgatatcaagcaagttaagtatgtgtgattcgctattagatatggcatgttcttctgtatatacgcaatcttgacactcacgcattggatgctctgcagtcaacctcatcactggaacctttgagggtgtgtgctagtcttcgttactccctgctctatgcttcatcgcgctcacagaaacactcagacatgtgctgtgtgaagcatgtctctttctgtcctgctatccctgcattttgcgtttgtcaggcaaaggggatgaaatacttggtacagttacttcacatgatcaaatcatttttccacgtctccgagaagtcca

SEQ ID NO: 39741 - DNA, 418 bp, Triticum aestivum
  Clone ID: PAT_TA_39741
aattacaatcagacccactccaaggtgcatatgcgtagttgacagccagcccacggacgtatcaatcgttatattgctatgccatgccatatttagctgatatttgccggaatcgaagagcctgtggttgaatgattgcgatcatgtcgcatcataaatgtcactcacatacgctaccggattggacacagtcgtcaattactcttaaatgtgcttcttcacaagtaccgatgtgcgtaatatctgttcccaccttgaagtttatgtcaccagtatttattaacgacatggtatcgatgctgctatcgatgagacagctatttgtctttacatgctttcaacactttcaaataattgagtcattacatacctgaacctacttccgaatacatatttgccattgatctgctctgcagcc

SEQ ID NO: 39742 - DNA, 331 bp, Triticum aestivum
  Clone ID: PAT_TA_39742
ctcaatggtctcaacggtgtccgccaaggacgccacgaaggaggagtggcactgtaccggtctgatcgtcatccctcgtggagtctatcttggtaaccgtataacactagatcgatgcttgacaatgaccgtattaatccgctaggagtcatcgaccttgtggtcacagcaaccactatgctacaccacatcagagaacacctgctgtacaacttaagcatatgctagacttgctaccccatacatctccaccacactcatatttggatgtggctaatgaaatcctcaataattctgtccatcataggtatagtctccaacatccatcttg

SEQ ID NO: 39743 - DNA, 444 bp, Triticum aestivum
  Clone ID: PAT_TA_39743
gtccacagtgtaacatgggaccagtttcagcaggcttttcatactgcccatgtttcagcaggagtccaagtccaaagaaaaaaaccatcacgtcgttcagcgtcaagatctcggtcgagatcagtttcttcccattcaaggtcaccgtcaaaggaacgctctccatcaagatcaccagcaaaatcccaatcccctgtcgctgcatctcccgtcgtcaatggtgaagcagcaagccccaagagggacccaagcaagagcccatcacgttcccggtctcctgatgccaaatcagagtaaaactgatgcgaggttaggggcggtgagaggcggagccatgggcttcaaattcttcatattttgtcttcgccgacttctgcatacgctgttatagtactatctgtgttcggttattctaggttccttgatgtttctgtaaaacttgtt

SEQ ID NO: 39744 - DNA, 408 bp, Triticum aestivum
  Clone ID: PAT_TA_39744
tttgacagcaaatggcggtagtgtgaccatccattaccccatgcttgcaggcgacaattatggggtggaagatgatggcgcggtcgaataaataaaggaccaagaggctttcgcctccctagcccaaggtgtgcctgatgagcatgaaagaatcatatgggataggaaaatttgtgttgcagctaaccttcatggttaatgagatgcgagatattggataaaagatgcaggtaaacatagttgtggaaaagttactatgggttgttcctgacaaatgtctaccaatctttggcaccatagagtagtggagcgatgtgaggaagatgtcgacgatggaggtgattgggtggctgatgacctatgagctggcgttgaagggacgtgaacgcggctaaaaacaagagcaga

SEQ ID NO: 39745 - DNA, 306 bp, Triticum aestivum
  Clone ID: PAT_TA_39745
cagcgtcaagttggcgatgacaaacgctggcacacagtctgaatagaaggctctgtgcagtcacaaaaccttgcacaagctagcatgtgcaatgcttaacacagaactgcagtcacaatgttatgtcaccgcaccatgtgtgggctatgtctgcccaatgtgttgtgccacaactgttttacaactgcgtggttgcgctatgctgcctggacaattgcttgcatacaccgacaagttgcaacagaataccctactctaatctctaatcaaaagatcatctgtttacttcccaaacaatctgccgct

SEQ ID NO: 39746 - DNA, 442 bp, Triticum aestivum
  Clone ID: PAT_TA_39746
gcgggtcgacgagaatcaatgctctgatgaagactccatgatatctgctccagcttcatcaacatagtcatcatcgctatcctctgggtctgagtcggtgtcgtcgatgatgatgtagttctctagacaggtgcaatcttcgtcttctcctccagttgcgggaaatcccatgaatacttttagcttcttcttcagaccatcgtccttctccactagtgtagctatttcctcctcatatccatcgcgtgtagacttgagttcttcctccagctccatgatcttggtcatggctttctttagatctatcatgcctgcacacatctggttctcctggcgtcgaatgtgctggtttaactcctggatgaaagctgcaattgatctatccttcctggtgttgatcatctcccattgctcatctcggctcccacaaatctggtagata

SEQ ID NO: 39747 - DNA, 421 bp, Triticum aestivum
  Clone ID: PAT_TA_39747
cccaagcgtccgatccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacct

SEQ ID NO: 39748 - DNA, 437 bp, Triticum aestivum
  Clone ID: PAT_TA_39748
ttcccagagtcgacttacacgtccgcgatctcgatcagcacaactggatacatgacacctttgactcaaccatatggtatcagaattccaaattgcgcggtgagaattcacactacatcaacgactttatcaaatctgctctacgagacaactgtccaataacacgtgaccaaattattagaggaagagcaccaccttagtacaatatcggatacattacacaatcttaatatggcttcagcttagacaagttaggtcactaaagctgttttcaagtatctggtctggcatgtgaatcacatacagtaattcattctggtgacaaaattaccctgctcaaccgaattacccacaccacattgcaaactcaccacaatgcgtacactttaacgctaagcaactatatctacaaaacaagagtcgtcagtagccactga

SEQ ID NO: 39749 - DNA, 425 bp, Triticum aestivum
  Clone ID: PAT_TA_39749
cgacgacgaggaagcgggataggcatcgccgacgtcgatgcgggaacaacttctatatagagttaaataaagtagttttattaattaaatcaactagctagttcaactactaaacacttactataaataaataaagtagtacttactaaaaacaaactactatatatagtaaaataaagtagtttattaaatcaactagctagttcaactatatatgaagcacttactataaataaaataaagtagaattactagaaataaactagtatttttctaactaattagattaaacactttctcttcttatttttttcatttttctaaatacgtactatgaacaaaagaaacattaaaaatccataaacaaaattacaacagaaaaaaatcataaagattctatgaacaggaaatctatgaaatacaca

SEQ ID NO: 39750 - DNA, 226 bp, Triticum aestivum
  Clone ID: PAT_TA_39750
caccaggactccgtcatgttcgacaaaggacaacaaattctactattacccagaaatggtggggacagtcatcctcatcttgggcagagccttgggcggcttggacggcgtcacgcgtgggtgcttgggagctttttctgtcggcgctggagatgaggtccgagggcgcttcgacgactgcccaacagggatagtcgccttaccacgttcccgcggcgggtcgttt

SEQ ID NO: 39751 - DNA, 418 bp, Triticum aestivum
  Clone ID: PAT_TA_39751
tccttgggactcagtagttcgaacaacagtgacgatcatcggttggctattctaccttgatcgcctagacacaaggaagaatcggcataagaggaagattctcgactcttcagcgtgtcctacatgtacccactcggttgaggatcgacaacacctttttttacttgtccagcagctcgcatgatctggagagcaaccggcatctgccctctttacactcctatcacaagtctcttcagcacgaagcttccggatccgctgcctatcacagtccgccccttcatgctccttttgattctttggaaaatctgggacgcacgcaacacgaaagttttccaaggactagatgttgtggcctcaaactccttgagagctatcctggatgatttgagtgtttggtctcatacactagaatctg

SEQ ID NO: 39752 - DNA, 381 bp, Triticum aestivum
  Clone ID: PAT_TA_39752
ctcgcgggtccacactcaccactacactcagtcggcctatggtcgccatcgctcccgcacctgcctcataactcggtagctggacctgcctacttcaccacgccaccagataggtcgcatcctcatcccaaatcactttgtttacgcgtccgttgtctgcatttttattctggggcaatcgattcccactgggaaccagcaccccttgaggcaccggagctcctatgctgccggttggctggtgtctaacgtacgggggatgggccgcaacttcgtcgcggaatcagcacttatatggctatattacagttgcgtaggttggaggtactgccgccgccggatctagataacgacgagtccttgtgaattggcccgggggcg

SEQ ID NO: 39753 - DNA, 397 bp, Triticum aestivum
  Clone ID: PAT_TA_39753
ttcgcgggtccacacaagagtctgagacgatgaggacgccatcttgtctgccgtatccggtacagccgggtcgagaccggaagatgacgtgcatgtagtagtgtaagcaagcctcgactgcccgtactgcagacgcaagtgcgtcacatgtgggatctatatgtgccaataagacgtcaggctggtcgtacgatagtgacagacacaactcaaccatccgtgtcgctcacgattcgtcatgttgatgggaaacgttgatacaaagcgtgcttcacgagctttgcactagctcggccactccttccgcacggtcactctgaaggcacagtgcagacgcagtcgcagcagtggttggctgatatctcaccactccctgtgatggaagtagtcgtacctg

SEQ ID NO: 39754 - DNA, 451 bp, Triticum aestivum
  unsure (1)..(451): unsure at all n locations
  Clone ID: PAT_TA_39754
gggtcgacacaagacacaaaggactcatcagaatagagctatgcaccccaccaacggcgccagaaaatagtcttgataacccacaagtataggggatcgcaacagttttcgagggtagagtattcaacccaaatttattgattcgacacaaggggagccaaagaatattctcaagtattagcagctgagttttcaattcaaccacacctgaaagacttaatatctgaagaaaagtacttagtagcaaagtagtatggaagtaacggtaacggtggcaaaagtaacagtagcatttttgtagcaatcgtaacagtggcaacggaaaggtaactaagaaaagatcaatatgtgaaaagctcataggcaatggatcaatgatggataataatgtcagatgtgattcctcatgaaacagttataacatanggtgacacagaattagctccaattc

SEQ ID NO: 39755 - DNA, 441 bp, Triticum aestivum
  Clone ID: PAT_TA_39755
gtacccgtcgtaaattccgggtcgacaagagaaattcagcaatgcatgtgacgatgagctagtgttagtatgtgagattcactaaatcgcatacaaagtaatgttttgagtgccggatggattggtcaccataccgacttactcatactattcgctttgctatatgggatggaaaatctgagtgacttacctatattacagagacaatgatcaagtccttgttcagaccgtagaatggtaccataacatttcccttgtacactgcagctgttgccaactcgtaggacatactgtgaggttcactgcacacccattttcctgcatgagacaccatagcttgttgactaccatgagatatctatacttgtttagtattgcgagcagaatcatcagttcagaacatacagtctcgggataaccgtaccattatgagaagacatg

SEQ ID NO: 39756 - DNA, 395 bp, Triticum aestivum
  Clone ID: PAT_TA_39756
gtcggagactgacaccgcatctacactaagcatccatcccttccccaagtggacgtgatccaccgggatgttagagatgtggccacagtcgttttgtgcgagagagtgtgaagagagcaaccccagcaagcaaccgtgtaggatggcccgtcctgactatgtatatagtggagcggtttccttttctctccatatgaacctatcatattgcgtacgtgccactgaagaaaaataataatttataaatgacgcgacacctactactcgttctcctataaccttgcgcttggcatctccaaaatattaaccttgtgattggctcttcgcctcttcgggaagtcgagcaataatggtagtgcagtatatatcgttctggctatatgagaccgaatgaa

SEQ ID NO: 39757 - DNA, 362 bp, Triticum aestivum
  Clone ID: PAT_TA_39757
gggtccacggacacatattagagtggttcgaatcaccatctgttgcagtcagtcaagcaacgggcagtgaccagtagcataaaacaatttacatcttaggtttcacctgacatcgcattgaacacctacaattctgcagataaatatgacataccggcgtcggcagtggttcatgaagaatctaacgtatgtatcacacacttaattgacaacataacacttgatttgacatcagttcacgccattgaggatgatgtgggcccacctaagtaacgatatggcctgacgaactcgattacaagttcggattgacgatgacagtgctcctaggtccgtatctatagaacataccagattgtgga

SEQ ID NO: 39758 - DNA, 212 bp, Triticum aestivum
  Clone ID: PAT_TA_39758
cacacgtcctagactcgcaggtcgacccaacaccccaaaatgattcaatggagtctgcaatgaaggcaagtttcggtaatacataagcccttactagttaagtataattaccacaggtcgaatcttgtataggcacacaatcatcaaacggtggtatctgagcatgagtgaaaacagaaaaggacaacattgacgcttaattctgcatgatc

SEQ ID NO: 39759 - DNA, 409 bp, Triticum aestivum
  Clone ID: PAT_TA_39759
caaagttggtcgtaatatgccctgaaggcattaataaagttgttattgatatttccttatatcatgataaatgtttattatttactctagaattgtattaaacggaaacttattccatgtgtgaggacatacacatacacagtgtcacttgtatgcctctacctgactagctcgttgatcaccgatggttaagtttacgatccatggatatagagtttccatttgaacaacagggtcatatcattatagaatgatgttattgacttgaaccaaccgtaagcttatcactatgattgtttaatttactgctattgctttctccataacatatacatgttcgtatgactatgagattatgctcctcctgaatattggaggaacacatagtgtgctatcaaacgtcagaacg

SEQ ID NO: 39760 - DNA, 263 bp, Triticum aestivum
  Clone ID: PAT_TA_39760
gactcgattcagggcacaggatgggatggtcaagtggagtttgcattgctagcaagctgcattcgggactacgaggggaatgatatcttcactgtgctcaagattcccatggatgtctcccactgtcgcgcgttgttgcatcctccatcgtggatattcatcgaacgacgtgttcaattgggtcgtcatggcatctaacagatattgagagctctatgggctaagccacatcgtttacatgctgatgtattgcgtgtcggtgt

SEQ ID NO: 39761 - DNA, 215 bp, Triticum aestivum
  Clone ID: PAT_TA_39761
tggtaagattctgatgcagctctcttacttgataagatgatgataagaacattcatcatcttccttgcagatatctcttgcatctttaatatcatacatatcagcattaccatacattcagtgagtccagtcatgaactcaatcattcaacgtgtcgttctctcggtcggtagcatcctatttaggcgcatgcttttcgacacgctaacatacaa

SEQ ID NO: 39762 - DNA, 371 bp, Triticum aestivum
  Clone ID: PAT_TA_39762
ggtggataagccaacatcagacacaccagcggagtaccttgctctgaaaccacatgaacgtgcattatatcgactatacggggggtgaatacgcgatttttatgaattcgtcactgaggaatttgccagtgaggaacttccttagcgaacaactacttgtaacagaataagtacgtatacgtaagcatatcacagtacagacatagtcatcatgatgaattggacacaagcatagcgtacacaaagcgtaatcatacgataacacacgatgaagacaaacatactgacgaaattgaactaacgaaattgagaaagtcatcagtcagagtcgtcaaacatagatatgaacaatcagtcaacacagttatgag

SEQ ID NO: 39763 - DNA, 353 bp, Triticum aestivum
  Clone ID: PAT_TA_39763
gggtcgacgtaaacgtccaaatgagatatgcccatcgcgtgggctggcagacacgatgccagctgtcacttgtgtactcgttgacagtgtaatatcaattaaagcaggtgacctgggctagggtcatgtgctcagcggtcagatagacccagtgcatgtgttgagtgcagatcggatggaggtcaagaatgtgtcacattgccacacaatgtttctgacgtctcgtgaattccacaatgcgatgaatgaacgtgagctgtcttcactgacagctgtgctcaagtgcgtcaaggagcaaatcctggctgagcaatatctggtggacccacatcagtaaatgctgattcagctgg

SEQ ID NO: 39764 - DNA, 398 bp, Triticum aestivum
  Clone ID: PAT_TA_39764
aactccgtaatgttcgtcagcggacttttggttctactattaaccaaactcggtggggacagtcatcctcagcttgggcagagccttgggcagcttggactgcgtcactcgtgggtgcttgggagctttttctgtcagggctggttatgaggtccgataggcgcttcgacttaagctctgcatggaatagtcgtcttacgaccttctcgcagtgggtcatctgttagcttgggtcgccgttccgttcacggagatctgtcttcttcctcatctgctgcacaggtttcatcttccacatccacctctcatttctggtcagttccgtactcttccctcacgtcaccacgttagcctccactcgcatcacgattatcaggctgctcatgttctccatcccc

SEQ ID NO: 39765 - DNA, 407 bp, Triticum aestivum
  Clone ID: PAT_TA_39765
gaattcatctcaattctaggtggggtgtaagtttgaggtcatgcattgcataacaatgtgcaacgtaggcctcgtaattccaggggatcgtcactcttcacaggttcctaaacatggattccaatttcgtccgaggtaaatgcatgcacatcattggtacaggatcgacataatacatttcatctagcgtatgacgtctgtgttggcctagctgactaactgtatctggcctgtaacatagcgttcacaaattgatgagcagcgtactgctttatgactcacattgacgtctataggattgataacatgtatcctacagcattattaccagtcattcagcagtaaggtcaaggtgattgcttgttcattcctatgcatttatctatcactctctcagcaagcttgtc

SEQ ID NO: 39766 - DNA, 141 bp, Triticum aestivum
  Clone ID: PAT_TA_39766
cgcagtgttccgagaagatcctcagacggcctggctgctgtgatgatccggcgagtggtccgtaaaggcagctcacacacattaggcgtcgctctagctcattggctcgctctcggctcatggcggtcttgtgcctcactg

SEQ ID NO: 39767 - DNA, 410 bp, Triticum aestivum
  Clone ID: PAT_TA_39767
tgagacctggataaatctcaatcgaacgatttttagctctgcctcccccggcgtcggcgccagcccaccccgtcttcggtggccttagggccatgggagcagatctcagcccttgtcggttggacgactctgtttttagatatgttttcgagttttgttatggtttgtgtcctacacgggaaggtgagacgacggcggctccctgaagatggaatatacgtctccccgtctagtccctgtgccgttgtcgcatctactattgtctgtgggcgtgtggatgtgtgtcttcaacgaatctgtctttgatggatttgctcggatctgttcatcattcgtctatattcttgtgtctttaggttgggtccttctgatctacactcttcatccacgatggtggccgttctggtgca

SEQ ID NO: 39768 - DNA, 301 bp, Triticum aestivum
  Clone ID: PAT_TA_39768
ctcgcgggatcgacagagcacccgagctcactgtctatcaggtgcttaagctccgggagatgagtccactctatgagatggctaaggcaggcatcgacatcaagagcatccagtggtcgcagcactgagactcttatcacaatgctgttcgctggactgctttagatgtgctcggatggacacatacataggtatatggcctttagctgttctttttatatcctgttttttttataagggaatatgtactatacctgctagtggaagtgtgtgaccttgaaaaaaaaataaaagagagaag

SEQ ID NO: 39769 - DNA, 121 bp, Triticum aestivum
  Clone ID: PAT_TA_39769
tccttcaccaatcaatgatcacattaattgcagcctaaccgcatggctatctcccgggcagctccagcccctgctgcgaaggacctgacatcaagtcatgagtcatttggttgtcaatttg

SEQ ID NO: 39770 - DNA, 424 bp, Triticum aestivum
  Clone ID: PAT_TA_39770
gggtcgaccacagctgggaactcgatttcagtcagatccatggcgctcttgggttgcgagggctctttagtgaaatggtcttcctgaactgtcgccgtgtgaatatgctccaagaacacattgctgggaatggcttctctcttggaacctatctttgccaattcatcggctgcttgatttttcagttgggggacgtggtggagttctaacccctcgaactttttctcaagctttctcaccgcgttgcagtaaccagtcatggctgtacttctgacgtctcactcctttatcacttgattaactaccaaatctgagtcgccatagaccatgaggcgacgaacgccgagtgagatggccatgcgcaacctatacagaagtgcttcagagtgaatctggaagacatatctgagcttgtctcctcggt

SEQ ID NO: 39771 - DNA, 221 bp, Triticum aestivum
  Clone ID: PAT_TA_39771
ggcaccatagtcagtcgtatcaccgacgatgaagagtaactaaggtaatacgtagatgtagtacgtaggatttcttttgcatgctttgcatgaatctagcagataaaatatgagagaggcgaatgcaaagtgactaatttaagaaatgcctagtcaatgcacacatccacggacgtttgaggggatttgccaagtccgaaggtagatgactgtttttttat

SEQ ID NO: 39772 - DNA, 359 bp, Triticum aestivum
  Clone ID: PAT_TA_39772
cctggtggagcgcgacctcatcttgaaccagatgcacaggctgacggcgaccatcgcccctatgcccacggcgacaccaacgctgacgaccagcccgagcacagaagccacgccgacgccgagcccgactacacccacgccgaccccgaccagtctcacggcagaggagcttgccgtttgatgtgttccatgtctatgattccttcctttttgatcgctgaacttttgggtgtgtttgattgccgaactatggcatgatgatcgctgacttgtggcatgatgatcgccgaacttttggccttttttggcagcaggaaagacaagtttgaatttttgggcgtctgggggcgaaatctggg

SEQ ID NO: 39773 - DNA, 316 bp, Triticum aestivum
  Clone ID: PAT_TA_39773
gggacgacagtgtaccccaaattgcctcgtatgaactgatggccaagggtgtagctttcgatctgctccacatggccaagcaaattggcccgcagtgcgaagccgccgaatacgaagatctgtccagggaggaaagcctcgccctggaccgcatcgctagcgatgatcgaaggagacatcaagccttatgatgacgacacagaggaactctcaatgaaagcaccaatgtcggtgtcgaaaccggcggatctcgggtagggggtcccgaactgtgcgtctaaagcggatggtaacaggaggcaaaggagaccatgtt

SEQ ID NO: 39774 - DNA, 421 bp, Triticum aestivum
  Clone ID: PAT_TA_39774
gggccgacctgcaacgccatacgtgaacgcagaagcgcgacaaggcacgaaggcgtactgcagcgctcgtcacgtgcgggagcacagttggacattggagtccgtcgcaaggatgtgagggcgtggagcagggtcagtcgtgtgcggcagcgaccgattatctatttttccctcggtcgatcataggcattcaatctggcgctcgtgacttctaaacacagcagaagtctaaatcagatcgaaacattatcatggaagaaattacaaagctgtcctcgagccaaatctaacccgaataatatcaatcgttggatgaacttaatactacccattacatccggtagtatgatgtaccgtaaaatatctcgacatgacatagtttgttttgtggttgcttaccacatacatcatgtgaaactct

SEQ ID NO: 39775 - DNA, 426 bp, Triticum aestivum
  Clone ID: PAT_TA_39775
ctcgcgggtcgacatggctctcaatactgagtcttactatataagtttgccatttggctcccggagtttgaattaccatggcggatggcaagtcacagaatgcaacgttatgcatacgagcataattttcagatatacaagaatgtgaggctcctgtatcgaaaagaacagatgccgggtgtcaattaacaagaagcgtaccgagaacgacgttgggatcatcttgagcttcttcggcagagatacagttgacatggccacgtgaagcggtgaccggtttagcgtggaacacttttcctgtcggcttgccacggacaacagctttagcagattgattggggttggtctgggggcactcactcatatagtgaccagattcgccacactttaaagaggtcatggaactggtacatggaggagcattat

SEQ ID NO: 39776 - DNA, 448 bp, Triticum aestivum
  Clone ID: PAT_TA_39776
actcgtggatcgacagtactcattatagtaagtcgaatgaaagaacttctactagtaaaaaagtgatttctgttgaagaaattaatactttgagtgataaagtagatgcgcttatgaaaatggttgctagtaaaagtgctcatattgattgtaattttgtgccattctctactttgattgagcaaaataatgatctcgtagatgtgaattttgtctctcaaaacaatttcaatagtaatgcttatagaggtaattttaatcctaggccatttcctagaaattcctctaatatttatggaaattgctaaggtaattattacaataataataggatgcactctaatcttgaaagtaatgttaaaggatttattaatacccaaaaggttttcaatactatggtagaggaaaaattgagtaaacttgatggtatgcctaggagcatggatag

SEQ ID NO: 39777 - DNA, 325 bp, Triticum aestivum
  Clone ID: PAT_TA_39777
acaccaggccctagactgagtcttagcacttgctgtgcggtgcgccacgcctctcgctctacggtgctccaccgctctcgtcgttccgtgaaccgcaaccaatcgacgttgacgcgcctagcttgccttgcggcgctccatcgatcatgttgtgcggcgagttgcagcctctcagcgctgacatgcccatcttgatccacagtgctgaaacgcaattgcaccaaaggtttgctcaagcctggcgatgacgcacatcacgggatcgtctaactcattgccggggagcgctgcagccttgaagggccatgggtcccttatagttttc

SEQ ID NO: 39778 - DNA, 379 bp, Triticum aestivum
  Clone ID: PAT_TA_39778
cttggcgctacacgttctcccaagacacgaatccagccgtgcgttgctgatcgatggaacctagctaacccgactgcgacatggctagatacgtgtcgatattcactgggtcatccatatatctttcgtggtttacatcgtcccgtaaaggaaagagtcatatgtgcggccacgcatggactgtcacgtacgaatgtagttaaaccatattgtcctcgctagccctttctttttcatttcaaaaggaaaccaattaagaatgtgtgttcgttgtgtgtgtgtatttctagctagtccaataaaggtcaaactccaagtgttacgagttatgacacgtttttgtgtttctcaccggggtttggcaatcttcgtggtaaat

SEQ ID NO: 39779 - DNA, 435 bp, Triticum aestivum
  Clone ID: PAT_TA_39779
tcgtgggtcgacgtgagacactatactgagtcctactagatctccaattgctgtgggggggggggggagtagttgtagcatcccaacaatcgatacactatcaattgctaaaacgtgtgcactttgtgatgtctgataattgcagggaacgtcggatgtgattgcaaggaagtggtggaagtcacgaagaatggcggtaattctctaggcgtggcggtagctatatatgaggagtgtacttctttttgtcggactttcactagtgtaatactttcagactgtcctacgaaggttaatagagcagcacataatttagctcagtttaccgagggaaaccaaatgtggcaagaatccctcgattttctttgagatgttctagccgatgatgtaactctcatttctgaataacaaaaacaagccatgatggtttttctc

SEQ ID NO: 39780 - DNA, 332 bp, Triticum aestivum
  Clone ID: PAT_TA_39780
tggaagttaattggttgtcctaacatataaccagggagcaccttgaggaccgtcctccaggaagcagtgcagacagacacaacacacaacagtactttgccatctaaagatagcagaagcattacccaatacacatacatgggcaaaggcccacagaactctcgcgcgaagaaaatagagcaccctacacacgggcgaaacacacaacaggacatggtcttgtgctaacatatgaaacaatggcccaagtagtcagcaacaacaagctgctacttcttgaacttgcgttgggttttcccttgaagaggaaagggtgatgcagcaaagtagag

SEQ ID NO: 39781 - DNA, 435 bp, Triticum aestivum
  Clone ID: PAT_TA_39781
ctcgcgggccgacgtaaccatctagattccgacatctgaagcccatgtggtgatcgttcgccaacgtgcggcgcctaccaaagttgccgccaccatcgacgtccgcgaccttgcggcacctgccgccactgtggaatattgaatcgacctcatctcctatccccgttgcatgcatgtgtgtataaatccatacgctggccgagcgcacgtcgctttcactaagaaacagatcgaatgcattatggtcgttcaacttgacgatgagcagcaagccagcaacagcaaggcgtccctcagaatgtatatgcattcacatctttttgtttttgcgggaaaatagactttgttcttgcttcgatgcgtataaacgtatctctccttatgcgacgggtgatgtaatatgtcacatccatgtacaagctggtatacggaaaa

SEQ ID NO: 39782 - DNA, 432 bp, Triticum aestivum
  Clone ID: PAT_TA_39782
attcacggatcgacataatccacaagctagcctcagacttgccttgcttgcatgatcacgcaagacgtctccacccttccaacttttaacccacatggtgggcccataacccacagttccacaggatcaaaacctgactctcctgtacacccccggtttccaaagttattccccacgcttgacttcgtatgtaatttacgggtcaccttcctaatgctcaattctggcatcagacacaataattattccgtggctttaaaaccactttcaccttctgactaggcattgaacgattgcctggctgcctgaaacttcttattgtaccttccaactttactctcgatgtgtttatttgttcaactcgagaggtactcatatgctcattcatgggttaatctcatatcattacccttataacatactaccgttgcc

SEQ ID NO: 39783 - DNA, 401 bp, Triticum aestivum
  Clone ID: PAT_TA_39783
agtgttttgtcaaaatattcctaactattttgactttttaataaaatattaaaaagaaatccccatataagtgcatatacaaccaggaaccaaagtgtatttccaataaagccgtggccaactcagtctctccatgaccaggacatgcaaccaattaggaactgaggagagaggaggacatgcaaccaatggagaccggagccctcaatttactatgttttccagcagaaatcgctatgcgcaaccggacgtgtacctggccacatcccccactaaagcacgtgtcgcccacctattggtccgattttggctgataagaaaagtcaaaaaaacctggtaaactaaacctgaccaagtttagtatatttagaatatatagagagaaaatcaaatctttggta

SEQ ID NO: 39784 - DNA, 178 bp, Triticum aestivum
  Clone ID: PAT_TA_39784
gaccgcagcatctaatcggggcgtgcacagtcggtgatccacctcgtgagtgacccgatagaaaaggaggatttcaagtacaagatcgaaatgcatacgcggattggcattctctctgtgtccgggagcaggacatcgtgcgtcgggcggctgaggacgacgtagcaggccggtgcgt

SEQ ID NO: 39785 - DNA, 361 bp, Triticum aestivum
  Clone ID: PAT_TA_39785
ataacacccgaaagtgagtcgtattagacgggtgacatctggcccactaacgagctgacaagtgttcccttcggccaatcagaattttacacgtggaaatttcccattggtccgggctgtttttttcttaaggttattggtccgggctgttaacgggttatcggatccaaaatccgaccagatagcttaacagcgttcctttatggtggatgccacgtgtcggtcacccttgataaccacttctgtgatgcgcgatttatcgtaatggaagtggacatttccgtgatgataattttggtaatgtcatggaacacttctacgacagcacatgtatgactatcttgattctgtcataaaaccg

SEQ ID NO: 39786 - DNA, 370 bp, Triticum aestivum
  Clone ID: PAT_TA_39786
actcgcggatcgacgatagtcccaagcatgcatttaatgaagatacccctgatctacagtcaactgcaacctcgcgtgccaagcggcgaaaaattgaggtatgttaagattatctgttgagaaatgaagagaagattattctaaccagtagttagacttcaagtagtggctttttatttatttatgtatcctctccatagaatggaatgtaatagttctgttggctcaaatgttgttaattgttggctaccttgcatttacgctggcatttgattcatctttgtgcaggtaaatcatgctctcttggaggagatcgaggagataaaccaagggctcatagacacgggcctccgtgtatgcaaggatgatg

SEQ ID NO: 39787 - DNA, 435 bp, Triticum aestivum
  Clone ID: PAT_TA_39787
cgtcgcgggccaggtgcattcacattataattcgagccccccctaccggcctaccgctcatgtacagccactacgtacgtaccatcgacatgagactgacatcatcagcgcgcatgttctaaatggtcagcacgaatatgccattgtataactgttctatggttcttggcctagaaaagtggtgctgctatcattggcgtcgcccagaagtggcaagcacggtgccttcatgatcattacttgcacattctggccagcgtcagcaactggattgtcaccatcatcgctgttattgtcacaacctccttatttccccacctctccatcctcataatcctccttcatttcctcgtcgtcaccatcagcttctttgagtcgttgtagagttacctgccatgggaaccatcggcgcaggatgttccaaagcaactgaca

SEQ ID NO: 39788 - DNA, 227 bp, Triticum aestivum
  Clone ID: PAT_TA_39788
gacgcggtgcccgagctcggctaactccatgggaacacccgacatatcataaggcttccatgcgaagatgtcctagttcccacggaggaactggacgagctcaccttcctatttgctatcaagggtggtggagatgttggtcggggaagcatttgggtccacaggatgaatgtgtactagcttcatctctcctgccgactggaaagcggattccacagtcggctttt

SEQ ID NO: 39789 - DNA, 360 bp, Triticum aestivum
  Clone ID: PAT_TA_39789
ggatgggagacgtagacatcactctggctgacgctggcgctgactgaacgggtctcctcccagatgggatgataatgcttgttgatcaccaacggtgaaagggagtgaatgtttggcacctcctggtctttggatgacgcatttatggatggatggacacactgtttaaaccgttattgtatattgatgatcacttgtaggcgatcagtcatcttacacatcgaattacctttcgctgagcaatgattctgaatactgttaaatactcttatgctacctgttttcatcaacatttatacatggattttgctctaactcctccagaaatttatggggaactcacaggacgcgctacatgat

SEQ ID NO: 39790 - DNA, 148 bp, Triticum aestivum
  Clone ID: PAT_TA_39790
atttatccaacatttctcttcttcaaaagccagaggccacaaaagagactgctaaggcacttgactcgaccgtagttgccgctggagaggataccaatgaacgtgaggaaggactacagccatctgaagaaagtttacctcaacaaat

SEQ ID NO: 39791 - DNA, 392 bp, Triticum aestivum
  Clone ID: PAT_TA_39791
aaactgagtcgtaatatcactttgggtgggatatatgggcctggaagaagtgctttggacaccatagctaagagaaaatcttcttcgcgaagacagaagttgagggagtccaaacagtacacggcacgtatccatgtggccgacatctatcaggctatcctggctagcatgagcatcaaatctacaaggaagatatacaatgtggtggatgatgaccctgccccgagatccgaggtctttgcatttgctcagagcttgatagagaaaagaaccctgatcttgcagcggattctgcaggaccaaacagccagaacaagaattatagctgctgaaaaacgggtatctaatggtccgttgaaactggagctgggcgttaggctttcccacccatc

SEQ ID NO: 39792 - DNA, 409 bp, Triticum aestivum
  Clone ID: PAT_TA_39792
acaccagtccccatatttttcaatacaacactgctgtggctgctatcattgagaaggtcctgagtgcgaggaatcctgagatccccatccgcaaactgagggtcaggttctgtttgaggcctgatgaatgtctctccatcagccaagtcgtcgcccttgccatggtaacccaaaagctcgatgttgctgagtttgtggtcctcacggagacgatttgtttgaaatgcactgaagaccatctcctctgttatgccaagcgcttcaatagttggcttggtgattgtcctgccatgtttgctggtctcacacgcctgtggctgcgcaatatgatgtttggtgaactggacatccccaacatcctcagcgcctgtaagaggttgggatcactgcgtctctcctattgtgacgc

SEQ ID NO: 39793 - DNA, 439 bp, Triticum aestivum
  Clone ID: PAT_TA_39793
cgcgggtcgacaggatgcgataacgagagtcgggggagagagaacgagagaggtggccatgggaggaggaatggatgcgttttggggaactcgagtgatggaattagtgaagaagcacgattccggtggtcttctttggaagcggatcaagctaacccctactcgtaaagccaatgccaaaacccccctccgtcgtgtttggcagaatgaggctgttctaagggcgtgtggtgaatcagatgcaccaaatccgccgggagctagcaacacaaaaagctctagcaatgcggtgaaaaatgcgtaaggccgaagagaagctagtcctagtttgtaaggactcgtagattaagtctctgtcgttacctgattttacaaaaataatatttgaaccttgtgtttggttaatagttttgccaaagaagaggcacctccacaccaa

SEQ ID NO: 39794 - DNA, 374 bp, Triticum aestivum
  Clone ID: PAT_TA_39794
gagcacaacatatgttgagctgaccgaggttaccttaaactggatcaaccacctaaaatgaggcccctgaggatcgtcgtctaagcccatagcatctggaaacgcaactagaaaacgggcctggatcattgctagccagtcagattatgcctctaaaggacctatggcagtaccggccaaagcaccccagcaagtaagacacatcatgtagagtacgagccatctctccccaaggaaagtgaaacctgcgtgtcctcgatctccatctatctgctaagcaggtaaggagtgacctgtcctaagagaaacgtttcacttgcctcatgcaaaactgcatcggttcaccttcctcatccttgtcccggtgttcaact

SEQ ID NO: 39795 - DNA, 428 bp, Triticum aestivum
  Clone ID: PAT_TA_39795
tcccctagggtttctggaatatttgtgaatttatagagctgagaggcggtgcaacagagctacgtgtgttggttctatatccggcatgtcttgtagtaggggtcccaagctaggcgtcttggagcggtggtaacacggacacaggattttacccatttttgggctctctcaaagagataataccctacgtcctacttttgattgtattgatatgggtgtagtacatggtacatttatctaccacgagattgttctaatgaatattagatcatgtattgactagcctggcctcactttatataatgtaccagaggcctagggtttagaagagccttcatcttggggccaagtcttgtggaatatcccttgtatgcgacataggctgctagaactggcccaatagtgaaacgccatggggggtcctcttc

SEQ ID NO: 39796 - DNA, 369 bp, Triticum aestivum
  Clone ID: PAT_TA_39796
gcgggtcgacgttcatctctaaactgagtcggaataacaacatacataccatcaaaatatcagacacatatcaaattcacaggaaccggatgaagaccagtttcatcgcgatgatgctcatcgtgatgaccgcagctctcctctatgtgatggtagtttagatgatcgatatcgacctgtaatgtgaagacaaactcgctactcgcggtctcgagacttgtaatgttctaactttgttcggtattttgaattccgagactaatatgatgaattgtattaggagactaatcgtccattgtattcgataaatctgttgtttacatgttgtgctatctatattctgcgtagtaatgtattttttaccctgtg

SEQ ID NO: 39797 - DNA, 389 bp, Triticum aestivum
  Clone ID: PAT_TA_39797
atctttaccaaacatcacatctcatatgctaagcactggaccgtcaatcgcgttggcatcagtgtgggcgctcctgagcatcattctgaccactgcagccttgggattagtcgtcgacgctgtggctggtatgccttcctaggagatctggtggcggcattgaatgccataagcgcctgtcgcatgtattccactaattgcgcactacctcgggcatctatttcaaattcatagaggacgcaacaacttggtatttcctcatcatgagaatgagcttgcacaaagtcgagcagcttatccagacggtcgcgtcaaatgctggatgcatacatgccttactagcaatgatgatcatcttctgtcatgatcacttaataccttcttcagga

SEQ ID NO: 39798 - DNA, 412 bp, Triticum aestivum
  Clone ID: PAT_TA_39798
ctcgcgggtcgacatggcacgcaagtctgagtcgtatcaaaatgcgtctgcactaaaaaaagattgctccttatatgatgcgggcaaacacaggattgcatggtgatgttgccctgggcgccgaccaagaaaagagcaaaacattggctctgtacaaaacagtttcgtacatgcacgactcatgttcggtgaaatgtgtgtgtgagctagactagtacaatacttcttgtacgtgcacttgtgtatgattggagtgttatgtagtttattttgcaccgtaccctttctttacatttttgagaattgtcccctttctttcctcatatatagtctccagctccaaccaaatttaatttcatagaagttcaaagatgaccagcatagaaggtcatagaaaaaaaacattttttta

SEQ ID NO: 39799 - DNA, 370 bp, Triticum aestivum
  Clone ID: PAT_TA_39799
actcgtgggtcgacatcactacccacagtcaggcttaagagggagattgtgggctccaccctgtctccggatggacttgcatatttgcttagctaaagaagtaaaaggcaggtgagcggcctcgtggcggacatttgcaaataacattttcgtttagtgaaacttaaaacacaagtgagtcaggaaaacaagtttattttattgcaccacagaaaatacaatttttacaaaagttttgagtgggtactaaattttgtaacagatgcagtacaaataaattcctagtttttttatcatataggacaaattagtaattactaggagaagagtacaattcaaagaaggcagagtcaatcagtagctcgtttcc

SEQ ID NO: 39800 - DNA, 255 bp, Triticum aestivum
  Clone ID: PAT_TA_39800
gggtccacaccatactcaaaactgagtcatcgtacgtaattctttcatacatgtcactcatgagtcattgcatatcccggaacaccgccggaggcaatcatatagtgtcatattttgttctatgtatcgagttgtaattgttgagttgtaagaaaaataaaagtgtgatgatcatcattattaaagcattgtcccagtgaggaaaggatgatggagactatgattcccccacaagtcgggatgagactccggact

SEQ ID NO: 39801 - DNA, 368 bp, Triticum aestivum
  Clone ID: PAT_TA_39801
tcccctagggtttctggaatattggggtatgtatagtgttaagaggcggtccggggggaatccgaggtgggcacaacccaccagggcgagcttgggcctcctggtgcgccttggtgggttgtgctcccctcggagcacccccaggtgcttctttggcccattggttgtcgtctggtccaagaaaattctccagaaagtttcgctgcgtttggaccccgtttggtaatgatttcgtgcgatgtctaaagacatgcacaaaacagcaactggcacttggcactatggcaataagttagtaccataacctgctataaacatgactacacaatgattataatacatcgaagattgatagtatagcagcatgg

SEQ ID NO: 39802 - DNA, 433 bp, Triticum aestivum
  unsure (1)..(433): unsure at all n locations
  Clone ID: PAT_TA_39802
aggaacagggcacacagagatggccatgatagagattatccgacggatagcagagtgcatgtttcaggtcccgagtgtttcagcagagccatcagagcagcagtgattcctcccaacttcaggttggcgactggagtcagcaagttcactggtgagtccaagcctgacacttggttagaggactaccgagtggttgtgtagattggtggtggcaatgatgaagtggccatgaagcaccttcctctgatgttggagggctcggccagagcgtggttgaatcagttagcacccggcagtatttatagttgggaggaacttgcccgagtgtntgttagaacatttgaaggtacatgcaaacgactagcagggctaacaaagctacaatcttgtgtgcagaagccgaatgaaaccttgaaggattatatccagagat

SEQ ID NO: 39803 - DNA, 434 bp, Triticum aestivum
  Clone ID: PAT_TA_39803
aacatgacaaaatttctcaccaccatctagttttgctaaaatgagtttgtttgtcttaccttatatatatgtgaagaaaattgacggcagcaaatttctcctgaaaataagttcaaataaaaacatgggagaaggtcacatatgtgtaccaggaaaatgtttgcgcaaaaatgcagaagactttactatccatgagtttgtgtacatgctccttttttgtggctgctgcaggctgcaagacctgtcgtcgtcatccccacttagcccatgtcatgaagcttcgctcccctactactgctacacgtaagtgctcgtctgcaatttggcacgaagttgaacaactttagctagagttcagataactgaatggcagaggttgctctagaactacagtagtatacttcagagttcagagtgcagataattaaatgttc

SEQ ID NO: 39804 - DNA, 416 bp, Triticum aestivum
  Clone ID: PAT_TA_39804
gggtcgacactatttgttcaattgaatattgtggcgaatttgctttttgcgtgccgattcaaaatgggatatttttgttttaacctggcaattgctccgcacacggttcaactaaatgagtgtgtgtgatccacatcggaaagcatatgtcaatcctattggaaccgtcggtgatacacagtagatcgcaaacgattcccagcgctattatgtgtgcgtaggttctccggaaccgtttgtgatatcgtgttatcgcacacgagaactgggagtaaaccgtggccaatgcaaaatacaatcccagtcgtatttattgtaggaaacgtgtgggtcccaaactaaaagcacacgtcactcttgcggcaaccgtcggtgatacctaacaaatcacaaacggtctgcagcacttgtatgtg

SEQ ID NO: 39805 - DNA, 431 bp, Triticum aestivum
  Clone ID: PAT_TA_39805
aagacgacagaagggggcggtagtgttcgatagttttcgatttgatagagagagagctagacgtagagcggtggagaagaggaggcgattccgtcccctttccccctgctggagcttaattttctctttgattcacggttgccatggttccagggtgttgttgtggaaagctcttgtagacgcagctatttgttcagcttcgcgggggacttcttggtgataatggaggctttgacaacgctctattcaagttatatatgaatcattgaatcattgaagaggaaattatcatgtgcttgaagaaggaatgttgtcagcccccattgttatactaaactctctgatggctttagtctgttcctctctttactgttgcactgcagtttcccagtgtcgtagttctgtatttaggccataattaatcttttttg

SEQ ID NO: 39806 - DNA, 407 bp, Triticum aestivum
  Clone ID: PAT_TA_39806
agacgacagaaggggctccaattcaaatggctgataaacaggaaacatagttgaatgtacagacattgtatgagagacagatgcaatagatagtgtggaaaaagatggcatgaaatagttgacgtgtatattgtttaactaaaacggatagcatgacataatttcacatatatgatgtctatctaaactggatagcatagcataacataattcacagatatgatgaataactaaacaagatcacatgacataattcacctacatgttatctaagtaatcaggatcgcatcatttaattcacatatgtgatttatatgctaaacagagggcattagatatgatgtctgaactaagaacatggtgtttaatattgtgtatatgatgtctaatctagcctcggctttgtc

SEQ ID NO: 39807 - DNA, 298 bp, Triticum aestivum
  Clone ID: PAT_TA_39807
tcccagagtaaaggactccgaccagctcacctaagcatcttcgacaacttacgctcgatcatgtagtatcagatttgcaagttgctcactgagattttacagtattgctgacatgaaatggagactgttcttcatgcatacattccaatcatctgtccatatggaatatgacggttaatgcagcatagccgaatcggtcggagacctagcatgatctttggagggttattgctttgctcaatttgtggatgcatcgttgtgtcatgttgcttgtcataccgtctagtctgtgtaagtt

SEQ ID NO: 39808 - DNA, 233 bp, Triticum aestivum
  Clone ID: PAT_TA_39808
gggtccagcgcggagcttgaaaggtagtcgaagaacggatgcagattgtcgtctgcatcgatgacatctgaaagacggaatgtgtgctacgttcacggctgagtggatggcaagtgtggattcctccctcggagtcttagtcgtggtggggtggcagatcttgagttcgatggcgtgtccggggtggtgcccccgattcgagtcgttcagagacagtgacctcacctttggga

SEQ ID NO: 39809 - DNA, 421 bp, Triticum aestivum
  Clone ID: PAT_TA_39809
tactaaaggaaacagtgctactctaccgttcttttattacaaacattaaacatatagtagtattatataccaactacaaattatttgaataaagaaaacataaatttgaataaagcattcatgaaaaccaagaattgaaagaaatcgaaaatttgaaaaggtatgtatcaattgaaaaaaagttcacaaaaagggaaaaggtttgtgaatttggaaaaagttcatcaaaatttcaaaaaaatctcattgaatttggaaaaagtttgtcaaatttgaaaaatatttgaaagggttcattgaattttttcaaaatcatacaataaaaagcattaaattttaaaataagttacagaatttggggaaaaatcatcaattttgaaaaaaagttcacaattttgaaaaaaacagtttatcaattttg

SEQ ID NO: 39810 - DNA, 416 bp, Triticum aestivum
  Clone ID: PAT_TA_39810
tacaagacgcatgtggtggcttcatcgatctcaaaatgatataccggttcaatctctcgaagatgcttataagaatatagatgcaagggcttatagggacgagtgtatgtatgcatgtacatgagcgtgtgagtcttagaaatctttggaagttacataggcggtgcgctggtggcgtacatgaattaccaatccaaatatacttgcacgaggctctgccgtaccaccacaactgcttcaggtcaaaaggtggccggtgccggtgcacatcacccgcaccagatccctccaaaacaataaaatctagtgttgtaaggtatcatttcatctgttccagcacgagcggccggctcagcatttccatctgagtagtccatccgtcttggaaaacttgtcgtaacctttgttaagcaatc

SEQ ID NO: 39811 - DNA, 373 bp, Triticum aestivum
  Clone ID: PAT_TA_39811
tgacccaagttagtttcaatcgatttgcttcaagtgggaatagagggacgacatagcgatgtatgggttgatcttgagagtccgtccatgcatgatctatagtgctgctcacatgggttcacttccatgcgatgcatgcagaatctcatgagcaacatttagttcattaagcactggtcattagcatttaattaatcaaagaaaaaccagccgtcacagccattatctgaacggcaacacaatgtgttttatgcaatcattagtggctatatgtgcaatgaaaaagaaaaacctttaaaacttgcacacaatttgcattgaatttgcactttctgaaatatgcagagaataatataataatgcatctgtcgca

SEQ ID NO: 39812 - DNA, 240 bp, Triticum aestivum
  Clone ID: PAT_TA_39812
cgggtccaggctatcctccaaacggagtcgtacaacaccgaccaccccctattgcaattgcaatgacagagctgaaaaagacgaggcgaacggcggcagcgtggtgtttctgccacatgattttcattgcaaactttctgcaacatcacgtgtgttgcagaaattccttccgcaacaactcctgtgttgcacaaaaagtgaagataaagaagtccgcagcatctttgtggcaaaaattct

SEQ ID NO: 39813 - DNA, 400 bp, Triticum aestivum
  Clone ID: PAT_TA_39813
gtccacctctgtaaataaagggacgacctgacggtgattcagggcatgtaagatcagaccgagagccaggtcaaacgatttcgctccctggtaatcgagacataagcaatcccactcaaaactggatcgtaggcttttaccttcaccttaaggggccgaccagtataaatcccgtgtcctttgtcccgattaacccctttaagtttcctaattgcgatggctccctcactaagtccttccactaggacatctaacgtgacaattccatgacacccatcctcctcctccttccacaacccgcacaccccgaccgctggtgcaacacttccacacaaatcaccgacccttccaccacataagcgcctccctaaacctatggtggacacagtatagacaggat

SEQ ID NO: 39814 - DNA, 419 bp, Triticum aestivum
  Clone ID: PAT_TA_39814
cgggtccacgcggcgtgtcgaacccaaattcttggctgccgctgagggaggggggcgcggcgagaatttcggccaggccactataccacaccaaggtaactggtttttgaaaagtttgtgttttaaatttttttgtttagaattttagaaaaatgtccatgttcacaaattttgttcataaattaaaaaatattcaggaatttcagaaaccgctcatgttttaaaaaaattgtttgcattttcgataaatgtttgaaaaattcaacaaaaatgtttgtatttttagaaatttgtaaacattcaaaaaaaatgttcatattttaaaattgtggtcaaaacttgttcagaagttgaaaaatgttcccgttttaccttttggtcacaaactaaaaaatgtttcgtatttttcattttttttt

SEQ ID NO: 39815 - DNA, 163 bp, Triticum aestivum
  Clone ID: PAT_TA_39815
cacttgtcgtgagaatgaatgaaaaccgtcttaagttttgtagccgatcgatctgtagcaaaactggatatatcatgctgctttaacttatcacctgcttgctacaattatgggagtatgggctaagatgttcaacatgttatccggtgcttgttctgttctt

SEQ ID NO: 39816 - DNA, 417 bp, Triticum aestivum
  Clone ID: PAT_TA_39816
cacacgtggcacggcacagcagaggcccattccggtgaagatgtcgggcctgtcaaaataagcggggcagcccattatcggcctacttgagtcaggcccatttacaggaccgcccatacaagttacacagaactggaccatcaaaggcccattcgagatgtcgacaatttcgagcccatcattagtttaagcccgttaacgaaccgctacgttttgtggcccaattgcggcccgagcttcttttggcctgttagcagcccatcgtcagttccagcccgttaatggcccataacgtcgtgcggccttttctcggaccattctgcagttgggccaattctagcccgctgtgaccttaggcctgtcctcggaccattcggtacatgggccaactcttgacccattttgtcgcttgacctg

SEQ ID NO: 39817 - DNA, 451 bp, Triticum aestivum
  Clone ID: PAT_TA_39817
cgggtccacttcgccacaagacaatctgccaccacctccgccgattttgccggaagaccatcagccgtcacctagacctactttggttcagaaaatagatgacaacactgtaacttaatattacacagaacattgaggaggactttgataaccgaccttcaaaaaaaagcaaaaatttctgaatcaagtgttctggagccatcacctatgtcaacatgtactccagtttctgagtgttttgaatcgattgtgccaaaatcagataattagatagatccgtgctccattgccatcacctccatccccatctagctcgacattatctcaagaacatcggtcgagccgtacaaatggcgcctgcagcggctacaccagaggtatttatccccttgatgaaagctaatcactgcatgtaatcccctgtttagttgttgttctggcctggttatac

SEQ ID NO: 39818 - DNA, 456 bp, Triticum aestivum
  Clone ID: PAT_TA_39818
cgggtccacactgcaccataaaacaaagcatctctactctaacattgagtcctctcgtgattcagtggaacaccattataagttcacaacaccagaatgaatcatgtcaaaaggaagcaccatgcaagctcataatacaatacaattaacatttaacaccttgcaataaatatttgttctgttgacagtcacaccatgctgataataaaacaacttttgatggacaaaccgcaagaggaaaaatatggtgtctttgcattttgtgccaagaagagacataagagaaaaaaaaggaagaacaaacagagcaaaaaggagaagacacaattatgtggcagacaggtacagatacatctcacatgttcttggcttcttctttcttatgtatataacaagatgagacttgggactgactgactggaaaagagaagatcacaaacaaaatgacttcactga

SEQ ID NO: 39819 - DNA, 424 bp, Triticum aestivum
  Clone ID: PAT_TA_39819
gcgggtccacactattcacgaaagtgagtcttatgaccctcttggggacatctccttggcctctcccagtaccccttttaccaacaatcagggtgaaaaatcctcctccgtctcaagcggacatggcgtggagcactttttgaatttgcgaacactttttgaattcatggacatattttcaattcacaaacatttgaatttgcaaagatcttttgaaattcacaataattttctagattcacaaacaatttttgagctcaagaacatttttttgaactcgtgaacatttttataatctgcacctttttaaatttgtaaacaattatagttttagctcaagaacatttttataatctgcaccattttaaatttgtaaacaaatacatttgttagctcaagaacattttttgaattcgtgaacatg

SEQ ID NO: 39820 - DNA, 279 bp, Triticum aestivum
  Clone ID: PAT_TA_39820
cgggtccacattgtagttgtgagaaagccacaattcataattctttcatacatgtcactcatgagtcattgcatgcatatagagtcatatcgtgttctaagtattgagttgtaattcttgagttgtaagaaaataaaagtgtgacaatcatcattattagagcattgtcccagtgaggaaaggatgctggagactatgattcccccacaagttgggatgagactccggatgaaaaagaagatgccataataaaagagaagaggcccagtttgaatgaat

SEQ ID NO: 39821 - DNA, 458 bp, Triticum aestivum
  Clone ID: PAT_TA_39821
cgggtccacccataagtaccaagtgattccatctccaatatgacgtcaatatctaaaatctctctacttggggaaatccatcaacggcgtctactgtgcactaatctttaattcagaggaacggctacggatttggctacttaatgatgatgaggtacgcggtcaaacaaaatgggtgctcaagaatgacgtgagcattcaaccactcgtgggaataacacatcaacactttggccttcaaaacaatggactttggactttgcaaaacacttcctacgaaccaatggcggagcagaaatttgaatgggatcctgacagcgacatcacccttgaagctgaggctaaggctccaatagatcaccttcatgatgatattcgtaccctaagatttcatccttacaaggagattctcttcttatggacaaattgcaaaagagtagtagcttaccatttgaaca

SEQ ID NO: 39822 - DNA, 459 bp, Triticum aestivum
  unsure (1)..(459): unsure at all n locations
  Clone ID: PAT_TA_39822
ctcgcgggtccacacgtcacggaaaaatcgttctggagatcagcccaagcccagcagaagccactcctaaccatgttcgctcgattgacaagagcagggcggaagattggatcgagggcgcccgcatggcctcgccgccgctgtcacctggattcgctagccgcctccttgagtcacacccgtcgccgccgcgagtaagctccaccgttgctgccaggaatctcgtccccggcaaggtaatttcctctgaatccctgctctccctaactcccttatcctgctgccctacttgctgcgtgtgtgctgtgtgctgtgtgcgtttagccatgatctccgcgagaaagctcaagtcnctcgacttttacaggtaccatccgcctcccttccgatcttcagatctccatatgtggtgaatgtggtgttttggtttttcgtcggattactatctgtattcgggga

SEQ ID NO: 39823 - DNA, 354 bp, Triticum aestivum
  Clone ID: PAT_TA_39823
cacatttcagtgtttatgcggtgtccgagaagcctactcaacccgccgcattaaagtcggcttcgcatccattcgcttgacgcgcaacttcgacgctgtgcaaatcacaccgccccactcctctcagctcacaacctcttcgatcctctccgctctggcggcgtccacacctcaccatgcagaaatcttggttctccgcaccggcaagcaatggctcctgatacggatcatagcgccgccgcatcgctctccgaagcctttgacccccacggtggccaatgagcagtcgccgtaccagcagttgtgtatcttctcagaggcggcagtcacggatgtggagtactggcagcacat

SEQ ID NO: 39824 - DNA, 291 bp, Triticum aestivum
  Clone ID: PAT_TA_39824
gccacattgagcctgatatggatgtcaaaagggcaatgaatgagatcaatgcagcttccaggatgatgtcggcaacgatggacggcacagaggcccaagtgattctcaagattagagaaccacagggcaaaacccactcaaagtacgtgactggcgtggacattgcactgtagcgtacaggctaccgtgaatggtctgagacacaggtgcttacgttctcggcaaacgtaactggcactacagctaaagacatcaaggacatcgttctggtcagccatgtatttcgacacc

SEQ ID NO: 39825 - DNA, 267 bp, Triticum aestivum
  unsure (1)..(267): unsure at all n locations
  Clone ID: PAT_TA_39825
cggtccgagaatcncgggtccactgtgtgcactcgaactatgtcacacaaagagccaaccccatctgctgtacgtaccttgtatagaaaagctttaccatctgttgccaaaacattctttctggagattaaattaagtatgattattaagcaaccacggccataccacagatatatatgctagaactttactagactgttgtccgatgtgttacattaatgggtgccagttcaaactttaacttttaaaatgtatgcagacctgact

SEQ ID NO: 39826 - DNA, 377 bp, Triticum aestivum
  unsure (1)..(377): unsure at all n locations
  Clone ID: PAT_TA_39826
agacactaccaagcagtgggacacgatgtctcagcagcccagtatttgagtgttttacctctctagattatatttgcaagcgccgatttctttttggatgcctgcaaatgccgatgaaatcatcaatttcttcgctcggattgaacacaacttctgtcactgcacacgcacaaacacgcaaactgatccagaggtgtccagatttagtatgcatacatatgtgacagcgtgaacaaattcaatcttggacccagtcaaatatctatttcaagccgaatgcatggacaacatcagacgtgtgaagtgcacttccataggcatangaaaaacgatgctgcncggtgctttcagttaacaaagcacagtcactaatgagt

SEQ ID NO: 39827 - DNA, 267 bp, Triticum aestivum
  Clone ID: PAT_TA_39827
ggtcgacgatcgactctaagggtacctgactcgcgatcgtggcttagggaaacgtaataataacactgtcacgttcatggtcatgactagtgttcctatcagtgttgtcaggaccatgggcatcgcagcgtatgtgactcacattatggagtatcgcttgtgtgtgttcgttaatagctggtgcatgttgaaccacggcacttgtgtgctatctaatcggacatgtaggttcatcgaagttgatggcagcatggctgagctcatcag

SEQ ID NO: 39828 - DNA, 434 bp, Triticum aestivum
  Clone ID: PAT_TA_39828
cggtctagaattcacgggtagacacatatgtacatgtgcatgtcgccaatgacttgtgggaagcgctcgaatctaagttcgaggccgccgattacaagatgtatattatagagcagttccatgattacaagatggttgagaaccgtcctgtactggagcaggctcatgagataatatgcattgttaaggagcttgagcttctgaagtgcgagttacggggcaagtttgtcgcgggctgcataatcgctaagttccccaattctcggaggaactttgccaccactctgaaacatcagaggcgtgaattcttcgtggaggatgtcattggccatctgagtgttgggcagaattcgagggcaaaggactcgcacggaaaatgggccgaaaggacttctgttgccaacatggggaagcacgggaacttcaactcccac

SEQ ID NO: 39829 - DNA, 356 bp, Triticum aestivum
  Clone ID: PAT_TA_39829
tgacattgatattcctgctgatgtcaaaaggcattataagctgttgcataagctcatgagcggaagcgccaacaaggaggggaatgctgcagaggaagtcttgtccctggaatctctacgcatggcttaccctaccttgagcatcacggatggtgatgatattgtttacttgttggccaagggcaccggcatgagggctatgccgacagtattctctgttgatctcagtatgcggactctgcgaggagtggcgaagctacccaagaggcaccttggttttatgcgctacttccttgccagtggaatctccaaacatatcaggactccaggtagaagtgattcgcttgggcaaactg

SEQ ID NO: 39830 - DNA, 346 bp, Triticum aestivum
  Clone ID: PAT_TA_39830
ctcgcgggtaaacgctgcgcactaacgagagtcggaggagggggattgtcagcgacagagcacaggaagagcatcaaaggcccagcccaagacccaaacgcaagcctctacttccgtctcggcttgcaggcctagaatgggcccttggtcttgtaacgatataaacagagtgttccccttcgggagtaggcggcggcagatggctggtggctggcaaggatagcgtgtgcgtgtgtttctctctcctccctctcgatccccctttccccatgggtttgtagctcgaatttgtaatcatggagtaatggagaggtagccctgacagaaagactatgggattcaacac

SEQ ID NO: 39831 - DNA, 419 bp, Triticum aestivum
  Clone ID: PAT_TA_39831
ctcgcgggtagacgagaggtccgagatgcaccctcagaatccaatcacatgtgaacagattgctctcccttcagtgaccaccattgagcatgtgaagcccatatttgatgagcatggtgatgtctgcaagtacgagatgtcatggcacactgggacgcacagaggtcataatccgccatccatcttcgctcttgccgagctgaggggtagactctattggaaggcgtttgtatttcctgatacatcctcaggaagctacattgtggtgctcatccacaatccacaatgtcagctctcatttgcaaaggcagggggtgataagtggacctggctaccgcctgattatctctatgatgactgcacttataaagatggcatattgtatacagtgaatgttaaaggagaattccacgcattcg

SEQ ID NO: 39832 - DNA, 440 bp, Triticum aestivum
  Clone ID: PAT_TA_39832
ctcgtgggtcgacgcaactccctaaattgagtacgtatgaactatatttagttgcgtaaacggaacattacttaaaaccttgcaaacaatgtttcaaatttagaacactttaattaagttaggaatattttttaacacacacgaacgaatttaaaaattccagtcatcttttgaagctatgaagaaattttcaacttcctgaacattttttcgtaaatgtgaacatttttggaatttgtaaacaaaactcgaaaagcggaacttagtttgaaattatatacaatttgtttaaaacaagaacatttttaaaattatcaatacatttttgaaaacgtgaacattttttaaaattccagaacatgatttgaaaacatgaacattttttgaattggtgaacaaattttgaaaacagggacaacatcctagattcataacaaaat

SEQ ID NO: 39833 - DNA, 439 bp, Triticum aestivum
  Clone ID: PAT_TA_39833
caggtctagaactcacgggtcgacggttgacttgaaactggttcataaaatcaccccctagtggtgaattaatggcagacatgcaactgaggtaagacaactaattgggtcaagttgcgggttgacgatggacttgcaactaatgcaaaaaaagagtcgggacctattgcgatgacaaatcaaacatcaagtcaagttaggaatcgagggtcaacttgcagctaaagaaaaaaaagagttggacctagttacaagttaatagtggacttggaggaaaaaagggtcgatcataattgcaagttgagggtaaaattgtaactaaagcaaatagaaagaagcacaaaaaaggttaaacaaaacatcgactctaatgaaaaataagacgaaaatgaaaagaggagaatggggagaggcaaagcagccaaagaatggaagtgat

SEQ ID NO: 39834 - DNA, 385 bp, Triticum aestivum
  unsure (1)..(385): unsure at all n locations
  Clone ID: PAT_TA_39834
ggtctaggactcacgggtcgacgatggacgtgaagcttggtcatgctcgccatgcggtttggtgctcgtgcgcatgcagtccggcaagtgctatctgttcccctgcagtccgtcaaccatgccatgcaactcagagacacttcccatgcggttcagagctcgtgcgtgtgtaatctagccagtgtctgtgcatgtacagtccagcgagcatccgtgcacagcagcgcctctgccacaacattcagtagaggattcccctagtttggaaaatgctaacttttggattctaagacgaattaggtcncttaattatgatgatatgttgctagaccaattagtgtccatgcacaacagcttctaagaccaattttgaattaacttttgg

SEQ ID NO: 39835 - DNA, 310 bp, Triticum aestivum
  Clone ID: PAT_TA_39835
ctcacgggtagacaggatgcgataaaatgactcataggagtacacatgtttggttgggcatcgcccatgaccccaatcttgtacctatgacaattacttctgaataaataaatcaggcgagatttctcaaaaaataggatattccgaatctaaacccccgtgtcaaggtcggccttcgtgcatgggctgtgccttgcacagcggggccaggtgcggaactggcccaccaaggcaatactgggccggccggcaagccctacactcggataccggagcctcgtgcgttcgcccaaaaaaaactatgtgcatc

SEQ ID NO: 39836 - DNA, 420 bp, Triticum aestivum
  Clone ID: PAT_TA_39836
aatttacgggtcgacgtccacataataccactagaggaaagacaacatacatctcatcaaaatatcaaacgaatcccaaattcacatgactactaatagcaagacttctcccatgtcctcaggaacaaacgtaactactcacaaagcatattcatgttcataatcagaggggtattaatatgcatataagatctgaacatatgatcttccaccaaataaaccggcaagcatcaactacaaggagtaatcaacactactagcaacctataggtaccaatcctagacttagagacaaaaattggatacaggagatgaactagggtttgagaggagatagtgctggtgaagatgttgatggagattggccccctcctgatgagaggagcgttggtgatgacgactgggatgatttccccctcc

SEQ ID NO: 39837 - DNA, 414 bp, Triticum aestivum
  Clone ID: PAT_TA_39837
ctcacgggtagacagaaagcccaataagctctacgatctgggacacggagggaaacatttaatcatctcgcgagctggttaagggatgtgaggcaatttgcaaagggcaacatgacaataatgctagttggaaacaaatgtgatctatctcacaggcatgccgtgagctatgaggaaggtaggaagttcgcaaatgagcatggtctgatctttgtggaggcatatgcaaaagctgcacaaaatgttgaggaggtgacagactgatcgatccttgttgcatctctgtgaaattaacgcctctctaggcattttctcatgccatttcaaatgcagggttttgttcagactgctggagtcatctctactcccaatgtctgagttgattgaattgtacggtttaatttcgtgcaaaaa

SEQ ID NO: 39838 - DNA, 410 bp, Triticum aestivum
  Clone ID: PAT_TA_39838
ctcgtgggtaaacgcgcatggctaaaggtagtcctatgactgcggcttgaaccttggccacatataccatgtgatgattgttgctactaatgatgtatccacatcgtaatcctgagccagcatgtgtctcgggaaaactagtttatgaactgtgggaattcgtggatgcatttctagtcatagtaaacagtccttgctggcacgacgttgttctggtcaggtcagatcctctgcctttcctttgcctgctttgctggtccgacagaattgaccgtcccgagtatgtgcatgttgttctttagtcggtttgttccggtattgcctggaaacaggaagatctcatgtgttaataatcatcccctgtctatgatctgtccatgcgcgtcaagattccgaaataacgatcccgc

SEQ ID NO: 39839 - DNA, 406 bp, Triticum aestivum
  Clone ID: PAT_TA_39839
aaagggtaagtgttgaaagatgtccgcaacggtaaactccattacgggagcccaacctggcgcgactggctcgagagtgagcggaccaggaccaacagccggatatgagtccgggggtccgggaatacaggcctccacagcggtgggacccgtgttcggctctaccaccgataagtgtgcggcctgcggcgtggggtccggccctccgtccataggcaacgcaacctgccctggatttagttccaaggctgcttcggggatgatgtcctgggcactgtccgatagcaggtctaggtcgtgcttgtcgtggctgtccgacgctcctggcgtaggctcgaatccttcgaacatcaagtctccgcggatatccgccgtgtagttcaagtttccgaacctgatctagtgg

SEQ ID NO: 39840 - DNA, 123 bp, Triticum aestivum
  Clone ID: PAT_TA_39840
gggtcgacgtaccacgggagccttaattccatttcgtgggtgacatctgtcgcgacaggtgctgcgccacgtgtttcctctagggaatggtgatttcccacgtgggaccaccccagttgtctg

SEQ ID NO: 39841 - DNA, 189 bp, Triticum aestivum
  Clone ID: PAT_TA_39841
gccagtccctatattgagtcttaataagctttgtgggtgttttcatttttctctcttctttttcccccctataagttggacctcctgttctttgccctatggctgtggttattattatctacacgatctgtggccgtttgcttgtaaccagatgggagagcccctcctgattaaaaactgtgtagcccc

SEQ ID NO: 39842 - DNA, 444 bp, Triticum aestivum
  Clone ID: PAT_TA_39842
ggtctagaactcccggttcgacatatttttcaatcccactaccgttaatacaccaagttcatcaaagcactcacatctacacagaagtaggtttacacaactgatggttcattagcaatctcaaaaacaatcaacaactaatggttcacgttaaacaactgatttcacgcgaacataagcaatagcaattgattagcactcccactataaataaatataaatctctgtaattagtttattgaagcaaagttaatgagagaaaaagttatcactcaaatgtgttatctccaccctttgtcgaaagtttgatagaatctgagtccagtcgtcgcaattaggcttgactaaccccctacagttttctggccaaaaaatggttaagcaagcttttgggcctggtttatgaccggctaagttgggtttggtagtatggtcgaccatgat

SEQ ID NO: 39843 - DNA, 354 bp, Triticum aestivum
  Clone ID: PAT_TA_39843
aggtctaggactcgcgggtcgacggtgatcgcgaaagcgtatcatgggatccttttgaggtgtcaggcgggacacgccagcgcttttctagggtgcggtgctgaccgaggattgaccatcaaagttgcatgcagccatgcagctagctgggtgccgggccccaggaccaagtgacaaaagagtggtgacaaaggaagagcgtgtgcgtgcgcttcttctatttttttcacttgtctttttttccttttataaaagctagagcgtgtgcattggaaacgtatctactaagggcatgtacaatgggggccgtcggtgcacgtaaacaaatagagttgaaaccatcgcttcaatcgc

SEQ ID NO: 39844 - DNA, 396 bp, Triticum aestivum
  Clone ID: PAT_TA_39844
cacaaaggcccattataactaacacatgtactccatgaaaagcctatggacaaaaccttcaaatataactcgaggcaaccattagaccatagagattgtcatcaattaccaaaaccaaacatgggggcaccgcatgttctttcggtgtgtcatcatcatccgtcggtgcgtcattattatattatgacgagagtcctgcatggactcaacaattatagtgattatgagaacatcatgtgtgatgttcacgacatttggcctttcacaaccatgcacatttatcccttcaccatgtttactccagcattcatatcccaacacgaatctcctcgtgaccaaatgtgtctggatctctgtagtgcttttcatactttgcaaatcttgacactccaaaca

SEQ ID NO: 39845 - DNA, 163 bp, Triticum aestivum
  Clone ID: PAT_TA_39845
aattcagggtcgacgccactatcaaactgcaaaacggaatccttagaagtgtgtcgatcatcattcatgttcacatgtgactccatttcaagaaatatccagtggccgcattatgccagaacgcactatcatcattctacatagcgaagtgggtatccgtcgc

SEQ ID NO: 39846 - DNA, 352 bp, Triticum aestivum
  Clone ID: PAT_TA_39846
gggtagacttcgttgtccataacaatgcacacattgttttcacaactaattgcaacgcattcgtagcaaatatattagagtgtgacgcgcccaccttcttgttttgtacacggaccactatggttgtttgatatgtgtttcacgtgcgctagattcgcattcaattttgatcttcttgttgattatgattgtgttgtttccttttgttgatatggtcttacttggtgcaagggatattggtgctcagggtggagcgagctattggttggtcactatgatattgttacgcaccacagtgttagcgtacatcggtgtttcacgttagcctcgtacggatgccacgattatctac

SEQ ID NO: 39847 - DNA, 413 bp, Triticum aestivum
  Clone ID: PAT_TA_39847
gggtagacacggcgttcgagatcattgctaactatggagatgccgaagttgcgacaccaaggaaatcatcgagatcatcgccggggagagcaaggtgaggacggcaaatttgcaagccatcgtcaaggtgtgcatatgagttcttgtaaggtgcgttcaagaattcggtggtgtgagtcgtctgctgcacttgagatgcgtcactgacggaagagaattgagagtggagagcggatggaaaaggaaattgtgccttgcatttccgttcgtgatcaagaagttccaacgagttcatcatatggtaaaggtgagttgcacgtatatggcgagttgtgttgctcctagacaggaggtgtcgttcgataagatatgggatcgacggcaacaagaaaatgtgaagatgttggcgggtg

SEQ ID NO: 39848 - DNA, 270 bp, Triticum aestivum
  Clone ID: PAT_TA_39848
ctcacgggtcgacgttcatctctaaaatgtctctctgatacaccaatgtagggaaacattggtgtaactgctgctgttttgttctctctgttccggtttcatgatcatatcggtcatgatgggtaaaatagggacagttcatgtaaacggatgggcactggacatggatctgtttatttaggtcaccctatcactttgtaagaaaactcattattgcgaaagtattactgaaagtgcatctgtgcgtctagcagttgcatcgtcctgtcc

SEQ ID NO: 39849 - DNA, 411 bp, Triticum aestivum
  Clone ID: PAT_TA_39849
gggtagaccgccgacgaccagcatgggtcgtaagctctccggaatggcccagccagtcgtcgaatcctcctatgtcccaacggggtcgggcggggtaatctgtgtcggcactaggatgaaaggggcgcgtgcttcctggcacggcaggggaaacaactgcttcaccatgtctgaacctccctgcgtcgccattgccgcctccctctctcgctgtcggtgtcgctgcaacttccggcgacgttctccgccttgcaagacagaaccggcgaagtgacgccgacggacgaggtggatctcgtctccgtcgcggcggtcggggacaagctagacgacatctcgggcagtggaccaggaccggtggcgaggatggggaacaacggtgaaggatggccaatgctcggccacgggaaa

SEQ ID NO: 39850 - DNA, 348 bp, Triticum aestivum
  Clone ID: PAT_TA_39850
actcgcgggtagacaggagacgctacatagcgtctgagcatctgccctccccgtcgaggtcgctcctcaccatcgcaggcacggtctggtcggggccacgacgacgagaggagcagcagaggataacttttccccacggatccttctcgtcttccacgtgattcgagtctcctctctccatcaggttttgaaggcggttttgtgtagaacagccacggagcagaaacaacgaacatgctgcttcagcaacagcgtaatgatcctgatgatactcttatcattttgttaacgtaatgtgtgttctgtcaatgctcgctccggatgctagctagacctactgggtagcat

SEQ ID NO: 39851 - DNA, 346 bp, Triticum aestivum
  Clone ID: PAT_TA_39851
gggtcgacgactcaatcccacacgcacgttaagtacaagacatatcgcctcatgcactccaagcaagttcagggagggcgaatgagttgagctccaatattagaacatcgaagggtagtagaacgcctctgccaacaaggtaagcttgagcaatggaacgtggtctgactgtagccagtacaggcgtcgttgctgcttccttcaccagtgagagaagaggataagggtcaaactggagatccgtcagtgcccaccaaaaatcgagatctgcgccgagtttcacatccagctcaattacctagcatgggtcgtggttcctcaacaaaacatcaggcaacagagatat

SEQ ID NO: 39852 - DNA, 251 bp, Triticum aestivum
  Clone ID: PAT_TA_39852
gagactaatcatcgcacatgttccatttgctctgttcgtgtgcagcgggtaactctactcatgtattggtgctcttgggcctgaggaccgggcagtgcgcgcaggagcctaccgcttaattgtgggtctgtgggatgtggctgtaattgtggtcgtacgccatgaccggagtagctagtagtgtgcgctgcactgactggatgcaggcagcgatgcgacgcatagccggagggaggttaggggtccaccga

SEQ ID NO: 39853 - DNA, 364 bp, Triticum aestivum
  Clone ID: PAT_TA_39853
gggtcgacaggccacccaatagtcagtcgaaagcaccgtatgagattctgcaggctgcagcatttgtcatcgcaaacgccacaagagaacaacctaccctgacagggaatgcaagagcaccatcggtggtgctcaaagtcagatgtgagagttaatttttctaaatcagaaacttgtactctgaagattttctagtgtgtttcagtgatcaatgcgcccttgtgttcctccagttcaggacgtcagacttactataccattcagtagactttgttgtcgttcatcactattttcttgggttcctcttgggccgtcagtgtttgtaagcgatgctattcatgtacgaagtacttgcgaacttttg

SEQ ID NO: 39854 - DNA, 396 bp, Triticum aestivum
  Clone ID: PAT_TA_39854
tggacatataccccggaggatcatattttacagggatgttgtcagcaaaggacggctcaatatggttattgagcatgaactttctgccattaaaaaggcatgtgcgtcgctggatcctatttataatccacaagttaccattattatggttcagaaacagcaccacacacgtttgttcgctggtaactatggtgttgggagcacaatttttgaaagtggaaatgtattgccaggtactgtggttgataaagaaatatgccatcccactgactttgatttttacttgtgtagccatgctggcactaagggagtcagccggcctgttcgttatcatgttctctgggacgagaacaattttacgggcaacgctttgctaattctcactaaccatctatg

SEQ ID NO: 39855 - DNA, 336 bp, Triticum aestivum
  Clone ID: PAT_TA_39855
atccgtcccaagatggacggtggcatagaattgagccaccaaatccgcatcgaaatccttgttgaattgcatgatcctgagaatgttcagctgagtgcacatctgaagagcttcgccaaagtactccgggtccttccccaaaacatcagtgtcaatggagcgaacatcaacaaaaagattcctcctgggcttgatcacatcaaagtagatggcaaactgaaaacggttccaaaacgggcggttgaccaaagtgggttcttggtccgccgcataagggttgcggcgacgcttctcccaaaactccttgttggtcatctcagtcacagtcttcccttt

SEQ ID NO: 39856 - DNA, 350 bp, Triticum aestivum
  Clone ID: PAT_TA_39856
tgactcatcggagctcgacgacaatctcgggagcatcgcgcggtcagggagggcggagttcaaggacggactcacagcaggcgcctatgtgtcgattagtagacagtgtggtgtcggtttcaagtcttcctaaatcgtctggtaaaaggttgtctgtgcctagtcacgcaactattagcatgtgtatgtgtgggagtcccaggctggtgtctctgtcagtgagtcacgtgatatgtctggggagcttcactataggggtaataagacagtccactaccacaacgacgactaaatggaatatcttgaggaccgcagtagctgggatttagtgtgtagtcgttcagagttta

SEQ ID NO: 39857 - DNA, 291 bp, Triticum aestivum
  Clone ID: PAT_TA_39857
agggctatgaaaagcaatgtgtaatatatttgcagctcacctgatatgggtaactgtcttataaaacgatctagctgtatagagtgtcatcatcagatgttgccaaggttgctccaacggaagtactcgtcttgcctcagttttctgtgaaatttccattggattacctacagccgtatgaataccgtcatgtacttctcactcaacttcactgggagcactgccaccgatgtgatatagatggtgctgatcacttacaagatggatgccagcagcaagatttgcactacc

SEQ ID NO: 39858 - DNA, 363 bp, Triticum aestivum
  Clone ID: PAT_TA_39858
actcccgaggtcgacccgatgcgataacatgagtcacagggtcgtcgggatgttgtcggcggtgtcgcacgccatcagagcgctgccaactaagtgtgtgcgaccgcagaccagagagagagcgaggggacatgaccgtgagatgtggagagagatcatcccatgcgtggtcgacgcaggtccaaagggcaacttacggatgtcctcacaagtcccacatggcaggggcaaaaaagcgagtggatactagacagtggcataccatcacagagaatgtcagtaatggcccattgttgaagtgcattactaccaagtgagcacattgccaatagttggggtgaaccggtcgttccaaagaacagg

SEQ ID NO: 39859 - DNA, 260 bp, Triticum aestivum
  Clone ID: PAT_TA_39859
ctcgcgagtccacacgaggcgctaaaatgactcataggagttctacgatattgtcgctggcataaagctgctacatttatcagcgtattattctggagaagaatcagttgcacttttccccacccgtgcacggtatgatgatgaccgtcacctaacatgaaccgtgggttagcatgattggcaaatgacagactcacgtctgaatgtgaggttggcatgcagatctacagttgttggtggagctgttctgaactatgcac

SEQ ID NO: 39860 - DNA, 419 bp, Triticum aestivum
  Clone ID: PAT_TA_39860
ctcgcgagtccacggcgatcacatcaggcactcctaggaggattaccatcggagtgcccatggtgtgagcttgggctatgccagcacggattttggctggaaggcgagatcctggagccggacgctgtcttcagaggattggcacgactgctttgaagtagacacggatgatatccccatgacagatgaagtatgttctgctttgttccctggtccacgggacgatgagaaggtggaggagccatcgttgagcgagctgatctgctacgctcccaccctgagtattgaggatgatgttctctacatgatgtccaagctgacccttgatccaaggaaccctgtggcatggttagctgctgttgacatggaaaagaaaacactggaacttatctctgttaatgatgaaattgcatcccgta

SEQ ID NO: 39861 - DNA, 448 bp, Triticum aestivum
  Clone ID: PAT_TA_39861
cctgcccgtacggtgccgatattccgggacgacgaccactggccacctgatctataagcttggcggcattgacaagcgtgtgatcgagacgttccagaacgaacccgctgaaatgaacaagaggtctttcaggtacccctgggtgcgtgacaagctcaacgccgaccgtgacacgggtatcaccatcgacattgccctctggaagttccagaccaccaagtactactgcaccgtcattgatgcccctggtcaccgttacttcatcaagaacatgatcaccggtacctcccaggttgactgtgctgttctcatcatcgactccaccactggtggttttgaagctggtatctccaaggatggccacacacgtgatcacgctctccttgcttcgactcttggtgtgaagcatattatctgctgctgcaacaatatggacgtcaccactccc

SEQ ID NO: 39862 - DNA, 447 bp, Triticum aestivum
  Clone ID: PAT_TA_39862
acgcaaacggtgcacaaccagccccatgggtagaccttgcatgtctgatggtttccatgcaaagatgtcccagttctcacgaaggaactggatgagcgcgacttcctatttgctagcgagtgtcgttgagatgtgcgtcggagcagcggtggggtcctccgggtgaatgtggactggcttcgtcgcgcgtgccgactggaatgcggattctgaagcatgcttcttagctcgcaaaaaatcactcggatcggcatttttcttgtattcctctatctcgaatgctgccatttgctcatcggcaatttttgagcctttttgaaggcactcctctgctctctgcctatttcccgtgactgtgatcacacctctggctccggccatcttcaacttgagatacacgtaacatggtcgggccgtgaaatgagaatatgcgggcctgcccagaat

SEQ ID NO: 39863 - DNA, 426 bp, Triticum aestivum
  Clone ID: PAT_TA_39863
tccacatggttccccacattgagtcatcatagaagcaaatcgctcgcgagatttctgttgtaacaacaagaagagtattcgaaaggattgcggttcgtcgtgtttcacaaagaacagcatggaagcttctcaaagatgctgcaaaatcgtcaaagaggaaagctatgagggggatgtcaattccagaatacacatactgtgttgccagaacaactttccgaggtaagatttacctgcagtatcacttttccttttgtaaattattattcaattatttttctttgttcaaacagcgcatgcattgggagtagctgctacttgggttgtacaatctgtcgtccaggtgtacaaatgttttattcgtcaacctgataatgatgacgatttgttcgacgagaaggaaaaactcaaaatgtttgcgagaag

SEQ ID NO: 39864 - DNA, 455 bp, Triticum aestivum
  Clone ID: PAT_TA_39864
cgggacgacgccgctttctatatttagtcttattatttttttttgcaaattttatacttatttggtcaccttttaaggtaaaccggcatctcttgatccagccaggctatatgtcttcatctcaacctggtgtttcttaacccagtgtggcatacagttatcatctgttaaagcatataatcaatggtgaactggcatctttcaatccggtctggctttgactacctgtcgctagtatgatcatccggtgttcatcacaacccgggtttacttcttacataccagcattgcatggtggaagttgggtattcacccttactacaaataagttggtaaaccgacagcataatttcatatcacacgtattatttattttttgctatttttacaaccttggttacctaccaagttgtgtaatgggcattatgacccatccggtggtaaaccgcccggac

SEQ ID NO: 39865 - DNA, 441 bp, Triticum aestivum
  Clone ID: PAT_TA_39865
aacggcaaccgtcccaacatcaccggtgaaaagacatcgcgccaatggagctacccctacggctcctatctcaactctcattattctacgtctcctgttttgaccgggcgcttctccaactacaggatgcaatcagattttatagcaaggatgttgggtctccatgaagcccctccagcgtacgagctcacagaagatcaatcttgtgactcatctggcatgacctttgcttctggtggcgctggtgtcttcaaggtgaagaccaagaaggtgccgacacttgccgcacaagttcaaactttcaagaggcttgtcaaggatggggtcatctcaacacatcagcttcaccactccgtcgcgctcatcgccatctccggcaatgattacatgagcgactccgacattgagactggcttctacacaagcttcgatgatcttgat

SEQ ID NO: 39866 - DNA, 441 bp, Triticum aestivum
  Clone ID: PAT_TA_39866
actggcagcaacctcacctggctggagtgcgaccacccggtccacggctgcaaaggctgccacctgaggccaccacacccatattacaagccagctgctgacaagttgaaggtgcaatgtggtggcccgctatgtgctgcaatgcggtggcccgctatgtgctgcaatgcgcagagacgtacctgggatccctgagtgctccaggaaagatccacatggatgccactacgagattaaatatgtcaccgggaagtcagaaggtgaccttgccactgacatcatttctgtcattgggaaagacaagaaaaacatcgctttcggatgtggatacaatcaggaggaaccagcagacgcaccgccctcgtcggtagatggcatccttggactcgctagcttcatcgaggttacccagcaaataaaaagcctgttcatagaacgtca

SEQ ID NO: 39867 - DNA, 347 bp, Triticum aestivum
  Clone ID: PAT_TA_39867
tcgcgagtcgacacaaggctctagagtgagtcatactagccgagaagggcgaagatctgaattgcaggatacatgcttcggtcactttccttagatgtgaggtcgtatatcttcaccaggagtgtacttttcgaggacgtaccgcacgttagaaggctgatgcccacacagacgatgtaccgtcagatcaggctctctggcaagatccactggtagagatttcagctcccatgtggaaagcctgggtgccattcctcagaaggaggcatcctccatccccatgtcgagaaataggttgactcatccccatggtcatccacggacaatgctgtggtccatcgctcagt

SEQ ID NO: 39868 - DNA, 425 bp, Triticum aestivum
  Clone ID: PAT_TA_39868
cacgtggtacgtcaaacctaatattgttgtctgcggctgatggagggggccaagttcttgtttataaaattttgttcaaaattttaaaaaaaatactgctgtgtttgcaaattgtggtcatgaattcaaaaaaaggttcttgttgtttcaaaattccttgctttttggaaaaaaaaatcgtaaactgcaaaaaatgtatgtgtttataatttttttcaatttttttaaaaatgttcatcttttcaattttgtccataaattcaataaatgtcaggaacatttcaaaatgtacgcacatttcaaaagtgttcaaaagttaaagaaatttcaagttttctattgtcagtcacaaattagaaaatgtttcatgatttccaaaatattagaattttcaatttgtatttgcttttttaaaaactatttgc

SEQ ID NO: 39869 - DNA, 416 bp, Triticum aestivum
  Clone ID: PAT_TA_39869
aaaccctaaatgatgagaccatgatcttgttccttgacaataaccaagtttttgaccaaactttgttcctatttagagagaaacatggccagcaacgatgaggccgggggttcgggcgtcaaggcattctggaagctgtcccaggagatggaggaacaacctcacttgtatgaggacgccgccttccccaccgatcctgagaccactgatggtaccgccgaggatgaccccactgatgccacgactgatggtgccgccgaggatgccaccactgatgatggcggcgcacgcactgatggcagccaaccgaagaggcaaccgaaggaccggcgcccgaccgtgctcagcggtaacagttacaaagggtacaccactacggccgaggcctaatctagatacgcccgctatctagcggg

SEQ ID NO: 39870 - DNA, 161 bp, Triticum aestivum
  Clone ID: PAT_TA_39870
caggtccgagactcgcgggtcgacgcaacacggtataatgagtcgtacaactcctgcgcatcgagcgaacgggggaagagggaccgctccttctgcatcgccgcgagccgctgcagcctctggcgacttcacgcccttcctcgtgtcaggttttggtgcca

SEQ ID NO: 39871 - DNA, 473 bp, Triticum aestivum
  Clone ID: PAT_TA_39871
gcctgccaagtacggtccaaccattcccgggtccacggtaaaaaataaatagtaatgtgtacatcttaatatctagccccatattaagtcgttggtttatttttttgtgagggtatctgatggtggttttctacaacctttttttaaattgtgcatatggtagaaattacaggtggtgccctacaaaggaacagttgccaccagtacaaaagaattagattatgatctatgaaaaaagcacaagtttacatatgtcttgggagttgtatcaatgttccttacatgagagattatttactcagataaaaataagaacagtagtcttttttggaggaaacaagtatgctgagataaatatctgaattcttttttcatgtttgactgggagatattggttagaaagctactttaccgtgtcacacatggagaagaagacgattggaaaatttcttccaaataattacgaagtcatg

SEQ ID NO: 39872 - DNA, 206 bp, Triticum aestivum
  Clone ID: PAT_TA_39872
ttcccaagtccacagtggcatgtgatgaagtcaaagtcgctcgttcatggtgaagggatggtgatcgcccttgcttggagagaagtgatggcgatgacacgatgacaccaatgtgccacctcgacatgtcttctttgtagtgttatgtgtcggttacctggccggtgccgctccgttggactgttaatgcttttggcccggttttt

SEQ ID NO: 39873 - DNA, 412 bp, Triticum aestivum
  Clone ID: PAT_TA_39873
tccacattgatcccgataatggtgcctatgaaggtctcaacacagagcttcatctgttgaatgagagcaccgacgatcaagagcagtttgcagggacatacagtacaatcatgcatgcatgggaagagatctgaacgagacttttgtttagattactacggctactagctagtacacaagtcaattcatcagagactaaaccgacgaacaaactcaatacgcgtatggatacattataagttgaacccaggaagcacagatcttagcagccatgcaatctccccaaattaacccatcgatggatggtcatggtataattaaccaatactattaaggagtatgtcagttgtagagattgagatcaaccgcagctttacgtacgtaaatgttttaccctgatgcagatggatgt

SEQ ID NO: 39874 - DNA, 429 bp, Triticum aestivum
  Clone ID: PAT_TA_39874
gacgttgagctcaggcggtggcgcgtttcggtctctgatgaatagatggctacgacaagcaatcgaggcggaggagagaggggttcgctctgtgagctcacagtgagtccaacatgcgtgagggagaggtcggggatgccctgtagctcccaaatcggcggcgaggatccatggtggctggcgatgggaacggcgatgctggcgaagttgtggcgcgtccttcactccatggcttggtggagaggacgaggaagacgcggcggtgctttttgacccagtggcacgacgtggggtagccggtggccgtgagaacagcgagcggtggtgacaagctctactcgggttcctctagtcttgcgagacacggacgaggacgagggaatgaggccatgggtgtcggtgggagtgtgtggcgtcgcctaagcgcat

SEQ ID NO: 39875 - DNA, 444 bp, Triticum aestivum
  Clone ID: PAT_TA_39875
cactgagacctagccacactgttagttgtaatattttcgataactcaaactgaaaaatgttcgcagtactaatatgatttagtgaatttgattattatatatagttaggagatatttaatgatatgcgtacatcgaagagtggtaagggtctttggccgggtgcttcttctgctatatattcagctctctcagcgaggtgcgaggttccccgagtggaactcccgagaaatggttcaaaacggccgcaggagggtgcttgtctcctctttccgtggacgaggacatctcctgtatcccagtacacatgacgaacatgaggaggcggcgatcgcaccggcggcgagtttctagcgctgcaaactgcaagtgagcctccgaatccaccttttagtttatcctcctctcatgagcagatgcatggactatggtgacgctgcttatgt

SEQ ID NO: 39876 - DNA, 267 bp, Triticum aestivum
  Clone ID: PAT_TA_39876
acctcgggaaatcacacaaatcacctactccctccttcccttactttggatactctctagtcatgtgactagtagtaatcatactcaaagtttttagtcaggccctatttggaacgtgactactactagtcagcactaaatgtctcaatattaaattcttctctctcccttccatttatctctcttcactcacttgtgcaacaacaattatcgctatactcacgcgcaaggaaagaaagcagcacagtcctgttccttttctccctc

SEQ ID NO: 39877 - DNA, 410 bp, Triticum aestivum
  Clone ID: PAT_TA_39877
cgttgtgcatttactttgacaagtagcttcatctcgcagttccacacgactttcattttgcacgtttttttacgatcatagaagagtagatctacaccatcctcgtgagtgtacatatgcatatgcgtggtctgattttagacactccttaattattcctctaggctttttatcccacgtcctgttacactgacgccatcgtcggtgtggttctgctcgatctcctcccctgcgtcttgctgtagtggcgtcatcatcgccaccgttcacctcggcctcctctcctacagcctactgcactgatgttgtcatggcacgcacactatatttcttctcctctatcctctgcctcagaaccctgcgattcttccctccgcataaaccttttgtgtggtgacgacgctaggaac

SEQ ID NO: 39878 - DNA, 440 bp, Triticum aestivum
  Clone ID: PAT_TA_39878
acgtactactaaactttccctctgccaactatcaaaaatcttatatatattgtgggtaaaaacactctcccaggagtgcatccatccacccaccgggtgctactccgtggtcaccaacctgaagaaaaacatcttgtacacatctacccatcctcctcccatggacggcgtgagatatgcatctcgcatcatcaacgatcacgactacgactacatacatatgtggcctggcacgtacccgacgttcctagaattttctgccgtgggaagctgtccagcccagccgaccgactgcacgtacgtacgggcacagctagctgcacgtacgacgtatactggtatacggacaacgcaataatgatatgaataaatataaagtaaacagaagataaagttgtcttgaagcagagcggaacacagcagcagcatttgggcgtttt

SEQ ID NO: 39879 - DNA, 237 bp, Triticum aestivum
  Clone ID: PAT_TA_39879
attcgcgagtcgacgacgtcagggtacagcgataactcgccgacggtgacagcaacctctgtctccatctccacgccgtgctctggtactttatcagccccggcgtcgccactccctccgatggggcgcttcggtggcatcctcatacactgacggctttgagaactgagagcgcgcggcgtctaggatgcaaccggagagagaggattgtgtgtgtgtgtggcgaggatggggggt

SEQ ID NO: 39880 - DNA, 452 bp, Triticum aestivum
  Clone ID: PAT_TA_39880
ttccggaaccacttagacgtcgtgaagtctaagtcgcatgacgtcatcatataaaagttgattgaatgtgactccgtttcttgttctgtgttcgctacagaccacatgggcttttgtttagctggagaccacatgggcttttgttcggttgtgttgcactcatccatcgttgtgttttttttttatttagccacctaatacatgcattgctacactgtgtaatggagctccgattttgtggctagcttcgctcatgttccgctccttgcattcgtgtcatcttgttacaccttttcgtttattatttaaaacaattactttatatttaaaaaaggacacattttttttaatgtaacaatgaaataacagccaaaaattcagaagaagacaattaatttagttgggtgcaaacataggatatacaactatgtgctgtcaactagcgtgcaaat

SEQ ID NO: 39881 - DNA, 375 bp, Triticum aestivum
  unsure (1)..(375): unsure at all n locations
  Clone ID: PAT_TA_39881
gatatgtgcagtgcggagatcttgcgccagtggcaacaaaacatttgctcactcatcttcagaagacttgaagctcgacgccgaaccgccttgacttgcaaacaggcangaaggttagagattctatgttttggagagacagcggttcacggacgaagcttgtctgcttgctcatgtttctcgtgcctcatttcaaccatgatcactcgatgcagtttgttatcaatgccccatatagtttcacaaagaaaagaggctctccacagtaaatcatgaaatgcaccgcgatgctgccagcgcttgctcaaggatgaaggatcatggcgcanggcaaatgagacgcatgcaaccggtacctgtctaagctgatcatgc

SEQ ID NO: 39882 - DNA, 437 bp, Triticum aestivum
  Clone ID: PAT_TA_39882
ctcgcgggtcgacgatttacccaacatgtcactccttctactccgaagacatcaacggtatggacgccgatgaaggagacgaccaagaaccagcacctatagggcactggaaagccacgccatcatacgatgtatacatggtggacacacctaaaagaaacaacgacgaggatcaaaagggcgcaaccaggaatcgctccctcgaaaaacaatcaaagcggcagcgtaagcgccgcgccaagccccacctcgacaaagacccagccatagagcatggcgaatcaacggaagatgaacatgccatcgagcaaccgtccaaacagggcggacaaaccaaacaatcagtccccgggaaagataatagtccggacgacctcacgccggacaagttgccagaacatcagaacctccaccaaaggctcgttgccactacacgt

SEQ ID NO: 39883 - DNA, 407 bp, Triticum aestivum
  Clone ID: PAT_TA_39883
tacccacagtactcggcggcagatgtggcaataggagaagcacccatggatcccatcttctccagaaccaatagccagataccttcacatcacccgtcaatcgccgtggatcttgttgaagacgagaacgatagcagaccagcgatgccgccacgacgatgccgggaaacgatggatggatgagacagcacaggtaagcaccttaataccggtatctgcaattctgcatcgtttttcagaaacagaactagcaattctttccgggcaccaatagaagcatatcgaagtgctatagagcgtgcaattgaaggagcatcaaaacttgggaaacagttgttttccaagcagctgttggcttaagcaaggaaatggcaagtcgtttgccgtgtttcaggaaaaatccgagc

SEQ ID NO: 39884 - DNA, 263 bp, Triticum aestivum
  Clone ID: PAT_TA_39884
atgacttcaatgatcttgacatcgatcgcacaaagaaagcttggtagagcgaccacgtaggggagacatatgagactgaggatggaatgcatcgatcaatatgcagtggtgcacaaccgttctttcagagagaacctttcacaatccgcatgagtttcctcagctccatagccagatatcgacctgtcgcccagaacctgggttgcctctggtgtccacaaaatatctgtgcaagtctaaggctggaagggaccagattccgg

SEQ ID NO: 39885 - DNA, 307 bp, Triticum aestivum
  Clone ID: PAT_TA_39885
aactgtctacaaccattgttagtcatgatgtacacaagatcatcgattcagctgtaagacatacaaacggtacaccacaacggatgaggccaaaccaagatacgccctctatctaccggtaaaggggacgatcgtttgagaatggatcaatacagtttcatcatggaaatcacatcatgatgaccgcagctctcttctatgtgaacgtactttacatgattgatatcgacatgtcatgtgatcatatcatcgctactcacggtctcgaaacttgttacacactgttctatctgtgttcagtcttttc

SEQ ID NO: 39886 - DNA, 338 bp, Triticum aestivum
  Clone ID: PAT_TA_39886
tcccgggtcgacatgtcacgcaagtgttctacttgggcacgtacgataagcatctccagcataagtacgacctggccacgcccccccccctcacaagcacaccatacagcggtgacgtacgcgacatgacatatatatatatggtggggacgagcttatgacggcagtgcctgtgaatggcccttttggtcggtgcagggcgctgcactcatcagtaatctaccccgacaaggtcctcagtgccatcatctcccgcctcccctcgacagatggtgactgccaagcacatgatctctctcgctggcggcgcttgcccacacactccattcagcttcgaa

SEQ ID NO: 39887 - DNA, 172 bp, Triticum aestivum
  Clone ID: PAT_TA_39887
ctaatgaatacgattttcatcgttcttttgcacatcattatcagcgcaacgctcttctaagtcacggtattttaaattatcaatatcgtcttgtaatgtgaatacatactcgctactcccggtctctagacttttgagtatattttctatcattgatctgtcttttcagttc

SEQ ID NO: 39888 - DNA, 414 bp, Triticum aestivum
  Clone ID: PAT_TA_39888
gggtcgacactacagacgatgatgactcgtaatagtttacacacaacgtccaagatgaatggcttgccatacaccttggccaagagaagccaacaacaatggcagcattaacaggcctcatgacccacttttgtgcgggcgatgacagctggctatcccgatgcagcaccagtgacccaagtacatccgaagttagagatggaaacgggaaatcacgacgcagcagaaataataagtgccggaataaagaatacaacccgattgagcatggcggttaacaccggattcagatgctctcggccaggtcagcaaaagccgcctctaaaagcgccggagatgaactgtccagcctaaacaaagttctggaccaaatatgtcagatccatagcacccctgataaacctgcaaatcata

SEQ ID NO: 39889 - DNA, 241 bp, Triticum aestivum
  Clone ID: PAT_TA_39889
gtacgtatcacatcgaaagacgggacacctttgccactaccaggtggtatcacatttccaggttgcttggtgagattttacagttttttttgtagtttcgaccgaatctgttcgtcatgcgtagagtccagcagaaagccataagcaagcttaggatgagttcaccctatccgaacacatctcagcccttggagaagctcttctgtatctgcattgatgaagttgctgttgcatcattgtg

SEQ ID NO: 39890 - DNA, 289 bp, Triticum aestivum
  Clone ID: PAT_TA_39890
tccgggtcgacgagcacagtatcgcggttaaggtccacacgagtgatacaatgatgcggggtccggtcacgagcgaagaaatatcgcgagtggtcacggagcttatgctcggagaggccggaaccggagcggcaaataatgttgccgagttatcggtgctggccatggagtccgtactggagatggggtcttcgtgcaaagcaatggatgagatcatccgtgagttgtgtgcacccaacatcatgcaggcacacgttgacgcgagcaaggaggagtccctagatgttta

SEQ ID NO: 39891 - DNA, 418 bp, Triticum aestivum
  Clone ID: PAT_TA_39891
ttcggagctgagactgcatctcgtccatggcaaggtgttgcgggtgatccgcatgaggatttggcgagttggcatgacaagattagggaggtgattgttagaactaatcttggcatatgtatctgcatgtgtttttttgttttgcatgtagctagtgtagtcatatcgtcggctgtacaccggcaagatgtacgtgtgatacgtacgtagacagcgagccgtcggcccaagaacgtgcatggtgagatgctattgtcgtgcgaggcggcggaagtgcgagatgccgagtgccgtgtgaagcagctgcacaaggataagagccagcggccagcaagagtccagccgagtcgattagtaagtctgttgtggccttgagaagaggtccagtattagatgtggtcaagtttgttagctgcat

SEQ ID NO: 39892 - DNA, 319 bp, Triticum aestivum
  Clone ID: PAT_TA_39892
acggaccaccaacgtgtgtcgctccagatcatcaccaagccaggtgggggacacgccaacgctgttcctggacatcatccagacgatcgggtgcatggataacgaccacatacgggaagagtaccagaaaggtggctgctgcgggtttggcaaaggcaacttctccgagctgttcaagtccattgcaggattatgacaaatcccttgaaccctagcaatctgctgcagttcatgcatcataggatagaatctggaattggaacctgatacgctgatccactgcattctatcatggtctcatggagcatcaagaacgttc

SEQ ID NO: 39893 - DNA, 338 bp, Triticum aestivum
  Clone ID: PAT_TA_39893
ctgctaagctgtcagcataaatttgccacgatgggaacgaggactttgaatccctgtgcgatccggccacttatcacggggcaccacggcacggcacgatgtggtttcaagaggtaaccccgaggattcgtggatacattccagagatacgccgggccgatcagtcgtgaccttctgtgtcctcctcttcctcggtcggggtggactggcgtggatcacaccagcccggtcagtcatgttcgtaggtacaggctgctgcatgctgcattctccaacaacctacgtactccactcagaatctcgtgtcaggaacatgtatcggaccggtggctatgcta

SEQ ID NO: 39894 - DNA, 392 bp, Triticum aestivum
  Clone ID: PAT_TA_39894
ggtctagaactacgcgggtcgacggatccagcaatgcaggttctcaggagcgtgaagtattgccggcgtcatgcccattgagaagatgcagattttctttctggttctctagattggtcttgataaagctttcatacaggatgcagcttaagctggagttcgtcgctaagcaggaaacatggctatcaattatcttgtatacagaatgtttgggactggatcttgtaatgaaagctggagcagaagaagtccaggacggaaaattcggcttccacggcaatgccgacgtgctcccctcgggttcctgcagttcgaggacggacagcccaggttctcaagcagcaaagttagcgcacaaagttgaactttgctgctgcaccatcgtcaacaag

SEQ ID NO: 39895 - DNA, 177 bp, Triticum aestivum
  Clone ID: PAT_TA_39895
gggtcacacgagatccaaatgaagaacatcagtggatgccctcatctggcgcaatccgttcactgagccggcaatccatccttccgaagctacgatgtccttccaaaaaagccaaggcccacctggttgaaacccgtggaacccttttaaggcaatttccttaaggactgaaaaacc

SEQ ID NO: 39896 - DNA, 271 bp, Triticum aestivum
  Clone ID: PAT_TA_39896
gtcgacgctgctccatatcgacagtcggggaagcaatccaccaccatcacacttgactagggtattacaccacaacggtggcccagaccagtataaacctcgtgtctttctatgttgcgagttcgtcgagtccgtccgccagatcttaccgagctatggcgtcaatcggtaggagggaaagacttcgcgcgcaccccattgttccaagcttaagggtttgccagaatcccacatgcggcaacgacagagagtcactccagggttcctatcg

SEQ ID NO: 39897 - DNA, 321 bp, Triticum aestivum
  Clone ID: PAT_TA_39897
tcccctgcggaatttgggaacatttgggtatttatagagcaaagaggcggtctgggggcactcgaggtgggcacaacccagcagggtgcaccagggcctcctggcgcgccccggtgggttgtctcctcctcggcactccccccaggtgcaaccacggcccatctgcttccttttggcccataaaaaatcatcattaagtttcgtgccacttgtactccgtttgctattgatttcctgcgatgtaaaaaacatgggagatagacgaactggcattgggcactatgtcaataggttagtaccatcacatgatatctaatgact

SEQ ID NO: 39898 - DNA, 323 bp, Triticum aestivum
  Clone ID: PAT_TA_39898
tttaattgggatgaaagaccaaacacgtgcccagttacgagtcaaaaatgggcttgtaggggtggacttgcatgtcaagggtgggcttgcaactgggataaaagtggtcgggtccgcagttacgtgttgaggatggagttacaactgggacaaaaatgggccaggccaagttgcgtatgaacagtgcactcacaaaaaaatcgggcttcttacacattacggttagacttgccagaaaaaggttgttgcctgtcattggagagtttaaaagcatattcatccgcggggttactctgcgccaacgacaaagaggaatgagacag

SEQ ID NO: 39899 - DNA, 308 bp, Triticum aestivum
  Clone ID: PAT_TA_39899
gggtcgacgtcgaggcacactaaatgctaagttttcatcatttagggtttatcgatgccgaggcaccctaggttgggcctaatcacttggcactaatcagttggctctattgccacctatgttgggtttatcatctacggtttatcgatgctgaggagaatttctaagttgggcctaatcacttggctctattgccacctatggtttaatgcagcaggaataaaggggcatttgatcctacttaattaagtactaagataccccggcccttgcattaatagcaagtaccgcatatgtccgatttttag

SEQ ID NO: 39900 - DNA, 161 bp, Triticum aestivum
  Clone ID: PAT_TA_39900
aaaatcgtctaatctgtggcgccgtctctgaccttttgcagctctgtcctggccagctccaaatcaaggttcagttgaacctactgcttctccaagtcagcaaagcgagctccaagatcgcaagatttctgaaatcaaaggggagaagttatcgttacagc

SEQ ID NO: 39901 - DNA, 320 bp, Triticum aestivum
  Clone ID: PAT_TA_39901
tggaaggcgaactcttcgacggatgtcctagggtaagttacttgggacaggtccgtgaccctaccctaggtacataaccccatcaacgacgcgccaggaaaactaacgctagtttagtcccacctcgtcgatcgaaggcgacgatgaccagtttatatacccagctcccgtcgtcagattgaactcctctggtctactaccccgtcgatgctgccctgttgggcctggtttccacggcgtgctctgaaacgcctgttgtagtcgcccggtgggcttgataacaatggtcttattaagacacgctgtggagacggacgggc

SEQ ID NO: 39902 - DNA, 398 bp, Triticum aestivum
  Clone ID: PAT_TA_39902
aaaagcgaagacaaacaggcccaggccaacaacatgatacacaacaaacaaacaaacaacgacaagcgcggcgggggatagagtgcttacacgaaaattatgaaactaaatcaaaagatgccaaacttagctgatacatcatttagaatagttgtggatttaaaaatatactatgaaattgtaaaaatcaaggattttacgacaaaaaaggtaaacaaaaccaaaagaaaaattgagaaaaacaaaataaagtgagtgtagagagtagcgaacaggaaatatctggaaaaaaaatgctcgccgctaactctttcaattattccccggagcctacagagaacaagcaaaaagaggcctactctctacatagacacacacggaagacaagcccagttcag

SEQ ID NO: 39903 - DNA, 299 bp, Triticum aestivum
  Clone ID: PAT_TA_39903
gggtcgacgctacacctgatgctcagcactccgcagcggcaccaggggaggctacctaaacgtggacccaaatctcctgcagctcgcgctcaggtacagcgagaagaagatggtctgccgcaagtgctacgctcggcttcccctgaggtcaagcaagtgccgcaagaagaagtgtggccacagcatccagatgatgcccaacaggaggttcatcaacaagctttcgaacttgacatcgaatcggtaggggagagagaagggaaggaccgtctgtgactaaattgtttcattcggtttag

SEQ ID NO: 39904 - DNA, 370 bp, Triticum aestivum
  Clone ID: PAT_TA_39904
aagcttgttgcaccagatggccgaatcgtcacgttcttccttctctccactgtagcaaaggtgcagtcggcgctgcccatgaaatgggtgaatgctccagaacctggtgcggccataggactgaggtgaggtagagcttcaccgagtccgtatcattggtgtacatcacattcaacttggtgcagccataggactgaacgacacactcaaaggggatctccttgctgaagtccatatccagcaggctcacccttcggatctccgttggagtctcttcgagtgaacgaatgtgtaggcggcggcagcagttcgtttttcagctcttggggaactggattcaacagtaagctgagtgtgttcaggcgacaac

SEQ ID NO: 39905 - DNA, 428 bp, Triticum aestivum
  Clone ID: PAT_TA_39905
ctcgtgggtcgacgctgcgcactatactgagtcatattaggctccagggtggacaacactgtcctaaaggcaagcgggcgcgtcagtgctggttgccgacatctagcaatgcctctgtggcgaccagagatgtacaacgacgacaacggaggtagaggttgcggatgcaaagtaagggggggagtggtggagtggaaggaaatgagtccgggaaggggatttaatgggcctaggatgtcagagtcctacgtgactgttacccggattcccgcagccccccccccccacgttgtctccactttgcgggagaaagtgcgtccagaccgcttggtggaccgacataggcccatgttggatggcacaacacgtccaaaccgtgtggtccaaacggttgcggagagtcggcgattggagatgcccttagtgtt

SEQ ID NO: 39906 - DNA, 433 bp, Triticum aestivum
  Clone ID: PAT_TA_39906
gcgggtcgacataattcactagatagagtcataatattagagaagtttgtgtgtcgcggcaaattgatttaatgaagaaaaactaaagtttaattaatatataatatggttacttcgcaagcacgacaaaatcaagttgaaaccaaatgccatactatgtataaaacatgaaaaatggtttaatttgatcccagaaaggcacacaatgaaatcaaaatgcacgagtagacaagcatttgattttctaaaattgaagcttctattcttctaaaaactttagagtccacaaagcacacacaagacacctttgatggtgattttttgagggtcataaacaaatatgtcgtggtgttgtagcatgtactttgtttggaatcttgagtgtgtagacattttcttttaactctaagaccaccggagaaagaacacctcg

SEQ ID NO: 39907 - DNA, 181 bp, Triticum aestivum
  Clone ID: PAT_TA_39907
ggtccaggcccgcccacaagataacttcgatcgcgctttcctatttagggtcgatagttgcaccgatggttaaggtgccactagtgccatcctccttggcggagaccctcgtggtctctggtggagctgccagtgtcttcttagacttgtcagtggagctctatggttcgtcgtcgacggt

SEQ ID NO: 39908 - DNA, 355 bp, Triticum aestivum
  Clone ID: PAT_TA_39908
tcgcgggtcaacagcacacacgaaaatgaatctcaataaatgctctgacgacataacttctctgtcggccaacatggtgagacgctggacacacgctgaaagcgagttacatttggcgatactgctgtaggggttctccacgcgccaatagctatcttttggattgctgaacgtcgtctgtggtgtaatgtgaaagtttgaggccatgatctgaggtgtaattgtgggcccgtgagaggagttcagtgtgtgtgtgtgtctcttgctgcattggccacaggaacatactacgtatttgtaaatagctaagcaactatgttggatgtgcacagacattgttgaaatggctgcatct

SEQ ID NO: 39909 - DNA, 331 bp, Triticum aestivum
  Clone ID: PAT_TA_39909
ctcacgggtcgacattgcacgctataataagtcgtgtcacggtggcccagaccctcagcatcattaactgatgtcaaggtctccttacgtgtagtttctctacagcggcatcatatacatgggacctgaatcccaagatagttcgatggatcaagtttgcgttcttgctgtcttgaatcttgatatagcggaataaatggtttttttcaagtatatatgtatacatgttacatacacggtatagtaagcgacgcggcacaagcttgtggaaaagaacagaagttgtgacccgttttctcaaaatgaataaaaaatatcatccgcattttgc

SEQ ID NO: 39910 - DNA, 230 bp, Triticum aestivum
  Clone ID: PAT_TA_39910
tggcagacatgacagtctggcacaccaatcagcacaagtacacgtacttaataggtagacatcgctttgtagaaccccactgacagtcttcatgaatcaacacacgatcatcaacagttgacgatatcgacgtatgcagatcccaaattgaaagcttcatcgaccgctgcaggactgctggaatgtctgagtctgctcaatgacgtgtctgcatatgctgaacactgagt

SEQ ID NO: 39911 - DNA, 200 bp, Triticum aestivum
  Clone ID: PAT_TA_39911
ctaaattgagtcatagtacattcaatcaagagaatagctcatgtcatatgaacgtcatattacaagattatctcatgcttctaaatgcacgtgcgtactaggctcggctccagccatgtggatttcagtgcattccgtactcgtttaccctaaagtcatgcaacattatgacgatagagattgtggcattttcactaaga

SEQ ID NO: 39912 - DNA, 342 bp, Triticum aestivum
  Clone ID: PAT_TA_39912
tacgggtggggcactcctagccatatcttaccatttacctatgcagattacatggcggtcgtggtgcttggtgctccgccaatgcccaagaagggcacacgagttatgacccagtgtgtggaggagaagtatctcaatgagttcaaggatgagatgaagggtttcttttaaaagcctagttgttatcatatcaatggcatgagtggatgttgggtttggataaaaaaattggagcatgaggaaatactacacttgcgatgttgggaaaagtaacaaataatattgtcgcacaactatccatgtaattcagggggtgggctaatatatggacaactgctcaat

SEQ ID NO: 39913 - DNA, 388 bp, Triticum aestivum
  Clone ID: PAT_TA_39913
ggtccggaactagcgggtcgacttccaggagatacgatgacctaccaacactatcgattgacgggacacctcatccgctagcaagtggtatcagatttccaggttgctcagtgagattttacagtttttcgtacctgagattcagtctgttgatggtacctatattccaggagcaggcgatttacagaatgacggttagttcatcccacccgaaccaggctgagccttgcatagtcttttctgtacatgctgtgctgaactcgcggttgcaccgtcatgtgcacttgctggtcttaccgtctattcttttcaagtttcgagtcctgtgcaggagtagtcacgctgtcgccgcaccatcagtatctcccctgttagcgaccacaattgc

SEQ ID NO: 39914 - DNA, 354 bp, Triticum aestivum
  Clone ID: PAT_TA_39914
tcgcaggacgacacaacaccactataatgagtcgtagtaagtattaaatacgcagacgcatttagtatgcaatgttgaataattatttaagtgatttgttacagtacaacatgacaacgttttgcattggtttgtactgacctatctcacgagttcttgatgagtttgttgtgaatgaagcttttgagaagtagagaacccatgatatgacacgaattatggagacacacaagctcaagcttggggaatcccaagtcgccccaagataatatttcactaagtcgcaggcatcaaagcgtggggatgccccggtaagtatcccacctttcttcctcagcaactatcggttactac

SEQ ID NO: 39915 - DNA, 303 bp, Triticum aestivum
  Clone ID: PAT_TA_39915
gcgggtcgacgctacaccctaacgtgattcataggacttaagggaaggacctgcgtgttatcgattcgtacaagaatgaatacgttgatgaaatcatcaaggctttcatataccctctcttccttggggatcacagcgcatcacgttctaccgagtaatcgttaggtataaccctatgcttcttccatatcaccagattattatgaaccatcgttgacatcaatggacaccgttacttcagatggatcagcatcagcggcagtccatcatcagagtgtgctgtgcgcagcagagactccagtt

SEQ ID NO: 39916 - DNA, 372 bp, Triticum aestivum
  Clone ID: PAT_TA_39916
ctcgcaggacgacacgagaccctaaaatgggtcatagtacatcgatcaatacaccacagagcggtgtgccacgatggacatccagtatggattgtctgtgaaccgttgcacaggaccatagtttgcgtgaaaaatcatgcgcagaataggtgcgagatacgacatatggggatatcttccgagcaattctgacgcatcagggaatggcgcaccttaatatgccacagcttgtttactgtatgagaagcgcccaaacctttcctcaatgtctcaacaatgaccagtcaatgaaaatgagacggctgttttaaaataccagtctggaactaagtcggggccacaagatctggcaataacacctctaaacaattt

SEQ ID NO: 39917 - DNA, 264 bp, Triticum aestivum
  Clone ID: PAT_TA_39917
gggtcgacgtactcctttcaggcctgaggagatggacatggggactattgctatcgcgtccagatacgctctcccagtgagagccgcactgccgtgaagtagttctcactaaccaatgtaagcctttgagacagtagtttagcaatgtatccacgccaactttcctaacagctagacagatacgctgttcatttgggtcccgtacatcaagatgtccagtgcactcaagacggcatcgtaacgcatcatcagtttacaagtgat

SEQ ID NO: 39918 - DNA, 115 bp, Triticum aestivum
  Clone ID: PAT_TA_39918
tcataggacgacgctatgccctaaaatcagtcgtattaatcatactacgcaacactgaaccgtcacgtacactatatggatataaacgaatgatcatcaacggggtcatccataa

SEQ ID NO: 39919 - DNA, 361 bp, Triticum aestivum
  Clone ID: PAT_TA_39919
catatcatgataacagggatgtgaacttcacatatacgactcagaaggagaagatcaaggaaatcaacaggaaggatgacatattctacagcagtatgttctcgaggatgaccaagccttcatcagaagaaagcaaagcttgatgcgcaacagtacccaaaggaaggataggactcgcggattgctctcacggaagggccatcgtgtctgctcagctctatgggctgggtataccacgcatgtgggtggagttgctaaagtttcgagagatttcagttttgaggttgccctacaatatattttcttgtcaaaaaaaactgatgtttagagcgttgcatactaaagtcattgcattccggga

SEQ ID NO: 39920 - DNA, 437 bp, Triticum aestivum
  Clone ID: PAT_TA_39920
cgcgggtcgaccttgaacctttgtgctcatgcccatggacctgatgacagacttatcatggaagctgctcataaaaatatttatttctttggtataagctcatcttgtatctatgaattggtcctttgcaaccgtggctctgaccatgattgttcccatttgattccatttctcggacaagttaaagcacttgtcttctacagaacaatgcatctcctcaacctctattttgatattccttcgagtattacccctggtatctcgaggatatcatgccattgcactacatcttatgaacttttgatgaagcactacctttccctgtcattgtcacttcacgggttctgtcttgtttatcaatcgagagcaccgataagtgaatcgattccacagtccgattcaataactccaagtaagttttgttgcctatgagttta

SEQ ID NO: 39921 - DNA, 425 bp, Triticum aestivum
  Clone ID: PAT_TA_39921
ctcgtgggtcgacgccatccactagactgagtcgtagtaggtgctgtacggcaaccacgagatcacggtcggatccgagctgaggccgtcgcaggtggcgaaccagcccacggtgcacatcacaggaagagcgggatcattctacacgctcgtgagtgctccattcttaagttgtatcattgattgcatatatcaatatcagaatttgcaattgctaacaccaaggagtggtctttagtggtctactgatacggaccttcttaatttgttactacgtgatggtagacccagatgtgcctaggccaagcgacccttgcgaacgggagtacctccattggtatgtgctaaattaagatagctttaccttagccacttcccttacgcgtgcactttgtgggcgaattaaccttctcaaaataacatgt

SEQ ID NO: 39922 - DNA, 415 bp, Triticum aestivum
  Clone ID: PAT_TA_39922
gggtcgacagagctcggtatctctctctctctcactctatgtgtgtgtgtgtgtacatgcgtactcgaggtgagtcgtgaataatatcgcagggcaagatggcctctacgtcgtacaccatgaagaatagtgtgtatccggtcgtgcgattgggcatggtacgcagcccctagagtacggagtcgagctcctcgacccagtgtttatctgagtcctttaaggatcgcactagtctaggtttaatgctactcattatcaagctgttatcccattcgacttgaccatttgtttgagggtgatagacgggggcataatcaagcttgatgcccagattagcacaccaagtttttacctcatcagctgtgaagttagagccattatcggtaatgatgctgtgtgggacaccgtaatggtg

SEQ ID NO: 39923 - DNA, 440 bp, Triticum aestivum
  Clone ID: PAT_TA_39923
ctcgcgggtcgacgacatcccccagactaaatcttaggatggtctcctcagttagctcacggctcatcttcgcactgagttcgccatcaaggacttgggtcctttgcactacttcctcggtgttgaggtggtgcgccgtctacatggcttcttcctacatcagcggaagtacgctcatgagctcttggagcacgccggcatgcttaactgcaagcccgccgctacgcctgttgatatgaaggccaagctttctgccacgaatggttctcctgcttcggatgctgttttctatcggtctatcattggtgctctccagtacctcactctgactcgactggagatctagtacgccgtgaagcatgtgtgtcttcatatgcatgctcctcgagacgttcactgggctgccgtcaagcgggttctccgctatatctgtggcacta

SEQ ID NO: 39924 - DNA, 428 bp, Triticum aestivum
  Clone ID: PAT_TA_39924
ctcgtgggtcgacgcaaatcactaaagggagtcgtagcaagaagaccacagaaggggggacagcttgcaaggaggggacgcacgtctggaccatcccgcgagccatggcggcattgttcgacaagatcgagaagctgaagaatcaagtggacttccagctacgcgtttctttcatcgagatcctgaaagaagaggtgcgggatttgcttgaccctgctactgttactgctggcaaagttgagaatggcaatgggcacaccgggaagttatccgtgcccgggaaacctccggtgcagattcgggaggggtcaaacggggtcataaccctgtcggggtcgactatgaaggcatcggtggcgactttgtcaatcttcggatgaagtgccgggtcagtcgtccggatgtgcttatagggatagggggtgcgt

SEQ ID NO: 39925 - DNA, 413 bp, Triticum aestivum
  Clone ID: PAT_TA_39925
ggctaatcctacatgatgcccgcatgcgtcaatatagttgaagcttcgctgaagactccaacagacaggccggcccacttaatggttattcagcttcatatctttttcttttttagtattttgttttcagatcttggtttttcttcgagtttgtttgcacacttttttatacgttttgcaataagcggtaaacaatttttcagtcacacattgaattcatttattatacaatgattttttaatagacgctcaacatttatttataatatacaatgaacaattttgttatatgcactgaacagtttaaatatacaacgaactttttaaattacatgattttaatatacaatataaaattataatataaaatgaacttttttataaaacaaataccaaattttttctaaagtata

SEQ ID NO: 39926 - DNA, 361 bp, Triticum aestivum
  Clone ID: PAT_TA_39926
gggtccacgccatacactaaattgagtcgttgtatgggatagcttgggattcggaattcagcagctcttacctcaaaagttcacatgaccgacttacacgttcatttcgaacacttcggcacgaccgcacaagcgccattggataatgccaatcgtgagagcatgatcactcaggttcgcagctgccaacagtctatcatgtcactgccactgtctgctacgtgatcactcatctcgcacgcagtcgcgtcgacggctctgctgatagtgtcatggatgacagcccgtactctaattgtaacgatgacttcagtaatttgcgagcaggtaattatgcggataacactagtcaggtgaccac

SEQ ID NO: 39927 - DNA, 385 bp, Triticum aestivum
  Clone ID: PAT_TA_39927
gggtccagtttgacgatctgactaagaacgtgcgaggacgtcgcgccttaacaatcgctaaaccaactccgagaggttattgaccacgccggagcatgatcaacctgaccacgagggtctgtttcctgcaagcaaacgaagaacaagcaagaaactaagattgcaatctagatattgcgaatataagatgaaagctttattgatcaaggtgtggttctgtgacgcctttgtctggtcgttgaacacaaacgaagtacgcgaaatttatgaagtggcatcttgtatattttgtccaaggcttcatgcacccattatggtggcttcaaagcccctactgctacatatacgggaccaattactagagtccagtaattgttgcattgtt

SEQ ID NO: 39928 - DNA, 445 bp, Triticum aestivum
  Clone ID: PAT_TA_39928
tattcgctaaaatgagtcatagtaaggaatgcagagaggacaagcaaggcatccaataattgaccgactgatatgtatggattagactatctggattttttttggtgttattattattataagtgagtgtagtactttgtttgaggagatagaagacaaggtggacaaatcatgcgtgctccggcctgaatatcttatcgcatgttcgcacaccaaatgactcagcatttttttatatatttttcgcaatgaaccaaagaatcagcatcagttatggagacacttctagaaaattataagcacgatgttatagaaaccggacgctctctcgcattggatagaggctaggcgagagtcaacttgtaggagctgatattcaaatacacccacacgtccgtccaactagtatatacaagctgaatatactttgtccccttcgaagaaa

SEQ ID NO: 39929 - DNA, 431 bp, Triticum aestivum
  Clone ID: PAT_TA_39929
gtccacgcaagacgctaaagtgagtcgtactagacatgtataacaaatatatttcaaccaacaaaatcaccactcaatataccttaccatgccataccggacgtaaccgtcccgacggtgaccggcgataagctcacgcctacccaaggcagaggcttttcacggatttctttccggtatgcatgcaaggcacatgatgatgattaccatcaccagtatactcatttccaacagcaaggaaatcactaatatgcattcatgcaaatgatcatatcacaatgacaataacaagttctcccgatataaagtggtgttacaaacgtttcaaccaacacatcaaaaatattattccgttgttcagaatgcattcctttaacggtgttgaaaagtgggggtgacccccaatatttccgaaagcttccttctccccc

SEQ ID NO: 39930 - DNA, 151 bp, Triticum aestivum
  Clone ID: PAT_TA_39930
cggtccgagattcacgggtccaccacggtccttgaagcctctaactcgagcgtagtccaatgcaaaagccagtcaacacgatatacattgtcaaaatatctgacttgcatccgcatgcaaacacaaaaaaatgccaaaaatgagaattagc

SEQ ID NO: 39931 - DNA, 439 bp, Triticum aestivum
  Clone ID: PAT_TA_39931
gtccacgttacacactatactgagtcgtagtaacctggaaacttgtccacttccaaggtcaggcccgtggacttggagcccgccatggtcgggtcctgcactttcacgatcagcagcttctccaagcttaaggcgacgctgcggagcttcgagtgcgcctactccaaacccttcagcataggcgggatagcatggttcctcaagctctaccccaatgggtaccagcgcgacgaggaacgcgtgtccctgtcgctagtccgtgaacgttacaaccaaccggcaacgactgcccagttcaactttgagtttgaggggatcgccaattatgagtctagtaagataacacacattttcaatcgtggcaactacgaagtcgaatataagctgccgccgctcagcacttctgcaaaacatgaccctctcatcatccaatgttgtc

SEQ ID NO: 39932 - DNA, 395 bp, Triticum aestivum
  Clone ID: PAT_TA_39932
cgggtcgacactatgacagaaagtgactcgtcataatcgggaagcataggtcctattcatcatccagtacgtaaatgacaccagatcgaatttatgaactgtgactgccatcacagtgtataagtatgactaagaggaaatttcagtcagttttcctatcatcagactgcccattaatacttaccaaaattctcatgtgatagaatcaacaagtcaacatgtgcattttcaaataattagctcacccaaaacccaacaacctatgttctcagccaccaaacaagtgcaactcaacgttatacactatagtttacgtgacagctcaagatacatcaaccactcatatagtcctctaagactgctaacaggcactacgtttacatgatcatgacatt

SEQ ID NO: 39933 - DNA, 420 bp, Triticum aestivum
  Clone ID: PAT_TA_39933
gggtcgaggctatcagggaactcagtttggagaatgttcctagaggttttgttgtagcgatggaagttcaatctacattattgggaaagattcgtgaagctcagaaggatgacaaggaaattgcggagataaaggagaagatgagtgaaggaaaagccaaaggttttcgtgaggatgagcacaacaccttgtggtttgaggaccgtgtttacgtgcccaataatgcggagatcaggaagttgatacttcaggaggctcacgactcgccatacttgatacaccccagaaacaccaagatgtatctgccacagccctagaatattgtttgtaaatagttgcatcttcatccaggcatcatatttaaatttctaaaacatgagttgaggattgttggaaaccctcaaaaccctaaataaaaga

SEQ ID NO: 39934 - DNA, 432 bp, Triticum aestivum
  Clone ID: PAT_TA_39934
gggtccaccagaagggctttccacgtgaagtcttgtctatgcgcactgatgcaccgctctgatttgttctatgtgcatcaaggacaagtaaactatctagtacaacatgctttttcaaggacaacaagtatactattgtccttcgtaattggcgatacaaacttttttctccatcttggccgttcgaggtcaaaagattccatggagtggttaagccagctcgctagggacatggaaatcactagccaaactaccacggtactgccgtccacgccgaaaactgtttgtctaattaaagcagacagctgactagttaacatccttaatcgtggctggtgttggatgccttaaacttaaagctggcaaggtcatggcgcacgcggcctaatgagttgatcgagatctagaagtaatcaaatgcgcatgccgaac

SEQ ID NO: 39935 - DNA, 226 bp, Triticum aestivum
  Clone ID: PAT_TA_39935
cggggccacttgctggtcttaatgtctagttcgtttagagtttcgagttcttttcacattagtcacgccgccgctgcgtcgttagcccttccattgtccaccatccatccatcagtttccaccacgtgctacccaccgttcattgtcataatcatagttgagatcattcacatcttcgcttgatccaatctgcatcttatctagtttgtttggaacaagagagagt

SEQ ID NO: 39936 - DNA, 392 bp, Triticum aestivum
  Clone ID: PAT_TA_39936
gggtcgactgggaggcgatcctgtccccagatcatggcacatttgtggacgccgttaagccctggctgtacccatctgtaaaaatgagcaagagcctgaaagattatgcggatgtcagcgttgctttcggcacgacaggatcggtcgtagcggccttgacttctgccgacacataagttatgaatggtttcacaaatgatacaggttgctttggttgtttcaattattttctttgtttcaccttgcataaattctagcagtgcagtttgctttcgacttgcagtttaaattatatgctgcaatgttgtaacttgaacaataaacttatttattttccattgggacaattgttctttgtaagttgtaacaaataatgtatggaacatttgcgt

SEQ ID NO: 39937 - DNA, 425 bp, Triticum aestivum
  unsure (1)..(425): unsure at all n locations
  Clone ID: PAT_TA_39937
actaaggcaaaagatggagatgatgcagaagctaccaaaggtggggaagattcagatgattcggatggtatggacgacgatgctatgtttcgtattgatccttatattgcgaggattttcaaggagcgcaacaaccttcctggtagtgaaactcagcaatctcaacttatgcgatttaagcttcgcgtgcttactttactggagatatatcttcagaggaatccaggaaaaaaactggtgctggaggtgtatgctttcttaatgcaagcttttgtgaaatcacatagtgccgatggcaatgagcagttcaggcaacgtattggtggtatattgcagaaaaggatattcaaagcaaaagaatgtccaaaaggctttgatgtcgaacttagtaaacttgaaagtttgctgcanaaggctctgcatct

SEQ ID NO: 39938 - DNA, 266 bp, Triticum aestivum
  Clone ID: PAT_TA_39938
cgcgggtccacgaggaccactaggaagagtcctactatgctcctttgcatccaccatcgcgtaggagacaccgccctggcgtcatgaacaatcaccacggagagatgaggaagctgaattaagttacaaggttagctacatccttcccaactctacctacgtttactgtcattcttgtttcaggtcatcaccacatgttcatttgattgtgaaccgtgtatcagttgtgtcattctaaaaaactggagctggacgtgtatgcattc

SEQ ID NO: 39939 - DNA, 364 bp, Triticum aestivum
  Clone ID: PAT_TA_39939
gggtcgacgttaaccactcaccccagccatcgaagtacctcacaagttatgtctctcctttctctgacacaggatgattgatcttcctatgtcattacgtcagcttagtacatccgtatcgccctccatcattcatgcatgcctcctgattcagtctttcacagacttgtgcacagacaggcagttatccccacacgatctgatattgcaggcgtgcgctccggttgtccatcaagcctatcacaccatttgttggcagcagtgctagtaccactccctccatgagtcaatctctgtacctctccgattcttactcatctcgtacacatacgcatggatgccgatcgatctcgcgtaatacatg

SEQ ID NO: 39940 - DNA, 435 bp, Triticum aestivum
  unsure (1)..(435): unsure at all n locations
  Clone ID: PAT_TA_39940
gcgggtcgacatgagacgatagctggagtcgtaattattttcattcatttgcgctctatatcgatcggcctattttgttcatttcctaatatcaagtaactaataactctcttgttcatttaattttctttgcctcgtagcgtttggagacggttcgtagatacaaaggtcggtgaattcaaaaaagagctagaattcaaaagggcaaaggctaagaatggtgaggatattcagccagcggggaccaatctatgtgcatactatgtctgtgagatgatccggagatacacctctgagcgggttccgagtgataccaatgctcagaggaataacctccggatgatgcttagtccagaagctcgcttccgaccacttcaagaggaactanctggatggttcaagagggaagtcctccatcctaaaggagaacaccat

SEQ ID NO: 39941 - DNA, 432 bp, Triticum aestivum
  Clone ID: PAT_TA_39941
gtcgacgccgatcacgatgttgggtcggcattagccgacgtcgatgcgggaactacttctatatatagttgagtaaaagtagttttattaattaaatcaactatctagttcaactactaagcacttactataaataaataagtagtacttactaaagacaaactacgtcgatatatagtagaataagttaggttattaaattaactagctagatcaactatagatgaactacttcttatttttttcctttttctaaatactttgaacaaaaaaatcattaaaattctatgaacaaaattaattactacacatctagtctaaaaaaaaatctaatctagcaacaaaaatctatgaactacatatctaaattactacacatctaatcgaacaaaagaaatctaattaatctaacagaagaatctaacataatat

SEQ ID NO: 39942 - DNA, 307 bp, Triticum aestivum
  Clone ID: PAT_TA_39942
gggtccacaactttcaccggtaatctgtatgcaacgtcataggaagaaaaactatcaaatatgtgaaggagcagtaaacaaaaggatcttaagctacatctacatatattacataaggatcttcaattatgggaaacaaaaagatatgcaaaaacacacatcaatgtaatcactggtttcaaccacaataacatatccataaactttccccccaaaaaaaaaaaaaaaaaaaggaaaaaaaaaaccggccctccaaaagattcaaacctaacttccccttcaatgcaacttaaaacccctccaaaat

SEQ ID NO: 39943 - DNA, 445 bp, Triticum aestivum
  unsure (1)..(445): unsure at all n locations
  Clone ID: PAT_TA_39943
tcacgggtcgacaccactccctaaagtgggtcgtactatacgtgcatccttttgccactgccgaagccccctatccttgagcttgacaagctcatgtggcatcctggacgacgtcctcgccatggcgcccaagcctcgcaaccacatcgccagctgccgccaaagctgatcatgttggcagaccaggatgaggacaacccataccgcacccaaggtagtaatttcagtcatgcttaccaacaagtttttttctacgaaaacaaaacttttgtttctgggcagcatgttcctcccgggcatcaacactgtgcaactttgaatcaaagggtgaggtanctagctcccttattgttgttttatttgattttcctaaggcattacatacataattgtaacccggcctaagcttcctagaaatacataagtctcactaggaagtttggat

SEQ ID NO: 39944 - DNA, 451 bp, Triticum aestivum
  Clone ID: PAT_TA_39944
gtccaggggtcgcagagacttgcagaacacgcaagctttctcatggagctcgtgtccaatgatactgaaaggaaaaatggagtgaaagtgctactgctccagttttgaacttcttattcagtcatgctattactgagtgaaaaatggagtcaaagtgtattgcaattgatctctcttagaccctggcaatcctctatttttatcctttgtttgcttgtcttttggtctgtaattcaagaactttgaccttcgtaattcggtttttggttaatttattatgcccggtacaaacctttaaatctgaagaggcttctaatagcaaaaaaatgtgcagccggtgtggtctatatgtcaattcatgtatgaaaatgtgcattcggtgtggtgtatatgttattcgtgtacatgtattatatgtgtgaaaaaatttctgtatatgatgagatgattg

SEQ ID NO: 39945 - DNA, 447 bp, Triticum aestivum
  unsure (1)..(447): unsure at all n locations
  Clone ID: PAT_TA_39945
ctcacgggtcgacgaccatgtgtaaactaagtcgtcataaatctcaagatgatatgctctcatagagtanggtgtgcatgtgtacattcatagaggtgagtgtaatcgcgtatgtatgagcggttgcatctgtactgtgttaaaaaaactcctactattatacatgcacgtagccaattcatcctcggagaccatgcccaactcaggacatgcaccatccatcaacaaaatcggagaagcagtgcagcccgccataaccccccaattatccaacatggctacacacattatttgattttagcctgcaaaaaaaaatgcaggagtcccgatagcatggaagcatcgatttttttcactgaagacaccaagtgaatacaccaaaaaataggtcaaatgtgaaagggaaaataacagggtaaataaactttggaaaagaccctataggag

SEQ ID NO: 39946 - DNA, 284 bp, Triticum aestivum
  Clone ID: PAT_TA_39946
ggtcgacgactctgctgaagcatgatgttaatgttactctcctgaaaagaatggtgaacttggtgacacatgtgaggaatatcaatagcattgcccacaactgtgctcaccaggttctcaattcaagaatagaacctgtttttagttgtacaaattcagctcattccccttgtccttctatgctttctcttcaagactttcaggttgaaggatttgtaatacacgctgtactttgcaaatgagttgaatgaaatttggcgcctgaatgcgccttccttgtgttt

SEQ ID NO: 39947 - DNA, 456 bp, Triticum aestivum
  Clone ID: PAT_TA_39947
ctcacgggtcgacgagtctcgctacagtgagtcggcccatgatcttgacgacatcgtaacttcaatttcacagctacgaatgaaaaacgaacacggagaccccttggacgcgtaagaacatgcactaccaaaagaccttgcatcactatgatcataattttatgagatttttcaagtccacacataaaacatagcatttataaagtagatgatcgttatcacttaaatttctagaattgttgctggtggccggttgaaaatttggtgtatgggagggaaaaaagcaacccattgatgagtgggtcccacgtgacaagaaagattctataggttgctattacaaaaaatcatttcaagatttttgtatttacatatactgacactagtagaaaacggggcttacgttcgggccagataagcccattagtcttggttccgtcacgaaccgggacccat

SEQ ID NO: 39948 - DNA, 448 bp, Triticum aestivum
  Clone ID: PAT_TA_39948
ttcacgggtcgactgtccggacgaaaatgccctatcagccttcaaacacagcattcgggatgaatggctagcacgccatctcggacaagaaaagccagagccaatggtatcccttacggcactcatgacccgcttttgcgcaggcgaggacagctagccggctcgtagcaaaaacacagccagtgaggcaggccctacagaggccaggaacagcactggcaagctccggcgcaatagacacaaacgcagaagcaatggcgacaacatcaaagacaccacagtcaacgccggattcagtggctccaagtccggccaacgaaagaaaccctacaaaagaaataacaaaggaccttccagcctggaccgcatactcgaccgcccgtgcgaaattcatggcaccccggataaacaagacaatcataccaacagggattgttgggtcttcaag

SEQ ID NO: 39949 - DNA, 427 bp, Triticum aestivum
  Clone ID: PAT_TA_39949
tccctaaactgaatcgtacaaatcaggaaaagtggttcactttcttatcctttggtaaaacgataagcttgaatacaggcatcataatcgaaaaacagatgaccaaaaaagagatgttaactattcatgataacaaccatcatggcaacaaacacattacaccactgatcagctagtagatctcacaaggtcagcactgagcaagtcttcattatctttaacatagctcttgaaatctctcgctacactcttcacattaagctcattattttcagcaccgtatgacgtacaatcaagcacaagctgcaaataagccaaaccataaatatacaggggaaaaggataaacaaagcaatgtattatcataactcgtaaaccaaaatatgcgttcctgtctaagagaaacacaagatctggctggttaccg

SEQ ID NO: 39950 - DNA, 428 bp, Triticum aestivum
  unsure (1)..(428): unsure at all n locations
  Clone ID: PAT_TA_39950
tcccgaaaatgagtcgtagtaatcanaaggatggcacctcaatgctcttcagagacccaacagtctgcacatctgcgtgacgcttcaacacacggctatctatgaggaattcctcaaggacctcgaggattccgtggacacagtgaaagcgaatccagggcctatcagtggggggatggctcccatctatggcgcggctgggaagatgccggacagaggcacggtcaaggagttgcttgtggagttcatggacagctcttgctaaccattgactataccccattggttatctctctgtaacatgtatgactgttgtgtgatcttctatatttggtttggctgcaaaacagaaggcacacaatgcctccaatacagacatgtatctatgtatcagttacattggttgcaatgaagttacattttcagcc

SEQ ID NO: 39951 - DNA, 396 bp, Triticum aestivum
  Clone ID: PAT_TA_39951
ttctagggtcgacgtacccaacgaacatgaaaaatgccgttaagaagaagcgcctgctcgccccgttggcggggccaaggcgggcgattccgacagtcatcgggttagtggacttggttcttttttaattgcctgctacttctctacacttttcccatgttcatgtcacaccatgcagatccgcccttgacctgatgttgacggcgacggtggaccagaccatagagtgggagccggaccggaccacagaggacctcgtgacctggcagactggttgcaaacctgacgtcacggagcgtgccgtgtggcgagaccgggagctggcaatgaaagaggcggcggagcatgcaacgagagacgaagaggctttagcttacgcgcgtgatagagccgccc

SEQ ID NO: 39952 - DNA, 435 bp, Triticum aestivum
  unsure (1)..(435): unsure at all n locations
  Clone ID: PAT_TA_39952
acgtccctaaactgaatcgtactactactccagaactgccaccgcctagccatacatttgtcgtcgccagcagccacgatccgccatagccggccaaccccgctgcatcaaactcctttgtggagagatcctccttgcctttgcaggagccacatggtcttggcctggcggcgacgagagggctggaaaagttggcggcgagggatangtctgacctgtcgtgtgtggctatgcgtgcaaattcaaagaaatcccgagtgggactactaattgactagaatagagttttctccctttttttatcatgtataaggtgcactggaccaaaatcgcaactcagtagaaaaatgccgattcgattgaattgttatcaagacaaggcaatattactattttcagtagtaagaataattccaggcagtagtgtcatcaaga

SEQ ID NO: 39953 - DNA, 311 bp, Triticum aestivum
  Clone ID: PAT_TA_39953
tacataaactgttgccggatcaagtaccgagatagacagcgatctgctgatgctattttctggcacgaagactaaatcaaatcgcagcggtcatccagtcctaattatgtcatgagacggctcaaacaatctgtaagttcatcaattgcaatggccactcagcaaagttaccaagtgcgagtacaaagttggatcaaagaaaagaagcacttcgagttggatcgtaacttggctaccaaatccgactgctagtcctccaatcttcaggagaagagcagggctacatatagaccatgttcggtctgagttcc

SEQ ID NO: 39954 - DNA, 236 bp, Triticum aestivum
  Clone ID: PAT_TA_39954
acctccacttccttcctcctcctcagtcggtgcctgcgcctcgttgggcatcgaatacaactcagtggtagcctggaagacaacaaaacaagacaagagtcaatcaaccgatttgcagtgaaatagaatgaatgaaacaggatcacaaccgaggataggtgttcataccgtgtctggatcgaaagactggtcgagcggcgggatcctcctagccccacgaaggttgtccttgttcc

SEQ ID NO: 39955 - DNA, 426 bp, Triticum aestivum
  Clone ID: PAT_TA_39955
tcgcgggtcgacattgcacactagagtgcatcctcatagaaacaatgtagaatttttcatgaagattctcaaaaaactaattatccccttgtacgattccattgtattataaaaataatgtgccaagattttcctttaggatgtttagatcgcttgttggtttgtgcggtgcaaaacagaaactttggctgtagtgctcgattttaaattttctactcgaatgtcaaatggttttgaaattttttgcactgtatttatatacaaaatttttatttttcctaattttttcagaattgttggagtaccataggtatggtgaatgttcagattactacagactatcctgtttaagacagattctgtttttgatgcattgttttgctcgttttgatgaaactgtcaatttttatcaatagtataagctat

SEQ ID NO: 39956 - DNA, 222 bp, Triticum aestivum
  Clone ID: PAT_TA_39956
actcgcgggtcgacatgacaccctagactgagtcatacagacctgaacaaattctggtggtggttggttgggtactggagggaacacttgcgcaatcataacatcgtgcttcacaaggtgctgcctgcatgaagctgatgtagttgatactgcagtttgaagattgtgcaaaaaacaatttgtatctgaatacacaaatttttatatactccgggatgtacc

SEQ ID NO: 39957 - DNA, 199 bp, Triticum aestivum
  Clone ID: PAT_TA_39957
gtgcgcacggacgcatcagtccgtacatgtcgaacccctgccacattgagctgatcgtgtcagagaaagaaaagcctgtgaacaaggaagctgaaagcgtcgtcgcaccaaggaaagccacccaaactaccggaatggatgcgatcatccaacagtccgagttgtagttcttcacaagtacctttgttggaagtgtttg

SEQ ID NO: 39958 - DNA, 446 bp, Triticum aestivum
  Clone ID: PAT_TA_39958
ttgatgatgtcaattgctcaaggactgattttggcgtccctgccccgaatatctcaattgctgcatggcactccaaaaatcttgtgcaagtcgtctggggtaaacactatttcctggttggcggttgctgtcgatgacgattgtaagcatgccgtcagtgtatctcgtttgaccatacaaggccgacgagcgcaaggatgcccacacactcatcttgacaaccatccatgtaatcggcatgcacagggcgcctgaaagtccacttgctttgaccatggatgcacaacccaaaattttggtctgcaccagtggcagtagcagcagagaaaacatgatttagtgcaacggaagttcatttcataatgatccgtccaaattacatcagccaaactcttacgacttaatcaacggacgcgcgcgcataacacgtgatcgtccctcgtcag

SEQ ID NO: 39959 - DNA, 191 bp, Triticum aestivum
  Clone ID: PAT_TA_39959
cgggtcgactgaaagtcattaaccgagacgtgaaaatggttgccccagcaaaagcaaattatctgaaatggtctcaaatacccatcacattcgaccaatctgatcacccgactcatattgccacccctgggaggcaagctttggtggtcgatccagttgtcgaaggcactcgactgacaaaatgctgatgc

SEQ ID NO: 39960 - DNA, 356 bp, Triticum aestivum
  Clone ID: PAT_TA_39960
tggtccggacatcgcgggtccacatccatccaagtgatccatagcgatacgcccagaggacgcagatcgttggcacaaacaagttgcagcctggggatcaatggcactgttacaactgaaacattttcgacatttatataccttcagtgcatcaaacggaaaatcgacgacaacctgacatgcaagtctatgcatgaggacagtatgtgtgtaccatcactgtccttatggtttgctgctcaaagttagagcttcgttaacttgacggtctaagcagcatgtcatattagctctcaaatggtcgtcccttttacgagcccgtcagtctgaacaaaaattgtcacgccgccgccgca

SEQ ID NO: 39961 - DNA, 398 bp, Triticum aestivum
  Clone ID: PAT_TA_39961
ttaatcctaataatggaaggaattacaaaccttttattcaaaaggtccaaaaaggaaccccctaaaatgaacaaaaggtctttcaattacccctgggtgcttgacaagcccaaggccgaccgtgagaggggtatcaccatcgatattgccctctggaagttcgggaccaccaagtactactgcaccgtcattgatgcccctggtcaccgtgacttcatcaagaacatgatcaccggtacctcccaggctgactgtgctgttctcatcatcgactccaccactggtggttttgaagctggtatctccaaggatggccagacacgtgagcacgctctccttgctttcactcttggagtgaagcagatgatctgctgctgcaacaagatggacgccaccac

SEQ ID NO: 39962 - DNA, 189 bp, Triticum aestivum
  Clone ID: PAT_TA_39962
gatgcgaatcgcgtcaaactcccctccggtccaaccaaggatggtgatgcacgtacggggaatttcaatttcaaggctaatttggacccaaccttgcaatgttaagaacaaagaaagttggtgcctgctaaggcagtggaccccgtttgctcccaattggaagtggaataaaagatgggatgcttagtt

SEQ ID NO: 39963 - DNA, 461 bp, Triticum aestivum
  Clone ID: PAT_TA_39963
cacaggtccaggactcgcgggtcgagcggacgctttaaatttagtcttattatttttttttttgcaaagaatgaaacatcttcactatatcccgagtcggtaactttctctacaattacacgccgcccgtcgaacaccctcgtgagtctgcacactacaaacaagcacggacaaatttgccaaacatctacaggaagaacccaagctaaaaaaaaactaatgttctctttgctttttcttttgtcgaaacaaaggagcagacggcccgtgtttcgatctgtataaacaccacgccgctgctatatcaggggttcggagagctccatctcgttggaggtctcctctgcctcggcaggcggcagtcgtacgtagttcagccccagccactgccatggccagcacacatacctgtggccgctgcggctgctcgggtccgccctattgtccgactcctccgcctg

SEQ ID NO: 39964 - DNA, 437 bp, Triticum aestivum
  Clone ID: PAT_TA_39964
tatggtccgacattcgcgggtccactaaatgtcgtcaacaattatccctgcgtcctctggcgcgtcgtcctctggtgcggcacctcctcttgcggcttccttccgtggagctctcttcataatcctggtcattgctcacgagaggtccatcatctccactcgggaaaaggtcttctcctagatccatcttctcctccagtgtggcaatatatttcttccggtcctcgagtctttccataaaatccttgacttcatcctgatgctcatagtgggcttcacgtgttgcatcctctagctcaatttcacgaagatgcaacttttggaccgtcttcaagctcttgcgcatctgaatctctagagccctgatgtgagcctccaagtcttggacatatgagcgaacggagtcgtcatctatggtgcggataatctctccatct

SEQ ID NO: 39965 - DNA, 405 bp, Triticum aestivum
  Clone ID: PAT_TA_39965
ttccccaaaattgatccttggaaaatttgaaaaggggacaacctcaaccccggggtccccgaaaccctggatttgctgcaaaaattgggcaagaacagtaaatcttgtgtatcaaaccaattcctatagacagtcgacgatggcgtgtattcatttggaattcacaagacttggccttgaagttcccgaagaagagatgttcacgtcatcatttgcatcagccaggttcttgaagtaaaagaatttgtctccataaaagagcgtttacgtcgttggtgatgatggcattttggacgagctcaagttagatggccttgactgtcatggtggtcccgaggatggcatgacaaacatacggttggaggcaaacatctacttccaccaggatacgagtgttcgaactgt

SEQ ID NO: 39966 - DNA, 427 bp, Triticum aestivum
  Clone ID: PAT_TA_39966
accttggcatgaattggcaagcataacaaaatgttgcccccaatgcaatgtgttgcctgccagttagaacaaaacgcccttgccttggaaagggaaacttcatattggctgcaaaacccaacctaagaggcggccggcaggagctgcagaagcagcacacaccaacagcaagccgaggcaacttgggaagcggaggcggcaataatgacttgctgaccacggggcagtctgccaaagcataaatcccattcttctcataagctatagccatgaccaaagacgacatcgcaacgtgcccctccctcctatgcctcaaatcgtgtaccagcgagagactgtaccagtgtagagaagcccttgcgaaactattatttagttagaaggctgattgctgatgaacattgattttaactataaacatatatat

SEQ ID NO: 39967 - DNA, 225 bp, Triticum aestivum
  Clone ID: PAT_TA_39967
tccgggtgcacaagatcctgcagacgcatcgaatccacaacactcgctttgaggcgcacttcatgatacatgggatgcttggtaccactcgtggcctatattcaacggctgggtgcaacagttgcggtaatcaatgaggcgattctggtgcacgcggtgctgtttgacactcagttcagttgaggcagccggtaatgttgttgcggatccatgtcaagctcgatg

SEQ ID NO: 39968 - DNA, 449 bp, Triticum aestivum
  unsure (1)..(449): unsure at all n locations
  Clone ID: PAT_TA_39968
cgcctgccggtattggtccgagcatcncgggtcaacatgttccgataatgtaaaagttcagcaattggacacaattgcaatcgagtaataatgcttgcagttgcaactgtagatatggacatgcaactggcctataaaaattgtaccggcccttgttgcagtcacattgagggacatgtagttgtagttgggttgcaacacttgtggttgcaagtccaatggtggacataataacaccccctattggcctaattgcagcttcattggggccatgcaattgcagtcgggttacaaacacttatagttgcaattctaagtaggttgacgtataactagctgacaacccccgtttggacccagttgtagttgcattggggcatgaacttgcagtcgggttgcaattcttgcaattacaagtctagtgatgggcatgcaactggcaacaacca

SEQ ID NO: 39969 - DNA, 410 bp, Triticum aestivum
  Clone ID: PAT_TA_39969
actaaaatgagtcggatgatatgcacatcattggtaaaattccttacctgcaccataaatcagggcgatgggtcgtgccaaggcgatcgacaacgcagctctagaaaaaattccggcgctatgggatgaatttggtgttctaaagaaagatagtgcccagatgcaaaatcaagtgtccaagctgcaagaagatgtacaagccattagttccaagcaaggagagattccagcaactgttggaatagtggaacaggtagttctggatttgggtaagcaattatcaggcatcaataatgttctcctgacattagtgaaatcaactcagcaagggctgcaagctgatcacccttccagttctcgtgaagtggccagatctcctactcttcatcaagagcaaacacaagaacaag

SEQ ID NO: 39970 - DNA, 381 bp, Triticum aestivum
  Clone ID: PAT_TA_39970
gggtccactccatttaatgcgatatttttgtactactcttttgcaaacactcctagctccttgagcatccatggcaaccatgatggtgacattgtggaaactgccaacataactagaatggcaactgccaacataacgagatggcaactgccaacataactagatggcaactgccaacataactagttggcaactaacagaaatacatggcaactctttcctttcttcatgccctccaacttgatgattgaaggaacatacgttaccttcttttttgcaaaataccatgatggcacctgattttttttattttaaaattgttgtacatcagcacatttacgtcgatcgtcgtgatcaacccactgtggactttactgagat

SEQ ID NO: 39971 - DNA, 444 bp, Triticum aestivum
  Clone ID: PAT_TA_39971
aagcgatagtgagcgagcagttcttggcgacgttggcgacgcacccgacgaagttgacggtgaccaagttgtacaccccaaacgggccgagattcaccttcaagaactccgccggcggcgaggccatgctggaggtggagtcccgcatgggcttcatgagcctacgctcacaccaattcctcgacgccacatcagcccaaccggtgatccatctccaggagaccggccttgaggagcgtaagtgggaggcgtacaggggcaacagcacgagagaaagcgacaagatcttcgacgccgtgaacaagtcatggtatttcttcctgatggggaccaagatcgaagtgttcctccgcaagtcctccgacgagccgaaaccagcaggcgtcctcgtcgatggcaactcctccggcggcatgcagaaaccagcagacttcgtcgtccttg

SEQ ID NO: 39972 - DNA, 439 bp, Triticum aestivum
  Clone ID: PAT_TA_39972
cgcgggtcgacgatgctcacgacaatgatgcatatgcaggtgggattggacgcgaagaacgagctctgtgcaagctgcatggattatcatctagcatgacgatgacctgccgctgggagcagtcgagaccggaccaaagtgcccagcgggcctgtccccctgaaccggaccggcgaggcgaaagctcggtcagggtgagggatctagcgatggcgagggagcgctagctgcgtgtgtgtgtgtgtgtgtgtgtgtgttgtgcctttgtgcgtgcccagagtggttgcgtgcgtttgtgccatgccctatcctaaagagcaaatcctccggatgcttgttgcagacaaagaggcagtccatctatggtagcatctcatcttggggaactctgccgcccggcggcactgtcaccacatactactatgtacgtacatcgttg

SEQ ID NO: 39973 - DNA, 438 bp, Triticum aestivum
  Clone ID: PAT_TA_39973
atgtttacagagagaggtgtcgatataaacaaatcacgtcaatagtagcatcatgatcattttattataatatcagtatctcatcatacaacttctcatgagcaagtaacaattcatcacaacggcaaagtatatggcataaactttcttggtagctaataaactatgttgttagtcaacagtgcaattgcagctcatcgtgtttttaggcagggtcgcatgttagagcttttgttcaacaggtccacatactcgactatcgtttagtcttctatgattgctaacactcacatatacaaatatagctagcgtgtcagccagacacatagaaagataggggcttatgatttcacctcacgattcatttacctcaagggtaatgtcaacagtaataactcattatcactcagactcaactggatacatgtgtcgacatct

SEQ ID NO: 39974 - DNA, 403 bp, Triticum aestivum
  Clone ID: PAT_TA_39974
attcgccggtcgacacctgaatctcgggacgagattctgtcaagtgggggcgagttgtcacatccctagtctggtatgacctaggctagctagctatttgtgcatcacatttaaatttcatttaaatttgaaatgaggattggtggaaccctcagaatcatttttgaaaatgacccaaataaaaatttctccaaaatggtccaagaagatgctcatgttgccctctgaccatattggacagagatagaaatccatgcaatatttttaggagctcatggacatttactttggccatttggacaaattcgataaatatttgcattggtaatataattctatatatatgaaatatggcccacaccttatgccatttatcaaatagctctggaataatatatccagc

SEQ ID NO: 39975 - DNA, 386 bp, Triticum aestivum
  Clone ID: PAT_TA_39975
agtccagtgcgctaatgggtgctcctatgctggtttcgtgctgtgacagagaagtcagagctgcggtcagcgacgccattgcggcaacgatgactccatgagggtggttttcagcgggcggtgctctccgggtgttgcgttggactaggtcggtgcgaggcgtgcaactttctcatgtgaagctcttcagcaaaatcggagctgtcaagtcctcgacgcttcggtcgattgtttggcgtttgtggccaggtcgtctgtgtgtgccccgtgggggttgtaatctaggttttcacccggttttccgctaattaaccgggcaactctcttctgcttaatcaatgaaaatggcaaatcttttgcctcgttccaaaaaaagaagtaagaac

SEQ ID NO: 39976 - DNA, 433 bp, Triticum aestivum
  Clone ID: PAT_TA_39976
aaatgaaacacgtaatacatcaaaaaggataacatgatataattcacatatatggcgattggctaaacaacatgacatttcataattcacatatataatgcatttataaaaaattgaatatatcatttgaaatatgttaaaaaatatatttgaaaaaatgtcagtcaagcaattgaaaaatattaaaatgttattaaaaatgctattcttttatttgaaaaaaattaatgaagcatttcaaaatattaaaaatatctatagaaaaaaggttgaccatgcattaactttttttatcttgtatatgagaaatgttgataaaacatttgaaaaatgtttaaatgtatatgagaaatgttgattaaatgtgaaaattttaaaaatatctactgaaaaaaggttgaccaagtattataattgttaaacttgtatgtga

SEQ ID NO: 39977 - DNA, 439 bp, Triticum aestivum
  Clone ID: PAT_TA_39977
gggtccacgcacagaagggaattgagactttatctatttcacttataatttgaatttgaattcaaagtggaatttgatatcagatatggctcaaaggtgaccaagcactgtttagcaaaatgaattagcttaattaaagagggttactgtacctcattacataggggtgttacacctccacaaccttattcgccgtcagcagcactgcagcataaaccctagctctcctctcactccttcacttccacttccatggcatggccgtacaacattactgttcgtgaaatggaacttctcaccatttgtgatatcccggcgccactggacacgcgcctgtcagtgggatggattctgagtgctgaggtcttcttgtggtgcctactccccatcggtatcgttgcctttgcgcacctcgtttgtatgtttcgggcacgtctga

SEQ ID NO: 39978 - DNA, 439 bp, Triticum aestivum
  Clone ID: PAT_TA_39978
aacgaggatgaagatggccagaggaggtacaagaggcaaatcctaagggagctttatgcgggaatgaataataggcgtattaggaccaggaactggggctatccatgcccattttgcaaccaaaagcttcatcacacgtataaaagtgttctggcacatgcaagaggacgagccgttggctccttcaagcagatgtattctcccagggtggcacacatcgcgtacactgagtacctagagaagcttcaggatcatgccgacaaatgagatgagatgtgggatcgaactatgtatggctatgtagtgtcttaattataaatgcgcctgagtatgcttaatgacggttgaactatatacttatggtttacctatgcttgtgtacgcttattacctatgtctgagtatgtttaatctatgtttacttgtgtctaaatgtggg

SEQ ID NO: 39979 - DNA, 450 bp, Triticum aestivum
  Clone ID: PAT_TA_39979
gggtcgactttgcatcttttggcatcaatattatgaatactagatgatatctcacgcattgctgcgggaactcttggtcatatgcacaaggtaatacataaatggaataactttgtttacatgatagatatatgatcttaagatgaaaacagtgcaattgacacaatattgggaataagtaatcccgtatgacttgcataagatgagcaccaagatccaaatccatgtggttgaagacaacaaacacatgcaagcaactaatcaaaaatgatataagatattcttctgacatacttgcttagtgatgattgttttttcatctattaaagccactggataatggagctcacatgagaatattcatgaaaaggactaattttatttatgcaaattggtaagaacatgatttaatattatgcattccatttgttattttaccagaaatttgct

SEQ ID NO: 39980 - DNA, 315 bp, Triticum aestivum
  unsure (1)..(315): unsure at all n locations
  Clone ID: PAT_TA_39980
gggtccacacaagacgacaaaatgagacgtgctgcaagatgaagatggtctacangccatggacgaagatgatgatgcggactgcggcggcgtgtctgacaacgaccccttcgcctaggcactccattgctggctggggttgccgcggctgatgcaaagagagtgagagagaccgttcgtttgttgttgtgaactagtggacctgtgaacccttgtatgaactagcctggggtgtatagttgagagtatacagacagctgttgtgaacttgttgtggtcgtgagtgggtacagacagggtttaaagagtttgagc

SEQ ID NO: 39981 - DNA, 441 bp, Triticum aestivum
  Clone ID: PAT_TA_39981
ttccactgaagcgaagtccatcatcacatcgaaagacgggacacctttgcttctatcaagtggtatcagttttcaggttgctcggtgagattttacagtttttcacagtttagatcgcatctgtcattcatacctacagtccatgaaaaagccacaaaaaaagttagatctgttcatcatttatccaagccagtccgagcctttgcaattttctattcattgcttgcatagttgaattatcggttgcatcgtcgtgtcagttgctggtcttagtgtctagttcctttagagttttgagttctgttcacattagtcacgccgccgctgtatcattatgccttccgctgtccaccatcccatccattaacttccaccacgtgctacgcactgttcattgtcataatcatagttgaggtcattcacatcttcgcctgatccaat

SEQ ID NO: 39982 - DNA, 417 bp, Triticum aestivum
  unsure (1)..(417): unsure at all n locations
  Clone ID: PAT_TA_39982
agcggctactaagtgggtggtgggttttcttcgtcgcccgcatcccattctagccggacatagttcagctaaggttctcctgacaaggagagagaccttaatgaatttagcacgtccccgaagggtgagtgctgaaagatgtccgcggaggtgaactccatgatcggcgcccagtcggactcgacgagcacggatatgagcggctcggagtccgtggctgtagatgaatacagtggtttggcgatacgactctcgtaaggggtaaagtcagcatccggctccatcgccactgagagtacggcctccatgacggggtccatcccttcgctctcggatggcgcgacttgctccggatcgatggacggagtatcttcggatgcgatctcncgaatactgtccgacagcagagtggcgtca

SEQ ID NO: 39983 - DNA, 443 bp, Triticum aestivum
  Clone ID: PAT_TA_39983
agcctagttgcttggttggcctcgagtccgaaaacaaacctttctcttccggcgccaccaaagccaagcttaaacgaattcggaggaccatcttcttttgcctctcaaggctagaagctcttcgtctcagcaaaaacaaagaaaagaactccaccacatatgagttaatttgcatgccaaacaagctcaaagcaagaaactacaagcaatgtctagtaggccgagactaagctaaaaaagtgtaatgtatgtgtcccatagcatgcacacaacataacaaatagctctcaatcagttatctaatccccctcctagtttgcgttgtttcaacaacaaaacccatcaaaaggatcgtgatagtcacaatcaactcgatccgttcaaactgcagagttttcttggtaaattaccaagagtagataagagttctttgcgtaatcgtt

SEQ ID NO: 39984 - DNA, 415 bp, Triticum aestivum
  Clone ID: PAT_TA_39984
tcgcgggtcgacagccatgttaatttagtttcgtcgatcagttaggccattaatttcgattagtcgtgagatattttgtaatcgagattgaaccatgtttgagtggaatgaataaatgattggtgtgattatgattgtgcagtcatatgggtagtgatattttctcaatagaccattgttctattctaattttctcatccactccaaaacaccagatgcctccgagacgtgaccccggtctcaacttcccgccggagctcacccagctgatccagcagcagaatgccctcatgcagatgctcatctagaaccagaacaacaagaacaacgatccaccgccaccaccccctgttgacaacttgactcgattcctaaggctgaatccgctagtgttctctagcagcactgatacgat

SEQ ID NO: 39985 - DNA, 429 bp, Triticum aestivum
  Clone ID: PAT_TA_39985
acattagaacccatgttcaatgtctgatatgtgtccctggaccggaggatattaaacattgtttgttcgactgtgctagagcaaaggatgtttgaaaggcactaggtctctatgaggaagtgcgcaaagctattgtgaaagcccggtgagtaacaatcaccctagaatcttatgtaagcttgaattggtttcgagggacatttcttcagtggaacttgcactagttgttgtgtggttcttatggtggcagcaaaagcaatggatgaaaggtgaagcggttcaattgcttgaaagatcggcaatatctattaaggtcctggccacaaacttcattagagcatctaagctgaaaatccagaagcggaagtgggatcacatatggaagaagcccattaaggggttcagaaaaataaatgttgattcaccctt

SEQ ID NO: 39986 - DNA, 424 bp, Triticum aestivum
  Clone ID: PAT_TA_39986
acattattgcctgaagatgcttggttattgctcaagaggcaggtactctcaagtgagatagatgaagattacacagatacgctaaaggatatcggattgaaaattatagaaaaatgtggttatttaccacttgccgttaaagtaatgggaggattattgcgtgaaagaggagggctacgtcgtgattgggagcatgttttggatgattctaaatggtcagtaactaaaatgcccccagagatcaactatacagtatacttaagctatgaatatatgccttcatatttgaagcagtgctttctatactacactcttcttcctaaaagtaaaccttataatatggatcaagtagttgcaatgtggatgagcgaaggttttcttcatggaaactcgagtgatttagaagaattgggaagaaattact

SEQ ID NO: 39987 - DNA, 436 bp, Triticum aestivum
  Clone ID: PAT_TA_39987
cccgggtcgacacgacagaaggggctcatgctcttgctaaacttgtttctagaagttgggcgagtggctagggttagtgcatgatatcatatgtatttcagacactttgattcttaaataaagtccctagttaccctttaaagtatatacgtgaggcatagccgcgcctgttagttggagctaaaggaactgtagaggaggtttatgaggaaccgtcccagtgatgttttcgccaaaaataacgccccagtaatgttaaagatttgttttttaagcaacagtgatgatcgcttcactacttcttataaaacaacagagttggtgatgatggtgtgcctgccatcttgcaatatatgccgtctgatctatatctgacggttaggaaggaaaatatgacaattttgcaaaaaaatatctgcactcctctccacatttg

SEQ ID NO: 39988 - DNA, 445 bp, Triticum aestivum
  Clone ID: PAT_TA_39988
gggtcgactttcccgtattgtaataagtgacgcacatgcaacacgtcacttgtcgcaaccggcgagttttcccttttttcgtagattcgtttattcaaaaaaaattatctcttaaatcgtgctccaaatcttgaaccgttttcaccattggattccttgcgtcaagatcttcaaaactagatcccatgttgatagattttaacgaactttttttccacaaaaaaccgaaaaaattgaaccagtagcacgtttttttctctttccgaatgaggcacacccgcgcctctcgcgacatcacaaccgtgcctctcgtgaaagcaaatccgtgactctcgtggaagaaaaaaaacagaaaacacgttttttttcgtttccgagaggtacggccgtgactctcgcgaaagcacaaccgtgcctctcgcgaaagcaaaaccgtgactctcgc

SEQ ID NO: 39989 - DNA, 447 bp, Triticum aestivum
  Clone ID: PAT_TA_39989
atgcaactggggaccctcgacatatagtacgaaacaaaaagtacattttaatagacgaagaatagaaaacagcaagaaaaaatgacaaatgggaataaaagataaaatgagaatgggaagcacgagtaaaaatgaacttgccaaaatttagaacaacaacaaaatccaatattttcaatgaaaaacagaaaaaaaaatctagaaccactactcctccccttgtaatgcaattggaggagataaagaaaatcgatggaaccgctactttcattcacgctctcttcaattctagaatggatctagctgtcatcctctttgtgggtctaaaatatgaataatgataagcataaaaaagaaaacacaagatgagagagaaaaaaccaagaacacaacatacaagtagaaaaatttatcttctagtacatttcagaaattaacccaatctca

SEQ ID NO: 39990 - DNA, 379 bp, Triticum aestivum
  Clone ID: PAT_TA_39990
tcattgccttcaactgtactcagcaccatctttgttacttcttccccacaacccccaggggtgttgaaaaaagtgagtggggaaatcgtcagggcccggagatttgatggggaacatcttgaatagagcgtccttcacttcctgttgcgtataaggcgcgttgagctgagcattcatatcgcttgtcactttatgtggaactatctcaataactctatccacatcttgcattccctctgaagtatatatggttttatagaaagagtttaccatgttttccatctcatcattatcctccgagagactgccatctctgcgcatcaaagctttaagcttagtcttccttgggtcaggaataggcgctcgctaaccgcgcctg

SEQ ID NO: 39991 - DNA, 391 bp, Triticum aestivum
  Clone ID: PAT_TA_39991
ggtccaccgaaaggggaaataccgggcagggaagtcgtgaagaagctccctcttatgtttaattatagtttttagttgttgaacttgtccaacgatgaactggggtgatctattggatgatataaaatgggtttatgtgcatttcgttgtccgtttgatgttgatttctccgttcgttgtttgatcacgtagagtagttcatcacgttgcatgcgtagtatggatatagggtgccagatatgatatacgcaaatatgaagagaaaaatttaaagtgtgaccagtcagtgccagtggacacgtccggacacgtccacaaaagtttgaggagttcgatttgctgtctgcggttgtaaatgctcttaggaccctgtgggagccgtaagtgcacg

SEQ ID NO: 39992 - DNA, 409 bp, Triticum aestivum
  Clone ID: PAT_TA_39992
aatgctggacgcaccacgggaacgggggctaggcaaggagaacgttattccatcttcagagagccgtcgttgtctcgtctttctgagcaggacacaaaccttaacagatttcgaagacacatctaaaaacggagccctcacaccggcaagggtcgggatccactgtgttctcatgaccgtaaggccaccggagacgaggcggaaccctaattagggaggaggcggcaggttataattcatacgaactgatttgtagttggacggctaggatgacagttgtatccccagccaaccaaggatgaagtcctagattattgatgagtggattttatacatacttttagagtatattatagtgccaaaatccctcacatcatatccatctagcacttagtcatgtctctaatgt

SEQ ID NO: 39993 - DNA, 430 bp, Triticum aestivum
  Clone ID: PAT_TA_39993
gtccacaatgcccatgccactgaagcgactaagaagcgaccgtgctcggctgggttaaggcttgcactcaaaaacgtgatgccaagcctcgcggcagccttcaccgagatcggcgccgaggggtgtgaagagttccagttgctgcaaatcaagttgccatgtgctctcagcaccactcactacacagagtagttgcgggtatacgatattttgtgatcctggtggtgttgtgataatcatgcacatttttgtcctacaacaattagatactcctttttgctttaattccccatcaggagagatattgtcgtagagtaatcagttatctatcaacatacatgtaaaggctgggtagagatttgtcaatgtgatacatcagtagaatataacctatttttcagaaagaagataatctacatatatagaagtg

SEQ ID NO: 39994 - DNA, 432 bp, Triticum aestivum
  Clone ID: PAT_TA_39994
tcccacaaaaaacgatagctatctcatcgaaacatcaggacaccttcggctctatcagactcttatggcaaaaactgggttcaagagtttttgaatgcacaactagtatctctacgcggtacaaattttgtctagccagtacttcgggatgccgctaatgcaacactaaaatcatagacccttccacgaatctgtatgcgatgcattagtcacaaacggtgatgtaataaaaccgctaaaaaagatgcaaaacgtttgcgatggtggatccatcaaacatggttcaaattttaacaatagaaacgggcagccagatgaaggtgtgtgcgatatgcggcatactattcactcggattaactgtttgtgattaggcaacacaacagaaatggtcagccagatcaaggtgtctgccattgaaggcatacaattca

SEQ ID NO: 39995 - DNA, 432 bp, Triticum aestivum
  Clone ID: PAT_TA_39995
aggagcaggttggcgacgccttcggagctgaggtcaatgctatggcacagggcgtcgcgttagctgcggagttgggattgctgagagtgagcttcgaaacagattcccagctcctggctgataccatggacctgcataaggccgactcctctgcatactctccagtcattgaggacaccaagttacagctcaagttgtggttctcgcgtcatgtaatcgtgtcttgtaggcgtgaggcgaactctgttgcccatgaattagctagtttgggtcgcttgtgtgaaataaaccactcgatgcagtgggacgatgatgtaccagccgctgttgcagcttgtgtccaggctgatttgccgggacaccgttaagttaaagctactcttttcctcaaaaagtggacacacaaattttgccgaaaaaagaaggagcaaa

SEQ ID NO: 39996 - DNA, 251 bp, Triticum aestivum
  Clone ID: PAT_TA_39996
gtccacgtgccctattatacaggaatctactcgatctccaattgctgtgggggggggggggactatttgtatcatcccatcggtcgattcactgtcaagtgcgaaaatgtgtgcactttgtgatctctgacccttaccgggaaagtctcacttgagtgttttgacgttgcgaaagtctctagcaatgagcgtatatctcaccaagcctgtgctgtcactacatctaaagaatgtccgtcgctttgtcggat

SEQ ID NO: 39997 - DNA, 340 bp, Triticum aestivum
  Clone ID: PAT_TA_39997
ttcacgggtcgactcccgcacgacactgacgtacctcgcgaacgagcttgtggacccattggtggaagagctgacccggagggtcaagctcgcgccggcgaactcgctgggagatctcctgctactgtgcttcgacgtgagcggggtacaaaacgggcaagtggtggcgatgatccctgacgtgacgctggtgctcggcggcggcgcgacggtcacgctaaaggcggagaacacgttcctggatgtgcatgacgggactctgtgcttggcggtggcggcggcgtctgagcacgatactcctgtgtccatcatccggaatagcgcgcagcagaacatgcac

SEQ ID NO: 39998 - DNA, 416 bp, Triticum aestivum
  Clone ID: PAT_TA_39998
acgaaaaatccaacggtgaaaatggttcaacatttggatgcatgattcaagagataaaactttttgaataaacaaactacaaaaaagggaaacttctgttgcgacaagtgatgcactatgcgccacctatcagtgcctgagaagttgaaagtgaccttcgaaagggtaatccttaattagtgatttgtggtaaggttctgcttgctacgggacgcgccaatgcctccctaacagcgagacgtagggcagcctcgcctgggctggcccaacccgcgggaggccacatgccacaacctcttttcctccaatttttcacttttttcaagtttacgttgccaatgcttccaagtaacaattggaaaatattaatagttcatttgaaaagttggtaaatccgtgcaggaaaaatgagtcgg

SEQ ID NO: 39999 - DNA, 207 bp, Triticum aestivum
  Clone ID: PAT_TA_39999
ttcccgggtccatcctcagggtacgagaatatgggcggttatttcaccgcaaaaagggctgaagtcggaaacctcgggtggttaaaactcctccatagcgaagatggagccactccagacataacccccttagatcacctgtcaagagttattcacactagtatcaggggcaagtaaagggtttctcgggcgccaaccaaaagggct

SEQ ID NO: 40000 - DNA, 355 bp, Triticum aestivum
  Clone ID: PAT_TA_40000
tccacggactatgctcttaagaatgctagctttcggcttcacccagtctgaggtacacatccggatgacccagtagtaacaaccgcagaggtgctccctttatgccctagccgaactaacgggaatgtagggcataataacaggagccaggcaacccaacttggccaaaacttaagtcatattgatgcatataatggcgaagaaaaggtatatatgagcaaaaacacatatgtgatgagcttgatcctcggagaataagcttctgtctgggaagcccccaagtatagtgggcgtacatgctcaaggatgtgtacatcacaggtgcacggtttagccatgcgaaagagtttaagtt

SEQ ID NO: 40001 - DNA, 344 bp, Triticum aestivum
  Clone ID: PAT_TA_40001
tccgtggtggaacccctccgcgagttcgccaaagacatcgtcagcctcgtcaagcgctgccactggcccgaccgcaaatgagttcaccatcagtggacggcgcgcgatcgcgatagggttcgtcgtcatggggttcgtcagcatcttcgtccagctcatcttcatctacaccagcaacatcagcgtcggctccagcaatgttggacgacaggattaccagatgcggggacatcgtgatcccggcaattgagcccgcggtgtgtccatgtacgcgcccaaagtttgttctgaacttgttgttagagacctgacttgtgagacattgtcactatcttcatcatcct

SEQ ID NO: 40002 - DNA, 213 bp, Triticum aestivum
  Clone ID: PAT_TA_40002
atgtctcatagaaaccacccggccttgcgtctgcgaacctgttatgcgccctgatactgtatgacacgttcacgggtgcgtcctccgtgtcatggacagcatcgtaccgtggttcgcatcggacgcagtcgcttcctgtttcagtcacttcatggcaatgtatatattgatgacatgcaccggtaatgcatcactctgcgactttcaggactc

SEQ ID NO: 40003 - DNA, 368 bp, Triticum aestivum
  Clone ID: PAT_TA_40003
cctaaatttattcttattatttttggagttgaaaacgctatactactgtattatgttactacgaaacaccgtaaagatgataggagggcaccaaatctgttgcgtcattcatatgtaaaaaccccaaaatgaacagatggatctcaactaaaacatcacacgacgtcgcctgatttaggggcgaccctagtgtagctgcacggtagagcgcacgccagatgacagaaaacttatggttattcatcgctgtaataactagtcaacaaaaatatggcgtcgccgattttattccagccgagggccggtgcagggctacggcttgaaactttggaatgaaccacagaggtccgtccaggtgccaactgatg

SEQ ID NO: 40004 - DNA, 310 bp, Triticum aestivum
  Clone ID: PAT_TA_40004
aggatggttacatcgcccacccatatctgcgtgtctgaccctctcgacgacgaatacatgcattgaccagcagtcaatgatagacactattagaatatctttacctttgtaacgtatgctaattttacaagcccgatcattctgactgtgtgtcacatgcctatgcatctgaataaaggtttcttcatcgaatccatatccatcactgacatcatcacctcaatcaaatcatgttgcaacgacatctttgttccactcccagtcatgtcggcattatctactgtgaacgattccatcgttgtggctactc

SEQ ID NO: 40005 - DNA, 382 bp, Triticum aestivum
  Clone ID: PAT_TA_40005
gacagtgggcgcaacatgtttgaagggaacgatgtgtcagatggcatgggcttcggaatgctaaccgagggtgagagatccttggtcgagcgcgtgaggcaagagctgaagcatgagcttaaacaggtaaaactcgctgccttccattctgtcagctgccactatgttggtgtccaaactgaactgtaaacaaaattattttcctgactttgcaggggtatagagaaaagcttgtggacatcagggaggagatactgcggaagcgaagagccggaaagctcccaggggacacggcgtctaccctgaaagcttggtggcaagcccacgccaaatggccgtacgcaactgtagtgtgacagacatcccgcatataccgtcatcg

SEQ ID NO: 40006 - DNA, 407 bp, Triticum aestivum
  Clone ID: PAT_TA_40006
tcgtgggtcgtcggaactgtctacagtgagtcgtactaatgcttgtttctcgccgtgacagagaagtcagagcttcatgcgtttaaggctccggtccatgcggcggtgcaggtcatcgccgtgatttcgtcgggcctgggagaggtgagagacgggactaggttggggattgcaggggcattttcaacatttctctatgggtccatcttgtcaggggcaaatcatcaagatttcagcaaacgtgtggcaaaccattaatgacgacaaaaatgagggaaaatcctgaaagtgcaaagaaagatgtggcaaatcctcaaattccccgagaaaacactgtccccgatgaagaagccaaacattctagagttaattccaattaaatgagcaaggacagaaccaccaaagcc

SEQ ID NO: 40007 - DNA, 386 bp, Triticum aestivum
  Clone ID: PAT_TA_40007
ccacattctccgctaaaatgagtcacattatacacttatagacctgtgtacactcacaaacgcatcagtcccttaatctataagtcttcaatacaccaaaatcactaagggggcactagatgcacttacacagtcagaccgcccggttttctaagtatttccgccggtcattaaaataaattaaaaaattttcatgaagtttccaaataaattttccttgcaattttaaataacaagttataaaataatttaactttccttgaaaacaatgttccaacatgtattcacaagataattcactaagtaccttaaaaatattccacgtgtattaaataaatattacacgtgtacatgtaaaatgtacaacgtgtataataatactatat

SEQ ID NO: 40008 - DNA, 396 bp, Triticum aestivum
  Clone ID: PAT_TA_40008
atcgtaagatgtatacggacgaatgtgcctcatcatgttggcgattgcttcctcactcaggctaacttacgatacgagagacttggctgcaggtgagacttatgttttcaacttagtcactaactgcaatttctacttcctggcataagtttttttccggcgatcaacactcattgcgtcttaacactgtaagattggggaaagtgtaaatgcgactcttactagcatcaagatccaacccttgacacgggagtataaatacctcacgtaacagtttggccgcactaaatgatcgatcctgtcatccgcttgcatactcagttatatcacttccatattgcttcagtcgatctcttcacaggctgtcggactacaccttcatgtctgcgaaactcc

SEQ ID NO: 40009 - DNA, 423 bp, Triticum aestivum
  Clone ID: PAT_TA_40009
tcgactacggtccattaaacaggacgacattcaagaacaagtatcaacttcccaacatcaacgagctattcgagcaactcaaaggtgctaaagttttcttgaagcttgaccttcgtatgggttatcatcagattcgcattcgtgaagaagatattcccaagacaacattcagaacaagctttggttcttatgaatatactgtcgtgtctttcggccttgtcaatgctcctccaacattctctcggatgacgaatttcatcttcaacccctataccaatgaattcgtcctggtgtatctcgatgatatattggtcttctccaagaataagaaggaccatgccaaacatttgcggttggtgctcgacaagcttagagagtataaattctatgcgaagttctccaaatgtgagttttggctcgatg

SEQ ID NO: 40010 - DNA, 403 bp, Triticum aestivum
  Clone ID: PAT_TA_40010
tcgacgaggacaagcatggagatgagtctaacatcttcggtgggcgtgtggagatgtgtctccggcgtatctgcctttggtggatttgctcggatctgttcatcgttcgtctacgtttgtgtgtctttaggttggatccttccaatctacactattcttcatcagcgacgtttgctgttctggtgcgctggttctatggggccttagcacgaagactttccgactgtctactacaacaagctttgcccggctccggcgagggggggctgatgacggcggcgcgctttcggcccgcttcgatgcttgtaattatcggtagatggtctatgaatctgaatgtaatttttattatttccggtgttcgttgtactgccatgattaaagatgaatacatccaatgttt

SEQ ID NO: 40011 - DNA, 404 bp, Triticum aestivum
  Clone ID: PAT_TA_40011
gacgtcgacccggaagcgcattatttttattttttttttttttttttttgcattttgttcatgtcaccatgtgcatctcatttgcatacgtgttcgtctcatgcatccgagcattttccccgttgcccgttttgcaatccgacactcccacatgcaccggcgcaccccctcttgtctcttttcgtgagcgggtgtcaaacgttctccgaatggaccgaggtttgctatgtggccttggtacaccaccggtagaccacctgtcaagtttcgttccttttggaggctgcttgatgctccaacggttaaccgggtaaccacaaaggcctcttgtgtggtgtagcccaacaccctccaaaacagcccaataacccatctaagccccctccatgctctccgccgttcga

SEQ ID NO: 40012 - DNA, 392 bp, Triticum aestivum
  Clone ID: PAT_TA_40012
ctcacaggacaacataaaatcctatcaagagtctaactagtggctgtgtgttcacctggggatgaacatgttctgcatgatgtttagctgttactgcaactttaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaccggccgcccaaaaggatcaaacctaacttacccttgaatgcaacttcaaaccccttcaaaattgtcaccaaaattaaatcaactgcccttcgtttaaaaacttcttaacgggaaaaaccctggcttaaccaaactaaacccccttgaacaaaaaccccctttcacaacctggcttaataccaaaa

SEQ ID NO: 40013 - DNA, 387 bp, Triticum aestivum
  Clone ID: PAT_TA_40013
ggtcgacgagttccaccaaatctgttcctactaaacacaggatacttgttacagctccacattgccaacaactcattagcgtatcaggcacgcaatgggttcgggtggggtgcaactggcccgcccgcaaactcaagggcggtcgaacaaagcagtgcatcaatgctagctctctacatttcgcatccggcgtcgtaatcccattcagtaaccgccgctcgatgcattactatactccaggggataaacgccatatcttagcccgcacgagacgtggatctcggccgcaatccggatgaggggacgggagatgaggctctggctcgtaccttcggcgaccttgaaccaatatgccatggcaggatcatcgcaccagcaagatgatgg

SEQ ID NO: 40014 - DNA, 421 bp, Triticum aestivum
  Clone ID: PAT_TA_40014
tccacgaagaagccaatctggtctcaatatcttggacccgaatatctggtgtccttcagtgaccagctaaaacagttggttgagctgcacaggtcagcagagctagccgtgaaggacctgatagtctggctatggcctgccgagcctatacctagcagctacttcggacttgttaagcggcttgtatgtgcctgtccgcggctctaagccgtgaagcggtcagtctgtattgaacgttcgcatatggcctttgcccgcgtcaagacgcattaggcaaaactggatgccaagaatctgaccaaggggccgccggatggcaatgattattatcgacgcgaactctattttgatggcgtcctggaggggtcccgccttgtggcggagcaatgttcgaacggctacatattcccatgagaacatg

SEQ ID NO: 40015 - DNA, 280 bp, Triticum aestivum
  Clone ID: PAT_TA_40015
atggatcagtcatagattttggctcacgctcagaaaggtttgatattggcacctgtcttgaagcgattgaacatgtggacgaggaccactcaagtttatttggcataactgtgatgagttcattctgtccggcggtgctcattgtttccacacccagctactattacaaccctatcatccagatgtcagctttgccaatcaacgaacagaaacgtgaacatgacgctgggtcttgcaaattccgcatccatgaccacaagtttgagtggacgaggtccca

SEQ ID NO: 40016 - DNA, 412 bp, Triticum aestivum
  Clone ID: PAT_TA_40016
tcgacataagacgctaaagtgagtcgtaataaacttggggagagagtgtttttcgtgcacacaccagagttcgaacctctcaagggtttgctagaacccgtaatccgacagaccaagtatggagccatcgtgtacattcatgaataatcttctcaggagaagaaccacatttacgattaaacaccacatcattcctggtaagccacagagccagcataaggcagccgccccaacaagaatatgtgcagaaaattgttcatcaataccccacaactaattgctgaacatgttatgcacactgtgtggggttacagatttcaagattcttgaactatggcccatactgcgcgagcaaacttacactcaaaaaatatgtgttttgatagactcgtcatgttggcaaaagacacat

SEQ ID NO: 40017 - DNA, 363 bp, Triticum aestivum
  Clone ID: PAT_TA_40017
gggtcgacacgactcgcgagatggagtcatagtaggtgtagaaattcacaagctgcatgaccggaagtgaacaacgcgggcacagtcggcatctcggacgactcgtcgtacggagtacggccacggcgaccatgacccacggtatgggcatggctatgatgctcagccggttgggctgtcattatacacaaccgtcaccctggccttggtcacgtgcttggcgcattgcttcggtgactgaggactgacttccgttgagaactatactgtacctttaccgcagttggtaatatcacattcatgtgcgcagcaatacatgaaatttgaggtcgtgatgctgcttgcagcatacagtatctgatc

SEQ ID NO: 40018 - DNA, 444 bp, Triticum aestivum
  Clone ID: PAT_TA_40018
cccaggtcgacgaccggcatgacagtgccccggtggcgaagctcgacgaccatggccctggcagtgccttgacaacctttgcgacacccctcgagcagagctcatcgccccatggccacgacgacggggtgattctactacggggcgttaggatggcgccacggtgagatgcagggatgacacactgcttgagcgacgtgcgttggaaatttcctttttttcctgtgagatgtgcgagaggaggaagacgaagatccagtggctaaccaacggtcgcgcgtgctgaatcggatggccgcgcaatgaccggtgcctagtagactccattaaaaaatgtacacgtatttaaaaagatcatgaatttagaaaatttcttgaaaacataagttttcttcattaaaagatcatgaatttttaaaaatattcatggaatttacaaaatat

SEQ ID NO: 40019 - DNA, 389 bp, Triticum aestivum
  Clone ID: PAT_TA_40019
atcgacgagagattttcgatcaacttcgtctttcagtcgtcgccgccaagacatcaacaatgccgcccaagcctcccaagaagcccaaggcccagaagaaagagtacgacgagacggatctggagaacttgaagaagaagaaagaggacgagaaggccgtcaaggagctcaaggccaaggctgcgcagaagggcccgctcggaggcgccggtctcaagaagagcggcaaaaagtgatctgctcgttttccaaaacttattgtctgtacttagaaagcctctgaagaaaaatggcccacgaaaaactactttagatagttgattttggtccagtgtttggggtctccctttcgtgtatgaattgagtttttgacgacactaagccagaaa

SEQ ID NO: 40020 - DNA, 236 bp, Triticum aestivum
  Clone ID: PAT_TA_40020
ctccagggtccacataaatcggcgggatgagcacagtattcacagcgatgagcagcgaagcagatgagtgttttatcctatctggcaagtggtctatcattccatttcaacattcgctaatacgctgtaaccactcgcatggggcacgtggaaatccgtatctctaacgacatgacaacttgtttcggggtttttaccagggtagacatttggggtctagcaccatcagggaaacg

SEQ ID NO: 40021 - DNA, 422 bp, Triticum aestivum
  Clone ID: PAT_TA_40021
agaaacagagcacaccgagatggcaatgacagaggctggcaaaccagcaacatggtgcatgtctctggcccagagtgcttcagcagagctattagagctgtagtgattccccccaacttcaggttggcgactggagtcagtaagttcaccggagagtccaagcctgacacctggctcgaagactaccgagtggctgtccagattggtggcgacaatgatgaggtggccatgaaacaccttcctctgatgttggagtgctcggctagggcgtggctaaatcagttggcgcctggcagtatctatacttgggaagatcacgcctgagtgtttgtcagaacgtttgagggtacttgcaagcggctagcaggtttgacggaattacagtgttgcgtccagaaaccgaatgaaactttgagatatta

SEQ ID NO: 40022 - DNA, 357 bp, Triticum aestivum
  Clone ID: PAT_TA_40022
tccacacggctgtctaaaatgagtcatagcagtgtcgccctagatcttggttctgcttattgccgcgtcaaggtccacttggcggacggtcaagtccaaccgttcttcaccatggacaacctcgaccaactcagtggcatccactcgcggatgatgctcccatgctgcactgccgtcaatgtcaaggaggaggaggccgatcgaggagccctgatttcttgtaactgcgttggtatttccccgaaaaggagaggatgaagcagcacaacgacggtaagtatttccctcagttatgaaaccacggttatcaatccagtacgtgaaccaagcaacactatgctagcggtaccggcacac

SEQ ID NO: 40023 - DNA, 430 bp, Triticum aestivum
  Clone ID: PAT_TA_40023
attcccgaggtcgacgatggctgcgtatggtgtgcgtctctccgacgtgctcggcgtgctgccgagggggctgcagtttgaagtggctgggtaatgaagttcagagaatgcttttttagtacattcagagaagttgctttcttgcttttgtgatattttggctacacaggtacttagtgcagagaggttgtgacctttgggtcctctcatcttgaacacttgcaccacaacctcatctcatgggtaaaatgactattagtaaattggcactaaaaatgaatacagaataagtagaaagacatgatgacctcatctcacgggttccatctcaatatagctcaagctttttagaaactacatttgacacaaagcactaaattgatatagttgtgatagcttccgaagtaagtgtatcacttttgcagctttg

SEQ ID NO: 40024 - DNA, 396 bp, Triticum aestivum
  Clone ID: PAT_TA_40024
tggcatcatctagtcattcgactggtggtatgctaagttcatactgtattcaatgtgtgcatctgcagcaatgttgtattgacacattgatatggtggcaggaagaagatccatgatggtactttggggttcttgcgttcaaccctcttgtagatattgaaaagcatgaaatggacattagattacgtattgggtacatattcacggttttctctaccagaatatattgcttctctattgtttggccaagtaatctagattcaccttatattcttgaaggtattagtctatcagattattaatctatatttcattttccaagaaatcaaaggacgagtcaaacattgtacgagcttcgactagcagaacctgcctcggaggtggtggccaacagtg

SEQ ID NO: 40025 - DNA, 350 bp, Triticum aestivum
  Clone ID: PAT_TA_40025
caccttcatcatggacaccgagtgcatcttctacttcaactgcaccagcaccaccatcaggtgccacctccagccgtgttacaagaaagcaggcacaaccaccattatctgccaagagtgcacctgctgggcctgcgcaaagttcttcttcttccatggcatcaacggggcacacaagtgatattatttgttgtcattgtaagggaagaggtcattatgcgagagaatgcaaatcttagtgtgtgatgattgctactaaagatggtcggtatgagtccactagtgactatgatgagcagactttggctctaactacacgtgaacaacatggtggagattattctgattat

SEQ ID NO: 40026 - DNA, 461 bp, Triticum aestivum
  Clone ID: PAT_TA_40026
aaggtttgtatgatagtcaagaagcagctggcagtccctgatgggacccctgtcacagcggagtcgaaattttctgaacttggtgctgactcactggatacggtaaatccgcaactccccatcccacagaaatggcagtagcccaaaagcagcgccgttcatacgtaacaccgattgtgttttgcaggttgagattgtgatgggcctcgaggaagagttcaacatcaccgtcgatgaaacaagcgcgcaggacattgcaaccgtgcaggatgcagcggaccttatcgagaagcttgtgacagagaagacagcgtaagcacctcggttcattggacagctttagaaggcaaaggtgtcatctggaaccgtggacttctgatttttcggtcgcatttggggcgagagaaaataatttatggacagctttgcattcagtctatgttgtgtgttcattaccattt

SEQ ID NO: 40027 - DNA, 372 bp, Triticum aestivum
  Clone ID: PAT_TA_40027
tcatgacgtcttagtgttccctgcagtcttaacagttcgattatacttcatccaacatacaacatcactactcatcatacctcatcatgccatttcggttacaatcgtctctatgagtaactagggacaatctcaggtctacccactacagagactttcctggcttcctttcagcatatgatataaccattcttatgatattaccagcttcagcattatcaattgctatggaatctctactatgcattcatacatctgattatatcaccacttttcgataacaagttctacatattgatgtggtgttataatcgtgtaaacactgcatgatgtatattaatccagtgttcacaatgcttgcctccaagagca

SEQ ID NO: 40028 - DNA, 401 bp, Triticum aestivum
  Clone ID: PAT_TA_40028
ttgaggacactgtctgctcggggaacgcctctcccacgtggcaggccattcagtacggcctcgagctcctcgagaaggggattctatggcgcgtcggcgatggccggaatatacgcatatggcgtgaccgttggctcccaacgaaaccgacggggtagccgatcacgcggcacgggacttgccgtcttcggcgggtctcagagctcctggacgagtccgacgcctggcgtacgaacgtgctgcgacagtattttctcccggcggatgtcgcgaccatcaccagcattcgcacgtcaccccgcatcaccgacgacgtcatcgcatgggccccgaagaagaacggcatcttcaccgttcgctctgcatatcgccttgccatggacgagcgccagcgtccattg

SEQ ID NO: 40029 - DNA, 224 bp, Triticum aestivum
  Clone ID: PAT_TA_40029
acagcacgcagccctgcaggagacatttgcttgggtcaatactaatatgcattgttctactttgccggatcttcctcctattccgccgcctcctacttttagctttgtaaatcctcaacttttcaatcatgcatcttaccatcatgcttaaagatcatgcttgaagtgtcccccgtcgggagaaggatccaataactttgtggtacgtggattctaactgccca

SEQ ID NO: 40030 - DNA, 424 bp, Triticum aestivum
  Clone ID: PAT_TA_40030
cacatgcatgcatggaaccaacggactagctataggggggtggagcaggagccacggatggagtagccacgatggagcacccgaaaaattgtcgggtcccaccgctctccttgtccagcgttcgcctactacctgcagctgctatagctacatttgggcagtatgcatgccgttcttttacttcttttggagaaaacagaagggtactggtttgcctaatgctaagtccacaagtctaacttccaaagtggtgcaatttcagtttagtggaaaggaagactcaaattgtgatttttagaattggtttattagataatagaaaaaagaatctcaattaccatagatataaattgacaccttttccccattaagaggtgtattttgttgactcgtaatgtcgcatcaagaaaacacaagcaccatg

SEQ ID NO: 40031 - DNA, 370 bp, Triticum aestivum
  Clone ID: PAT_TA_40031
acggtccgacatcacgggtccacagcgacgaccaaagggtgttgctacaaatcttcaccaagccagtatgggacaggccgacgttgttcctggagatgatccagatgatcgggtgcatggacaaggacgagagacgggaagagtaccagaatggtggctgctgcgggttcggcaaaggcaacttctccgagctgttcaagtccattgaacattacgagaagtcccttgaagccaagcaatctgctgcagttcagggatcatacgatagaagctggagctggatgagctgatccagtactttgtatcaggtctcatggagcaaaagaaaatgatgttgtttgtaagatgcggtgcgcaattatgtccgatg

SEQ ID NO: 40032 - DNA, 428 bp, Triticum aestivum
  Clone ID: PAT_TA_40032
aaagctccgtcgaagattcctgtcatctcattgggatggtgaggttagggtttctcttaatgtggcgagatttggtgtcagatgattaagatctacgcaagggttcaacggcgagaactgcggctccagggcgtcggtccttaggggcacgtggacgaagacttcccgactatcatccacaaggtcaagctagctccaataggagagcggcaatagcagcgcgtcgatggcttgttctgacggtagtcagtggcggagccaaccagctcaaggagtcggacaaactctttgcaccctgacgtggtcagcatttgtccaaggaattaacaatactaatcatggttgctttgtactagttagtgaagaatggcagaagcagcccgggcagctgccccgggtcgccaggagctaactccgccactggcggt

SEQ ID NO: 40033 - DNA, 173 bp, Triticum aestivum
  Clone ID: PAT_TA_40033
aagccatcagctgcgaccgtaacaggatcaggatcaggatcggttcacgagaagaagggtttctttaagaagattaaggagaaactttctggccaccataatgatctttgaaggcttccatacggatggtcatgattacttgtgtaatcacaatcatgttctaatttcttggg

SEQ ID NO: 40034 - DNA, 441 bp, Triticum aestivum
  Clone ID: PAT_TA_40034
agatcaatttttgtaggcgggtctcagtttaggtgtgcatgaccttacttgaactttctcaaaataatataatttactttttcgtgaccactaatttaacttcttttaagcaattattatgagtagaaaaggcaagggcgtactgaaaaaacactgcaaattcaaaaaatgtccatcgcatatttaaaaaaatattcttcacatatttaaaatacccatcatgttttttataatattcatgtatgcaggaaaattatattcatatgttgaaaaaaactatgtaactttcaggtaagtcaaaggaaaaaagtaaatgtaaaaatttggatttaaaatgagtaaaagtataaaaacggaatataacattgaaggaaaaagacagaaaaccgaagcaaacataaggaaaattgcaaaaacaaaaacgaccatctggcgcaatga

SEQ ID NO: 40035 - DNA, 416 bp, Triticum aestivum
  Clone ID: PAT_TA_40035
cacaccagcatttgcaacacggcttttggccggccgtcggcaaagaaacaagagccatccatgatttgcatggtccggttgcctaattaggatgtttgtatggcagctaagacagaagtggggttttggcgcggttggttagcgcgtatgtaaacttacaaaatcagacaatcattatgaagaaacgctcaatgaccacttggatcgccacatatacaactgaatcatctgactaggctagtacaatgtatgcgtctaaatctgtgggaacgcataagttgcatgtctgagtggtcccatcatttctaagttttctatgcgacgccaggctctataacagaaaaaaaaaatatcaattgtgtgctagcttaacagttttttataaagggaatatactaatatcaaacggatatcaa

SEQ ID NO: 40036 - DNA, 335 bp, Triticum aestivum
  Clone ID: PAT_TA_40036
agtgctcaaaataaacattaattcctcaatgcttctcattgatgattccagtacaccgaaaaagaaacagtcattctctcaagaggacaagaagcttgatgaacaagaagcattgcatctagaggcaactgtcgtgtgccatcaagatatcaacgtcgatgcaatttttaatggcaattcttgttgagcgatgattattatactccttcagacttagccttgcccgttatgtaccaaagctgatgcaattttcactagcgaggcttgttgatcctgtgatggtatttataacttgatatgaatgtcctccttttgttatgtctgggatgtttcac

SEQ ID NO: 40037 - DNA, 482 bp, Triticum aestivum
  Clone ID: PAT_TA_40037
aggtccgagattcccgggtccacaccgtgggctcaaaagaaaatgctggggcatctccagctcaaatacaagaaccctgtagtcatgatccatgagaacggagctgctgggaagaacaccccggatgacgacgagttcaggtcgcagtacctgcaggactacatcgaggcgaccctcgaatccagcaggaacgggtccaatgtgcagggctacttcgtgtggtcattcctggacatgttcgagtatatattcggctatcgcatgggttttggcctctatggtgtggacttcaactctgaggagaggacgaggtaccagaggcactccgccaagtggttcaccggcttcctccatggcggcgagctcaggccggtggctctgcccggcaaggtctaatcccagtgatcttgtcacacgtcgtcacgcttccgtagcccacgaacaggaaaatgcactaataagcctggatggttaagtgttgt

SEQ ID NO: 40038 - DNA, 433 bp, Triticum aestivum
  Clone ID: PAT_TA_40038
aagtatttgtaaatagaaaataaaaaataattaatgataaaaatagaaaataaaatgagtagggaaaaacctcaaaaataatagtagagaattccacaagaaaacaacctaaaaaggaaaaaaatcagaacattcccaaaccaagcggaaagttcgtatacataagctttcatgacaattggtatgggttggacctttcagaggaaaggttgtaggctagtcatgcttttatctcgcattaagcgagacgtatcacctaacaaatgttcttggataaggaaaaatgttcaagaatttcaaaacatgttttcagatttcaaataagatacaaagttttaaaaatatttactaatttctaaaaattctaggatttaaattgaaagagagaaaatagtatagttcaaggaaaaaagacatgaagagaaatgaaaga

SEQ ID NO: 40039 - DNA, 339 bp, Triticum aestivum
  Clone ID: PAT_TA_40039
ttccaggtcgaccgcgtccttgtacttgtccttggcgccgtccacggggccgccctcactgttgtcgtaatcgcagtactagatgagcgagatctcgcgtaggtactccaccgcggattcctcgatgggcagggtcatctctaactcgacctcagcgagacgcaaattgtcatctccgccggcacgcgcatctctaagtcccactcggggatctcatgaataagcaggtgctcaagaggcaactccgccttttctgagatgggttgcaagctggtttcccacgtgagctggaatatcatggcgtgtgtgtcctcaatcttgggaaggatggactccgac

SEQ ID NO: 40040 - DNA, 434 bp, Triticum aestivum
  Clone ID: PAT_TA_40040
tagttactccaaagactttctagccactgcaacacaccagatttgttgtactctatggagagcacgacctactagaagagcaatgagccgggttttaccatgtttatttttttccttttactttatttttgtttttttctttttcttcacttttgcagtctaattcaacatgcttcttctgtgtctttttttactcggttttctcatgcttttcccaaaataatttcggttaacaaacgcagaaaatgttgaataagcattaaaaatggtgaacgagtattgaaaatttgttgaataagtacgaaaaatgttgaacaagtattttaaattttttgaataagtatttgaaaatggtgtacaagtattaaaaatgtggaacaagtattttaaaaaatgtttaataggtattaaaagtttttgaacgagtgtttaat

SEQ ID NO: 40041 - DNA, 343 bp, Triticum aestivum
  Clone ID: PAT_TA_40041
cacattgataaacgaacgcaaatacgagaactccatgcagactgcttcaatgatgattttgttggagtaccttttccagataccgatatggatttgagatatatacctagaaaggacccaaagtggcagtcacgacatgacaatgatcatgaatctgagagtgcttccagagcattccagtcttgctgagcttgactcagatacaacatatatagtttaacttagtgatgcatatagagcagaatgtgatgctatgcattatgctatctgaaacattcaagaggtcagtcaagcctatgccaattgagctcaattcatcgttaatcgtgacttaatgttcctc

SEQ ID NO: 40042 - DNA, 157 bp, Triticum aestivum
  Clone ID: PAT_TA_40042
ccacaccaatgtagattcaacgagttttttttgtgaggaactgtcgattcaacgaggtgaaagattagcaagacataagggcttatgggccgtgggcggtggaaagaaagcgttgtgggctttcctctgactcattcgattaggcaccgttcgtctc

SEQ ID NO: 40043 - DNA, 430 bp, Triticum aestivum
  Clone ID: PAT_TA_40043
attccagggtccacgcctacgccacaacttctaaccctggacgtatacggctagctgcatcgcgcgccacgtactacgtacggcacaacagaatgatttggattcgcacgcagtccacgctgccgacagtcaacgccgtgctaagggatcgcgcgcccctgatcgcccggttaatttgcctctgcgaccgcgccttctgtcccctagcttacttcaggttcaggccatgacagatggatccatacgtatgacgcgtgtgggcaacgtcgctggtggagcgcacgaacgcccacggcacggatatgtcgagataacgctatcgagatttatttacgttcatcgtgcgctgatggtggtggtgccatcttacacagtccaggtaaacgcagatggaatggatcggtgtatctactacccctataaaaagaag

SEQ ID NO: 40044 - DNA, 399 bp, Triticum aestivum
  Clone ID: PAT_TA_40044
ttaatagccagtcggcaggcgatcctgcggaccagccgttggattgacatctcacatctgtcgtgtatcttctacctcttgtcttatttttccgccagccgcccaaactaaaccaccccatcggctccgtctgcgcacgcctcccatggctggctgcgcctccgccggcccaccatacatactctccaacgttggccagtccctcactctgttcccccacacgtcctgttattcttcggtgatgtcaaccccagcacgcactcgcgcccgaaccagtcaaccctcgtactcccctccgcttgcgactggaccggcggatcttcagcggctcctgttcgttccgtccgacgcctcgccgtcgtcctccgccttgcaaccttggttcgctcatcgtgggtg

SEQ ID NO: 40045 - DNA, 410 bp, Triticum aestivum
  Clone ID: PAT_TA_40045
tcccacagaaaacgatagccaacatctcatcgaaacatcgggacaccttcgcctctatcaagtggtatcagttttcaggttgctcggtgagaatttccagttatccctagattagatttcttttcttacctattgaccaagaaaaagccacaaaaaaagttagatctattcatcctttgtcctagccagtctgagcctttgcaattctcttttcattgtttgcattattgaattatcggttgcatcgtcatgtcgagttgctagtcttagtgtctagttcgtttagagtttcgagttctgttcacattagtcacatcgccgctgtatcattatcctttccgctacccacctccccatccatcaatttccaccacgtgctacccattattcattggcacaatcatagttga

SEQ ID NO: 40046 - DNA, 377 bp, Triticum aestivum
  Clone ID: PAT_TA_40046
aagttcaccaagtggattgaggcgaagcctataaagaacttagactcaagcacaaccatcagtttcataagagagctcatattccgatatggagttccgcacagcatcatcacagacaacggctcaaactttgactcataagaattcagagcattctgcgcctcccagggcactcgggtggattacgcatctgttgcgcacccgcagtcgaatggtcaagctgaaaaagcaaatggtctgattcttcaaggtctgaagcctcgactcatgcgcgaccttaagcacgcaactggatcttgggtaactgaattgccgtctgtcttgtggggattgaggacaactcccaaccgttccactgaccgaacccctttcttcat

SEQ ID NO: 40047 - DNA, 427 bp, Triticum aestivum
  Clone ID: PAT_TA_40047
agactaaaattaaataagacaacctcagtaactaaaaacaataaaataaagctagataagaagaaagaaataactaccgtagacataggataagaaccatcttctgcaaagtcgttaggcacaataggttcacccacagaatctgcattctcaagagatgatactaaccaaacatccggatgagagactttctgtagcctactcattaaactaaataaaacatataaacagaatacatgaaggaggaaaaagaaaagaagtaaaatagtagaacaaatctccatacacttcattaaagaatacacatgaacagctaacgcaacgctatttactagacaaatctagaaagaacacagaaacaatcatcaacctaaaacaggaactctgctcaatactacttcaacagagacacactagcacaaggaaa

SEQ ID NO: 40048 - DNA, 383 bp, Triticum aestivum
  Clone ID: PAT_TA_40048
aatggcttcagctggaggaactacagccagagaccaattcttggggagaaggaatactttaagagatagatcaaaaagtgttggtgcacgcatgcataatgtatgtatgtactgaacagatttcgtagggtccatgaaaattaaacaattttgttgttgtgggctcacatgatgcataaacccaagcttttagaaggaaaagatcccatgtgttgcctcttctacaaatatcatgtatttatgttagttatacttcattgtctggtgataaagttaagaatgactgttacgtggtattgttcaaagttgggagttggtgattttaatattttctcatcgtaatcagtatgtactgtcttaacttattcctcctgtgatcgcat

SEQ ID NO: 40049 - DNA, 352 bp, Triticum aestivum
  Clone ID: PAT_TA_40049
aaaggaactgatggcttgtatttcagtgatctactgttggcttaccatttgtttttatagagggtcgtgcaacttgattgaagatgggaagatgatgagaaccgcctgatgaagaagctgctgagaaccagcgccggcgtctcccagccagcgcctgtgaatggaattgacggccagccagttttattagcgatggggcctgtatataagcaatgaaaaaggcgcgagggcgagcagcaaaacgcagaactggcgccagaaaagttgttgagaagcgagtgggcgggaaaaagttgttgcaatcacgcatatagcagacgcgtttgtgaaaaaacggataaagctcgttttt

SEQ ID NO: 40050 - DNA, 382 bp, Triticum aestivum
  unsure (1)..(382): unsure at all n locations
  Clone ID: PAT_TA_40050
tttaactattccccccatcgatcgatgtacctcacaagttatgtctctcctttctctgacaaaggacgattgatcttcctatgtagttatgtctgcttaccacatccatatcgccccccatcattcatgcatgcctcctgacccgtctttcacacgcatgtgcacagacaggcagtcatcccctctcttattgatattgcaggcgtgcgctccggttgtctagcaagcctatcccaccatttgttagaagcaactccactaccaccccctccaacaatctagctctgtatctctcccaaccttattcctctcctacacatatgcatggatgccgatcgatctcccttaatacatgaggtanatcgatctcccttaatacatg

SEQ ID NO: 40051 - DNA, 324 bp, Triticum aestivum
  Clone ID: PAT_TA_40051
ccgggtcaactcacatggctacatctaatatggattaacgaacggaaaaggactccacaaaacaagttatatgctcatctactaagagcgataaattgcgtggaggacaaatttgcacatccatgctcagatcattcattgacaccacaacgcatacgacgaagcaccaacaaacatgacgatttatgactttcacccaggcacagattctacattaatacttgcggcacctcaataatgaacatttatgatgcagtagatgacacagtgatcaataaaaacaattagttgaaggtaaagatgaatgttctggtacttggattc

SEQ ID NO: 40052 - DNA, 393 bp, Triticum aestivum
  Clone ID: PAT_TA_40052
cgaccttgggacacagatagatgctcatcaggggttgcagttctattcacaggaaagccttggcagctggctggagcgcatgtagatcgttaaagaagtggacgatcgaagatcatctcttttccatctagtatgattatggtggcaacatttttggtatcgggttggaaggtagaagctgtgcgatcgtatctcagtgacgctttagactattgaagagtctgcacaaacacctgaacacctattttgtttcctgaaaactgaaaagacatgtaaaagcgttgttgttttccctcttttgcgaaaagtgtggtggaaacttggattaacttagctctttccatgtgtgcagttcaggtaactgcaggagtgccctggttaaacctggttatg

SEQ ID NO: 40053 - DNA, 268 bp, Triticum aestivum
  Clone ID: PAT_TA_40053
gtgctgtacaaatggggaatatgacgcagggtgcttgctatggctgcgaaaacctctaatctgttgttcacccatccatcgaatcatattgcgtaggaaaaattagctagtattgactatcatgattccgtcactgtgattgatatcgactacttctcgatacctggtgggtaatgatggcatatgtggtcagtcttcgctcttgtatattagcttgccctttgcgagaatcatcatcgtatgcatgtgatatattcggggttttcac

SEQ ID NO: 40054 - DNA, 356 bp, Triticum aestivum
  Clone ID: PAT_TA_40054
tatctttgccttgacgttgaagaccttcaaccataggccgaagtgcggcttgactcgcaataaagcctcgcagatgacgatgaaggtcgagatgtggaggaaggagttcggggccaaatcatggaaatccatcccgtaaaagaacataagccccctgatgaaggggtggagcgggaagcccagtccccggatgaattgagggacgaacaccaccctctcacctggtcaaggcgtggggatagcaaggccttcttctggggcccgatgagcgatgttggccgagaggtacccagcgcacttcagatcctcaatgtcatcattggtgacattggaggcctccaactttcctttggaac

SEQ ID NO: 40055 - DNA, 412 bp, Triticum aestivum
  Clone ID: PAT_TA_40055
tacgaagccgtgtgtgttgactacgtcaatctcatgataatatgtcggctcggtctctcgaagatgctcataaggataggatgtgcgtgtctacgtttatagggatgagtgtatgtgtgtagtgtatgcatgagcgtctccgtctgtattatttcaaaaaaaaactgaaacatcagtcaccattactagttcattatattttgggaccaaggtagtaccatccttagctcaattatgcaagaaaaagaaccgcgttattaagtatacaccctttatcttagcctcacctgaaacataaaccaacacgaacttaaaaaacataaatcaacactaaaaaaactgaaaaatgaacaaccactagctcaattatatgtcaaaaaggaacctttgtgttaaaaaaaaggttattgca

SEQ ID NO: 40056 - DNA, 407 bp, Triticum aestivum
  Clone ID: PAT_TA_40056
tttagatgcacagttcgggaccccctacccaagatccgccggttttgacaccgacacccgtagcatgcacgtatggtgaaccgttatgtaacgaagttggagcatgaggtatttattgattgtcttccttatgaatggtggtcggggacgagcgatggtgttttcctaccaatctatccccttaggagcatgtgcgtagtactttgttttgatgactaatagattttttcaataagtatgtgagttctttaagactaatgttgagtccatggattatacgcactctcaaccttccaccattgctaacctctcgtgtgccgcgcaactttcgccggtaccatacacccaccatataccttcctcaagacagccaccatacctaactattatggcatttccatagccat

SEQ ID NO: 40057 - DNA, 389 bp, Triticum aestivum
  Clone ID: PAT_TA_40057
cagggtccagactccctctgaagtaacagatgcagtgagcagaataaacgggcagtagaagatcccccagcccaacacatatgcagagaccgaatccataaccaaagaccaccgcgctcgccgctcatgcgaggagcccgacgccgccaggccgtctcaaaaagaaacaggtgccgccacccgcctcacccaaatcggtacggaaacaaatgatcgcaaccccagctagtaaagcatactatcgatcgacacgtgcggtaggaagtattgcaatgggccacatgtacattcgagtagatcgacacgcccagacatgacgagcaacacgtttgcagggaagatttagcctgcaggtcacaaccccactatcaatctaggagcccccctct

SEQ ID NO: 40058 - DNA, 391 bp, Triticum aestivum
  Clone ID: PAT_TA_40058
tcaaagatcctctccaaggtcattgagtactgcaagaagcacgtccaggccagccccaaaccggctgactccggcgccgtcactgacgccaactcctccacctccactgcagccgccgcccccgtcgaggacctcaagagctttgacgctgagtttgtcaaggtcgaccgggccaccctcttcgacctcatcctggctgcaaactacctcaacatcaagggattgctcgaccttacttgccagactgttgccgacatgatcaaggacaagactccggaggagatccgcaagatttttaacatcaagaatgatttcacacccgaggaggaggcggaggtccgcaaggagaaccagtgggcttttgagtgaaagtagtagcatctaggcaatg

SEQ ID NO: 40059 - DNA, 414 bp, Triticum aestivum
  Clone ID: PAT_TA_40059
ttcccgggacgacctcgcggtccgctctgccgccgggctggatccaaggggattggatcacctcctcagtctcggtggaggatctggagaggctcgtcgttgacgggctgatagcggatggatcttggaggctgccggaaggggagtccgagcccgcgccgcgcgacggcgagccggttctcctcacgactcatgaagaaagacgtttctcgcttcccccacatccattcttccacggtttcgtgaatttcttcggtgcgcagatccatcacttttccccaacaccactttgtaccttgccacatttgtttcgatgtgtgagaagttcctgggatgccacccacattgggggttattcaaacatatttttacctgttgatctcagtcggtgaacagagccaatctgactaatga

SEQ ID NO: 40060 - DNA, 113 bp, Triticum aestivum
  unsure (1)..(113): unsure at all n locations
  Clone ID: PAT_TA_40060
gactcagcggttccctatcctcctgtccacgctaatgccgctcgattgttgttacagttgttaacttcatcaatgccccttgattgcgctatatagtnttgttcagtcgcgca

SEQ ID NO: 40061 - DNA, 398 bp, Triticum aestivum
  Clone ID: PAT_TA_40061
taccaaattggttgcagtccccagcggcaacaacctttaagagcttgaagcatattggcctagagcacataacccactgcacccgactacccgatggtttgtgcaggatccgcagtttggaaagactagggatcgagcatgctccagccatcgagcatgtcgggcctgacttccagacccatgaagatgccgcaagggaagtcgcattcccaagtctgagaagattggtgttggatgggctgtcgggatggaaggagtgggagtgggaggcggaggaggagcagagcaaagtcatcgccatgccagctctggagcatctaggaatcggggactgcaagctgacacaccttccccgaggacttgctagtggccgcaggcataatctgagaatccttgag

SEQ ID NO: 40062 - DNA, 403 bp, Triticum aestivum
  Clone ID: PAT_TA_40062
ttccatgtggatgggaaaaagaaagtacaaaaactataaaataaaataaagttaaataataaaattccccatattatgcgtgtttcgatctcatcgccgcacaagtctcatcacaattgcagacgtgttttaccccttgagtcgcacgtagtttgagatgcacgcaattgcatacgtgttgcaccctcgtagttgcatgaattccgatagttctagttgtacgtaaggggaacaagagtttttgtgacaaataaaaagaaaagtcaacaatttttctgtcaacctgatgtaggaaacatagggcatatcaacattacgaaaatatattcctgggtaatacatgaatgaaacaattttttttagaaaaaagaacaggcaacatacaaataaacaaaaaatccat

SEQ ID NO: 40063 - DNA, 361 bp, Triticum aestivum
  Clone ID: PAT_TA_40063
cgtgcgagattcgcgggacgactcgcagtctcatattaagtgaaccagaagcggtacatgcgatagaaaagaaaaacaaacccaagcaccagcacgacccttcctctcgatcccatctggacctttagtattctcgggaatatatctgattatgaagatgttccgtaatgctctggagccgacaactttttggactgctcgatgtctaataccaatgatactacgtttttgggtgttggctgtaggctggagctatcagtatgactgaaattttcatttcaccagtgtaaatttatacggacatcaatagacagcgacacgtcaatacttgtcaccagtttgcaatttgtagtacagtatg

SEQ ID NO: 40064 - DNA, 382 bp, Triticum aestivum
  Clone ID: PAT_TA_40064
agcgtggcaacgaagaggaacaactatcgttcacgggcggatacaacatccaaacatgcatctcatacaactcatgcattcgtccacgggcgttcgttctcggcggttataccttcgaagagtgcgtttcaaagaggaccagttcgtagaggaagtagttgttcacgagccattgagggaagtagtggtacacgacgacgatagtggtacacgttttcgtagatgttctgggtcggcggtagaggtacttgtcgcattgccgggcatattcatacccgtttcggagaggaacttggcatatccatgtacttggcattttgcaatcccatgtccagggtcgtcatgtagtcgttcgggcgtcatggaggaacttgacattcac

SEQ ID NO: 40065 - DNA, 418 bp, Triticum aestivum
  Clone ID: PAT_TA_40065
atatggggagctaatgcggaggagttcgatccatcgaggtttgcagatggcaagagctaccaccttggcgcgtacttcccctttgggattggccctgccatctgtgttgggcagaatctcgcgatggttgaggcaaagctggcgcttgcaatggtcctccaacggtttgcgcttgatgtctcgacgtcctatgttcatgcgccgatgaaggtgatgaccctccaaccccagtacggtgctcaacttcttgtccacaagatctgaaccttgtgtggtgctgtctatggagttgggaggtttggcagcaaggtatatgtgaatgtgatgtccccgcgtctcctgtatctctgttgacaacttgtccgaagtttgtcctgaaaatgtgtacagaaagtagtatatgcttcgcgacagtaaa

SEQ ID NO: 40066 - DNA, 262 bp, Triticum aestivum
  Clone ID: PAT_TA_40066
tcgcgggacgatttcgcggtcgacagcagacgtgatcgcggtcgagttgtcataagtctatcatagatcttaggctcgaaacatagtatctcaatggatatcgctcgctcgatgattctcaattcagatgttcgcgctcctcttcgtgttgatattctcgaggttactctttttgtggcgtgtatgatcatctgcactgcagtattgtttaagatcagattggtgtatgggtactatttgtatcgcatcagtcggcctttaa

SEQ ID NO: 40067 - DNA, 382 bp, Triticum aestivum
  Clone ID: PAT_TA_40067
accccactcaattatgctacgtagctgcacttctagtgcaccttgccggcaagctgcgctctctcgtaacttgagttccacgtataatccacagaaacacgagtaggattttacacctcacaatggcccggacatgggaaaacttgtgtgtcgtctgttggatctgctatttgtgcattatgatttccacagccgaatcatcaaggggcctttattggtcccaaagattgtcgtaccttgacaggtgacaacaatatcaacgaggagagcaagacatgaaaataagatttgagtcaagtgttgtgccaagtggcgagagaataagagagtgaaatgcatttgttaaacctaagaagaaaatgagcggctgtttactttttta

SEQ ID NO: 40068 - DNA, 686 bp, Triticum aestivum
  unsure (1)..(686): unsure at all n locations
  Clone ID: PAT_TA_40068
gtgttcaccaacaatctggacaacttggaggtggggaattgggaggttgcaaagcaatttattatggttacgtgaaaacttaaccactctgttgctttacagccatttcatgtctgtcagagtattataggaactctgttccctttttttgcgaaagataggaactcttttccctgctgtctatttgcagaattctagctagaccagtagttctacatccaaatggaatggatggtgtaatgtgtgttcatttttgggtttgacgctatgctttttcttcagtaatcatctataaatggctagttgcaaccgtatttttagagatggtggaggcagcagaacgacattattaagggacgnngtgaagggggcttgtcagccccggacggttggaattcatgtaggctagctctttcaacaactttcttgtcgcaatggcaatcatgtctctgctctatatttcaatgatgacatattactccttgtgatgctaaagaaataggggcatgtgcatgcacgacgaggcgactgtgtgctacattgacatgatcgatcaaactacactggggcacaggttcatcaatgaggaatttagtcagattccgaggattggttggcagattgatccatttgggcactctacagttcaggcttaccccctcggtgcagaagtgcaagattctgaa

SEQ ID NO: 40069 - DNA, 520 bp, Triticum aestivum
  Clone ID: PAT_TA_40069
gcggatgctctctcgcctgtggggatttccggcgagaaggactcgaggcgagcggatcgagagcgcccgcccgcccgcccgacctcgtcgatcagccgcgatgaactgcgagacgtgccacctcaacgaactggagctggagccgctggagatcttagacgcgctgccatgcatcttgcacactatattctttcatcgaaccctcactcttgtccggcccttggatgttgactgcgacctgtttgctatcacatatgttcactgtggacttgtgtaactagaccaggaggttgatgaaaggatcaaccggttcattgcttgggcagacatgcattccaatcgcaatagccacggtgtttgctgcggctgaacaacatatttctactatttgcatgtatttctactatctgcttgttctttcttatttacgttctaacacatggtggctgaatataatgtgagcctctctttcttcgctgagaagacaatgacccaggctggctcacagcaggactgagag

SEQ ID NO: 40070 - DNA, 401 bp, Triticum aestivum
  Clone ID: PAT_TA_40070
caggatttgtttgctgagctacgaccaaacatgaccagatattcatcaatagatgaacttaactctgcattagctgaactcgaagaacacgagcgtgcggcctcagtagagaaacctgagagtgaaaggcactcggacaatgaatctcagaaaaggcagccacatgatgatggcaggggttcagcgaatggagctgagggaaatggtaaggatcatggagaaggcgcagatagtgagagctattcagatagtggcagcattggtggtcatgaagatgaagaagatcttctgtctgaggagaaatcaaatgatgcatcggagaacgaaggtgatgatgaggatgatgggatgcctgttggttctgatgaagatgagggtgttgaggttaggcaaaaggtcgt

SEQ ID NO: 40071 - DNA, 274 bp, Triticum aestivum
  Clone ID: PAT_TA_40071
gcgttctttcttagtaccgaggccaccaccatttttttttgtcttgcgactgacctacgcgcttccagaacccaatccctagccaacccaacgcttgatcctagttccccagcctactcacgggacatgggcgtggataatccgccgccgattaccgaattccagccgcgacgacagcgcgttcgtcttgatctcccagggctggcgcgaggtgcgggactcggcgaccgcgcgcctgcagatgatgctcactacggaccgattgggaactggt

SEQ ID NO: 40072 - DNA, 398 bp, Triticum aestivum
  Clone ID: PAT_TA_40072
gctaatatccatccttgcagctaaccgatcagatcatggccatggggactaggcgcgccgctctctgctttcttctgctagtcgccgtcttcttacaaggcaaccctacattggtttcagcggacgaggagtgcaagtacaggattccgtacgtacccttctgcaaggggtggagctgcaaggtggagtgctggctggaggccaagctcttccgcgcccgtctacaggagcacaagtgcatcaggggcggcatcaagggcgcctgctactgcctcttctgcgggaagcacctccaatgaaatacatacatcatccatccatcatttgctcgctcgctcgtccagtaggcattaccactagttatttatctcaaacgttcctcatccacgttcgcttat

SEQ ID NO: 40073 - DNA, 218 bp, Triticum aestivum
  Clone ID: PAT_TA_40073
gttgtactccatatgagcaatcgttcattatgtattgaactactcattactcagagaacggaggtgggcttcccttcctctgtgcctagaccatacatccaaccttcttatttttcacttaatccaggcgaagtaccacctccgtgagcttgttgaatggaggccgcggtagtccagacatcggtacctgtctgaaagtacatcccgacccgcttgac

SEQ ID NO: 40074 - DNA, 246 bp, Triticum aestivum
  Clone ID: PAT_TA_40074
aaagaaaagaaaaagcaagcccaccccgtgaaccctacatcctgcaaaccatgccgaccttgcatccctcccgcgcgccgccgcaccgtcctcgcttaccagcgcgcctcctgccggccttcttccagcgtgcctgcggtcggcctgtccttgagcgcgccgccgtccggccttctcctcgagcgcaccgctgccgggcctgcttctcagctcaccgacggccggcttgctcccaacagccatatt

SEQ ID NO: 40075 - DNA, 232 bp, Triticum aestivum
  Clone ID: PAT_TA_40075
gtctaactttagagccacctccctttttattatcgttattttcccaggaaggctttccttaaaaactgaatcagattgatcccagtatttcagcgtcattatgcctctctttttcttcaacatacagcgtaagaggcatcctaatgttccatccccaacagtggcacagctctgcatatccttcatcccccatgactggctccaggtgcagattctcggcaaccgccttctc

SEQ ID NO: 40076 - DNA, 394 bp, Triticum aestivum
  Clone ID: PAT_TA_40076
gtttctgaatctgcccaatttggtgtcgatcgggcgcatggcgtcggggccgctcattggatggatgattatgaatgaatggtatcttcctgcttttggcacattagctttgtctggtgcaagtgattggttggatggttttttagcaagaaagatgggcatcaattctgtcattggttcatatctggacccattggctgacaaggtgttgatttgctgtgttgctgtagcaatggttgagaaggagctcttacatcctggccttgttggcctggtggttgcaagagactttctcctggtgggtggggctttctacaaacgagcatccagcctgggatggaagtggaacagttggtcaaacttttgtaacttagatgcaattcagcgtgagaag

SEQ ID NO: 40077 - DNA, 187 bp, Triticum aestivum
  Clone ID: PAT_TA_40077
gttcaacttctgtatcatgtcacagatggctggagcatctctctggagtctcttcgggcgagcagcggcttgtagcaggcagtgggagcttctctgccagccagtaggctcgcaggcatctcgagcatagagtcgtagagctgtcaaatctgaagtcagtctcagcttcgcggtagtttcctctaga

SEQ ID NO: 40078 - DNA, 399 bp, Triticum aestivum
  Clone ID: PAT_TA_40078
cccacgcgtccggacaatatctctgtcaccaagggggttgtttctagagtggaaccaacacagtatgcccatggtgcgactcagctcatggctatacaaatagatgcagctattaatccaggcaatagtggagggcctgcaatcatgggtgataaagtggctggagttgctttccaaaatctgtcaggagcagaaaacattgggtatattatacctgtgcctgtaattaagcgttttatttctggtgtggaagagagtggcaaatattctgggttttgttctcttgggatatcttgccaggccactgagaacatccaaataagagagtgctttggtatgcggcctgaaatgactggagtgttagtcagtagaataaatcctctgtctggtgcttacgaa

SEQ ID NO: 40079 - DNA, 342 bp, Triticum aestivum
  Clone ID: PAT_TA_40079
agtcccaagagaacgtttttgactgataaatgatgttcccactaccaatttaagtccagaaagaaaattgtctcagactacacacattaaatggcttgcacaggtttactgtccaactggagttgcatttatgatctccaaattgtcaggtgcaataatcctcaggcatcatactctgaagtttttaccacacgcagatcccaaattaacattgttttcatgatattattggacaatgatttttaccaacatatcataatactcaattttagacttgcggagaagaagcaattgttatccaaggatcacaaagttttgcctttgagttctcaaaaattcctt

SEQ ID NO: 40080 - DNA, 220 bp, Triticum aestivum
  Clone ID: PAT_TA_40080
cggacgcgtgggggaagccagcattttattacagtggcagccacacatccgcataggaccatcagataagggaagggtagagcagcccgcgtcaagttcataggccacggatttacatccttcttgcttctaaaaccctggtgttccccaacttcctctccttgctggactttgccgttctcgacattcctgtagtaaagcccagggaggacccggtgat

SEQ ID NO: 40081 - DNA, 307 bp, Triticum aestivum
  Clone ID: PAT_TA_40081
gctagctacgccctcctcctcctcttccttgtggccctggcgatccggggagatctgcaagcctccgaagtcgcccctactcccgtttacgccgcggaggtcttcttggcggcggcggcggcgacgataggcatggcggatcaggagctggacagaacggtgcattgcctgatcgggtgctcgacgactgttctgggctgtgccttcaactgcctgtgcgtgcgcaagggcattgacctgccgatctgcgttatctgctgcaacgataggcgcatcgtctgcatgttcagttgttgcaagccacctt

SEQ ID NO: 40082 - DNA, 228 bp, Triticum aestivum
  Clone ID: PAT_TA_40082
cccacgcgtccgcccacgcgtgcgcttttcccttccctgtcgcggaggaagagaggaccgtccgaatcgagcccattcgagctcgattttagccgtcaaaaagtttagcgtgctccatacaggggcttgccgtacgggcaaagctttgagcggtagatcgctcgcggtgggcggcgagatctgtgacccaaaccctaagttgcggcagctccgtcgtgggggtgaaat

SEQ ID NO: 40083 - DNA, 279 bp, Triticum aestivum
  Clone ID: PAT_TA_40083
acgttctagatctttaaatcgtacgtacgcatgcattctacatgaaaagtttcttctatgattacctaaattcaaataaccgagcggtgcgtcctacgtccgccccctcaatcggagtccagcaatgccccggcggcggccgagggccggagagaagcggatggacgccgcgatcgaccactttgccgagatgggataccgcaaagccgacgtcgtccatcttgttataaaacttctcaaggatgtgtatttgaaagataagtgctcgttggtcaaagg

SEQ ID NO: 40084 - DNA, 400 bp, Triticum aestivum
  Clone ID: PAT_TA_40084
gcaaagctttgccaagaggactactaccagaggaggagacaaggaatccggggggctcgcttccccttcagcccaaccccaaccccaaccaggccccgcggcgaccacaagctccttcgctccccgcaacctcgtctcgccacgctcaggtcggtcaggctgttgagtggccagaaatcttgatatggatgtgcctgctgctccagccatggcatttaaagcctacaagttcaaagaggtttttgtcagggactacttgctcgcagactcttatgctccatacactgctgtgcttggggggatcctgatgtgcaaattggcctatgatttcacgcgcattattaggttatttaactacaaaggatatgcttttttttacaattttcatttcatttgattg

SEQ ID NO: 40085 - DNA, 241 bp, Triticum aestivum
  Clone ID: PAT_TA_40085
tttttgtttttttttttttttttttttttttttttttttgaggcttcaccccatcctcggcggttttattattattgcactcattttacgaaccccaccccaccataaaaaaaattactctgccactatggggacgggacaatcctatgggccaaaaaatgatcaccctagaggtccaaaattgtaagaaggagaaaacagccattgcagaggcctttctatgccttttgcttggactttt

SEQ ID NO: 40086 - DNA, 197 bp, Triticum aestivum
  Clone ID: PAT_TA_40086
cgcacacgagggcagctttctgccatactctgccacacatttttatgctttcagagagatttctgtagcgaggcatgttacgttcttacatgaagcaaagacttcttttgcacaccatggagtgaaaatctctaatctggaaggggatctcccagccatgatggcgcagaaagacaaggccgtggtccggttaacaa

SEQ ID NO: 40087 - DNA, 402 bp, Triticum aestivum
  Clone ID: PAT_TA_40087
gttcatcttgggcgtcgttctccttgccggagagcgtgccggcggtggcggagttcgctggcggctgcgcgatgctccgggccgtgtgtcggtctatggaggtgcgcggtgcggcgaggaggtcgcggtggctgcggcggcacggtgaggaggccgcggaggacctgcgtggtggcagcttcaacgacacacagcggcatggcggcatggaggtgctgcgctgcggttgaggccgcagcggtgcagggcaataagccgtggcggcgagccgggcgcaaccggtgcgtgttatgggtgcacactgaacgcgtcgggcgcgtcgggaccgcgggcgcgcgtacgagcgtgcggttgacgttgggaggaggcgtatgtcgccgttgtgctcgagtcaatgctcga

SEQ ID NO: 40088 - DNA, 213 bp, Triticum aestivum
  Clone ID: PAT_TA_40088
tcatcaagaaacctggagaggatcatggccggcgtgaacaccagtgtggtcggactcaagcccgccgcggcggtgccgcagtccgtctcgccggcgacggaaaagcgcgttcaggtcgcccctcccaaggaccggcgggcggcgcttctcggtctggcggacggtttcaccgtgaccgtcatacgcttggggtgatggaagcctagctcattt

SEQ ID NO: 40089 - DNA, 403 bp, Triticum aestivum
  Clone ID: PAT_TA_40089
gagcattttatagagattatccgattttaagtattttatttaatgtgtctatctccggttgtgatcctagaaggcagtaaatgtgcacttgtgttttgctaatgcaacagagtatctatgagattagtaattctctgtataacatggaaattcttcacaactgtaattttgaatgaagctattttctgatatttggatcttgccaaaaatgaacatgagtgatataacccatataacaaaacagatgagagttctctttgcaagttgcactgcaaagattgctttttagtgaagttatccttggcggtgtacaacttagaacttgattgatacttttcattttacattgatgtgctctccagtgagaacatttttttgactgaacgtgtttcattagatatgc

SEQ ID NO: 40090 - DNA, 364 bp, Triticum aestivum
  Clone ID: PAT_TA_40090
actgcgtgtaggagtacatcgagaagcacagtgactgggtcgctcactggagcgagagctttatactagctggtacactaggtgtggtagtccacgtggtatgtgacacaacatacgagtccatcaacacatttaacaacacagggctctacaaccggcttggcatcttgcatgccatgcatcttggcatggatgtgcgtatgcacgcagctacaactgcaattactggttgcattcatggcgtccttgatgaggtcctagatgagttcatagaggcaacaagcgagcctacatggcgtgcttgctagcataggatgcctcatatgcttggagctaagccgggagacataccgttgtatattca

SEQ ID NO: 40091 - DNA, 328 bp, Triticum aestivum
  Clone ID: PAT_TA_40091
agagcatgtacattttagaagaacttgtgctcgcatatgcaagttccaggtaaaatcccctttcccccgatcctctctcagttttcacatttcattaccttgttagctcctttgttgtactcccaacagctactcgaaatctataacatgacagaaaattgtcaagaagaagaaaaacctagacgctctagagcagcagttaacaagctcattctctccaccctagctagtagctacaccctgcaagcttcgtcctgcaccttggcgccgtcgagcgtggcgctctcctcggcgttatagctcgcgtgcacgctgtagagcacgtaga

SEQ ID NO: 40092 - DNA, 227 bp, Triticum aestivum
  Clone ID: PAT_TA_40092
gacgggcctaataaaatattctatttattttaccctcaccaaactcttaaaagcactccttttttaaacttgcttgaccttttgctaacattattacataagatcttttttaaaaatactgatgagaatacttcgaagttggttgaaaataaaaacccccttaatacatattttttttttgtttttaaaaataagctcttatttttttaaaaacattaaatttttgt

SEQ ID NO: 40093 - DNA, 303 bp, Triticum aestivum
  Clone ID: PAT_TA_40093
taagtggttttttttttgtgttttgtgagagcaagaacaaaatcagggttgatcaggtttaacggatataattgaaccacacggtggtatagtgccactagtaaataaggctgaaacagtgtcaacttacagcttatagatgcaaattcaaatgggtggcaagcaccataaaatcccgtcgctctgcgagatctatttttctttgttttcccaacaattacttttcctgcgattgcaagttaaagtctcgtaacccattatagattgcaaagcggaaatttcattacagttaccataaccttt

SEQ ID NO: 40094 - DNA, 227 bp, Triticum aestivum
  Clone ID: PAT_TA_40094
tcgctgcacttcgatgaggagaaagccagccatttccttacaagtggcaagccacacatagctcatagggagcagcactacaaggggaagggtaagagcagtaacgccgccatagttcctggatgcgccggagtagcgcagcctctccttgctttcgctccgcccgctattgatgctccgtcccagcccatagccagagccctcagcccaccagagtccgttgcgta

SEQ ID NO: 40095 - DNA, 151 bp, Triticum aestivum
  Clone ID: PAT_TA_40095
gtgagtttggatgcggtctttagatgaatcaagcctgagatccacaggtgtcgtgggctaattagctgtgagttccaaaggtgcaaagtattttgtaccctccgtccggaattattgtagaagaaagatatgcctagacatattatagttc

SEQ ID NO: 40096 - DNA, 320 bp, Triticum aestivum
  Clone ID: PAT_TA_40096
cccacgcgtccgcccacgcgtccgcccacgcgtccggccgcagcatcacaggaggttggaggggaaggtggccatcgtcactggcggggcacgcgggatcggggaggcgatcgtgcgcgcgttcgtccttcaaggcgcgcgcgtggtgatcgccgacatcgacgacgcggcaggggaggcgctggcggctgcgctgggcggcgcctgctgcagctacgtgcactgcgacgtgtcggtggaggccgacgtggaacgcgccgtcaggtgctgcgtggcgcggtacgggcggctggaccttctttgcaacaactccggcgtgc

SEQ ID NO: 40097 - DNA, 354 bp, Triticum aestivum
  Clone ID: PAT_TA_40097
cgctcgtctctccgggctccggcgacggccgtgccaggcagcagcggctgcgcgggccgagcagccggagtgtcggccccatcctgttgtgtttagtcagtcaccgaattgtgggcccgtgtccgggagcgaccaaaccggaatcacgatcctcctgatccgggtccgacccaaccgccgccactcgctcgctccaaaccctagctagctacctacctcgcgccgccgtctccggcgccctcagccctgagcccttccgcagcgtcaaccgccggcggctgtgcgcggttcccctccccagcgtggcgctcttcagcatctccgcccaccccgagggcgccggcctccacaacg

SEQ ID NO: 40098 - DNA, 356 bp, Triticum aestivum
  Clone ID: PAT_TA_40098
gcccgcgggtcccggtccggggttcgagccacgcgtccgacactggtgtccatcatcctggtcgacaagatcggccgccgcaagctactcctcgaggcctgcgtccaaatgctcatcgcccaggtccgtccactaactataacttaccaatcacctgaaaatatataagacgttattcacatctgaaattacgatggatgatccgttgcactgccctgcaggtgacggtgggagggatcatgtgggtgcaagtgaaagacaacaacaaccctagccactcgtgggcgctggccatcgtggtgctgatatgcgtctacgtgtcgagcttcccgtggtcgtggggccccatggggtgg

SEQ ID NO: 40099 - DNA, 362 bp, Triticum aestivum
  Clone ID: PAT_TA_40099
agccgggggcccgtttcttatctaaaataattcaagatgcgtcgggtttcccccgttagcccaaacatggactctagcaggcgccccagtggaatacaacaattgcttgctgcagagcaagaggctcagcaaattgaaaatgctgctagggctgctacaattgatgtggtgtgagtgtgaaaattatttctcagaagaatttaaacattttaaaagcacaatatgacttgggtgcaccagatattttccgcatggtccaacccccattttctctcaccgcctcttaagttaccaccaatggttgctaacgctccaccgttagactgagaaacaagaattttttttttggctcttgttgcatg

SEQ ID NO: 40100 - DNA, 343 bp, Triticum aestivum
  Clone ID: PAT_TA_40100
aatttaccattgaatcaaccactgatatattttatttcacgaattataacactatgatcgaccaattcaggcacatacttctgggtatcttacacaggtccttgaacaactattggctctaacattaactcagctgctcatccaactacacatggcctaggggatgctactagacacattcatcagctactcctccatctacacatggatcaactgttgcaactaccatacttatatatcagggtatatatcttagcacttataataacttataccttacccttagtcttaggcccgcatacactcacacattaactataattgttatcatcactgtaaccaa

SEQ ID NO: 40101 - DNA, 272 bp, Triticum aestivum
  Clone ID: PAT_TA_40101
gggaaggaatattcggcaaattacatttcataaaacaaatacaagggttacccgggcttaatcgattaacgggtcatgcccacacacccccacccaggcgtttgttttttttggggccccagccaaactaagacaaattaatttccccaacccggggcatataaattaacccacgcaagaaaaacctttttaccccccgcccgtttttggcttgagaaaaaaaaattgggaacaaaaaaaaaaaacttgctgggtgccccggccaatccttc

SEQ ID NO: 40102 - DNA, 167 bp, Triticum aestivum
  Clone ID: PAT_TA_40102
attaatgtaattttttcattatcacacttaacacatgacactttacacgtttcaaacaaaaccgtaggtgcagaagggcacaatgacattttttacgacgacaagaaccacaataacacgggcgacaaaaatgatgattattactacggtaataaaaaagaaaagga

SEQ ID NO: 40103 - DNA, 360 bp, Triticum aestivum
  Clone ID: PAT_TA_40103
cagatccaacataacaagtactttattatacaggtactaaactgaacaaataacaagttgctacaacttgtcaagtctgaacattacacaaccctgaacattacaaaattctgaacattacacttctaaagtttacagcagtttgagagagagagagagagagagagagagagagagagagagagagagagcttcaggttcagaagagaagcaagaaccagtagcagaggcgtagggaacaggagcagctggcacaagtgaggagcagcaacggagcttggagaagcagcaggttgaggcaccatgagaggattaggaggaggagcagtagcaagtgaggccgtccctgaatgaatcttt

SEQ ID NO: 40104 - DNA, 145 bp, Triticum aestivum
  Clone ID: PAT_TA_40104
agaactagctagacgcgagcggtcgatcattcaggttctaaacataacaaatcccaagtttattcatcttggcagcaaccaatatttcacaactttcaaccttacaaaattttgaacactacactttttatagttacaataactt

SEQ ID NO: 40105 - DNA, 167 bp, Triticum aestivum
  Clone ID: PAT_TA_40105
acgcctatcgatctagagcggcagcaccttcttttttcgcccgattcaaatatggccatggggaaaaactcgaacgaggctcttttccacatgatccaccacctcaacaaataacacccccagactttttcttattgaacattcaatacgagctcatgtaaagggct

SEQ ID NO: 40106 - DNA, 297 bp, Triticum aestivum
  Clone ID: PAT_TA_40106
ggctcaagcttaaaatacgctatcaatgacacaaactgtacatgctgcctgcggtagttctaaaacaaatatactgtacatgctacgttcatgcacatagtacacctgacacaacttgtttggcagaatcaccatgacaaagatagaaaatgagatggttcacgacacatgacaaagaattccctctgtaaagaaatataagagcatttagatcacaagtggtgatctaaacactcttatatttctttatggagggagtacaagttcaccgttttcataaacggccacacaggcacc

SEQ ID NO: 40107 - DNA, 253 bp, Triticum aestivum
  Clone ID: PAT_TA_40107
gaagtagccgtggagtttgagatttgtgaccttgtatcataaaacgcggagaatgataagtcgggggaattttaagaactccccgtggagtttgagatgacttcctctgtattacttatagcatagggaagatgaaaagccagctgaatatgaagtagctaccgtgtagggtgagaaaacagaaaacggtcttgtctatgaatttaacattttaatctattacaaacttgtaaggttatgaaagtataagctg

SEQ ID NO: 40108 - DNA, 350 bp, Triticum aestivum
  Clone ID: PAT_TA_40108
caaacactctctcttggtctacatagtgagcagtcgcactgtttttttgagccagctcgccaaccagagaagatgagggtgatcctgcacatccagggtggacagagtggaaaccatattgattccaagttctgggaggtggagtgtgatgagcatggcattaaccccaccgggcggtatgtcagcacctatgaccatcagctggagcgcgttaatgtctactacaatgtggcctatagtggtctttttgtgccctgagctgtccttatggatcttgagcctgtgtacttggacagtgtccgaactggaccgtgctgtctgatcttaatgtattgacaactattgttttt

SEQ ID NO: 40109 - DNA, 375 bp, Triticum aestivum
  Clone ID: PAT_TA_40109
caacattcaaagctgattttcttgatggagttcctgtagcattgccttttgatgagcagaatctatccttctttatccttgaggtcatcactgatgactatgctgtgtttcaattccctatgcgcttggatagcttgtactgctgtgggtttcgatgtcttgatctttgtgataaccccttggagaagctttggtactcatttgggaaggtgtcgattcttccgaagagactattcaagaaccgaaagaaatctgggttatcattagcttacaataacttccgtaaaattcagatctttgctggtgtgattgcaaaattttgtgatcattttcgggggttcagacctgttgatagtgctgatgatgatctggtgg

SEQ ID NO: 40110 - DNA, 278 bp, Triticum aestivum
  Clone ID: PAT_TA_40110
gagccatgatgtgatttattaataaatgaataaatggttacatgaacaagggtttttgttctacatccttttaggccaattattatgggcgcgttacacacaaaacctaggggcccagttaaggaaaggaggaatattatcaaaaaaaatgtacatggtctatgaacaatccccagagaaccaaaatttggggggccattgctctccgaccgaaagaacaaggggcaatcatgttcgttcagacagcttctgcggggaggtgccaaaaagagatcact

SEQ ID NO: 40111 - DNA, 340 bp, Triticum aestivum
  Clone ID: PAT_TA_40111
tctccccctaccagtccacccgctcgaccccgcggacctagggttcgcgccgccagccggcgaccccgccacgtcccgtgcgccggtgaccacgccccgtcccgtccgccgctgccccgtaccgtcgccggcgacccgtcgcgtccgccgccgccccgtaccgtcgcccgccccgccccgtaccgtcgcccgccccgccccgtcaggtccgcccgcaggctgtttcaaagtcctagatccgccactggagctgactgtcccgccggcggttcttctgtagtttctgtcaagatggggttgtcttcggccggtgagatcgacggtgcgcagctgtgcattt

SEQ ID NO: 40112 - DNA, 310 bp, Triticum aestivum
  Clone ID: PAT_TA_40112
ttgaatgtatcgttttttattttttttgtcatttatttttatttttttttttttggaaggaatatttcgaaaatggcatttgataaaaaaaatccaggggttacaggggctaaaacgattaattggggaagcgcccacacccacaccgagtggtttgtatttttggggggagactgccaaactaaggaaattaaatttcaccaaaccggggctttaaaataaacagccgcagaaaaatctatttaacaaccgcccgttttttgctggatgaaataaaattgggaactaaaaaaacatacttgcatgggtg

SEQ ID NO: 40113 - DNA, 458 bp, Triticum aestivum
  unsure (1)..(458): unsure at all n locations
  Clone ID: PAT_TA_40113
cgttcccgcncaactcggttnccccggaatcctcccacccttcggccttccccttcgggtcttcccccttcncctggggccggccccggcccccccccctttccctggccaacggccaccaaccgaccaccaacaccacctaccatcggcccgcccaccccttgggcctctgggaggcacccgcgccttgagccccccaccggccggcaacccggctgccgcggatgacccgcccgccggcgacgacctcctcctccccgcgtcgttcttccaccccgagcaaccacccgagagcgccgccgtcgcacttccgaagaactcgcggccaccgtgccccctgaggcccgctagcttgaccaagggctccaccgtcatcctctccttcacctacggccgcccattggagcgcggcgccgttaccccgcctgcatcgcccgcttcgtcaacctccggccacc

SEQ ID NO: 40114 - DNA, 296 bp, Triticum aestivum
  Clone ID: PAT_TA_40114
acgcggacgcgtgggcggcgccagacttacacttccggtggacgccaaaaccctgacgggggtaaggtatggcgcgcggcgcatctttcatgacacacacactagtgtgggtcataggcaggacggcccttaattcaccgggacatgtggctcttctttttccctggggttcaagtgtgagcctaacagatatcgtcaattcggacctttgaacctttgtttatcacgcacctggtggcctttatcgcaatcatctagagcctgagatatatttctctatgcgatattacaatttt

SEQ ID NO: 40115 - DNA, 369 bp, Triticum aestivum
  Clone ID: PAT_TA_40115
gcaaaagaaaccatgcccaggagctccatagattttggccaaatatattttgaagaactgagttggaatactagggagagcaggcccgggacattgttctttacagttaattttcttcatcaaatttggtagccccaagatgcaccaggagtaggcacaaggaggcggacgggggcagttaatttactatgtgttagttgttaaatatatgtccaaatgttgatactcctacttgcacgtcgtatgattttttttgaaatgctttgtatgttaaatgaaccatggcgatgtttttgtttagttgcctctgatgtgcatgcttttattttctctttttctcataattcctagatttaggaaaagatatgg

SEQ ID NO: 40116 - DNA, 199 bp, Triticum aestivum
  Clone ID: PAT_TA_40116
ctccctcaccatggccgccgccgccgccatggcccgcaggctgctctcccgcaccaccacctgccactcgaccaccgcccgcctactcgtatcccgtcgcctcgactccgacccgtgctacccgcgcgccccggcaggcggcggccaacgaaatgctgaaaccagcgggcgaacccttatctgaaaactactttctgcg

SEQ ID NO: 40117 - DNA, 250 bp, Triticum aestivum
  Clone ID: PAT_TA_40117
ggagagggtccgcaggtgggcgcccgaccgtcaggacaggttcgtgcgccgattcgccgacgccctcgctcaccccaaggtcagtcactagctccgcgtcatctggatcgactttctctccaagtgtgacaagtcgtgcggtttgaaagtggtcaaccttctttacgtggagccattcatgtgatgatggttggaccgttttaaactcttagctatgatgttcacattatggaccaggtattttgggacc

SEQ ID NO: 40118 - DNA, 218 bp, Triticum aestivum
  Clone ID: PAT_TA_40118
cggacgcgtgggtgctgcttcgcttcacacgttgcttagtccctaacgtacacaagtccgccaggcgagcgtcgaagatgtctctggtgacccatgtgcaggtctatgtgacacacacattgagcgacatcgaccgggcacgggggctggatctaatcaccgtttggagagcatgtactaatggccagtgagttacttgatcatatcataataggggt

SEQ ID NO: 40119 - DNA, 334 bp, Triticum aestivum
  Clone ID: PAT_TA_40119
accacgcgaaaaatcaaaggaaaatcttaatttgaaacagaagtgattctagaagggatacctcaagcgagtactggcccaactgaaggccacatgatactcaacatgatcctgattattgcacagaaacatgcagatgaacagccaccaacatatccaccaacgaataaccaatgccagaaccaaatccagctgtggatgatgtcctcatggatgcctcaaagactgccgtacatactgctgtaactactgcgttatgcaatgcaatatctgatgttccttatggtcccccaacaagtgctggaacgacggcattaaatgcaacatttgactt

SEQ ID NO: 40120 - DNA, 188 bp, Triticum aestivum
  Clone ID: PAT_TA_40120
gaatccggagatttcgacccacgcgtacgatcacgcgaaaaatcaaaggaaaaacttaatctgctacagatgtgattctagaagtgattctttgaggaagtactggcccaatttatggccacatgatacgtttcatgattctgattattgcaaagtatcatacgaatgaacagttacttttattttat

SEQ ID NO: 40121 - DNA, 209 bp, Triticum aestivum
  unsure (1)..(209): unsure at all n locations
  Clone ID: PAT_TA_40121
ccggtaattgacacccatgatcccttatgctacccttattcctaaaatataccaacagagccaggactaatctacttgcggaccatatnataacttaaataaagcatgtttattactatattatccatacttttatttcatctatactttgttatacctcccttttataatccaatttccccaaaattcttcaactttcaagagattta

SEQ ID NO: 40122 - DNA, 442 bp, Triticum aestivum
  Clone ID: PAT_TA_40122
attcaagctcacttgttaagacctatcctgatataggtgaactggcttttggccggaaaggaagaatcatagtagcaatattcatgtacctggagctgtaccttgtggcaatcgatttcatgatactggaaggtgataacttggagaaattatttccaagtgtcgacttccatgttgctggactcaagattggaggcaagcaagggtttgttctgattttcagtctgttggttttgccaacgacatggtttcggagcttaagtgcgcttgcgtacgtctctgttggaggaatcatggcctccgttattctcatcgctgctgttatctgggtaggagcatttgatggtgttggcttccacgagagaggcgtgcttgtccactgggctggtattccaactgccatgagcttatactcattctgtttcagcggtcatgctgtttt

SEQ ID NO: 40123 - DNA, 327 bp, Triticum aestivum
  Clone ID: PAT_TA_40123
ctgttttctgctacaaggatatctacctttttttaaaaccccctcattcttggtgtgtatatgaaagggggatgaccgatcactatcatccaaacaatgcaacccacacgaggattaaagataaaattcagcttgttaatggccttccatatatcataattactcgtctatgtcatcaagctactaaagatgctgattttcatgttcctcacgtcaatgatcttgccttaaatttttcatagccttgctacttgcccttctacccaagtcatttttcttttactaactttccgtttaactaccgttgcactaataatcactcacaat

SEQ ID NO: 40124 - DNA, 173 bp, Triticum aestivum
  Clone ID: PAT_TA_40124
atttgtggtagccactctgtaactattcctctatttctggtactcccttattttgtgcggttttcagtgggttgacaggcaaggtccaagggaaaaaactttttttttaaacccactcatatcctcaacagcatcccccggaatcttttaatcacctttaaattttaattttt

SEQ ID NO: 40125 - DNA, 409 bp, Triticum aestivum
  Clone ID: PAT_TA_40125
acccaaagtcctccctttcccctccccctccccgctttccaccatttcgtcgaacacggggtccgatcgcgcgcgggcggccatgggggaggcctccgagtatgacggggtggatgtggcggctgtatcggcgaggttgctggagctggtggccgacgacgatgtgacggcgctcgtcgacctcctcgccgcgcacccgctcctcgcggatgagccggcgccgtggtactctccggcgcggggcgcggagcccatgacgccgctcatggtcgccgccgcgtacgggtccgtggcttgcctcgacgccctcctctcgccggcccacctcgccgaccccaaccgctcctccgcctcctcgctctccaccccgctccacctcgccgccgtgggcggcgctccatccgcaccc

SEQ ID NO: 40126 - DNA, 300 bp, Triticum aestivum
  Clone ID: PAT_TA_40126
caactccttatccaaccctccctctaccatatcacaccccacacctcctccagctcgttcctccaaccgggtggcggcttcgccaattccttctccccttccgtcctactcctcccgcatacccccctttcataaccctagcaatggatgaggaggctgagccgctgcccgccaccaaccatggccttcctctcctcttccttggtcgcctcttcctcatcaaggcacttagagcggatggcatgtccgtgcagaaaaacaaaagctgccctctctgcccttcgaccacagaaaaacggc

SEQ ID NO: 40127 - DNA, 253 bp, Triticum aestivum
  Clone ID: PAT_TA_40127
aatggggaatagagtgggcagcgaccagcacagggggcacagatttgctcttcttttctcatcatatccccgtccaacaaattagatgtatcagcggaagagttccgacaaatgcggtaattagatactggaaagaaggcaggcaccgttcctttttagctgtgagtggagttcactatgcccatgacaacatggtggtcgaaaccgacgagaagaatcaacccatctcagtctcccgcatcctcatggctag

SEQ ID NO: 40128 - DNA, 446 bp, Triticum aestivum
  Clone ID: PAT_TA_40128
ctcttaaggtgcgttgggatgagccgtcaactattccgcggccggatagagtctgtccttggaaaatagagccagcttcatcacctcctgttaacccgcttcctctttctcgggtcaaaagacctagaccaaatgttcctccagtttctcctgaatcatctgttcttacaaaagaaggtgcaactaagattgatatggattctgctcaagcacaacaaagaaatcaaaatagcatggtcttgcaaggtcaagagcatatgaccttgaggaccaacaaccttactggcagcaatgaatctgatgctactgttcagaagcctatgatgtggtctccatcccccaacattggaaaaaaccatgcatccgcgtttcagcagaggccctctttggttatttgaatcgcacctgggaagatgtgatgctagttctggtgctcaatcttttgg

SEQ ID NO: 40129 - DNA, 364 bp, Triticum aestivum
  Clone ID: PAT_TA_40129
ggtgggggaggatcgatcgtacagggcaacactggtactgcggtagcttagtacgtagtagtacatcagtcccctgcaagctttcgagggcggtagcgaggccaaaaccggcatcgccatgccattgaatcttaaggcgcggaaactactcccaagtcacccaatcgatggatcgatggatccccctacgtttccttcccaccttagttcgggacacaccttggatcatcacggtacgtacgtacgtacgtatgtatgtatccatccatagttgattagttgcaaagggcgacggcggcctcctggataaccccttgggtggggtgggcaacgttatgagcctcgcgctccacctgctcccggc

SEQ ID NO: 40130 - DNA, 415 bp, Triticum aestivum
  Clone ID: PAT_TA_40130
ggatggtactccaagatgctgtagttgtgaaagaatggagccaagggaatcaagagatgtattgcttgatgatggtcgtaagctctgcctggagtgccttgactctgcagtaatggatacaaatgagtgccagcctctttacctcgaaatacaggaattttatgaaggtctcaatatgaaagtggaacaacaggttcctctgcttcttgtagaaagacaggctctaaatgaggccatggagggagagaaaactggacaccaccaccttcctgaaacaagaggtttgtgcctatcagaagagcagactgttagcacgatattgataaaaaccaagattgactggaaacaaaattatggaaatgataacagagccgtataggttgacacggcggtgcgaagtgactgctaattctca

SEQ ID NO: 40131 - DNA, 394 bp, Triticum aestivum
  Clone ID: PAT_TA_40131
atgtcctggctgctggctccaaacattatccacaagaacacgctcgctacttgtggaccggctggcacagggaactcaatgtgctacttgaaacattccaaaatgcttatgcatatcccaccctgaggagaagatactagagcatgaccagattgaatagtgcacgtttggagcaacagaagccaataaagccgatcactatagaagctccaagatgacacacgcaggcatgcatggacactgctccagtctagatgtaatgatgacacatacagtgggctgacccaatcaacgcttggagtgcctgcacatttgattcgcccagaacataaggctggacaatcattgccgtttcgccagcttaccacctagcacgctgaccaggaaccctacc

SEQ ID NO: 40132 - DNA, 322 bp, Triticum aestivum
  Clone ID: PAT_TA_40132
cccccggactttttctttttttctacctaaaaaaaatcctttcttttttaacagataccaattttctcccacctttccatataacatacttcttttttacaacagggtaaaattaaaatacttcaaccaaaatgacatcttttttaaactatatcactttctgacatcacatatttcataagattatgcatattccttcacaattttactgataaccgtatatttcaaataataacacaaatctattacaaactttcatacaacacctgaatctactaaacttcaatcttttttaaaaacacatcattattattattaatta

SEQ ID NO: 40133 - DNA, 370 bp, Triticum aestivum
  Clone ID: PAT_TA_40133
gcctcgctcaccgtcgtcaacgtcggccccgggttccgggaccagtaccactctttccccccgaattcccctttccgtttcttgaaaattaaccccccgccggcgccccccaaacaaaccattcttacaacattggaaaacaaaaggcgggggattccattgtggattggtttgggctggggaggctgcaaaggctcgtgttccctctaacccggcaagccgcggggattgatatgcatgtatgccgggatgcttccgaggatatgagaaactctccagggaggtggagaagagcaatcaccgcgtgcttgaccaggaaaagcgcaaccccttgatgaggtgcaagacaccgggactgcaactgcaataa

SEQ ID NO: 40134 - DNA, 339 bp, Triticum aestivum
  Clone ID: PAT_TA_40134
tttttggtgggtttttttttttttggggtttttttttttttttttttggagttccttttttttcctttttaaaaggacatttgaaaaaaaatgggtggtttgaatcctaaaaaagaccgaaaactaaggccgcacaaaaaaggaacaaacctaacaaaattcaaaagacgattaaatcggaacttatttgggacaagcatatgcgggaaaaaaagacttttgcctaacaagctaaagaagaaaataaaaaagtttcaacaccgcgtctgggaagagccagaaaaaaggaatttggggacattatcgggagctaattaaaccgggggccaaaccagcgcg

SEQ ID NO: 40135 - DNA, 431 bp, Triticum aestivum
  unsure (1)..(431): unsure at all n locations
  Clone ID: PAT_TA_40135
attcccttttcaagccacgcttcctctctcctcttctctcctctccaanaccaacacctattcttaccaccaacacacccacaagggccctctctctcaccgatagcctctttacataatcttctnctctcctacttcaccaactcttcttacacacccccctcaatataaccaatcccaacttacacatcctaatcttatccacaaacaaacaaaatcatattacaacatcaaccacatccttcaagactttcttttccctcttactccaaatatctcacattacaaatacattactttattatccatattcatcttaccctttaacattactctataatttcttcctaatgtacctttcctcatccattaccccattctttcaacaccatttcattctcatcatcctcctttaacctttctacaacatc

SEQ ID NO: 40136 - DNA, 459 bp, Triticum aestivum
  unsure (1)..(459): unsure at all n locations
  Clone ID: PAT_TA_40136
ccgtatttccctggtcgggctaggcgtccgcccactcgtccgttctgttgctgccatcactttatatactgtgactgtcnaatgttgtggggagcaccatttggagggtgatgtgaaattctcttatttacttgaaatgatgagatctaattttacatttactgacactattgtaactgttactgtcccacctcttcatcccttttaaataaaacacttaaatgctttcgatttcaacatgaacaaaatgccttatttctccatgactcttgccgtttttgccctcttttccgatgttccaactgctatcatagatgttgcctcctggagagtgaaggaaaccgattgaattttttctatccatacctagctgactaatcttttatcatctttgtaggaatgccccaactacttcatcatcactctcccagaaaaacttatcttcacgtttatcgatac

SEQ ID NO: 40137 - DNA, 254 bp, Triticum aestivum
  unsure (1)..(254): unsure at all n locations
  Clone ID: PAT_TA_40137
gtgggttttttttttttttttttttttttttnaaaaaaaacaaacttaaccccgatcccttttccgtgtccatagtactttatttggaaatcctgttttaaacaccagcccacaaaaagtttgctttttttcgcgacgagatacaaaaaactccccacccgtgcactttttacatacacaaactcgccacccaacgtttaaccacacaacaactggaaaagcctttgtttgtttttcctccctttacagcattt

SEQ ID NO: 40138 - DNA, 416 bp, Triticum aestivum
  Clone ID: PAT_TA_40138
cccactcgtccgggcggcggcgcgttgcacaggagaaggagcaggcggcttcgggggccgaatataataaggagggggacctatccctagctcgcaaccatggctaggggtttgaagaagcatctgaagaggctcaatgccccgtctcattggatgcttgacaagcttggaggatctttttcccccaatccatcattctgtcctcacatggccagaggagtgcctgcctcttatcctcatcctgaggaacagactgaaatatgctctcacctaccgtgaagagcaatctttccttattccagcggatattattgttgatggaaaggtccatactgacaagacctaccctgctggtttcatggacatcattttcattcccaaaaccggtgagaactacatgcttctttattacacca

SEQ ID NO: 40139 - DNA, 418 bp, Triticum aestivum
  Clone ID: PAT_TA_40139
ataaaaaatcaatctttcgtctcgatgagcggcggcggttcgggggcggcgccgggtgcggagagcgggggcgccggagattccatcaggcgtctccatgaccggctcgagtcgatgctgccgcgggtggaggcgctcgccgccgaccgcgcgcgcgtggaggaaaccaacagggcccagcacgagctgctgggagccctttatgcccacctcctccaggcggaggcgagcagggataggtggaaggcgctctactgtgatctataccggtgctctaatccaactctcccaactctaaaagagagacgcggtggattcccaagcctgtgaaactcttcctgattccaataactctcatctgcacgagactacgtgggatgcccgtgaaatggagcttgtacagaacacgatgcagatc

SEQ ID NO: 40140 - DNA, 334 bp, Triticum aestivum
  Clone ID: PAT_TA_40140
aaaataaaaggttttacatttgaacaatgctcgtctgaacaacaacaatacacatcaaacctgggcaagcatattcttttgctagaaaaaagcctgccaccggttttggttttaccactaacaagacaagttgttggccaatctttggcctgattacttggcctattcccaatccatatttacatgccacttacaaattttacaaaccaccccgtgccttaggcaaaaggggtgctgtctttagctttaacacccgcccggccggctgtagataaccggataagaagaaataccagaggcgccttgtcctctatcttggaaaatctctatttcg

SEQ ID NO: 40141 - DNA, 334 bp, Triticum aestivum
  Clone ID: PAT_TA_40141
ggctcattaacgtggattgccttcagtgccgtcgacaaattgaaggaggattgcgagatgctggaacatttgttttgttccctgcctagttgttgaattctgcagcttcgaaccccacacacaacccagagttgtcttccaggttgaaactgatttgccatcagagtcttgttgtatgtgtcttctcttcattcttaatgtttcgtgtctgctaacctgttcgggagaatcaacatctcatactggttgattgcggtctaccatggaggctatatcacttgaaagctgtattgaatgtgtcgttggcaaaatacgccgacataatcagtatctc

SEQ ID NO: 40142 - DNA, 181 bp, Triticum aestivum
  Clone ID: PAT_TA_40142
gaaagaagaggggggcaattgttttatcactggtacagctgtcttttttgacatttggaaagaccgccacttgtggcgtcccccgcctccccttccctcccctcccttgttcttatccaaaacaacgtattgaaaaatttggccaccgacccaccgaccaccggtaccttgccgggcgccc

SEQ ID NO: 40143 - DNA, 194 bp, Triticum aestivum
  unsure (1)..(194): unsure at all n locations
  Clone ID: PAT_TA_40143
tatcaaacattatactttcttcccaattttctacttatacatcaacaactntctgaagctttttactaaaaagacttgatcttctcataaccctattctttcacatctagcctctatactatacaagacatctatcacatccccttttcattttatccattacacctattataatatattaacactccttacat

SEQ ID NO: 40144 - DNA, 428 bp, Triticum aestivum
  Clone ID: PAT_TA_40144
cgaggtgctactgctagccagctgcgccgacaggttacttccgagcaaatctgaagctaacaggctacagaagaagttacccaaatgcagagtcttcttctttgagaagcatggccatagcttgctgctggtgagtttttttaagcagactttatcaccccttctgaatctgcagttgctctggacatacgacgatatcaggagcgtgcccttcggcgggaagctgctgcgggcctacagcaaccatctgaagctaagggacactcaggaggtgatcttgcccggcgcagttccgaagattcccggccggttctactaccggttcgggaagccgatcccgacgagggggcggcaggacgtgctcaccgaccggcgggccgcgaccgagctctacttcgatgttaaatcggaggtggaggaaatcatcg

SEQ ID NO: 40145 - DNA, 448 bp, Triticum aestivum
  Clone ID: PAT_TA_40145
agccagcgcagcactgtgctccgtgctttgaccacaatcaccgccgaacgcggccatgctcgcccgccgctgcggccactactgacgcaggtgagttttcccctcccccaccgctgccgttatggatccggcgtccgaggagctcgagcgccgcagccactacctcagctcactcatccgccgcaccaagctcaatgccgcgcccgccccgccacctcgtacttctcacccgaagccggagacgaagctggagctggagcgggagcgctcgcccatccgccgcaccaagctcaagctcaacgccgcgcccgccctccctccttctaccactcacccggagaccgggaaactggagcgggagccgggccctaagaaccagaacctcgttgaggccaaagcgttggtggagaaggaagtgaaagagggcgacggataggggaaggaggag

SEQ ID NO: 40146 - DNA, 416 bp, Triticum aestivum
  Clone ID: PAT_TA_40146
ggtgaaggctggtatcattgacccacttaaggtgatcagaacagcactggtggatgctgcaagtgtgtcgtctctgatgactaccacggaagccatcatcgttgagatccccaaggaagacaaggcggcacctgcaatgggaggcggcggcatgggagggatggatttctaacttgctcccaggctcatgtcaaaacaatgtgattagatggaacatctaggttagaactttttgtagcgcggatgtggattcatcggtatttaatgtgggtgaataaggctgtcacattttttgttctgctgcaagatgattttgcaacttgaatcatgtatgaacatggcgaacagagcctacagttgttaacaagcccgaaatgcccccaaattaagccaaagcgtaggaggataagtataat

SEQ ID NO: 40147 - DNA, 240 bp, Triticum aestivum
  Clone ID: PAT_TA_40147
accgcagaaactagaacatggcccagagcaggaccaccgtcgtcgcgctgctcctgatcgccgtcctggtggcggccgtgtgggagccgaaagcgaccgccttcggctgctacgacgactgctactagcgctgcgccaacggcgccaaggaggacccagcctgcaccaaaatgtgcggcgaggcatgcggggtcaccggcaaagccgtgggcgcggaaggcgggtatgccaacctattaa

SEQ ID NO: 40148 - DNA, 228 bp, Triticum aestivum
  Clone ID: PAT_TA_40148
gcaccaataggttaatatattgtagttttcaatattaggtttttacaataccatttgaaattatgataaatccagatcgacgaacatagatgacactgccataagtatgtgtatgacatgtggatatgaatatcaagctatgcaacgcaaagcctgaattcattcattttcatcaagccgcctcccttctattgaccttaaccatgaggccgtgcttggagtggagca

SEQ ID NO: 40149 - DNA, 427 bp, Triticum aestivum
  Clone ID: PAT_TA_40149
atcaaaccgaatcccaaacacacggtacgcaggccacgcccacgtggacgctctccggctccgcccgtcgccgccggcagcatgtcccgcggcggcgtcttcctcggcgtcgatgtcggcactgggagcgctcgcgcaggcatctttgatgagaagggtaaattgctcggttcggcgagcagcccgatacagatatggaaagagaaagattgcatcgagcaatcttcgacggatatctggctcgcggtgtgcactgctgtaaaatctgcatgctcgcttgcaaatgtcgcagctgaggatgttgttggcctcggattcgctgctacttgctcccttgttgctgttgatactgatggttcccctgtttcggtttcttggagtggtgatgcaagaaggaacatcatcgtgtggatggaccatagggctg

SEQ ID NO: 40150 - DNA, 394 bp, Triticum aestivum
  Clone ID: PAT_TA_40150
gccacaccaccaagaagccgtactcacgggcgattgttggtgccactatgaaagctatccaaaagaagagggccgagacgcctgaagtacgtgatgctaacaagaaagccgctatgcctgagatcaaggatcgtatcaagaaaaccaatgttgagaagaacgccgagaaggtaaaggtgaccaaggacgagaagtcacacgggggcaagggcgccacccagaacgattccacggacccaaacattggcgccggccacaagaagcgcaaaaagttgattactccatagacatagagttgggctgcctagccttgtaccctatactactatcatagacctgtgtcaagttattacctatccctcttgaatagacaccttatatgtgatgctgaatg

SEQ ID NO: 40151 - DNA, 295 bp, Triticum aestivum
  Clone ID: PAT_TA_40151
ggggaaacaaaaaaggagaccagccaggactaggccttgggggtttatatatatgatcatagaaaaagcatgctcggttttttacagcgggtacaattgacaagagatggggacgaccctcacacatttacatggaaccagggataatgaaatcaattaaaaatataaactttcaacactggcgggaacgtgattccgtacctatgatgcatccacccactgggttgcaaatcaaggacaagagcaaatgagttcaacagtaactagctggtcaccaacgaatgaatgaacgaac

SEQ ID NO: 40152 - DNA, 217 bp, Triticum aestivum
  Clone ID: PAT_TA_40152
atatcatatcatattgagggggggggtcttctctgcgagaaggccaaaaacgagaaccgctctgtacttccgcgtcgagctcgacctttttgcaagcattacgtaaagccgaacgcaggtgctacacggtgcgcatcaactccatgatatgcctgacgtgacactgcgacatggaatgcgaaaaccagagcccggaccaggtacaaactctgaccat

SEQ ID NO: 40153 - DNA, 446 bp, Triticum aestivum
  unsure (1)..(446): unsure at all n locations
  Clone ID: PAT_TA_40153
gtcaggcccgcatgcactgcagctgctcactttctcatcgcccgctgtcggcgacaacactcccttcctccagcgcgtcaccggcgcggccaaccacctacaccggcttcggctgcaaccatggcgcctctttttgtcaacctctagcatgttttttgtttcttgataacagcctattgcttatgcttatgatttgtttgttctacggatatgaaggttatgccaccgatagctcaaatcctctctccatcaactcatgtaaattgtcgcatttgacacctgagaattactctccccaggatatgaagaacccagccggtgcttcttagttgaggcatgtcagaagctcccctcctatcgtgtagtggtacaaaactgtgtgtggacgctntgttgtgtcagctgaagaagttcaatgcagggaaacaggaactacgccatgtaca

SEQ ID NO: 40154 - DNA, 134 bp, Triticum aestivum
  Clone ID: PAT_TA_40154
accaatccgcgcggcgagttggcttgaacacagagggcaccgggaaataaggcaattttgactttcacaatccccgggcggtataaaaaaaaccggctacgggttctgcccacctccctttgggaagggagctt

SEQ ID NO: 40155 - DNA, 441 bp, Triticum aestivum
  Clone ID: PAT_TA_40155
tgcacgagtttcctttccctgctgtctttccaactctagcatggtatcatcctgttagatcctcaacttccgctgcctccactccttcctcgcaacatgagctcctcgtctgatctctcctccggcggctctgattccgacgaggagttcggccctcccgtcgccacccagagcctccccactctccaaatccagagccttcgcatccgcgatcatgtcatggtcaccctcgacttcgagaaggagaactatggcctgtggcgtcgtcagttcctcgacgccctcgccaagttcgggctcactcatcatgtcgatggctcgccggcgcaggccacctccgactgggtgctcgccgacttcgcgatcctatcgtggtacaacgccacggtgactccctcgaccctggagatcgtcgcggaccgcaaggacaaggcgtacacg

SEQ ID NO: 40156 - DNA, 441 bp, Triticum aestivum
  Clone ID: PAT_TA_40156
agagatcgagaccacgccgcagtccctctccacccttcttccccatccccgtcgtcggtcttcgatcccgccggcgattccgtagacgagcggcgagaggcgagtagcagagcgagcggggaagctagggtttcggcgtgtgtgtgcgggaggggagaagaggagcggggatggcgcaggcggtggaggagtggtaccggcagatgcccatcatcacgcgctcctacctcaccgccgccgtcctcaccaccgtcggctgcaccctcgagatcatctcgccctaccacctatacctcaaccccaagctggtggtgcagcactacgagatctggcgcctcgtcaccaacttcctctacttccgcaagatggatttggattttctgttccacatgttttttcttgcgcgctactgcaaacttctcgaggagaactcattcaggg

SEQ ID NO: 40157 - DNA, 396 bp, Triticum aestivum
  Clone ID: PAT_TA_40157
aggcacggattttaccaattacatggagggcctgtaacaagtcgatgaactatacccagatcagaacctatgctcaagagtctctattctcaacacagcggtctcccccaagttcagcagtgacccaacgatccatgagtccgccgaggacatatggctatatcgagaacgatcaacatcccctgaatagttcacgcggcttccagaaaccttgagagtctatgaggcgcgacaggtcgtatatttccctagactcagagagaatgcattgctcccccgcagttttgtataggcatatgcacgttctgacatggacctgagtgctcagagcatgcaggatagttaatccttagcaatcctgcttgacagttgaccagtattacccacgcttatggt

SEQ ID NO: 40158 - DNA, 332 bp, Triticum aestivum
  Clone ID: PAT_TA_40158
gacacggatttgaccaattacatgtgggggctgtaactagccgaggatatctaccatgatccgaacctatgctcaagaatctctatcccaaacacaccggtctctccaaagttcacgcatagacccacacgatccatgtgtccaccaacgacaatattctaatcgaaaccctcaacatgccctaaatagttcacgcagcttacagaaaccttgctagtctatgaggcgtcgacggtcgtatatttccctcgtcacagatataatgcatacgtcccctgcagttttacatattcatatacactgtcctcttcatacacctgtctcgctcattt

SEQ ID NO: 40159 - DNA, 353 bp, Triticum aestivum
  Clone ID: PAT_TA_40159
ccgaatcgcaattccgggggggacgcacgcgtacgcgcacacccacgcgcacgcgcaagtctgctcccaccagaagaggaaaaaacaggggggggcgataaggaacgggagctttacattatcacaagaatcctaactgccaaaagaaaaacgagctcctcatcagtaactgaataatcaagaggattatttgatatacaccacatgactttaaccctgaactttaataagacatccataaaggagccgctttagattatactaaaaaggccaatctaagtattacatcatatgcccccaatataacaaaacggtattatttcaaatgaaacaaattgcctatgaacatttat

SEQ ID NO: 40160 - DNA, 447 bp, Triticum aestivum
  Clone ID: PAT_TA_40160
cgtcgcgcaagatgacggtgatcggcacggtggacccggtggacgtggtgagcaagctgcgcaagggctgggcggcctacatcgagtccgtcggcccggccaaggagcccgagaagaaagaggagaagaaggaggaggccaagaaggaaggcggcgacggggccaagaaggaaggcggcgacggcggcgacgccaagaaggaaggcgacggcaagaaggacggcgacgggaagaaggacggcgatggcaagaaggaggagggcgacggcaagaaggacggcgacgggaagaaggacggcgacaagaaggaggagggcgacggcaagaaggacgaccagaagaagccctgcgccggggccccgctgccgtacccgcaccacatgccgatgccgcaccacatgccgccgtcctacatgttcaacgccgactacatgatgaaccagtacc

SEQ ID NO: 40161 - DNA, 225 bp, Triticum aestivum
  Clone ID: PAT_TA_40161
ccacacacctacaggatgtgcccattcattgtgttggtgcaggactgaacaagcgcggggacatctggtttgcgtgacagaaatttatccgcacgtttcttaacaggataactatgacaaaggtgagctactggggttcgtaattcagcatagtgaaatagggaaggtatggtaggaccaatactattttaagcccatatatacacaggactccaatggaacagc

SEQ ID NO: 40162 - DNA, 156 bp, Triticum aestivum
  Clone ID: PAT_TA_40162
agcacacctgcgatgacgcgtggtctttattatgtaatctattctccatgggtggcgggagatctatgtgggagtacaacatctacaacctcccgatcatgctcatgctcccaccaaagcccttatcgccggtgcaggacataactgcaaggaccg

SEQ ID NO: 40163 - DNA, 417 bp, Triticum aestivum
  Clone ID: PAT_TA_40163
ccgcccgttcccggctcgaccgcgctgccgtcaccgtccgtccccggctccaccgcggcggcggcgtccgtctccacctgcaccgcgccgtcgcagctggtccctgcctccactgcgccgccgtcgggacccttgtccattgcgccccccacccgtcctcctccaatggcacgaccgtcaccgggccgtcctcccctgccctagcggcacggctgtcgtgggcagcaccactgccggctcccttctacgcatccgccgccactggttaccaccgaagtggggcaccaccttcccttttgccccaccccacgcggttggaagaaagctggagctagcaggggaaagtaccgacacgtgaacggcgtccttgtgagccttattaaggagcattaccctggcatggtttctttgcctggg

SEQ ID NO: 40164 - DNA, 313 bp, Triticum aestivum
  Clone ID: PAT_TA_40164
tgtgtttggtttttttttttttttttttttttttttttttttttttttttttttgggacaaaaatcagggcttttctcagtttcattcctaaagggccattcagagaaaattaaagaggggtttgtcctagcgggcaagctagccagttgggccatttttggaatgacttccggcaggaggggcttggtttcagcgtaccaggccccgatgtcggcgtcttccttgggggggacgggggcctgcacccttttaaatctttaaaaaaggcggttggcaagcccaaggaccggcggtttggcctcggggtcgggg

SEQ ID NO: 40165 - DNA, 441 bp, Triticum aestivum
  Clone ID: PAT_TA_40165
gcaataaccaaaagatatgcgcatttatcgtatcgttgttgtactcataaggcccccagacatctcctttccctaaattcaatttatttgtcttttcttaacggggtaactatgacaaaggtgaactactgaggttggtaattttgcataatgaaatagtaaatgtatggtaggaccaatactattttcagcccatatatacagaagactccaatggagcagccaatgtgggtaacttacttgttccatgcagttaccaatgtcctgcgtgtctgcacggtgaatcagttagcaccaaggtcacgtcatttgcagttgtcgggcatgggaggcattgggatcagttcaagaagaataagcacaaattgaaggattcagattccagcgagatcaagctttgtagggtgatggttcagcttatactcaccatcctttgcacat

SEQ ID NO: 40166 - DNA, 191 bp, Triticum aestivum
  Clone ID: PAT_TA_40166
gcaataaccaaaacagatgcgcatttatcgtattgttgtgggactaaaacggggccggcgcaagtctgtggcgtaaatgcaatttcaaagccgcttcttaacagggccgactgtgactatggcaggctacacatgtcgagcatgttgcatgatactgtattcaactgcaaggccctgaaccgcaccgttca

SEQ ID NO: 40167 - DNA, 160 bp, Triticum aestivum
  Clone ID: PAT_TA_40167
gcgcacgcgtacgcttacacgtttattttaagcaccatacaatttattatcttattatgcgaaacaaagggtcgggcacagtctatcgtagaccaaacatataactggaacagctatcgcttggccagggcaccatactttggaaaacaactcaaggatg

SEQ ID NO: 40168 - DNA, 243 bp, Triticum aestivum
  Clone ID: PAT_TA_40168
tttcttttattcttactaaatataaaaatttttatcattaacattagtctcaaaaggggacgggatcactagatgtaagtcgaaacattttgctactacagacattattttgcatccacgacttaattggtcaactcttatgatcataaccattttgatgatctgacgtaactagacccacactacatagacgttatgtgtctccaaggagttcttgtcgacaaattatggtcctattgccta

SEQ ID NO: 40169 - DNA, 419 bp, Triticum aestivum
  Clone ID: PAT_TA_40169
cgccaatgggggacgcgtccacctccgccgctcccgccacgcccacctccacgctcatctgcctcgaggacggcaacgacctcttcctcgacgacgatagccccgacggcggcttggcggactcgcgcctcgccgccgacgacggtctcctgctcctcgaccgcgacgacgagtacgtcgcgctcatgctctccaaggagggcgccggcggcggcggcacgtggggtgaggagctggacgagtggaccaaggccgcgcgcgccgtgtgcgtcgactggattgtcaagacgaacgcgaggttcctcttcagcgggaagacggcgtacgtggcggtgacgtacctcgatcggttcttggcgcagcggcgagtcgatagggggaaggagtgggctctgcagctcctctcggtggcgtgcctg

SEQ ID NO: 40170 - DNA, 271 bp, Triticum aestivum
  Clone ID: PAT_TA_40170
acccttcccggacccctgggttggcgaagaaaaattttgttatttggagggggcacttgggctattgggagaatatttcattaactgaatcataacttttggaacctaagaccaaaatcgtgatatgcagctgggtgatttttcaacataaagactagagaattgcttcaatttgagatggcagggaatgcttatgagacttgctttgcttcaaaggggaaaataaaatataccttgcgtggaaggaggccgccgatggtgcctggggagc

SEQ ID NO: 40171 - DNA, 216 bp, Triticum aestivum
  Clone ID: PAT_TA_40171
cgcacgcgtgggtggtggaggaagaattcgattatttggagtgtgcactggagctatggggagataattccattactggagtcataacttgtggaacatcagtacagaatcggtgatatgcacctggttgatttttcaacataaagacttttggattgctacaatattagatggctgccagtgcttattagactcactctgtttcctacgagggat

SEQ ID NO: 40172 - DNA, 297 bp, Triticum aestivum
  Clone ID: PAT_TA_40172
gcgcgacgcgtccgaaaaaacttattaaatctcccgccgatcatatatttttttgcaacgacggccacctgggagggggtgttggcagtcaggcttatttcttatttaggcttagcttctctaacactaggatttgcctgccgtgcgatgtgcaggccgagtagggaaggtcgcttggctcttcttctcacttatgcaaaagccactacaatcctatccaggcggagccttatggtttgactacacccgatgatactcttatcgtttacgctgctagatcagggatataatgttaat

SEQ ID NO: 40173 - DNA, 379 bp, Triticum aestivum
  Clone ID: PAT_TA_40173
cggcacgacaaaacagatagataggagatatcccggcattgcatggatctgctacaaaattcacaaggcattatctatcatgaacaacgctacacaacagggtaaggaaagcaatcacattattattcgagcccaacactaattgaatgccctatgctcagattagaaatattgggtttaactcagcagtctttaactagcaggagaaagacctgtatcatgtgcagaacaaaatccagatgcgcaaatcgaagatgataatccatctaaaactgagaccactgtgagctccccgcactaactaatgaccaccttcttcattggacgggcacctctggcagtgtacgaccactatatctgccttacgatgaccatgcct

SEQ ID NO: 40174 - DNA, 288 bp, Triticum aestivum
  Clone ID: PAT_TA_40174
acgccgacgcgtcggactatgttttaggatacgcgtccggcaacccataaccagacggaagaccgacatgggccggatcggcatcaccctgctcgcgctcctggaggacgccgaggccgtggcgcgcctgtctgccccggtctccgagggcgagcaggactacatgctgttgaagcgcgcggggaccttcaacggagccggttggagagtgcaggggggactgaggacaaagagatgggcacgggcgcctacggcaccggcgaggccctgtgccgggtgctggcgcgc

SEQ ID NO: 40175 - DNA, 255 bp, Triticum aestivum
  unsure (1)..(255): unsure at all n locations
  Clone ID: PAT_TA_40175
aaaaaactcattaacccccgcgccgctccgatcttcttttccggcgacggcggcgggggaggcggcggtggcagtttggcttcnctcttccttggtctgaggatctccacccgcaggatttggttgccgggcggggtccgcccgctaggcaagccggggggcccgttttcttggttaagccaaaatcaagtacaatcccatcctgccggagcctcgtcctttgcctccagcgggggaaccggtttgggttaagcc

SEQ ID NO: 40176 - DNA, 449 bp, Triticum aestivum
  Clone ID: PAT_TA_40176
cgcagccgcctccctccctcactcgctcctcatccggcaacggcgacggcggctcccgggcccgcgttcttcctcccgcaacacgtctcctctcaccgccgatccccaacccagacgtcagcgcacacacgccggtggctcccaccaaccacagcgacggcggcagcggtcacagaggagggcagcggatcagctgcaccggcgatggcgtccgtggcggcggtggaggacgcggctgcgacgcttcagtgatgtcgcgcgtgcagcaggtggcgacgcggtcggggcgcgcgcaggagtcgatgcgcgtggtggcggtgagcaagacgaagcccgtgggcgtcatctgcggcgtgtacgacgctgaccaccgctgcttcggcgagaactacgtacaggagctcatcggcaaggccccccagcattttcccttgattatgttcagaaga

SEQ ID NO: 40177 - DNA, 420 bp, Triticum aestivum
  Clone ID: PAT_TA_40177
cttggtgaactctccaccggcgacgatgagccggaccaccgtgtgtgcgcggcctccggcgtgcctgccgctcgtgatgacgaagtacaagggccgtcgaccatgcacggtcgttggcgcaccctccgctgtccagcctgccggcaacaccatcgtgtctggactcgtcgacacgcatcgttcgactcggcgccatctagggcgccaccccttctacctacaccctcggcggcgcctgggcgaggctccgccgcatcacgaggtctccttcgccgttgtcttgccggtccatggaggcgccatgggctggccgggactcggcgacatggtccgttcgacgcgtcggcggcggagcggcgctcgacaggtcacctctcctcatcgtaaccatggcggcagagcggcgctcgatgagtcacc

SEQ ID NO: 40178 - DNA, 301 bp, Triticum aestivum
  Clone ID: PAT_TA_40178
cttgttgaactctccaccggtgacgatgagccagaccaccgtgtgtgcgcgggggccggggtacctgtcgctcgggatgactaaattcaagggccgtccaccatgcacggtaatgggcagcaccgtccgatgttcagcctgaccccaacaacatcgtgtgtggactatgcgacacgcatcggtctgacttggtaccatataagggcgccacccgatctacctacacacctgggtggcacctgggagaggcttcgccacatcacgaggtatcgtctcacaatgtcttcccgctgcatggata

SEQ ID NO: 40179 - DNA, 350 bp, Triticum aestivum
  Clone ID: PAT_TA_40179
tccacgaaaggtgaacagaaataaccagaagaaggcacgtggcggccctcacgccggtggtgaccaggaacaggaatgtggaaatcttatctatcaccttatatttataaaaggtgggggtgttaagagctcttaaggggagacgaccgacacttacatgagatacgctcgtgacattttcgcactatcacaccggtgagcacgaatctaccactgtttatggtgagctacattggcggggtgaagagtggtaaaaaaaattgtctccgccaaagaaaaaaaatgtgggcccaatcttttagcaaaactagagtgatgggttgctcagcaagtttccactgccttctttt

SEQ ID NO: 40180 - DNA, 148 bp, Triticum aestivum
  Clone ID: PAT_TA_40180
attttctttttctgggggggaatttattgagatgggtggtaattaattttaattcaatgctcatattatgggcacacctcggagaaagaaaaaacggccgctgtttatttaattggaaatgaattccctccctttttttcaggtgaaa

SEQ ID NO: 40181 - DNA, 151 bp, Triticum aestivum
  Clone ID: PAT_TA_40181
aagaatctaatttttgggggaacaaacttattgagagtggtggtaaataatccccactccaaacatatatatgggcactacacggggctcctttcctgggacgcccacttcgcgcgcgggcacggggtgccaaccgtgctttactggatcc

SEQ ID NO: 40182 - DNA, 355 bp, Triticum aestivum
  unsure (1)..(355): unsure at all n locations
  Clone ID: PAT_TA_40182
catcacactccacctgcaccacccccatccatccatccatcatagaagagagagagagacagagagagaggagccatggccaaggaggtgagcgaggagccggagcacgccgcgccggcgcacaaggactactccgacccgccgtcggcgccgctcttcgacatgggggagctccggatgtggtccttctaccgggccatcatcgccgagttcgtcgccacgctgctcttcctatacatcaccggcgccaccgtcatcggctacaaggtgcagtcggcggccgacccgtgcggcggcgtcggcgtgctcggcatcggctgagccttctgcggcatgatcttcgtnctcgtctact

SEQ ID NO: 40183 - DNA, 414 bp, Triticum aestivum
  Clone ID: PAT_TA_40183
gccggccaccgccggtgacaacaccccggcgaggcgccggctgggttgggaagggagggagatggcgacgacccgggaccgcatgtcgcatctcacctccttccaggagcagtgttgaacgcctgagtccggtgaccagtacccagggacgtctccgcagccggaggagagtccgttcatgagttggaggagagcccacctatcatgttcttggactagcgaggaggaagcggcggcgatatggtggaggaggaataaggtggcaatggttgtgaagcatagtgttctctggcgatggaaggccattttcgactagttgtcgacgaggccctggctttgtgggagcagaggatggggagttcggtttgaaaatggaatgggccgtatagcgaaggcttttagcattattaaaaa

SEQ ID NO: 40184 - DNA, 282 bp, Triticum aestivum
  Clone ID: PAT_TA_40184
cggacgcgtgggcggacgcgtgggggcgacacccccacgaggccacaaagccaaagctgctcccaacgcagacgcaagcgatacagagcgcgccgttagcatgagctcgtcggtgcagctcaagcggctgtaccagctggcggtgagcaacatcgtggccatcgcggccgtgccctttggcgccttcgccctggttaagggggcggagctagggcccgaggagctgctcgcccggctgcgcgcgctccggcccgtgcacatgttcctggccgccttcgtccc

SEQ ID NO: 40185 - DNA, 445 bp, Triticum aestivum
  Clone ID: PAT_TA_40185
gacatgcaaggccctcctggtctgcgtcctccggctccattctaccccggtggataccctcccccgccgggctggcctggttaccctatgccatttgttccggtgcaagggtacggagctccacctggtgcgtatcctcaacccggaggataccctccagctgggtatccacaacaacatggccattccgccgcaagctggttatgccgtccatgataaatcgaagaagaagtcttcaaagaaaggaaaaaaaggtaagggtggtggcttcggctcattcctcgccggtgccgctagcggtgcagttacggtacttggagctgtattggctgaagatgaagaacagtcttctggcaagttcaaaatggagtgctaaaccaagaaaaaaaatgcaattaccattttgtcttttgatcggtggagcgaaaaactactactttttaga

SEQ ID NO: 40186 - DNA, 411 bp, Triticum aestivum
  Clone ID: PAT_TA_40186
gttacaaatcatgcgggcacaaatgcttggaccaccaccaccaccaccaccattacgatcaggaccaccacccaagcgcgggttcaaagcccccgagtccgaagccatcaaagtcggagactaagcccgcgccaacaaaagccacaccttcaaaggccggttcaacggaagccattgcggcaacggtggccattttggccgccgtggccaatgcggccgaaaccaacccggccgaagccgttgttaaggcggccgtcccatcttattgcacggaagccaaggttaccgtgtccgtcgaaaattaattcgaacccgaaggcaaagtcaaagccgaagccaccgtgcccgtggtcggccattgtatttgtgtcgacaacaattagcaccaactgatggttatacaccatgacg

SEQ ID NO: 40187 - DNA, 388 bp, Triticum aestivum
  Clone ID: PAT_TA_40187
agtaaacaagtgagtgtagcattgttctgtctttcattggataaaacaaattgatcatctgagaggaatagatcacatatcctgagagaaataacatctgcatcacatatcctggctagttttcaaatggactagagctactctcagaacaagcatcattggaaccgattacgttgcattacaaaatattatccataagctgtcctaaagttttgcaaaacccaacagcctacttgttcagggctggaggcttgctgaagtggttggggcgcgcaaaattgccggggacgacggcatcgagctctgcaatagcgctgtccaggctatgcagcagccctgccagttcgttgtcaagtttcttcagtaattcttcattgtccttggtctc

SEQ ID NO: 40188 - DNA, 448 bp, Triticum aestivum
  Clone ID: PAT_TA_40188
cttttctcatggcatgtagtaaatgtgtttcttagtgacttggccatcacatcacagtatagtgagattaatgtgttcaaagtaccgcaggcctataagttgcaatttcaacattatatccatcgatctggctaggtacttaaatggtagtttacttcctgaatatttgattttttttatgtctgcattacatttcataataaagatatatgtaagtaaactggtgcgagcaagacctaaacgaataaaacatactactgcatttcttattaattttattgcagtaatgttttcttgtcacagaaggggagccttggcgcagcggtaaagttgttgccttgtgtgagtcctggaaacagcctcttgcagaaatgcaggaaaaggctgcgtaaaaaagacccaaagtggtcagacccttcccttgcaaaaaggacagcgaagcgggagc

SEQ ID NO: 40189 - DNA, 142 bp, Triticum aestivum
  Clone ID: PAT_TA_40189
ccacccagcgcccttcttgatcaaatgattgtttttagagaaatcatatatttcgggtgttcacacctttgatcatcccccctttatcccaaaccagtattttcttttccacccaaaagaaaactgctagcatctactacca

SEQ ID NO: 40190 - DNA, 395 bp, Triticum aestivum
  Clone ID: PAT_TA_40190
gggaatgacaggatgtgaagagtacattttgatcacgaacctgcacacacggttcaggatcaaccagtgtggattgccgatgacatactacacagcagtactcggcatgcctggtcttactgactattctggattgtgggacccggacacaccacatagggttgattgtgttttcatctcagcaacgttaggtgctgtacataagctggtcgtgcaacttgtaccaatctgtctttgccaactgttatgacagtttaggttttttatgataacgtcatccttataaaaacaaacttggggttcgactactcttttaactacatgatggagcatggacctgaacgccacactgctgtggtgcttcccgtagggcattgacatctactacgataact

SEQ ID NO: 40191 - DNA, 363 bp, Triticum aestivum
  Clone ID: PAT_TA_40191
ctaattctagagggacagagctaatcttgaaggttatagccctgtttcttccctgtggtagatcaaccgttcttctttcttcctaggagctccactgttttggatgaactggactaaccctagaagggatgaaggtcatccacgtggtgtctcaaggtgaacccagtggtacccgaccaagtggctggagggaatggtgtatgctcacaagtatgtacagaccaatttgcttcactcggacaagaatcccacgaaccttaatgtggcctttaagtttcaggtccttggggttggatgcggcaactattggatcgaagacaatcttttgtggtggagcgacatcaccgccggctggttctgcaa

SEQ ID NO: 40192 - DNA, 326 bp, Triticum aestivum
  Clone ID: PAT_TA_40192
gatcggtttccgagggagtatcttttttaaccactacgtggacgtatatcatgtgacgtggcgtgcccagcttaatcacttcccgctcggaacagtcgcactgattaagagctcggcaccgccccctgcctgcatcacgacgacaatgccctcctcggcacccggcgagacgatgccgcacgagacgtgcacgggcttgcacccatccagcacggcctcctcgagaccggcctcttgccagcacgcgtcccgaagcaggtgccccggaggcgtcgtcgtcgtcgtcgtcgtctccccgtcacctcccgcgcaggagcgcaagacgt

SEQ ID NO: 40193 - DNA, 200 bp, Triticum aestivum
  Clone ID: PAT_TA_40193
cttcctccaaccctacgatagaatgtttaccttttttttttttgatattacatatgaacttgtgatgctcaacgatgaactgactgtctcacaccattgtgctaagctactaatggcataaattatctagaaccaattttcttcctcgtctaggttctcataacgctgattctattttttgtccgaacaaatgtttctac

SEQ ID NO: 40194 - DNA, 383 bp, Triticum aestivum
  Clone ID: PAT_TA_40194
cagcagaaaaaaggaaaaagcagaggacccagctcccctgcccccttcctccgccaacggcgcaagaagcagaggagggcaagcctgcggagcatagcacaacagagggacaggggagatggcggcaccgcgcccacagccgctgctgctcctgctcctcgtcgcgctgttggttgcctccgggcccggccgggccgacgcttggggcaaggagggccacatcatggtctgcaagatcgccgagaggtacctgtcgaaggaggcggtggccgctgtacaacatcttctcccagactcgcgcgggggagatctctacaatatgcccccgggcggacacaatatgcttttgctatcacagtggcagagcgctctactactccaac

SEQ ID NO: 40195 - DNA, 410 bp, Triticum aestivum
  Clone ID: PAT_TA_40195
catcatgcaattgtttataggtggtgcaatcatacgatcctggtcctcatagtggaattatgtgtgcatacagagtgtgcctcctgaacgatttgggatcatatttttttttttatctacgagacggcttgtaaaatttgtatcaagcggttccatttccatgtgaatataccgaactccttcatccttccgttttcatctggtgcacattctcttttctgaaaccacatggtagagttgggtatagatcaactgcagactgcacaatcgccttatctataccactgactatacactgtacaacaacctaaatatcctcctactagatactactactagtaacctacagtctacagattgaaatgttcaaaaaatccaactgaacttccagtacgagattcctacacctt

SEQ ID NO: 40196 - DNA, 139 bp, Triticum aestivum
  Clone ID: PAT_TA_40196
ctacgcctcaggtaccgaactcgcaattgcgacccacgcgtacgcgtacgcttatggctagttatgaatgaacaacacctagtgatcgctatcgtgacgcgggcggaccctttccacacctcgaagcccagccaggaat

SEQ ID NO: 40197 - DNA, 294 bp, Triticum aestivum
  Clone ID: PAT_TA_40197
gaaagatactcaaatacggcagatgcaaacaatgtcgaaatcaaatcaaggccaaggccaaatccaaccttgtcctgaagacctatgtttttgaaaaaaaaatgttggtaaaaattggaaccagataacacctcccggtggtggtcctaattacctaaagagttccaggaaccgggaccggaaaacttccctcgcaggtggattattaaggacttgtggaccgttggaacccttggggggcttcgccttttgttttttaagggccctttgacaattcggccgacaaaatttccg

SEQ ID NO: 40198 - DNA, 344 bp, Triticum aestivum
  Clone ID: PAT_TA_40198
cagcagaaaaaaggaaaaagcacaggacccatctcccctgtctccttcctccgccagcggcgcgtgaagcagaggagggcaagccgtccgtgcatatcataacagagggacaggggtgatggctgcacctgttgccacagccgctgttgctcctgcttctcgtcgcgcttgttgctgcctccgcgccccgccgtgccgacgcctgtggcatggagggccacatcatggtctgtaagatcgcctagaggtacctgtcgtaggaggcggtggttgcggtgcacgacctgctgccggagtcggtcggcggtgagctgtctacgatgtgcccgtgggcggacactatg

SEQ ID NO: 40199 - DNA, 251 bp, Triticum aestivum
  Clone ID: PAT_TA_40199
cgccctctgaataaattacgacgacaatgccctcctaggcacctgaaaagacaatccccaacaagacgtgcacgggcttgcacccatccagtacggcctactaaaaaccggcctttggccagcacccaccccaaaccagggcccccggggccttatctataccactgactatacactgtacaacaacctcaatatcctcctagtagatactactactagggccatacagggtaaaaaccgaaaaccgcaaa

SEQ ID NO: 40200 - DNA, 452 bp, Triticum aestivum
  Clone ID: PAT_TA_40200
cccacgcgtccggaaaatccccctctctctccccaatcttcctctcccacatcaccagggcccgccgcgcgccaccaccccgccgtgcccctaccggccctgctccaccgcgccctaccagccctgctccgccgcgtcgcctcttcttccccttctctaccacatcggtgacccaatcggaccatccggcggtgggcacgatgtcctcacgcggatctgactgccgccactgtcgccgcctccatgccacctcgagctgctccttgatgcagttgtccccgacgagcaccacccccacacgactgtcgctgacgagctactccccgacggccacatcctctcctacacccggggtactacggcgatgacaagggcctccacttacctgctagatcaagatcgcgtccaccaccttgacttcactccgaaagttctctccctgtcttttggtt

SEQ ID NO: 40201 - DNA, 273 bp, Triticum aestivum
  Clone ID: PAT_TA_40201
cccacgcgtccggaaaatccccctctctctccccaatcttgctgtcccacgaggagcagggcccggcgcgcgcgaccaccccttcgtgcccctaccggccctgctccaccgtgccctaccagccctgcttcgacgagtcggctttttatccccttctctaccacatgggtgacccaatcgttccatcccggcggtggtcacgatgtccttactctgatctgactgcctccactgttgtcccctccattgccacctagagctgctccttgatgc

SEQ ID NO: 40202 - DNA, 364 bp, Triticum aestivum
  Clone ID: PAT_TA_40202
acgtcttcgagcttctcgaagatgtccatcatgaactccttcatcaacgacatcttcgagcttctcgaagatgtcgttgatgaagctcgccggcgagtcggccaagcttgcgaggtacaataagaagcccaccatcacgtcccgggagatccagacctccgtccgcctcgtcctccccggcgagctcgccaagcacgccgtctccgagggcaccaaggctgtcaccaagttcacctcctcctaggctaggatgcttttctgtaatagtcaggtggtcaaaccatggcttcctggaacttggggtggttctgggggaacaccctggttcattaccctcaggaatattaatggtgtttctttggtc

SEQ ID NO: 40203 - DNA, 443 bp, Triticum aestivum
  unsure (1)..(443): unsure at all n locations
  Clone ID: PAT_TA_40203
caagaaagaacctcccgatccggaaaaaacggatcggagatctcgcgcacatccccagccaccacattccaccggcggccgctaggaggctgtatctcggggatggctgtgtccagggcggagggagatggctggggcggcgggtggtgctcggagggtggcatgaggctaacgatggcacacgcgttcgcggcggaggtcgtggctacggcgtcgtcgcgtgcatccatgcgccggcacgagggtgagacatcccttgtcggtcctggttgcggcgccggccaaggcgcctnctcctcctcacacctgtacccgcccatgcagtaggcggcggccagtggcatcggcgcggctgcccgtaactgcagtggtgagcgctgtcaggagtgtgtgcgcagccacggagatcccaatgctgcacatctcagcactttcttatacgt

SEQ ID NO: 40204 - DNA, 122 bp, Triticum aestivum
  Clone ID: PAT_TA_40204
tcgagcggggcgtacatggctaggggcggcaaggctgaaactacgacggtcttctttgagcgaggaggcggtacgcgggggcagaaggctcccattacacttcccggcggggactgccgacg

SEQ ID NO: 40205 - DNA, 425 bp, Triticum aestivum
  unsure (1)..(425): unsure at all n locations
  Clone ID: PAT_TA_40205
gcggcgaagcctcgagactcctccccccggtcccgtcctgtctcccccggccccggcggctcactcccgcccgacggccgccggcgagcgccgccagggaggcaggtgcaggatatacagaaggcggcggcgcacgcccaaccgaccgcgtggagcggagcggaaaggatggacgcggcgtgggcgtgcgcggtggaccgggccgccggcgccgccgactccaccaggcgcttcttcctctccttncggcgcccaccgnctncgncggccgggcccaacccgatagacatcttgaagcgtcttcagcgacaagcgttccatgacataatgcaactgaaggacaggcaagagaaggtcgagaaggggctcaccctcttcaaggctcacaaaaccggcccgtttgccgaagagagcacccgggtcaa

SEQ ID NO: 40206 - DNA, 455 bp, Triticum aestivum
  Clone ID: PAT_TA_40206
ctgctttgaaaatttagggcgctcaacatgtacaacttatcgactaagaaagcaataccacatgaggcacaacactctaggcgcaataggacatggaaatatcacacaacctggattgttcaagtcagcgctgctgggacgcgttgttctgcaagcaacagctgctaccatccagttcaatagaccaggaaaatcaaaaccttcataaattcatgttgagatgcaggcgtgtgtataagcatgaagtgaagtctatgtcggttgctcatggtacacgagtatatacagcagttgctgcgtgttcggccaggagtagtgtgaactcttaagcagcttcaattgcagacgatgggctcacatccatctccatagcataaacatcgtgcacgtcactgattcgtgcatatatgtaaagcggcgaaacaagatcagcaggctagcacatccaacgccta

SEQ ID NO: 40207 - DNA, 333 bp, Triticum aestivum
  Clone ID: PAT_TA_40207
caaaggcaactgagatttttgaagaaattgctcgtcaatcaattaacaacaatctgctgaagtataatggcagaagccatcctcctaaatgcagggacctgccacctatttaaagctgatgctgttgctatacaaaattcatgggagagataccaggaaatcgacccgactttttaaggacctggggaatacaaacttttagctgtatgatacaacatttatttgcctttccgttgcaacacttgccccttttgatcattgcatttccttgctttaatagtaaaaatggaatccattggttataatgaagattagggatggtaatttaggatt

SEQ ID NO: 40208 - DNA, 154 bp, Triticum aestivum
  Clone ID: PAT_TA_40208
ctagagtgaaattttctattgtgcgtggaataaaaagaccagactagtggatagcgtgggtccggggaaatatagtgtcagaggcatactacttaatgcaggagaggtggcaacttttaaaagatcaaacttttcgtacgcaaaattcagaggg

SEQ ID NO: 40209 - DNA, 343 bp, Triticum aestivum
  Clone ID: PAT_TA_40209
cggacgcgtgggccgaggtcatggtagttccaaatcaaatgagcgccgcgctgaacgaatactatagcgccggatttcgtccttatctaaagcgggctatcaaaaggttgtggaaagggtcatgctacggtgatatataagggtttgtattgttaaaggctacttgaccccactgtttaaggatttacataaaaaaacatttaggtttttcatagaagggggactttgtggttctttttaaacactgaatatttttattatttgttttccctgggttaaatatctaactttgtatgcattgcggataaagaactcttaattttagttttatagttctctgttt

SEQ ID NO: 40210 - DNA, 394 bp, Triticum aestivum
  Clone ID: PAT_TA_40210
cggatccggtccgagagtagctagcctagtctagggtttccgtagctcggagaggagagaaaggaagagatccatggctgctacttagtaccgctgcttcgaggtctgtctagcttgtgccaccgactaccacaacctcaatgaggcgttacaacagtacggaccgatctttgtcgcgaacatcataaaccaccgtttgacgtgcatgatccaagatttatttttctttacgttcgaaaactagcagtttttgctcatggcattccctgggtttaacagcaagaattttatccatcgcaaaacaagaattattgtgctcggtctctaggattctgggtttttattgtaggatcttgctgcatcaatggatgacggagatgttgccaatattact

SEQ ID NO: 40211 - DNA, 209 bp, Triticum aestivum
  Clone ID: PAT_TA_40211
cgtactcgtggggccgcagtcgccccggtgtctctttatgcagggccgccccgacgaggccggttcggttctccggaaagtgtgtaacacggtgggagaggcctacttgcggctcgcggacattaagagcgcttccgtttttgttgagggagacgccgtgttcgttctcgcgccctttagttgtggtaaaggcgtgttataggagttgt

SEQ ID NO: 40212 - DNA, 264 bp, Triticum aestivum
  Clone ID: PAT_TA_40212
ctcatacgttcgagcggagccgcctagctttttagagccaccatcccatcggctccggttccgaagggtcagagatggcggaccgtgctaaccacccgtctgtcatgcagaagtttggtggacagtttcacctttccttcagcttttttgagggtgttcgtgctcgcaacatctgcccttctttgccattctatttgaggcgcttaccacaagcatgctacatgacttataactcttttcatctgtgtcctaatgatgttcatt

SEQ ID NO: 40213 - DNA, 375 bp, Triticum aestivum
  Clone ID: PAT_TA_40213
ttgacaagaggatccaagttcacaacaggagcgtaatttctggaggaatgcccctggctttggtattgcacaattgggggctaaagagaggaccacaacaggttgaagcaataaaagggatgggcttgattatattaatttggctggtggtgtaaaatctttttgaggttcagtatgatcattttccaaatccacagcctgaaacccgaagtgataccaatagcacacttttatttacgggccatgttgtttttgaaccttaatttttggttgtggtttggaaaaagggatggaaaatttgtattctggcagggcatttttaaagggccaaatggattaaatttgaaaacctggcttttgttgccagccgagctg

SEQ ID NO: 40214 - DNA, 190 bp, Triticum aestivum
  Clone ID: PAT_TA_40214
gggaaatcagagcagcagagggccctggaaacatagtttttcttttctttttggggaattgccgcacacgaataatgtgattcattaaacaaacagtgactcccctttcattttcgacccgcctttcatctagtcaataaggttttaattgcttctttgcatggacggctccaattttagtggccacatc

SEQ ID NO: 40215 - DNA, 215 bp, Triticum aestivum
  Clone ID: PAT_TA_40215
tttttccaatttagctaaaagaaagaaacgggggtgaaggcctccatgtccatcactaccatcttttctcgtggtcgttatggccgcaccctccctagctcgtactgacaaccattttgaggactttgtgggccgtctacaaaaggcaggactaacagcccacagtcgacaacccaaaacaaaacaaggcaatgagcttttttaaaacagggaat

SEQ ID NO: 40216 - DNA, 359 bp, Triticum aestivum
  unsure (1)..(359): unsure at all n locations
  Clone ID: PAT_TA_40216
agttgagaaaattgaggagggtaatccttcttctttttttcccacttaaggggtcaccaccccaacttcaattaaaaaggtgttaacacagcaaaagtgacagaggttttttttctaccaagcgcctactgacaggtgctctactctgggaacttgggaagtacacaaaactacagtaaaagaaactgaagcagcgtacatttctaacaaagcataccaggaataaggatattacctaagaaagcaaaaaccagagcacgcatcaacattctgatagttcacagcaccttcttttttttaccacttcaactcattgctttttcttttcattccagnctttggcaacgatgcccagcctc

SEQ ID NO: 40217 - DNA, 187 bp, Triticum aestivum
  Clone ID: PAT_TA_40217
cccactcgtccggcaactcatccggctatacgtgcggtcacatggacgttaaaggtggggagttatccgagaaggggacaaaaaccatggtctgcgcatgacggataaggggatttacaagaaagaggcaggtaaggctgtaaagctttctaaaaatacatggtacaagaatggcagtggtagaggc

SEQ ID NO: 40218 - DNA, 383 bp, Triticum aestivum
  Clone ID: PAT_TA_40218
ccgcagcctggggccgacgctgccgcttccccgcgatctctctcccgctctcttctccccaccaccacccaagtcgtcgtctccgtcgccggccgccatggctccgggcctctacaccgacatcggcaagaagaccagaggtgccgccagtctctctcccctcctctgattacctctccggtgccgatcttgacgatgctgtgatgtgatgatttgcacgcagatctgctctacagggactactgcacgcaccagaaggtcaccctcaccacatgcacccccgggggcgtcgcaatcacagctgcaggaactaggaaaaacgagtctatctttggcgagcttcagacccagcttaagaacaagaacttggcaggtgatatcaa

SEQ ID NO: 40219 - DNA, 374 bp, Triticum aestivum
  Clone ID: PAT_TA_40219
ctcactcgtccggccacgcgtgcggccacgcgtgcggtcactggacgtgttacctttggagttatccgtgtaggcgacaacattcatggtctgcgcatgacggatgaacgtattcacaagattgacgctggcatggttgtcatgcttattaaaaacactggcacaagcatggcagtgatagaggctgctggcgctgctgatatactcacaatggctgaatcgtctggtccagctgttgtacacaccgtggcaaatccccctgctacgactgctatgactgcaggtgagtaggaccctcccacaattgctatgactttcgctgagaatgattcaccactggctggccagcatgtcactcatgtaacttgagccaa

SEQ ID NO: 40220 - DNA, 299 bp, Triticum aestivum
  Clone ID: PAT_TA_40220
agccatctctgtgagcgcccgcagcacgtttttacacagtatggcttcgacgacagcggcccacttgggggtggagggtgtaccgaacaactggttcatcatcgcgcgtaaaccaaatggtttgcgcgagcgcgccaaccgccgtcatcaccttccactggaactaaatgatccgccggagggcacctcggccattggcgacttgaacgctgaccgccatacacatgcctatgctgttgtgccaaaacacacacaatgctatcttcttgccgaccgcgaccatgccttacgcacctctt

SEQ ID NO: 40221 - DNA, 427 bp, Triticum aestivum
  Clone ID: PAT_TA_40221
agcagtccggcgaaggcgatggccgcgttgttcacggcgaagctagggcgtcaggcgtccgggtacctgcaggacaagtacaagcaggcgaggctggccctcggcgacgtaactccggcagagctggctgtgcaggaggcgaccaacgacgacgcgtgcgtcccggacgccaagacgctggcgtccatcgcggaggcggccttcgacatcgacgactactggcggatcgccaacgtgctccaccgccgcctcggctgcgtccacgactggaaggagtggcggccggtctacaaggcgctcgtcgtcctcgagttcctcctcacccacggccccgaggagctccccggggacttcctcccggacatgcaggccctgcgcgacctccgcggcttcacctacaccgacgacaagggcttcgactggggcg

SEQ ID NO: 40222 - DNA, 123 bp, Triticum aestivum
  Clone ID: PAT_TA_40222
gggcgattaaaaccttattgactagatgaaaggcgagtcgaaaatgatagggacgtcactgtttgtttaatgaatcgcattattcgcgtgtgcggcaatcctccaaaaagaaaagaaaaactt

SEQ ID NO: 40223 - DNA, 369 bp, Triticum aestivum
  Clone ID: PAT_TA_40223
tcacccaagcgttcggtcttgttgttaagttgaaacaaccccttccaccagggctggaacgaggggttgttttcggcaccagaaaaaaccagaaccgtttttatgggggttccaccccccctccaattagggtgttagggccaaacctttttcttgggacccaaattaagcccacctccaggccccagaaggcttgtggaataattctttaagttggggccatgaccacccgcaggttagggaccttttaaggacaaaatattcatgggagggagttttcgaagggggtcgtatgggtttcgataaactgtttaataaaagaaaggcttcccaaagcttttttttcttctcaagcataaaggatttgaa

SEQ ID NO: 40224 - DNA, 128 bp, Triticum aestivum
  Clone ID: PAT_TA_40224
agccggtgaaccactactgaattctgatcatctacacaacacaaaaacttagatagccaaggccgcaagaacacttactggtagtagtagtgccgtatgaacaaaatcagggggacattaatgaaaga

SEQ ID NO: 40225 - DNA, 297 bp, Triticum aestivum
  Clone ID: PAT_TA_40225
aaaaatcttgtaaaaaaactagtaatgtaaatatataagaaaaagactagtacggataggattattggaagctaggcaaaagggccgttataatcgagctggacggagccgccccacatttggcctttccttttgggcacctcgctgagggtcacgccctgggccgccgccagaacctcaacctcaacgcccccgccatcgagccggacacttaccaagggcttgattgggcctggggccccccccggccgccctttctcctggtagaaggccacctagtagccccgctttacgttc

SEQ ID NO: 40226 - DNA, 249 bp, Triticum aestivum
  Clone ID: PAT_TA_40226
ggacgaggtagcaatctgctcccaggagttctataagacatagtacaagtatacaacattggggaagtggcatgctggaaccaaagtggcagcttttttaatcctatatcactcctggcatcagaaactgcataagaggatccaaaagcgaacacaaaattcctgatacccggggttttaaaataaaagcacaatttttgggcaaacatcaaaacaccacttgaagttccaaaattgggattggtttta

SEQ ID NO: 40227 - DNA, 337 bp, Triticum aestivum
  Clone ID: PAT_TA_40227
tcgcccaaatctaaatatattgctctcctgtttacgtttgcatagccacgtctgcaaagaagatggataggaagagttccgatggagaaactgtccaggttgatgaggcggtggctctcgagtcacacaccatagcgcatatggttgaagactactgcgtagacatctgtttccctctttctaacgtcacgagcgagctcctcggcaaggtgatcgagtattgtaagaggcacgtaaaggctgttgcctctaaggtcgtggccgtcatgggtgctgcttccttcgatgactatcttaaggcctgggacgctgtatttatgaagatcgttcaagcttc

SEQ ID NO: 40228 - DNA, 313 bp, Triticum aestivum
  unsure (1)..(313): unsure at all n locations
  Clone ID: PAT_TA_40228
cccacgcgtccgcgatcgtgcatctccccttgtaccactttgaagacatcgaccacagtagcgatacggctacatccggagatgcgtcaagttcaacttccttcatgggaacgactacctctcgcgggcgtgtatcgtagccttgtaccatttcggttcttcaaggccaccaagttccgctacgagatgtacccataccatcgccgaagacccgtgtaacacaagcgtcaagttctgctaccgtcgcgagaacgactactttcactaaaaaaaaaaatnatcaaaaaaaaaaatggttaggataaaattgaag

SEQ ID NO: 40229 - DNA, 411 bp, Triticum aestivum
  Clone ID: PAT_TA_40229
cccacgcgtccgggccgccctttgtttattttgctgggtaaaaagcatggtatatgggctctataccgcctgtcactttgtactccctcgccccggctggcgcacggccgagagagtagcatattctttactttatactccacaagagaagagagacgaagaactaatcgtggatcgaatagtacgaagggctgcactcgtgaatcaatcaatgctggccgagcgcgaagcctatgccgtggcgtgtggcggagaaggtgccgaagagcatgctcccgaccaccccaatgacgatgggcagcacggcgagcacctgcgccgtgaccttggacgacacggactagaagcaggacacgacgttcgcgtccaagagcgcgactgtcacgaagaccatgacggttacgacggctt

SEQ ID NO: 40230 - DNA, 202 bp, Triticum aestivum
  Clone ID: PAT_TA_40230
ctcacttctttcaactacaattttaccatataaccatacatataaacttacaatggggggtcttaaacatgcttgagcagcgtctctatataaatacattcttcattcctagcaagtactatatattttactcataatacatcttaggatatatgagccatcgaatcattcactttttgaataataaaaagatcaaatttta

SEQ ID NO: 40231 - DNA, 419 bp, Triticum aestivum
  Clone ID: PAT_TA_40231
acgcccacgcgtccgccgtattgatcaattcacttcggtctgatcataccgtgatcgaggccttgatcgatccatccatccatggccatcaagggcaactctggtgagtacaaggcgcggagcccgctgggcatggtgatcaccgtcctgctgtgctgcttcttctacgtgctcggcgcgtgatagcgcagcggctacggcatgtgtgaccgcatcgcggtggcggtgacccggcatacggcctgctccggcgcctctgccggggggctcagtttcgagacgcaccacaccggcggcctggccaacgcgacgacgtacggtcttggcggcgagccgccgtcgccgtgcgcggcagcgcttgcggaccacactccctgccacgaccaggatcgcgccatgaaattcccgcgcaagaacat

SEQ ID NO: 40232 - DNA, 226 bp, Triticum aestivum
  Clone ID: PAT_TA_40232
ggctgatccaaggcatctcaatcttggtcttcgacgacgacgaggcctccgggaaggtgcgcgttcgcgtgcgccgtaagcgcaaccgtcacccggtctaggaccacccgacgttatcttctacgagccgcgcggttgggcggaccgattctgctacccgatctggccgtcttcttgttggactattagtactattgcctgtccacgtactactcattcaccttgt

SEQ ID NO: 40233 - DNA, 347 bp, Triticum aestivum
  Clone ID: PAT_TA_40233
cgtccggctatttatagatggcgggcggcctctctagaggatgcaatcttacgtccgcgtgcgtggggagagatattttatttagtgtgctaactaaaattaattgaccggccggtgacaaacaaccgactggctggaaaaaccctggccttacctaacttaatttgctgggcagacatccttcttttgctagctggataaataaaagagagggacggaccgatcttccttaccaataggtaggctgactggatggtgggaggggccctccctcggccggttcaataagggcgggggggggggtgggttcactcagaccgatccatttacttgcgcgcgagcgcgcg

SEQ ID NO: 40234 - DNA, 230 bp, Triticum aestivum
  Clone ID: PAT_TA_40234
taattatttgggcatcatattcaaccactttaagcaatacattttgttacttaaaccacctgatgaatgaagaaatgactctttaacagccacctatctcatttttcttaaactggctgacatgaatcccaacaaaatggatggagatatacatacatgctactataaggagctataccttaccaagtacaaattggtgtgctaatttgatacactttatgaggcacaac

SEQ ID NO: 40235 - DNA, 241 bp, Triticum aestivum
  Clone ID: PAT_TA_40235
caaatgtctttgtaactgagacaactctagtctacattttatgcaaacattgcttattctggtttttacatacaatgacagcaaaattaaatagctgatcacacaccgattctgaatggcatgacctttccgatcacgcacagaacctcgtctactacatcttttcttctctttttgaactagagtcctagttttatcatagcatcatgtttgttatttaacctaagtatatatatcgatc

SEQ ID NO: 40236 - DNA, 343 bp, Triticum aestivum
  Clone ID: PAT_TA_40236
cgacggtcggacgccgtgaggagctcgacccctccaccactgctcccccccttctctgctactcaccgcgggcgaccaaattaaggcggggattagggtttacgccaccgccccctcccttcccctgtctccctctgcggcgaccccagccacctcggagccccccgctcgtcgctttgcatcgacgccccagaccctcgccgcggagcccagatcgccgaccaagctcgtcacgacgctgggcccagccgacgacacccctatcaactaaaagatggaggccaatctgaagaaccaggcgaccaccgcggtggcgatgcttggaattgtctccctcgcaagc

SEQ ID NO: 40237 - DNA, 312 bp, Triticum aestivum
  Clone ID: PAT_TA_40237
gttcaccacgagaggggcggcagcccggaggccatgcagggctggctgcctagcatggtgcccaagttcctccccgccgccaagggccccgagcctcccccgcctgaggccgttgccgccgccgccaccatgcgcaaggcccgcgtctccgtgcgcgcccgctccgaagccgtcatgatcagcgacggttgccagtggcgcatgtacgggcagaagatgtgccaagggcaacccgtgcccgttcgcctactaccggtgcaccatggcctgcggctgccctgtgcgtatgcaggtgcagcgctttgtctagga

SEQ ID NO: 40238 - DNA, 263 bp, Triticum aestivum
  Clone ID: PAT_TA_40238
agaagttaaaaacaatcataaaatttatatccagagagaaaataattgctgtacacaatattagctgggacaagaggacattttaagatggcaagccagtcactaacttgtaaaacccgttctcatgtgaggatactaaatggtataacaacagctcattccatgtatcaggcactccaggaaggcaccagtggctgcagtcctgggtgctggatgctgtaaaaagtactgccttactcccatacatagaggggtgggcattt

SEQ ID NO: 40239 - DNA, 208 bp, Triticum aestivum
  Clone ID: PAT_TA_40239
aaaaaataaggaaaccctggttttggttgccctgggaaaacaaaacattagggagctttttttggcggggccctcgctcggtggaggggggccgacactggggggttcccccccaacctttttttttagcccccgccccgcgccaccccgggcaagggaccccaaaccttgtgcggagaaaaagggaggggccccccagtccactcca

SEQ ID NO: 40240 - DNA, 307 bp, Triticum aestivum
  Clone ID: PAT_TA_40240
gtccctgcgcaaccagcagcgggtcatctacacgtcgcccatcaaggccctcagcaaccagaagtacagggagttcaaggaggagttctctgacgtcggcctcatgaccggggacgtcaccatcgagccaaacgcctcttgcttggtcatgaccacggagatttggcgcagcatgcagtacaaagggtccgaggtgatgagggaagtcgcctgggttatcttcgatgaggtgcattacatgcgtgacagggagagaggagtggtgtgggaggagagtattgtgatggcgcctaaaaactcacggttc

SEQ ID NO: 40241 - DNA, 313 bp, Triticum aestivum
  Clone ID: PAT_TA_40241
gcgtctcgtactagggaagcagatagcaaagatcttgcttactagaagagaaaggttgttgctggcgctgacgttatagccacccaacttaactatgccaccgatatctatctcaagaaggcgaacgactggcgtgcgataggtataacctgacctatcgtggctgccataacgccaatagataacatacaaagcgattgggcgcatgactggatttttgaaaaataggataccagctgagataactggtgccttgggtcctatgaaagacaaagacgaggctgatccagaatgcagagtgcatcttggtgct

SEQ ID NO: 40242 - DNA, 393 bp, Triticum aestivum
  unsure (1)..(393): unsure at all n locations
  Clone ID: PAT_TA_40242
atccatcttccattataattctggcaatcctttgctcccttcattttaactaaaccttttcttcagatctgtgaaagccatataatttgcatgctccaattttaattttaactataatggaacaggttacttttctggtttcattttaactatcatggaacaagttacttttctggtttagtgtatctttttgcttctaccttgaactaagcgcaattgctttattataaacaattgatccaaaatgcatagtgcatcttattgttcggcgaaaaactttcctggtcgacactatagctaaaccatcttttcacaaaatcctgctattctctctgtacatttgcttcacttattttggtgtcttagtttgataattcgngtatggttgaaaaa

SEQ ID NO: 40243 - DNA, 387 bp, Triticum aestivum
  Clone ID: PAT_TA_40243
atcgcgccgggcggttaccacttcatgctcgaggagccgaagcacgcgatcaagcccggcgacaccgtgcacctgcgcctgaaattctccgacggcgaaacggtcgatgcgccgttcgccgtgaagtcgccggcccaggcaaagtgatgcgcgcgcgatgaacctcctgtactggctcgatccgtgggaaccgtcgccgaccgtcgtcgtcgcggtgctgacggccgccgtgctgttcgcgcgcggcgtgaagaaggcgaaggtgtcgccgctgcggcagttctcgttctggttcgggctgacggcgctgtacatcgcgctgcatacgcggctcgactatttcttcgagcacgagttcttcatgcaccgcgcgcagcaccttgtgct

SEQ ID NO: 40244 - DNA, 308 bp, Triticum aestivum
  Clone ID: PAT_TA_40244
gcctagccaaacgcgacacaatgcttattgctcacatcagttttttcaatactacaaacatcatcattaccatcactctccctttattatgcagtatatgtacatgatgtgtcacttcctatgcgtctgacgaactactcgtctgcctcggccgccttcgtcttctttgcctcgtagtccttcactgcggccttgatggcgtcctcggcgagcatgctgcagtggagctttcaccggtggcagcgacagatgcttggcgatctctgtgttcttgatcgctaccatttccttcctttgcctccgctcca

SEQ ID NO: 40245 - DNA, 360 bp, Triticum aestivum
  Clone ID: PAT_TA_40245
ccaaccaccactaaattaagaacaagtttgaatgactcgtagcattcaattacagcgcacttcatatactcgtctgcacatatacgcttccacaaatcactgtctcttggtctaaattgtgctgccatgtctaaagctataggtatcttgctagcaagcaagaacaacggccactgcatcaattttaagctcgggtctgatgagtatggaaccaccaataggtccatctccttatcacttataaaatcttcgtcgcggaaactgcaaatcacttcattccacagttgagcaaacttggcagcttcagttctctttgtgggggaaacctctgcaaagcgctttgcgagtgaaaaacgtctg

SEQ ID NO: 40246 - DNA, 351 bp, Triticum aestivum
  Clone ID: PAT_TA_40246
cggacgcgtgggccgacggcgctcatgtcgtccgtggccatgacgtccctcgggtacctgctgccgctcatggcggccaccggcgccgtcgacgcgccgccggagcaatgggggaacggcttcttcgccgacgccgcaggcacgatcgctggcgactggctcaagtactggatcgaggtgggcgcggtgctctcctccatcggcctctactcggcgacactaagcagtgcggcattccagcttcttggaatggcggacctaggcctccttccccgcgtgttcgcgctccgcgccccaatcttcaatacttcctgggtcagcattgtggtcaccagcctcatcacccttggc

SEQ ID NO: 40247 - DNA, 178 bp, Triticum aestivum
  Clone ID: PAT_TA_40247
aacaaaaataatagtcaattgtaatcattttgggcgctagccggccattggattagattgaattcaaacataccaccaccgtgttattcacaaattaaatggctatggaatgggatgcattatataggatttttctcaatttaatataattgtagggggaaaagaaaacattgattta

SEQ ID NO: 40248 - DNA, 230 bp, Triticum aestivum
  Clone ID: PAT_TA_40248
cctccacccgctcctccgcctgaaccctagccatggcgtggcgcggcgctgcgtcccgcaccgtcctcgccgcggtccgccgcccggcaccctccgtcgcgctcggcggccttcgcgcccctcctcccttcgtggtcccgcgccgccggatccttttcctcttcgcctccttccactccacctacatgtttggggccgtactgacactgtcttctattatgggttctccg

SEQ ID NO: 40249 - DNA, 149 bp, Triticum aestivum
  Clone ID: PAT_TA_40249
cacactcactcccactccacctctttactccccacgccgccgtgccgggttcgccgacaagttcacgcctcgcccggttgccccaccccaacattgcggccggaccatagctgcaattgcattgcggccgttccaacaatccaccatat

SEQ ID NO: 40250 - DNA, 257 bp, Triticum aestivum
  Clone ID: PAT_TA_40250
ggtagtttttgtgggcgactcttttaataaacccagctgagctatatttttaaccataactgaagatttattacggtttacagggctctatcattgcttatcaggggggcatctatttatccatccaagcattgcaccaccacataaatgcttgtgaaaatttacaaatggaattataaatgcaatggcactgtttcgatcgcgccgtttaatgcatgatggaagggaaagggaaaagctagttagctgccatcatt

SEQ ID NO: 40251 - DNA, 271 bp, Triticum aestivum
  Clone ID: PAT_TA_40251
cctccctagtcctcgctccagcaaccttttttcttccttcttggttgattgatccatcagcccccggtcagagctcgatcgccggccggccggagcaggcgcagcaatgtggttcacggcgcgacccgcggtgtgcatcgtcggcgtcctcctcctcgccgccgccctactggcggcggcggagggcgagtgggacgcgccggagtcgtgcgcaaccccggtgagcgtggaggctgcgtgccgggtggcctctgacacgcaccatggcttt

SEQ ID NO: 40252 - DNA, 201 bp, Triticum aestivum
  Clone ID: PAT_TA_40252
ccagaaaacacatattggatttacaaaaatgtagctgaatatacaaagcaaaagctgaaggaaaacctgtaaacagcagatatcagatcacttttgtagaggctccaagttaatacagttagttactcgattccatatcctgggagcgagacttgccttcaattaaaggacatcacggtttggatatttagtaattagctg

SEQ ID NO: 40253 - DNA, 386 bp, Triticum aestivum
  Clone ID: PAT_TA_40253
atcgctgcacaagttaccaagctgaagtggtaaggcagaatatactgccttgtagctatagaagatgctcttggagttgccgggcagctccccggtggtctgcacccaggagttgcaggcgaagtgcacggatgctcttatgtgggatcaaaagactggacgatccagagggtccggttttgtttcttttaggaatcaacagaatgcacaaactgccataaatgaattgatggtgcactccctgttgcttattgctagcaatgtctaattctggagttaacaaataagcttcattgcaaccgccaaatccccccctcctgtgtttttaggttcgtaacagttgagtgatcttaatgtgaggtggatgttcttctctgatgtacatg

SEQ ID NO: 40254 - DNA, 112 bp, Triticum aestivum
  Clone ID: PAT_TA_40254
accacgcgtgcctacacactttcttgccttatattgatttgcataagtagatagactaacttcggtccgtgacactagtaaatcatgcacaactctgaattgctgccgcctg

SEQ ID NO: 40255 - DNA, 333 bp, Triticum aestivum
  Clone ID: PAT_TA_40255
agacaacaaccactctgaatttactatcagcaacttagacagcaaagcatacatcagcgcttaccaaccgacaccgatgatcgggtcgatggcatgcttgcaggtgctgatactactgcaagtctttattcaaccttgttcacacagatggatagacagagactccactaatgctactactactgcaacaacaggattattcattattcaacttgtgtccagcatggggtagatggtcactagagaatcatcaatcaaaccacaccactaatgctgctgctgtccataccaggaggaaagaagcagcattgattgtctgggctcaatcaacgc

SEQ ID NO: 40256 - DNA, 427 bp, Triticum aestivum
  Clone ID: PAT_TA_40256
cccacgcgtccgcccacgcgtccgaggatattcaacaacatatcctctttaaaagctgcatacattcagctgcaggaagctcacaccccttacgacccggacaagatccaaactgctgataagcttgtcatagatgagctcacgaggctttcagaactcaagcatacttacagagagaaaaatcctaagccagtagcagcatcacctcaagattcacgcttgctttctgaaatacaggagcagcagaacttgctaaagacatatgaggtcatggtgaagaagttccagtcacagatccagaatagagataccgagattacccttttacagcagcaaattgatgaggcgaaacatcggaaatcaaagctggagaagatattgaaacagaggggcttacttaacaaagaatctgaggaatctgatgaag

SEQ ID NO: 40257 - DNA, 375 bp, Triticum aestivum
  Clone ID: PAT_TA_40257
gtccccacgcgtccgagcagatgtagcgagactttatggggaagaggattactataattttgttgtttcaaataggaaatgaacaaaacaggattttgctaacctctatatgacccagcttctgcttggatccctccgttggttttatgaatgttttttccggagatctttgcatgagttttggagaaattcacatatcaccaaagagtgcagttttggcttttgcactgtgccatcttggtatttgatcaagatcaactgaggattcacggattccttatttcgtggggcatgaaactgcctcctgtattatggattctggaagcacaaagtctgcatcacccgtgacatcagagaccatagatgatcacatgc

SEQ ID NO: 40258 - DNA, 273 bp, Triticum aestivum
  Clone ID: PAT_TA_40258
ccggaacgaccgacgcgacctaccacgcggccgaccacgcgtaagaccacgcagactgataccagaccgaaaccgccggggaagaagagacgtagggagagaaggccaggaggaaggaaggagaagatgccgacagagcacggaatgggggaggggacgcgcgaccaaaaagcgcgggcggatcgtaagaagggggacaatgccgataagcaactaactggggaccaacaaggagggggggcacggcaaccaaaaggggaaaagcgccgtaac

SEQ ID NO: 40259 - DNA, 378 bp, Triticum aestivum
  Clone ID: PAT_TA_40259
gtttttcgccgtcaaagatgcgattgggccaacgcttctagtcctcaggcaagacattcagcaaaatgttcaggtaatattgcgactctgcattgcacttgttcacataactaagcgactgatcgagcatatcgactctgcgttttaattgagtgaagcgatcacagttatctatcttccttatgcagagattacaggatctccatgcaagagactcttcacagtacgtgagcttgacggcgatcgtgatggaagaagtggaggaagggacctcaaagaagaccaacagttgtagcagggcaattatctggctggctaggtaacttaactgtacatggacatggctgatctatgcaaaaagataatgggtaaagaaca

SEQ ID NO: 40260 - DNA, 263 bp, Triticum aestivum
  Clone ID: PAT_TA_40260
cgacaaagcaagtaatacttcatattaactttcatatgtaggttcatctgagctaagcaccattcctgtaccagaagatgatcctatatgaccaatggaccacactggtctaggcagaagatgctgctcactaattaggacaaaaccatgcctggaaaacgaatgtgcttgatgatatgcctgcgctttttacttagagcaccgaatgtacactacgcgttatttacagtgcatactgaatagacattttttacctgagaacc

SEQ ID NO: 40261 - DNA, 377 bp, Triticum aestivum
  Clone ID: PAT_TA_40261
cccacgcgtccgaaaatacaagacttggttgcacaggtggatcccctcggcaaacttgatccagaagtggaagatttggttttagagattgctgatgacttcattgaatcggtgactgcatttgcgtgtaccctggcaaagcacaggaagtcatccgttctggaagccaaggatgtgttgctgcacttacagagaaattggcatctgacagttcctggtttttcgaaggaagacaagcatccacagagaaattataactgcaacaggtaaaggcagtagtggatccccaacagccagagtgtgacgctgctggagttagaagcgcaagcaataaattagttgcttataattcaattgccaaccatcaaacaagaggt

SEQ ID NO: 40262 - DNA, 433 bp, Triticum aestivum
  unsure (1)..(433): unsure at all n locations
  Clone ID: PAT_TA_40262
attcgttgctgacaaaggaatcgcacagctcatggatcatatgaataacttgacaagggtgaaaatatggtgtgagtccactacggaagccagcagcataactcatctttcaaagtccattaaggggttcatccagagaggtagccatgcaagtgaccatcgttcactctcactgaatttcaacgaatgttcagaagacttgctgagttttaccctggaaaaatcctgccatctcagtaaactgaagctacaaggcaacatattcagtctacctccatttgttaccgcattggctggtctcactgagctatgcctttcatcccttggtaagttcaccggngatgtacttgcttccctgagcatggtgcactccttgcagtacctgaagctgatagcgactcacatggagaagtttgtcataagaaaggggcag

SEQ ID NO: 40263 - DNA, 360 bp, Triticum aestivum
  Clone ID: PAT_TA_40263
ggtagcctgtggacatagtatgactgttgcactcgccacatctggtcatgtcttcacaatgggtagctctagtaatggtcaacttgggaatccaaaagccgatggtaaactaccttgccaagtacaagacaagttgaacagtgagttggttgaagagatctcatgtggctctaaccatgttgcagtcttgacttcacggagtgaagtatatacttggggtatgggggccaatggaaggctgggacatggtggcattgaagataagaagaaaccaactattgtggacgcattaaaagaccgccacgttaaaagtatagcatgtggttcaaactttacgacattgcatttgcatacataagt

SEQ ID NO: 40264 - DNA, 180 bp, Triticum aestivum
  Clone ID: PAT_TA_40264
ccaacgcctacgagaccaggctcttcgtcaacctccgtagctactacacgaccaacaccctggaaacgaagtacggggcagggctcatgtcagcctttaagtggggcaccggagactcgcgcaagacacattccatggacgtgcgacggaacctgctccaatacacggacgggaggcagc

SEQ ID NO: 40265 - DNA, 424 bp, Triticum aestivum
  Clone ID: PAT_TA_40265
cccacgcgtccgggaaaactttgtgatgctatgccctttgcatcagtcttccaagttgccaaatgaagtttctcagccacaaaagcaacccaaaaggataacagcaccaaaatgtccatctcaggtaagatctagccaagcttgcagtaataactggaaatggccatcaggatcaccacagaagtgggttctctgctgttcagctctttctgctgctgagaagggcgtcgtaacagaatttgcaaaattagctggtgtgcctatttccaagagctggagccccagcgttacccatgtcattgcatcaactgacccctctggcgcttgcaaacgcacgctgaagtttctgatggcaatcttgaatggcaaatggatcgtctccatcgactgggttaaggcttgcatggatggcatggaacctgtt

SEQ ID NO: 40266 - DNA, 392 bp, Triticum aestivum
  Clone ID: PAT_TA_40266
gatttaatgagtggcgtgatgcgataagcgccaaccccagggtggataaccataagttaggaagcaataaattcaccacagaccaatttcagacagttttcttcaaaatgcgcccagctattatgcttgatgggtttacatcacatcaattaaagttaattcaacaggttttgagaaaaaactttagagacctcatgtatgtttgtacatttggcggggatgaaacatcagaaaggagagtagtttatacagacaacaccgaagacagtatattattgatgaaagatgtgcaagaagatctattcagaagaagaaatgcaatatgcggcatcagcaataggaaatccggctggtcattgattctatttgcctaaaaaagaaaattgattgtt

SEQ ID NO: 40267 - DNA, 256 bp, Triticum aestivum
  Clone ID: PAT_TA_40267
ggaacgggatggatacttgggcttaaggtaaccaggttggttgagtacaacgaacgcctgacagaattatggggggacaaccttggcgtccgggatgatcgggctcccccccacgtgtttttaagacccccagggggggttcccttgggccagttgcccggctttggggtgcccgtcgcctcccccgttgtttacggaaaccggaaatgtttttttctcaattgcggacgtgaactccagggactttggttccacc

SEQ ID NO: 40268 - DNA, 350 bp, Triticum aestivum
  Clone ID: PAT_TA_40268
gtcgctgctttgcgtcaggcccgacggcgccgtggcgctgcccgcggcgccccacttctggtgcaagctctcggtggagcacccgcgcggctacaaggacgagatggtcatgatggcgtccgccgtgagcagcagccccctgtccgccggcccgccggtgccggggcaggggatgttcgtggcggtgccgcacgagttgatgtccggcgacgtgctcgccatgagcgttcgcattgatcagctccaggctcctcctacttctgccttcggtgctgtcgcggccagggcaccggcgtcaccaccaccatcccatgctaggacaacataccagaggcttcagtgacaactgt

SEQ ID NO: 40269 - DNA, 424 bp, Triticum aestivum
  Clone ID: PAT_TA_40269
cccacgcgtccgggaagatgagagtgtgcaagacattttcatgacatgcctaggcctggccactagaactatgaaggataaagttgtcccccttgtgatgaaatttgttcatgagaatatcaatgggcctagtcgcatgatggccatttatccattaggttttatccttgaaggtccctctgttaatcaacttgctcctgtagttcctttattggttcgcatgatggaagatcctcaggaaggtgaaggtgtaagagggagggctgcatggattcttggacgggtgtttgagcttgtgggagcaaatagaatcatatcttgggaaaagaggaagaagtggtgccatcctgggatcatataattgaagttctgtacaagggtttccaagaattgtcactttaaccgtcaattttattaaagcttt

SEQ ID NO: 40270 - DNA, 337 bp, Triticum aestivum
  Clone ID: PAT_TA_40270
gattcatccattgaacgcgaagagttcctaccggtatttgttggatgacgacaaaaaataacttgggccgttctagccctgttccaaacttcactcgtagagggttgagggcgggtggcagacgtccaacctagagcgcttcatgtactgcaccatcctggacgtcaaggcccacattcttctgaggtgacactattgcacctctcaaacctggcaccttaaatgctttgtcgtgttcaattttcactgttgcacctttcaaacctggcaccttaaatgctttgtcgggttcaattttgctcaagagttctgacaggttaaggatcttgcattgctt

SEQ ID NO: 40271 - DNA, 414 bp, Triticum aestivum
  Clone ID: PAT_TA_40271
tcgcgccggcccagtaggacctccccgcctgtggtgtacccggagaacagatgaacatcgtgagacggagtacactatgtacaggtgcacgtataaggcccagcaccagtgcacgcatgaagactgatcgccggctggcaatcactggagacggccacgtatgacgacagatgcctagccttgtcgctaagtttctagtctacctcttgccggtgaaatcatctttgtgttgctgtgcaccacgaagtggccattgcgcgcgcatgggccatgcacgtagtcatttgatggcagggtggcatgtttgtcaacctttcgttgaccggaaaagccatcggagccctcacgcgagatgactcgtgaccaagctcttctacgttctgcaacatcataaccatcgtctacatcgagcgc

SEQ ID NO: 40272 - DNA, 219 bp, Triticum aestivum
  Clone ID: PAT_TA_40272
cacatagtactcctcatcccgatttgaaccagctcaagctccgtttatacggatgaggctccgcacagttgcaatgtatctcaaatttcccatagtcattctttaagcgacacccatttcctgggcctggtcatgctgtacgagtcataagtgaagttacagcaggcactgctttggatggttctttctctggtgattttgatacacattcaaatccat

SEQ ID NO: 40273 - DNA, 266 bp, Triticum aestivum
  Clone ID: PAT_TA_40273
cctaggcgtgctctactaccacccccacctgattgtcgatcattataaattaaggatggctagctgtggcaaacttatcactcttctcctcgattattgctcgctatctacaagaaaactattttaggggcttgctgatcacaaggagcaacttggcgctgctctctgaccttgcaggtactacgatggcacgaacgccgaggcggcccaagattttaggaactgccgtgtgttcccatgcgagagagcttctgtgtttatcaaag

SEQ ID NO: 40274 - DNA, 426 bp, Triticum aestivum
  Clone ID: PAT_TA_40274
cttggaggggtactaagatcacccttacctcaatgacgatcagtataaatcaagggttacttgctggccaaactgatgacgcatctcctcgatgatgggttgttaactacaagaaaactattttaggggcttgctgatcacaaggatcaacttggagctcctctctgaccttgcaggaattacgatggcaagaacgccgaggcggcccaagagttcaggaactgccgtgtgttcccatgcgagagagcatctgtgtttatcaaagcgaaggaagcctgctgctgacatcgctggaggaatactggagatggtgggcctgcagctgacattgctggaagtttgatctttcagagggcggagcaatcccgaacgagaaaactgctggcgtgagcaaaacatggaactgcatctgtgtttatcaaagcg

SEQ ID NO: 40275 - DNA, 461 bp, Triticum aestivum
  Clone ID: PAT_TA_40275
ttcgtcccacgcgtccgcttgtcttcactcatcctgttttccctgatttacaaatgttatctacagcaagactagggggtgtgttggattgtcaatcagaatgttgcataattttttcatgcacaaacgttgaaataatgatgaattagttatcatcaaagctgtgtatgctattgatataatgttggccatccacacacttatacatacatccttccttaccatagatcgtttcgtgcgacaagttctagattgtcacgtattgagatgcaaacgagtctttctgttggagcagcatatttttttgtatacaacattcagccgcctatagacgaaagatgccattctaagagatacatatggttggtttatgtttaagaacaagtacgcatatttttatatgccgattatagaatgcaaccaatcgtacactccaagggcaattttagcatagtggtgag

SEQ ID NO: 40276 - DNA, 195 bp, Triticum aestivum
  Clone ID: PAT_TA_40276
ccggaccggcgagcggcggaggaaggcgttagatggcgttttcatcggccggagaggagacggtgcgggcgtcgcacatcctgatcaagtacgtgttgtcccgtcgcatggcgtcctgtaaggtctcttaggtacgattaatatcttcgacgactttggtagtctattaagcatgtaaaagttgactcttgaaat

SEQ ID NO: 40277 - DNA, 177 bp, Triticum aestivum
  Clone ID: PAT_TA_40277
tcgttgttgatttattcaggcctcaaaaaattgtccaatttcattccattcataaaaaagagggcaaacacgaggttttgctatgcccatttggcccgctagcttttcttatatttgaaaaaatgcctacatcataaaacagtacccttattgcattgttctgaattttgaaaaact

SEQ ID NO: 40278 - DNA, 430 bp, Triticum aestivum
  Clone ID: PAT_TA_40278
ctagtcttcacacaacaagtttctcctgatttacaaatgtgatctacagcaagttagcaggtgtgttatattgtcaatcagaatgttgggtaattttttgatgcacaaacgtagagaagatgatgaattagctatcatcgaagctttgtatgctaatgatagaagctcggccaaccacacacgtatacatacatccatccttacgggagatcgatacgtgcgagaagttctagaaggtcatgaattgagatgcaaacgagattttcggatggagcagtatatttttcgtaacttagtccagtgccttcgagaaagatgccatctaagagatacaaattttgtctcagtggaagaacaagtaggcatatttttatatgccgtttcaaagaatgcaaccaatcgtacactccaagggcaatttcagcatagt

SEQ ID NO: 40279 - DNA, 197 bp, Triticum aestivum
  Clone ID: PAT_TA_40279
ctacctcatacctggagtctgcgtcgtcggatacgtgcggccacaagcgcgccatgaggcgccacctgaaaccactgggctgagtcgctgcagcgggcgaaatcatacatacacatcaaatgggcaagacggaaggagccggcctgagtaaccatctagatacgaaagaagggggatcagtctctacgctggggatc

SEQ ID NO: 40280 - DNA, 132 bp, Triticum aestivum
  Clone ID: PAT_TA_40280
ctatctatttttagagagccgactttggatattaactgggatgcattcttacggaaagagccacctcctctacaatgaagaattcagaccgtgcttaaactaacaccatctcatgtttgattactacggaca

SEQ ID NO: 40281 - DNA, 413 bp, Triticum aestivum
  Clone ID: PAT_TA_40281
ggctctgccaacgctggagcaggcctccgcctcctcgtagtcggcgtcggcggctacatccgcccacaaacgcccgctggggcgccaccgcgtaccactgccctgtgtcgctccaacggtcggcatcatacatacacatcaaatgggcaagtcggatggagcggcctgaggaaccacctgatccgaaaaaaggggatcgccccacgctgcggcctcgaccccaacctcgcgggcgtccggcatgacgtctccactccgtcaccacgccatgagcgcctccagcaagaagcttccggtggccatcgtgggcgtacacggcggcaaggagatggcctccggtctcgtgttccggcaggagatcctccatgtggtgctcgtcacgttgcagagatcgatccaaacgaggctgtagc

SEQ ID NO: 40282 - DNA, 250 bp, Triticum aestivum
  Clone ID: PAT_TA_40282
ggcacgcgtggggaacaatagattaggggatgctattggcataccatgtccagtttctccgcatgcacttactatgtgcaagacagaagcagtagcttacggctatccatgtggagaccacaaggtcacgactgaagatgggtttattctgagcttcaaaaggattcctcacggtcatgatactggtaactcaaccgtggaggagaacacaagggatcctatactggcatttcacgggctttttgtggat

SEQ ID NO: 40283 - DNA, 319 bp, Triticum aestivum
  Clone ID: PAT_TA_40283
tcgggcactgtcatctattcatacatatgaccaaacgattttcataggacgcccatggggggtggtgttggaattcgagctcaacactcacagagttatgcatcttacatagcgcatgttacatgactaaaggttctgtcggcattttcttcagaagatgccacaggctcgctaaaagctgcaatctgggatcctgatcccgatgtttttctggaaaatgaattaccctatggagagtggtgccctgttgctgatgaagtgctagataatagttatgctatggcaattggctgagtttggattagatcgctagggtata

SEQ ID NO: 40284 - DNA, 409 bp, Triticum aestivum
  Clone ID: PAT_TA_40284
gctctgccgcccctgcagccctcatcatcctcgcgcttctcccgaaccggcgtctcccgtccgcctcggcgccttccgtagcaggccagggccggagccgagaatgaagcgtccgcacgcgtccatctctcccttcgagccccttcgatgcgcccccgactgtcgccgccatcttcactggaagctctacgatggtcaagactggggaaggatgccgaagatgtagaggttgttgccccagtgacgctggagcccattcaaaggaacagaagatgcgcgtttttcctcctgaccatttgagtggtgttctgtgcaatttatgcttgttttgaaaatttggttatagacgtcgaatttatctccaatcatctggtgtactatatcttctacaatctttcatattttagca

SEQ ID NO: 40285 - DNA, 169 bp, Triticum aestivum
  Clone ID: PAT_TA_40285
cacgcgtcgcgcccacgccattcgtctggttatgaaccatatatgatactgatgaaactggggaatggcgtcactaggatcacattttaggttcgttgtgatggtacgatgctacatcggataactcgtattattttctagagttaatacatgccaacaaaccccgact

SEQ ID NO: 40286 - DNA, 111 bp, Triticum aestivum
  Clone ID: PAT_TA_40286
gtacattgatattgagcaaccaacctgaagcttgctcgactttggtattgggcaatttttagcaaggagttttcataagcgatccattaattgtgctgaacagtttgagtc

SEQ ID NO: 40287 - DNA, 407 bp, Triticum aestivum
  Clone ID: PAT_TA_40287
tttcgttttgttcgttgtatgagaactacaagccatcatcctctgttctgtgggttcagcataaatagtatggtcctccacctccccactataaaaagctcacagctaaatagattggtttgcttcccaagtataaagtgctgctagagactcacactgaaacaagactacctttcgaggaacttattaatttgtagatctactcaccctgtaactaacgtaactgacaggagttcgacatacatatcttgttaccacatccaatatatatgtcctttcatgttggatcaccccttcatgtattataagaaacattccattggactcctgaaaataatattaatgtccacttctctttggtcttcttctttgatatatatttaaattggtttttttaactatatata

SEQ ID NO: 40288 - DNA, 283 bp, Triticum aestivum
  Clone ID: PAT_TA_40288
ataaaactggtcatcctcctgcagggttgattatcatcaaatcagaagcgacgacagcatattattcccgtgtgcacgaaaactcagtgcgattctacaaaaaaatcatggaagcagagctagtagaatcctaggctcggtgcaaaatctggtcactcggatcagcatgttctatgtgacagcatgccactgtgggctcacaagaacctgtccactgtggcgggcaaagccgggtctgcaatgtcaccgataactgttgcctttcttttgcccgccttgaaga

SEQ ID NO: 40289 - DNA, 186 bp, Triticum aestivum
  Clone ID: PAT_TA_40289
gggacggaatcattattatgtaagcatatatatagtagcaagctgtgtatattcaccacttcagcatacagggctcgggtctaaggccacaggtcgactggaaccaagtacctacaaccgatcttaattatacctgagagggtcccgggtggaatgggcgccgggaaccgattatacatgcggggc

SEQ ID NO: 40290 - DNA, 203 bp, Triticum aestivum
  Clone ID: PAT_TA_40290
ccgcagccgccgccggcatgtccaccaccgcgcgcccgctcgtctacgtcaaggccctggacggtgtcatggccaccgacgcggccggtgttccgatgccggacgttatgaatgcgcctattcgtcccgacataattaccttggtgcacagggtccgtttctgaaacatacgccagccctacgccgtcttccgagagggcggt

SEQ ID NO: 40291 - DNA, 156 bp, Triticum aestivum
  Clone ID: PAT_TA_40291
gccatgcttgtgcaggcatgtaccaatccgcactgtggaacggctaatggctgaccaaggaagttatggtatgtgcgagcgcacacgctactctaataaccgtatttatggtagagccaattcgtgcaacaatcccacactggtgggaggggcgca

SEQ ID NO: 40292 - DNA, 282 bp, Triticum aestivum
  Clone ID: PAT_TA_40292
aattcgaaacatggcacaggagagtgtcgttcgttggcttaacgagttacacatacacggcatcctgctatcatttgtgtatagagttgcatacttaagtacaacggggacacatccgggaagcagcacagtacaaaattacgcaaaagttattcttgtgaggattcaaatctcgagaggattcaaatctccacaataatcacaaaccacctatagtgtccttcaggcctctatggatgtgtttgccctacttgcatatgatcattggccggtgccgtgttt

SEQ ID NO: 40293 - DNA, 369 bp, Triticum aestivum
  Clone ID: PAT_TA_40293
cgcatatctccttttggccccagatctctacggcgcacggtttctacgcgatggccgggccactccggggggtcttaccctccctcggacgggccctgctatcggctacgccggcgcggatgctctccgcggagggcttcgaagccctcttggagatctagcccggacagaacgtcatggtctccggaatcccagaggagcaccttcagcgcaaggtgctaatcgagacaccaggtaggactgcatctcagcaaggttaaagctaagccgggaggcggaaaatcaattacatggtaacccaaaagtgggtgaacccattgatggcatggacaacgactggtgatccggatgctaaatgtaggtgaatgc

SEQ ID NO: 40294 - DNA, 408 bp, Triticum aestivum
  Clone ID: PAT_TA_40294
gaggctgcaagacattgacctggagggcgaccccttcacctctgctcgtgtagccgaatactgcgtgcctgcctgccatttgcttgctcaccgagagatccatcagtcccgattctctcacaatgccgaagaccagatcgtgaccttaggccaattgacctgcatcatcctggcaagcgtcctggaactcaagaggagcgccagtggcatctgagactgttgtcgcaacgggcagccatgggacatgggcacaggatgtgctcatatatatgacgagaggcagggcctccgtaacatggtcatactacttgacaccaactcgactgtcactagcacggccgtggcagacagcaatgtcagtgaactgtatgggtccaagtgaccgtcagtgcttgtcccgcctacgac

SEQ ID NO: 40295 - DNA, 308 bp, Triticum aestivum
  Clone ID: PAT_TA_40295
catggatcagcttcttttgaatcctgaatcttgctactctgctcagctttctcagatggagactgagacgcttctagcccagttagttgagacagatatgaacaaacgtgtgcagtaaggcacttacaaaggaaagaagtctaatgctattcgccatttttttggctaccaagcaagaggtgccctgccgtcaaactttgattgtgattacgcatatgttgtggggcatgtctgctttcacatcataggtagcggtctgaatggctacatggccactgtaactaatttaaaaaggcctgtgtaccagt

SEQ ID NO: 40296 - DNA, 274 bp, Triticum aestivum
  unsure (1)..(274): unsure at all n locations
  Clone ID: PAT_TA_40296
gaaancgngtggggactccacgcgtccgccgagacttcctatgtctcttcattgtagccccttgcagagaggccattttaagaacgggggcattgcgtggcactaagaatttgccttgggaggcctatttaccatatgcctctacagaggacgatgccagcttcatcatgggaacaaatgttgtcgatgcttttgatacagaagtagcttcagagattccaatccttcagagtgaccaggatgttttcggacgtgaggtattgaaccttctaag

SEQ ID NO: 40297 - DNA, 154 bp, Triticum aestivum
  Clone ID: PAT_TA_40297
gggatagcaaacaacggaccgttatatattattattagaagggctgaggataaatttctagcttttagatgaagccctgccgaggttacagcttccgtagccccccttgaacaggccgccatggcagattcgtgagagaaaattttcagtccag

SEQ ID NO: 40298 - DNA, 215 bp, Triticum aestivum
  Clone ID: PAT_TA_40298
aaagcccaacccttcctactttatcacctttgcgacggtaccgtaaccgggtggggccatcgttatccccctcttactcggagtttgaattaccctgcactcgttgtgcttaggaacgatgaagccgtcatttcgtccgcaccatctacgtgggtaaaattcccgttgacattccgtagagggaaaatgaggtactttattttcatttacggtcc

SEQ ID NO: 40299 - DNA, 215 bp, Triticum aestivum
  unsure (1)..(215): unsure at all n locations
  Clone ID: PAT_TA_40299
cccacgcgtccgcccacgcgtccgcgcgcttccgtttccgtttccgtgtcgtggccgtcgactcccccctcgccncggcggctgagtcgcccgcactcgctgcgcttaggaacgatgagccttcgcaacggccgcaccatctactttnncntttttcctcggggcatcccctagagggaaattgaggatctttttttcaagttcttgacctattg

SEQ ID NO: 40300 - DNA, 422 bp, Triticum aestivum
  unsure (1)..(422): unsure at all n locations
  Clone ID: PAT_TA_40300
aatttccttcaacaacccatgcttatgatctgagaacactctatttatgtactgatgtacattggatgccgggcttttaattttgagtgtgtgtaatgtgatgtctggcattcacttgaagtggcactcctatatttgcttataatataaatacttgtttgtgcatacgcaaatattttgtttatgcatacctgaactcctagctagcacttgacaacttattctctggtttcctattaattaaatggtacaccctccgttccaaattactcgtcgtggttttagttctggtttcctgcctcnttgatttgttcaagtattatcggcacattagttctttcattgagtagtgtgtattttctgctcatctaggtttgacaactagttccttgctctgctctgctcctgcttggtgctcgcag

SEQ ID NO: 40301 - DNA, 235 bp, Triticum aestivum
  Clone ID: PAT_TA_40301
gctagatatagatcgacagcgtatgcccttgaagcctgttatgagagctggtggggggcagacagaactggacttatatttttggaatgggaactcatccatagtgctgagggattagacaccatcaattggtggcagttacgatgttttaagtattgtacattgcgatgtatggcttatgatatacttgccattcttttaacaaccttgggatttgaatctgtcttgagttcta

SEQ ID NO: 40302 - DNA, 201 bp, Triticum aestivum
  Clone ID: PAT_TA_40302
agaaacggaaaaggcacaagttgtgcggtgccacaaaatttgctgcgtcctcttcttctacctctagcacatgaatgttttcttgagagaatccttgggctaagagagttgcaaggtagagaagaaagcggtgctacgagaggctgctccaacaattggcatcagagccttgtcgatcctctgcttgtgtagcttttcttt

SEQ ID NO: 40303 - DNA, 447 bp, Triticum aestivum
  Clone ID: PAT_TA_40303
ttttgtagatgagttgaatcacggtggttgagaacaagaatgtgagtggtggtttataccctgattcaggctagctaaaattctaacggctatgcttagctcatttgaaaagggtcaccttttccatgtcggtgcgacttatctatgaatttccaacctaacttgtcaagaattctttgtattgcttagtttaggggggtgatttttaattaagtaaattttagttccattggcttctgtatattggtatttttttatatagtgtcctttattttatattttttttgcgttttttttatttaatatttgttattataatacctttatcttatcttatattttattttttttttgtctattttctatttttataatttttttttattttttattttgtcctatttgtttttttttttttttaaattttatgttccacttttttttttt

SEQ ID NO: 40304 - DNA, 332 bp, Triticum aestivum
  Clone ID: PAT_TA_40304
tctacttcgaatgatgcttcgagtccaacatactggccgtgatggacgcgtgagtgaatgacggcgtggacttactttcgttcttcctttttggcccttccataccatttgttaatgacctgtttgcaaactcttctacttagttttattatatattatcattgtagttttttaaattactattatttttatatactatttatttttattattattatttttttttatttttcattatttttatgttataatttttctttttctctttatactatttattttattttcttctattttcattttattttttatttctattttaattattaatt

SEQ ID NO: 40305 - DNA, 255 bp, Triticum aestivum
  Clone ID: PAT_TA_40305
cccacgcgtccgggaagacgctgtgaaaatattacttggtcttcgtgagaatgtatggagcttatcataaatgcaaattcactctagaagccatcaatgcagcagtttatttgtcagcaagatatatcccagacagacagctttctgataaggctattgatcttattgacgaatcttgcagtagagctcgaattgaatcatttcaaatgaagaaggcaggacagtttttcgttctttttaaaggagccggatgaa

SEQ ID NO: 40306 - DNA, 139 bp, Triticum aestivum
  Clone ID: PAT_TA_40306
tctgtccaaggggcatcactacattttcaccgacgacaagtaggggttggagagcgttctattaaagcacattgaagacattcatgttctgataaccacttcattccacccagcctatgttactgcatataggttcaag

SEQ ID NO: 40307 - DNA, 208 bp, Triticum aestivum
  Clone ID: PAT_TA_40307
aaaactggtcatcctcttgcaggttgggttgttatcaaatcagaagcgatgacagcaaattattcccgtgtgcacgaaaactcagtccgatttttacaaaaaaatcatggaagcagagcttgtagaatcctaggctcgttgcaaaaactgttcactcggatcagcatgttctatgttacagcatgccactgttggcttacaagaacct

SEQ ID NO: 40308 - DNA, 257 bp, Triticum aestivum
  Clone ID: PAT_TA_40308
gtaatgttgaaataacactgcagttgcagggcaaggcaccgggatatgtgcagtcgttccaatgaacttgttgtgtggagcaccaacttgaatgattgtcttgcattttttgttataactactaatttgttcactaatgtggtgattattttaattgttttattattatttttatatttttattaatatacattttattatttttgtattttacttttcatatttttatctctctttattatatttcttttattatt

SEQ ID NO: 40309 - DNA, 265 bp, Triticum aestivum
  Clone ID: PAT_TA_40309
cagaaagcattagtatgactatcatgcggatgttcctagctctcttcgcccggggagagaggtatcaagagtagtagatagattcatcgtttttatgactttcaagttttttacctaatttaaattaattcattaatttcatctatgatattctggttcatttattaatcaattattccttattattcatccattatttatttttaataatcaatatttaattattattttttaataattttttttattatttatatttattatt

SEQ ID NO: 40310 - DNA, 208 bp, Triticum aestivum
  Clone ID: PAT_TA_40310
gctttcgtgggggtgaggactttctttgatgaacagaagaagaaatgcgattatttgtttatttcaaaactgaaacgctagtggatgaggggaataagaagctgaaaacttactgcagttgtagatacccttggctgcaccagctcatatcaggacaaagtttacgttaacaagagaaatctaggatagctttacctaaggacataac

SEQ ID NO: 40311 - DNA, 143 bp, Triticum aestivum
  Clone ID: PAT_TA_40311
cactggagcttgagagaggatgcgctggagcttagaggaggatgcgcgggagcgtcgaggtggactcccgcgagctcgaggaggacgtggccagaggtcctgacgatgcctgcatgttattctaggcggttaggggtatcgtt

SEQ ID NO: 40312 - DNA, 163 bp, Triticum aestivum
  Clone ID: PAT_TA_40312
tcgtctctctgctcagcgcagcgcagatggtagcccgtccacgccgggggcggcgagggcgatcacggcgagggcgcccgcgcgctccttgcgctgttgcagcgcgtgcagtctgaggcgctgcgcgtgctggggcctcgcgacttcgtccataatctctatc

SEQ ID NO: 40313 - DNA, 174 bp, Triticum aestivum
  Clone ID: PAT_TA_40313
agcagataccgagacccagtccgcctgctgtgccgccttcaccttcgcgatgagggccagtggaagaagaagaggatgaggaggctcaagaggaagctccttaagatgaggcatctatccaagtatgcgaacaacgaggagaaagcttaaccttggattactacaccattcttt

SEQ ID NO: 40314 - DNA, 340 bp, Triticum aestivum
  Clone ID: PAT_TA_40314
gaaagttaaacaatcccaatccaattcaaggggattcttcttcccctgatccagtgaccatattcctaataaaccccaacttttgttgcctcttttcatgccacccaaaattagctgaaacaagaaacagttggtaaatagggaatgcattcctagcgcttctgctcgccggctcggtagtagtcgagcgtaacgtggagcagcagatcggagatctggcgcgccgtcggcctctcccctggcgcaagcctggtgcatcggaacgccacctcgaggaccttcgtcatggacgactcctcgcgcggcaccagcggcttgagcgcagggtcgaacacctggt

SEQ ID NO: 40315 - DNA, 247 bp, Triticum aestivum
  Clone ID: PAT_TA_40315
ccacgcctcactctcctatcctcctcctctgttttcagttccacttggcgggtcccttcctctgagtcggctgctgtgggagcgctggtagggtgcatggaggaggaggaggccgccggcgtgaggaagcggaagcggggcggggaggccgcggtcgtcgtggtgtccggcgaggcggtgctcgtcgagggaggcggttgcttctcgtggaaggaggcggatattgaggagggggaggagttccagg

SEQ ID NO: 40316 - DNA, 382 bp, Triticum aestivum
  Clone ID: PAT_TA_40316
gcgggcagaggcggaggatatgcggcggcgcacgttcctgccgtaccggcaggcgctgcttctcggctgcctcgggtttggttccggcggttacagcgccatgcacggcttcgccgccgccaccaccggcaagtccaagtcttgacgccagaccgccgacgcctccatggaccactagctcacgagtgtcaaacaagcaatactagtaacttcccttgtaaagtactgcggtggcaagaaggaatgcagtggaaaaagaaggttgacttgtgtatagaaaagggattattgttcccttttgtagtaattttattgtgatgtaagtgtggaattctgaagaacaaaattggtgttttatatgccccgaaaaaaaaaattatta

SEQ ID NO: 40317 - DNA, 459 bp, Triticum aestivum
  Clone ID: PAT_TA_40317
cgaaagcaaaagtggacttcagaggaagaggctgctcttagagctggcatagcaaggtatggagtgggaagttggcgcctgatattgaaagatgatgacttcaggtccatcttgagctgccggtcaaatgttgatctaaaggacaagtggcgcaacatcaacgtatttttcaccgaatcaggctctatggataagggaaggactgccatgaagaagaaccgagctactccaaggaggaatgatcacccaatggcaaagagcacagttgcttctgatgttgatgacgaaattgttgatgaacagcctatagcatcagtgtcaagtgaactgtggaatgtttcaattccaaagaaatcgcggtcaaggctaaacaatatcatattggaatctggcaagaacttgaatgagcctacaaggtcacacagcactacgattgctaagtacatagaggaggaattt

SEQ ID NO: 40318 - DNA, 172 bp, Triticum aestivum
  Clone ID: PAT_TA_40318
tccactccatcttgtccacgcgctctcactcgaaatcttgcctccttcaagaaggagggagtcatggtggtgactcttttcactgctttagttaactagaaaatgactcacacctagtccaggtccgaacgtcttttccaaacacgcttttaatagcttttctacattcctg

SEQ ID NO: 40319 - DNA, 461 bp, Triticum aestivum
  Clone ID: PAT_TA_40319
aggggaggtcgagatggagatgtcgacgagcttcccgctgccttgtctcgccatggtgcacggcgtaagcgccgaacaccaacaacccacggcgacgacgctgttcagtctcgccggcgcgaggcccctcaccggagtcgcccttgaggaggagctgaagaacaaatcagtctgccccacgccgcaggggtgggtgctagtccagcaccgagacgccgtcgtcgtcgccgtcacctacctgctggatccgcgcagcagccaaaggatcgacctgccgcatctcgcaatccagcagggcctgatcccctactgcagctgcctgctcgccggcgaccccacggccccggggtgcccagtgctagtggtggagcccatggccaccttgctatggtgctgccgcgtcggcgacggcgagtggaccaggcacgactacgacatcgggaccctgggagacgagcact

SEQ ID NO: 40320 - DNA, 249 bp, Triticum aestivum
  Clone ID: PAT_TA_40320
caaaagacgaagcagtttcttgttcgtactcgtaggatttagtggcggggttttcaagagaggcccggatggctttttattagaaaaatctctagtttggtggtcgtactagctgctttcatcccatgtctgtgaatatcgcaaacatgatgttcggttgcttacactaatatgccagtccattttctcttgtcctgttattatggcggagtgggggggccggttcccttcttttcatcttctgcttat

SEQ ID NO: 40321 - DNA, 315 bp, Triticum aestivum
  Clone ID: PAT_TA_40321
tgttttttttttttttgggacaaaatgagtcctcccatatcttaaatcacaagtttcagattaagagtccagtttttggaaaatacattcagggcgaaagagatctagtaacaaaaaaaaaatccaatgcaggaaatccgtgcaaaaatctgatcttaatagacttgggggaacaggaagaaacaaaaattggaacaggggtgttggcgcgcactattttcatcatagactgaaatttttcttaactctttcaagatttaaattagctacatggatcattttatttacaaaatttacagtttcagcttccatgtt

SEQ ID NO: 40322 - DNA, 251 bp, Triticum aestivum
  Clone ID: PAT_TA_40322
ttcgacaaaaaaaaacccccttttttagtaggtccatattgggtccaaaatgtgagccttttaaataaagtgttaccgtgggtttcgccagaacggttaaactggttccatgaaactgaacttttgccagagtggtccactttttagcatgatcaaactggctttttactttttttttatgagcaaactttttcttaagaccattcacaagcctttttccccgccaagtaattttgggttaaagttttggt

SEQ ID NO: 40323 - DNA, 321 bp, Triticum aestivum
  Clone ID: PAT_TA_40323
gattcctcaagcactggcagggctgcggtaatggggagtgtcagcaactaaaattaattcatttatccttggaagtgggataacaagaagggaaaatggcatgcatgatcactcttttttaatgtaaaaaatattaactggaatttaagaatgttgacaccgcatctctggttcattaatgaaattttctgctcttcagtttaacttctgtggctcgttgtgatagtgaaagtcgatattttgatatctaatggaatgtacatattcttgccattttatagttgacttcctgccatgatttgcttcctaaaagaagtagta

SEQ ID NO: 40324 - DNA, 190 bp, Triticum aestivum
  Clone ID: PAT_TA_40324
cgtgcgcatgggttccagtggaggctcctcctcccgactgagggtgcatgtggcttagtttggcccgatacaaaaaatgcgaccctttcttgttcttgcgcggcaagagcatatcctcggagagatttttcgagcccatacttcaagcttccagctccttcctcgtgtatagattgaacttgctggttgc

SEQ ID NO: 40325 - DNA, 344 bp, Triticum aestivum
  Clone ID: PAT_TA_40325
cccacgcgtcctagtctaaagttaattttgttacgttctttgtattgaacgcgagaatgcgtgagttcatgacacttcaggttgaaaccagttattacaatgaggagttcttggtagaacaacgtaggaaacttcagctgcaggacagagtttcaagaggtgcccagtttcattttacaactggtttatgtatccgcactaactgggacatcaagcatgtgcgtgatttggatgtagaatttccatttgttctttggggcttattaaacgtgttttggttttttgttatattttactttttaatctatatatttcattatttattaaagtattttttattattt

SEQ ID NO: 40326 - DNA, 138 bp, Triticum aestivum
  Clone ID: PAT_TA_40326
cgggtacgacaccacgcgtaccgatatccaccgtgccatgccgggcggtaccagcggggttcaagagcgtttttaactacgctccggtgctcaaggctcatattgactcgaggagcaaggggtttattggacgttctt

SEQ ID NO: 40327 - DNA, 246 bp, Triticum aestivum
  Clone ID: PAT_TA_40327
accagggtttaacaaattttgcaaagagaagtttaagaaagtatctctcctgaggcctaaggcgacgaggtctagttcgagggagatctacatgatctgcgaagggttgctgtagaagattttccaccacttaccttccatgtgatcatttatgtctgttctgagcattttgtttttatcaagaactctacaaatttgtctttatagtttatagttttttatatcttgttttgatttctttttttt

SEQ ID NO: 40328 - DNA, 196 bp, Triticum aestivum
  Clone ID: PAT_TA_40328
agcacacgtgctcgcgcgtaatgcttagtttatatccaaaatgtggtgtatggtcaagaaccaacaaacccggaacgcctactacaggctcatgacaagaaaagccgcaatggtctctcgctaaatgataatcagatcgtgaccggcatagaatatattcaagctgttttggattcaaatgctgctggttggggcg

SEQ ID NO: 40329 - DNA, 262 bp, Triticum aestivum
  Clone ID: PAT_TA_40329
tcactcttttcggactccaaggagctccccttgcacctcacgatcattgcggattgaatcctcgtcatgcacccccactcctacatcctacactacctaacccattagcccatcatgaccgatctcaaacttgagctctaaggctctttctctctccccaccccttgaagttctactgggattgtaaatttactcttaacatcaggctttcaagtaccttatcaaacatgaacttagttttccttgttaaggttttttcctt

SEQ ID NO: 40330 - DNA, 157 bp, Triticum aestivum
  Clone ID: PAT_TA_40330
aaggggacagatgagctacaaaaattgtgcacaatcagtgcacgaccaggaatagagtaagacttattccccttataaactcaagggatacatctattagagaatcttaacctgctctctacagttactaaaaaagaacacttttaagctgcaaaca

SEQ ID NO: 40331 - DNA, 258 bp, Triticum aestivum
  Clone ID: PAT_TA_40331
ccatgttgtgtgctggcatttattgctcatacaccaacgtaacaagtcaggaccaataggatccgttgagaccttagggctcttggcagcggttcctgcctcaaagaaggctgatcagaaaccacgttgtgattgatcgaatattctccatggtctgagctgtttttatcaaaacaacctggttttttaacaatcaaaggccctgggcaagcttacaccatggctgggggcttttactgggcttcactcgatatatgg

SEQ ID NO: 40332 - DNA, 253 bp, Triticum aestivum
  Clone ID: PAT_TA_40332
gcgcgctgtccggtgtgcttcttcgtgcgtaggtgttcgagcaggggttcaaaaggacggacaggcgcatcgttacctgcctcgccgtgcttcgtgcggtgccgcggcccgtgcctcccccggcgccttcgttttcccggtcctgtggcggacaccccgagcgtctcgtggcaccagtttcggcacccgacccgagtccagagcgtacagtagcgtaatctttgagaagaaggtcgtcaagttcaccggcgag

SEQ ID NO: 40333 - DNA, 146 bp, Triticum aestivum
  Clone ID: PAT_TA_40333
gatcgtgagcgagcgctcttatattttttgttttcagccggtaaagacaaagggataagagatatccaggcatttcatggatctctcagaaaattcacaaggcatttattttttatgtacaatgcttcttaaaactagtttgagga

SEQ ID NO: 40334 - DNA, 466 bp, Triticum aestivum
  Clone ID: PAT_TA_40334
cggcaggcccgggatgaccgacgcgtcccacgcctcctgcaaatttgtgtacaaagagcactgctcaatgagtggcaagggggagccatgggtaaggaatacgtgcgggcagcaaaacgagtccattgtcgaacttgaaaaacacagcctggttgaagcacttgagcaacttgtgcaaactaaggagagaatggattatattttattggagacaactggttttggctgatcctgcaccacttgaattcattctttggctggacgatcaattggagttattaatcagactagactttatcattacggatattgatgcaaaaaactttatgcggtatattgatgaacacacaaactttttagctatttcctgaagcattttaccaaaatttcattttctggtggtttcgatattaaacaaaattgatattattaaagacaattctttggtttagtataggcaaattat

SEQ ID NO: 40335 - DNA, 161 bp, Triticum aestivum
  Clone ID: PAT_TA_40335
tcttcctcatctagaaccgccaacttggtgagattcgaaaccacttcctctcaaatagtaactactaactcatctttcaagttcagtcaaatataatatttttttgctattcaattatttacgcacctaatttgtatattaaatcgtcgtcatctcacatt

SEQ ID NO: 40336 - DNA, 358 bp, Triticum aestivum
  unsure (1)..(358): unsure at all n locations
  Clone ID: PAT_TA_40336
gggagnnccggggcgacccacgcctcccaaaccggcattaataattccccggcaccccgctccatcttcaccgtaccaccgggggttctaaatggagattaacaatattgtctttgccggccttctcgcgggcggcttagtcaccggcgtcatgggctccgaggattcccctgccaccaaaaacacctttcaggtggcaaattccccaggcgccctcattgtctccctcgggatatattttctctactcaaacaccggacacgtaagggaggagtgcattactagcattcattgggcggttgtgtgtttacatacgaatgatgcggggtgatttttattgttttcttcttgattagca

SEQ ID NO: 40337 - DNA, 257 bp, Triticum aestivum
  Clone ID: PAT_TA_40337
gttttatattacacagcaaacccctttttttttttttatattgttcgaggagaggcactcatcaaacactatcagtgtcgtctcatttattcttatcgagccatgctttctatctgctctacagttatgtctctgaatatgtattcacctcaactgagctaaaaatgcgtctccagatcagttgaatttatcttatttactaaaaaataatctattaagagcaatattatgtttatttagctttatgaaacaaacat

SEQ ID NO: 40338 - DNA, 256 bp, Triticum aestivum
  Clone ID: PAT_TA_40338
agtaccgtcaactgggggggatttgaaaccactttctctcaaatttcacgactaacttatatttcaagtttagtcaaatagaaaattcaattgcattcaattatttactcatctaatatatatattaatactgtcccatttcacattttgaagtaaagcgggacaaaatttgcctacaacatgaaacacatgttttttgctgctcatttttaattcatatgatgctgagctgcgacaagcaattaataacttactg

SEQ ID NO: 40339 - DNA, 359 bp, Triticum aestivum
  Clone ID: PAT_TA_40339
ataggtcgggagctatcacaaggaaacccacattatgaacaaatacgagtatgtgctgaggatgcgattgagtgcacaaactttgtccaacatagagacccgttagtatagcacatataaaggataggcttgctcgaacagaaagaatggaggttttcccaaaaaataaaaagagaagaacagatgtagtcccagctcagtacttctgcggtgtactgcaagtccatccactagagcttcggttttcattcaaacctaacaagtctagcgtctgctcgtttcgtctaacaaacaatacagatgaacatgtgttatttagactcaagaaaaaagggagggagttggggaggattacttta

SEQ ID NO: 40340 - DNA, 307 bp, Triticum aestivum
  Clone ID: PAT_TA_40340
cgccaacttggtcagatttgaaaccacttcctctcaaaagtaacgacgaacttatttttcaagtttagtcaaatagaaaattcaattgcattcaattatttactcatctaatatgtatattaatttgtcgtcatttcacatttgaaggttgagcctcagtaagttgaagacaacatgtttcgtaggaagcacgcttctcatttcaattcagatgatgctgagcagcgacaagcaaagatcaacgaactgagagctgcacttgggcctatgtctggccgtggcgaaaaagtctgcagtggaacatgct

SEQ ID NO: 40341 - DNA, 424 bp, Triticum aestivum
  Clone ID: PAT_TA_40341
attaccttcaaggggtgggggattttaaatcatttcttcttataatttactactatcttttaaacaaagaataggggaattgaacaataattgtattcaagaatatactcatctaatacgtatattgattaaataaggttttacatttaacccacacgcggtggcatttttaagacatcattttttgtgggaaacacgcttctttttttaattcatatgatgctgagctccgtcaagtaaatatcaaccaactgagagcttctcttgggtctatttttgcccgtggcgaaaagtattttagagaagcatgcttggcaaggtttctttaattcgccactggcttgtcatgagtttttcccaatatttgaagatatctttcttttgggactttatttgcctgtgcattttctagcctgattttttt

SEQ ID NO: 40342 - DNA, 347 bp, Triticum aestivum
  Clone ID: PAT_TA_40342
gcctcccacagctccgtcgcggctcatcccgaccgatctcccttgcgagattgcgtttcttgcggcgcgtgcgcgcacagcacatccatggctgtcgccggaggaggaggaggaatggcgctgagcctgcgggcgccgtcggcctcggcgtcgccggcggtggggcggctgcgtagggcgtcgtcgtcgccggcagtgaggtgcggcgcgacgcgggaaaggtggccgacatcggccccgtacggggtgctggaggaggaccactaccggactttgaggctgcagccgggcgcctccaggggcgaggtcaagaaggccttccaccgcctcgcgcttcagtaccaccc

SEQ ID NO: 40343 - DNA, 273 bp, Triticum aestivum
  Clone ID: PAT_TA_40343
cggacgcgtgggcggacgcgtgggttgtcaagggcattgttgattcaaaggagctttccctgaacattttccgagagactctccaacagaacaagatcctcaaggtcattaagaagaaccttgtcaagaagtgcattgagctcttttttgagattgctgaaaacaaggaggactacaacaagttctacgaggcctttttcaaaaaccttaagcttggcattcacgaggacttctataacaggaccaagattgctgagcttttgaggtaccact

SEQ ID NO: 40344 - DNA, 124 bp, Triticum aestivum
  Clone ID: PAT_TA_40344
agattttaatcctttaggatacggaatttatgtgagagtgttatgattcacaatgcctaccctgttggctctggcctgtgtaaaatctaagtgattattcaatttttcaaccttgtcgctctat

SEQ ID NO: 40345 - DNA, 343 bp, Triticum aestivum
  Clone ID: PAT_TA_40345
gctctcgacttcatgcccgccgagaaggctccccaagccggcacagtcgctctcggcgccaccaccaacaatgccgtcgccgtgcaggtgcagcagcagcagcacaagaggctggaggggaaggtggccatcgtcaccggcggggcgcgcgggatcggggaggcgaccgtccgcgcgttcgtcaggcacggcgcgcgcgtggtgatcgccgacatcgacgacgcggtcggggaggcgctggcggccgcgctgggcggggcctgctgcacctacgtgcactgcgacgtgtctggtgaggccgacgtggagcgcgccgtcgggtactgggtggcgcggcacgggc

SEQ ID NO: 40346 - DNA, 141 bp, Triticum aestivum
  Clone ID: PAT_TA_40346
tcgcccacgcgtccgcggacgcgtgggctaaattaagctgctcctggtcatagtttctttaattaaaaactttgctggggatcatctgtggcaaacttgttaaacttgtgtagccgtttgcagtttggtatgttgtgttgc

SEQ ID NO: 40347 - DNA, 139 bp, Triticum aestivum
  Clone ID: PAT_TA_40347
tttacacatattctagtttatcaaattttttcgtctgttctgcaaactcatgtcaacgagggtgatctctgtggcagccatttcttcttctccctttagaatggctcaaactcctacatttcggcttctcctgctatct

SEQ ID NO: 40348 - DNA, 137 bp, Triticum aestivum
  unsure (1)..(137): unsure at all n locations
  Clone ID: PAT_TA_40348
tgctacttgtacatctgtaattcctattcagtcgtaacaataatatttagtgatctcaattttcatgccatgctgaattaaattcagctaacatcagcaatttagttgaaagtgcaggnagcgttctactttaattg

SEQ ID NO: 40349 - DNA, 109 bp, Triticum aestivum
  Clone ID: PAT_TA_40349
agctgaaaaaggaacggggccaactatatatatgacccttactttagatttattacggtttacatggccttattttgacttatcatggggattgtatattattaattca

SEQ ID NO: 40350 - DNA, 446 bp, Triticum aestivum
  Clone ID: PAT_TA_40350
gtgccagcgctactacttgattgagtgccagcacgtatctgtgctttcagcaagaatttcaccattgggagccggtgcctttcgaagcactttcacgtgtgaaccgaagtcgtcttgcccaaaacccacggagacctacctatagtgacgttaaagtaccaatgagcatggaggtttggttggaattggatactacatctttcaaataaaaaaaaaaaaaaagggcgtcccgtttagagtgtttaacattaaatacacgctggagctgacacctaacttcgacactgcggtgctcccttgctttcgcctctgaaaaactttgaaacgagagaagaagatggacaccatcaccgtcgttgagaatgtgttctgagaggtggagcgcaaggtgcataagagctactgttaggagcactccaaggacctcaccggggagtccatgatgc

SEQ ID NO: 40351 - DNA, 214 bp, Triticum aestivum
  Clone ID: PAT_TA_40351
agtgtattgtaacaaaaataaactggagtcgcatggaattaagctacagttcaaatcacaaaaggccgccaaagtagattgtcaaatataaactagaagtggcaaccaatttaaccgtgtgatattaaaaaaaacagttaaattcacataggcagattagttcaaagtccacttattcatacttgaccgtgctgctatttcaaaactgtttaaa

SEQ ID NO: 40352 - DNA, 454 bp, Triticum aestivum
  Clone ID: PAT_TA_40352
cccacgcgtccgcccacgcgtccgcccacgcgtccgcccacgcgtgcggactagttctagatcccccagaactggatccatcgctcgcacgccggagacgggcgccatggccgcctccctcgaagacctccggaacgagagcatcgatctcgagtcgatcccgatcgcggaggtgttccaggtgctcaagtgcaagccgcacgggctcacctccgatgaggccgccagccgccttcaggccttcggccccaacaaactcgaggagaagaaggagagcaagttcctcaagttcctggggttcatgtggaaccctctgtcgtgggtcatggaggcggcggccatcatggccatcgtcctcgccaacggcggcggcaagccccccgactggcaggacttcgtgggcatcgtcaccctgctcatcatcaactccaccatcagcttcatcgaggagaac

SEQ ID NO: 40353 - DNA, 199 bp, Triticum aestivum
  Clone ID: PAT_TA_40353
cccactcgtacactatgcacacatatttgaaacagagcttgtcatatatatagaacagggccaatatgaatacatatattttattgcctaagagatactctatagatgaagaacttattcattagctctagctgagctgggtacagagctaatttattagctcaccagggatcatgcgtgttgcttaatatcccatctt

SEQ ID NO: 40354 - DNA, 293 bp, Triticum aestivum
  Clone ID: PAT_TA_40354
gaaatacccaaatagtctcgcggatcagccgaggccgtcatccacaagcgcgaggcggacatgttctacctgttaacacatctgcactcagcatgggcgacggaccaaaccatcctctccgaagaggaacagctagttatcatccgcttcagccactattgggacgagacacgcatgcatatggatgacgtgctatcaggaggggctgagaccataaagaactatgcggtgatctaccttgtttacattaccgaaggttctgaattcaacaccatgtgcgagttgtatgaccc

SEQ ID NO: 40355 - DNA, 202 bp, Triticum aestivum
  Clone ID: PAT_TA_40355
ctcgaaacaaaccaacaaggacaaacattctctcctgattcggatccgacgggcgatcgacctttccatggggcgccgctctggaggaggaggaggcgactgcagctttctcaacgcgccacggtccgcagcccctgcacccaagcccgcggccaagcagtcgttcgccctggcgccgtacaaaaccgacagtagcagcgcc

SEQ ID NO: 40356 - DNA, 106 bp, Triticum aestivum
  Clone ID: PAT_TA_40356
cggacgcgtgggcggttttgcaaaagaatttgcagaacaactgtttcacggattgttttgcagaagaatcgagattcaatcagcaatgtcacttgttcctcaaaaa

SEQ ID NO: 40357 - DNA, 122 bp, Triticum aestivum
  Clone ID: PAT_TA_40357
atgaacaattaatgtacagttagcttcatctggcaaaaaaaaacgccgcatttctcatatagacatttaatgttacatatgggcgctataagtaaacatatttgacagtgtacaaaatccac

SEQ ID NO: 40358 - DNA, 195 bp, Triticum aestivum
  Clone ID: PAT_TA_40358
ggcgcatcctgatgaggtccaataggcacggatacctattccggttcttggacaggataggggtccaacacgcactttttattgaccacaagttatggctcgtttgctgatgctatgcacagctgcattggggaggtcaaaggaggcccgatctcatgtgcctgcgcaggaaccgtgcttgttgttgtacattgt

SEQ ID NO: 40359 - DNA, 274 bp, Triticum aestivum
  Clone ID: PAT_TA_40359
ttttgtttttttttttttttttggggaaaaacactctctaatttttttggaggaacttgacgagtttttagcttacaagcagaccagttgtgatctgtgaatggacgacggaacattttatacaaccagatggatttttttgatgggggcagcatatgggcaaaatgcttcgtgttatgcttatttagaggaacaaaataattccctcagcccaaatgaagaaaggaacatgttttgcgcaaaattaagcacaatttgcctacaaaattaaaaa

SEQ ID NO: 40360 - DNA, 198 bp, Triticum aestivum
  Clone ID: PAT_TA_40360
cggacgcgcgggaaaaaatactgtcgatctagctttgcggcgcggcaggaaaccagccagcactcacggcggaggagggaataacccactgcttcaggggcgtgaaggggctggacgaaaggggggcaaaagaaaaacgaaggcccattcgagctcccagcgatgaacatacagctgggtctgtgatctgagcacaag

SEQ ID NO: 40361 - DNA, 348 bp, Triticum aestivum
  Clone ID: PAT_TA_40361
cacccaaaatccgccccttttcccgccgcacgggccctaaaccctaacccagtcgccggcgcggcgccggagatgatgcagcaacagcagcagcagcagcctctgccgccccctccgccgcagcacccgccggcgcagcccggcggcggcggcggggacttctaccgcggcccgctgcagccggcgatgcggcagctctctgcggcgtcatccaccaacctcgcgcccgactacgccggccacccgggaccccagcagcaccatcagcagcagcaacatcaacagcaacagcagcagcagccgttcgacgcctatggggacaattttggcgctaagaggatgcggaag

SEQ ID NO: 40362 - DNA, 381 bp, Triticum aestivum
  Clone ID: PAT_TA_40362
caattatcaatatcatcaggaacactcatcaagtggacaaagggcttttcaatcaacggcgcggtaaaattcaaaacactacacagcatttgttgagcagttcctagcacattagttagcataagttccactggatattcttataaatccattgattcccttggcaagtttctggtggtaaaccttgatttcgtatgccaatcagaacttaagtgctgaagttatagtggttttgttcttcgtttttgtcaatcagaacttaagtgttgaagtacaaatagtatatggtatcgaagccaattgttggtcttaagtggtatcgtaagtttcatatgccaatcagaatttaagtgttgaagtacaaatagtatatggtatctg

SEQ ID NO: 40363 - DNA, 284 bp, Triticum aestivum
  Clone ID: PAT_TA_40363
tcgcgactatttggaaaaccagaataaagaaacaagtgtatcagctgggccctatttagatccagatccaacatcagatacacttgtttctttattctggctttggatctggatccaagaagggcccagcggaccttaaggagcgtacgcaggtctggaccacgagcttgccttcatcttgggtcctatttataaatacttgcgcttgtgctaagactgctagctttgtcatccatcgctgtccattacctggtgtaggaacaattttgcttattcattcctcg

SEQ ID NO: 40364 - DNA, 282 bp, Triticum aestivum
  Clone ID: PAT_TA_40364
cagagtttagcaatggcggccgggcgagcgtgtgctcttagcgcggtgcttgtggtggtggtggcgccgctcctcctggccggcgtggcggacgccgactgcttcgactactgcttcaaggactgcatcgccaaggacaagaacatgatcgactactgcaactacgcctgcgacaagacctgctacacgggcgcgccccagcggcccttggcggcggctgccgcccccggcgacatgggatgccagctctcctgcgccaggacttcctgccaccgtcttgat

SEQ ID NO: 40365 - DNA, 239 bp, Triticum aestivum
  Clone ID: PAT_TA_40365
aaaccaaggaccaggttaatattttcggcctgggaaataaattttatcaaactggaagcacaattctttgccgcaaaaccagtgaaagctataatgtatgattacacatacataccagcattgtaaatagagaataaccccacggcccaattccagagcaaacccgaaaaccctcatggctattgaagcgaataatacgcatgcagccatgctatgaccatttaaaaagattacacact

SEQ ID NO: 40366 - DNA, 389 bp, Triticum aestivum
  Clone ID: PAT_TA_40366
cccacgcgtccgcggccgtcccgcgtcacaaagtcgcggatcatggcgcaaaacagtacccaactaaagcgaaaagctcgccaagaaaccggccaaagcgctaaagcgaccgcacactgcctgccaccagcggcagcagaagaatagtaccccaactcggagcgaaagcaaagcttgccggcttgatcctcatcctcgaccggatgccatggttttcaccggcacgaaacttctgaatctttcatggagttttcggttctctcgccgagtggagctgcgctgagctcacgtgtgacataacatcacactcacactcacacccaccaagagcggccaggacgaatcccagtgatgtctccctctcggtagccggcctatatatacaggcg

SEQ ID NO: 40367 - DNA, 219 bp, Triticum aestivum
  Clone ID: PAT_TA_40367
agcaagattgcgatctagctcgatcgatcgatcaaatcctttggtcgggttctcattttggtctcctgtgtctagacctagattataatggctcctgttgttgaccctgcagaccccgcatccgataccaccccaggcctcacattttgtatcggtgtgaggatgatcgactttttgcctgacgtcgccggtgtatccctaacgtagacagatttattc

SEQ ID NO: 40368 - DNA, 337 bp, Triticum aestivum
  Clone ID: PAT_TA_40368
actatgttacaacggaatattctagaggatataacctaagccataacgccatgaatagcaccaggcatagcacaagtggctgctcaaatcacgctgagggacaggcaaaacgaaatttacaagcgacatctcatgactgatcttgcacctgtgatcgctcttttggcagggtactttggatggtacatttaccgttacagtgaccgcaactgagctatcaaatccattcacatatgcccactcatcaggccactgaacagaacatcgttctgagcatcacatcggggggaacaacgattggggagccgatgggtgtgcctatgtgttaaaaagggcg

SEQ ID NO: 40369 - DNA, 378 bp, Triticum aestivum
  Clone ID: PAT_TA_40369
cccacgcgtccgcccacgcgtccggataaacccctccatccgaaccaaacccaaacccgagggagccgccgcccgcggaatccaaacctttttccctccatccccttccttcccttcccttccccgcgcgatcgatcaatcgcttgatcgagcgatcggagccgatcggggagcagcggcgatcaggaatcgatccgtcctacgcatacaagatgtcgccggcggagatggagtccgacaaggtcgttgaggcctccggtggcgctggcgaccccaaggcctgcgacgactgcaacaccaccaagacgccgctctggcgcggcggacccaacggaccaaagtcgctgtgcaacgcgtgcgggatcccgtacaggaaga

SEQ ID NO: 40370 - DNA, 218 bp, Triticum aestivum
  Clone ID: PAT_TA_40370
cggacgcgtgggcgcacgcccccacgtactctcgccccgcccggacgacctcaacctctacctgctcctcctcccccgccgttcgccctcttccgttcctcgccgttccttccgagccttccgccgctccttcattccttctgagccgcccgccacgcccttcgacggaggagccccttcgtcgagggaaccgtcgtttagaccgttcctagagcccg

SEQ ID NO: 40371 - DNA, 377 bp, Triticum aestivum
  Clone ID: PAT_TA_40371
atgtagcaaacaggttccttgataaacagagttctcccaagatttgcatggtgacaggtaaacagacttcgaccaaaaccaaacatcagatcaatggagccgcgacggcgattgcctagctgttggtgtacgcgtcttcataatactggcgccgacgtccagctggtcctcttgcttgtgcttgcggcttcttctcttggtagccgttgcgccggtgctggtacggccggtgctcacgccctgcttgcttgtccccgtcgacttcaccggcatcacgcgcgtactgatggtaaggccgcttggctgcaggaaagtgtgcgccaggcggctcccggtgctgacgatacccgccgccctgaacttgttgcgccggaatc

SEQ ID NO: 40372 - DNA, 224 bp, Triticum aestivum
  Clone ID: PAT_TA_40372
cccacgcgtacgggagagtcaagctctccatctcccgcgccggggttggggcgctcctccaccgatgctgcgccgccgcggctgactgcgtctgtctcctcttcgggcgcgaccaccatgctctttcggcggctaacaccctctgcgactacgacgaccaaaccccaggcgagccgggcctttgcatctaaatatgcggtcactccttgactccaccaacgctg

SEQ ID NO: 40373 - DNA, 275 bp, Triticum aestivum
  Clone ID: PAT_TA_40373
cccacgcgtacgggaggtcaagctctccatctaccgcgccggggggggggcgctcctccaccgctgctgggccgccgcggttgactccgaccgcctcctgttcgggcgagcggaccaggcccctatcccagcttccaccctctgctgctacgacggccaatccctcgccgccccgggcctcctgatttgaataggcgaccattccttgctctaccaccagtactacattttagattcccttacaccgcctcaaccgagtctacaccctgccccca

SEQ ID NO: 40374 - DNA, 367 bp, Triticum aestivum
  unsure (1)..(367): unsure at all n locations
  Clone ID: PAT_TA_40374
cccacgcgtccgggaggtcaagctctccatctccggcgccgccctcgcggcgctcctccaccgctgcggggccgccgcgggtgactgcgacggcctcctcttcggccgcgcccaccgcccccctccgccggctcccaccctctccgactacgacgaccaagcccccgccgccccgtgccttttcatctcaatctccggccactcctccctctcccacccctgctccctctcagatcccctcggccgccccaacccgccgccacccttctncccttgccccctcggcttcttctcgtcccgccggcgcacccctctccgcgccttcatgcgcgagcacgccctcgcgtgctcccctgccaaaacccta

SEQ ID NO: 40375 - DNA, 194 bp, Triticum aestivum
  Clone ID: PAT_TA_40375
ctagggaagcaaatatttagggacaaggggggttttttcaccactttaaaaaacaggctcgtgtttagtcccacagggggacagaaaaaaaattcttacaaccggttttttttataccttaaagggccccggggggaatgtgcccggagaacagattataaatgcgggggggggggggggagcccccaaatggg

SEQ ID NO: 40376 - DNA, 248 bp, Triticum aestivum
  Clone ID: PAT_TA_40376
cccacgcgttcgcccacgcgtccggcaaaacatgcttgaaaaccttgttgtccttagtcgttcattggttttactatgatattgcagttgtaggtgcagagatcgactatgatatagcttggtacatggcttcctcatgaggaaaacaaggcaacattgtgttgaaacatattgcacgggaaaacagtaggatttctaggatgccacattatataaacaatgtaatgtgcttctatttattctagatc

SEQ ID NO: 40377 - DNA, 379 bp, Triticum aestivum
  Clone ID: PAT_TA_40377
tgcatcatgctttatttgagtgtctcaatgagtattatgttggatggcctacccaaggtagtcagtgggtgaccaagtatccggttgttgcggaagaatcatttaccagagacgaaaccgggggttgcgtgcttcatgccatcaggcactatgatggctctaagttgaagattccgctcacgaagtacaatgccgacaaaaccaaaaggcaagcactgcatgagtgcctcaaactacgggggaactcgtcgaagttggtgcatgatgcattttggacggcagtcttcgctaccgcgtcatacgtcaaccaaaacgtcatgctaccctactgtcggaacagtcgtaggagcacaacacgagtaccaaaaggtcttgcaca

SEQ ID NO: 40378 - DNA, 389 bp, Triticum aestivum
  Clone ID: PAT_TA_40378
attgcaaagatgaagaaaggtgtaatcttttctttgttgaacatgccagcagtcatggatacccaagctgttgctgatgcttgctccagcggccacattgctggatatggaggtgatgtctggttcccccaacccgcacccaaggatcacccatggcgctacatgcctaatcacgcaatgacccctcacatctctggaactacaattgatgcacaggtttgcttctgtgtttttatctcagcataggccctacccagccatatgcttttaacaaaactatggacgaattctaagtagtcactaatcagttattccgaatggattctgcatatggtaaccttgtgttttcctttccttcataggggagaagcaaggaataatctatatta

SEQ ID NO: 40379 - DNA, 390 bp, Triticum aestivum
  unsure (1)..(390): unsure at all n locations
  Clone ID: PAT_TA_40379
cccacgcgtccgcggacgcgtggggggctgcctcaatcccctccggcggcgtgcctccatccatcccctccggcctctcaccccgacagaacaccggcggccttcaagttccggccggtgtcggagacgaaacggcctatatttagatggaggagagggcggaggagatctgagcaagccgaggttgcgcgcgcgcgatggggaaaaagctacccccttctactccggcctcgtcatggacggagacggcgggaaggcggcgcaaaggcccctccttggccccgctctctgcctgcaagcgccggcggacccctgaggcaagcggctgggcttccctccccaccgatgtagttcacctcgtcaccagccgnctgctggccgacgacgtgg

SEQ ID NO: 40380 - DNA, 125 bp, Triticum aestivum
  Clone ID: PAT_TA_40380
ttagctgtagcgcgggatgacccgtttttttttgcccgttcccactggggctgtcatacttgctgatatctcttctataacgcaaatagcttattatatgatgacatcaataacgctatcaaggc

SEQ ID NO: 40381 - DNA, 231 bp, Triticum aestivum
  Clone ID: PAT_TA_40381
cccacgcgtccgcccacgcgtacggacttgttctagatcgcccgaaccggaaccacactgttctgtccaccccgcgaggagagcgaacgcacgtgccatacggacatgcctgtgacgccgaccatcatcggtgccctgctgctgctggacacccagatgtgctccaacgccctccgtaagctcccctacattctcgatgcccgggagcctgtgctgggaatgggtctgggt

SEQ ID NO: 40382 - DNA, 269 bp, Triticum aestivum
  Clone ID: PAT_TA_40382
tcgcccacgcgtccgtgggtatgatattgtttcaatgaatattaaccggctgggatgcggaggtaattatcacgccttaatgtttctacctggcattgaagtaacggctgacttacgggcaacaaggatgcggaatcgaactgggagtgttaatccatacatggctattaatcctatattcgagaaaggaatggcgggtttatccgttatgaaattttgctgaaaccttagaggttaaagcattgattgcttcttgtggacagttacaa

SEQ ID NO: 40383 - DNA, 291 bp, Triticum aestivum
  unsure (1)..(291): unsure at all n locations
  Clone ID: PAT_TA_40383
gtgttttggttnggcaaatgacgcattagctgttcaaactagaatggtggatttgatctgatctaccagctactggcactgtatatgtacgaaaagaacccaagaaatcctacccgccctgttctgattagggatcacaatctggaagaaagaaagaagaaaaaaaatgcaggggaaccacccgatcggggtgaaaatggatcgacccttacggctgacgttggttggttggttagaaggggtggtagctcccgcggaaggcgccggcgtttgcaaatagcccgaggagat

SEQ ID NO: 40384 - DNA, 346 bp, Triticum aestivum
  unsure (1)..(346): unsure at all n locations
  Clone ID: PAT_TA_40384
aagcgagaggaaagctctccaatcgagaggcatcaacggggtccacgacgcaggcttgtggtgctcccatcccatggcgccgtggctgctgctcccctccttcccgtggcctcccccgccccctcccggctcctcctctggccgcggcggcggaggcggtggaggcnacnncngagattggaagcccaacgtcgtcacggccatcgccggcgtccaccttggtcgctccctccgccgacgactatcgagtcttctctgcttgcctgaggtgcggtctcttgatgtcttgctcagaatttgcctctatttgtttttaggatcacagcctctagacacacaccacatt

SEQ ID NO: 40385 - DNA, 422 bp, Triticum aestivum
  Clone ID: PAT_TA_40385
caacttcttctgcgcgctcgggtacaacgtgacggcaatgggcaggttcaacgagacgcgctacgcgtgcccggccgtccccgtcgccgtgcgggacctcaactacccgtccatcacgctgccggacctcgccggcctgacgacggtgcggcgcagggtcaggaacgtgggcgcgccgaggagcacgtacacggccgccgtcgtcagagagccggaaggggtgcaggtgacggtgacgccgaccacgctggcattcggcgccgtcggcgaggagaaggagttccaggtgagcttcgtggcgagggtccccttcgtgccggcgcccaagggcgccggagggtacgggttcggcgccattgtctggtccgacgggccagggaaccaccgggtgcggactcctctggctatcaggaggcgcaaga

SEQ ID NO: 40386 - DNA, 408 bp, Triticum aestivum
  Clone ID: PAT_TA_40386
ccgcgctgctgggctacctcggcgacgccgcgggcgtcgaccgcgtccccgcgtggatgccgctcgtctactccctcgcctccttcgtcctcgggtcgctgctggtggcggacgcgtcggtcagcgacgaggagtgggacgagtgggtcgcgcggcgggagcgcggacgccacctctcgttcctcgagtacgacgaggcgctgtggcacacggagcgggggcagcccgacgcagaactcgcttgcagagaagggccgcaggatcagggagctcaccttcgttgatcataagcgctttaacttcccggaaaacggcgttgagctttacgccgagaaggtcgacaaccgtggcctttgcgccaatcgcccaagctgagtcacttccctacaagcctcttggaagcctttc

SEQ ID NO: 40387 - DNA, 215 bp, Triticum aestivum
  Clone ID: PAT_TA_40387
ccccggaggcccggcgcagtattcccgggtcgccacgcctcctccgagcggtcgaagatgggaagggttccacctttaccttagagaaaacaaaacgggtgatttttacacgtgtattgcacagcgctcaacgaatcggatgcttatttaccgctggatgcaccttcttaacgggtccagcctgacgctacaccccccaggttcaactacaaaac

SEQ ID NO: 40388 - DNA, 343 bp, Triticum aestivum
  Clone ID: PAT_TA_40388
gttatagatggtaacatgcctctcggaatctacaaatttttcaaggtgggggggggctattatcttgaacccttaaaactacgctgtcatggatgctggtgctgttcctgtgttctcatatgacattaaggtggtgctgctggtgagggaaaaagattaagggccatacggttgccatttttatcttttctatagtgtcacctaaaatcaataaactgggcggggagatactgtaagaattctgataagagacgccccttatcagaaactataatgatggtggtcaatagtgctttcaaccggtggttaattgacgtagaggtcctcaccgattggctttatt

SEQ ID NO: 40389 - DNA, 115 bp, Triticum aestivum
  Clone ID: PAT_TA_40389
aaatcatgtacgtagattcatgtgcacgccgtgcttttatcttgtttaggattctagttttgtactccataggatcctacgattatatttgttctaatttagtggagtttgatcc

SEQ ID NO: 40390 - DNA, 388 bp, Triticum aestivum
  Clone ID: PAT_TA_40390
ggggactgtcaaattcttggagacatgtagaggtagcgtcatagggcaatgagtcatcaagaaagggtgttatgtacaccattgcactcttttgtcatctgtactcttttgaagtcatctgtacccttctaaattagcttatcttggtatagaaatcctgctcgaatacatttagatcaaagttttaaatagcccggtatagcttccctgtagcattgctatagcttttgaagggcccttccgcaaagccatgcacttttactggtaaattacagatgaccgtaatagcttgctattttccgctataccgctaaatttgaagtcatttagcgccggtaagctactgttgggccaaaaatttctgcgcttccaaaatcacatcgcagcg

SEQ ID NO: 40391 - DNA, 177 bp, Triticum aestivum
  Clone ID: PAT_TA_40391
attttgggggtctttaggagggaactaagaggttttggagataacttttgcaggcagtttgaaaacagggttgtgggattcccttcacaattaggaaacttttccaagttcctgaaagggattgagaaaaggcttgggcggatttaaagggtggaaccaaaggttaccccacatttt

SEQ ID NO: 40392 - DNA, 171 bp, Triticum aestivum
  Clone ID: PAT_TA_40392
ctcgctcgcggccgatctatagtatccaagcttatttgcgcgaacaacccatgtggggggtgttttatcttgtgcctcaatacaaattacttggcctatgtttagatcatgatcactggaaaaaccttttgcctactcatcttaaccttctgacaccagattcccctttct

SEQ ID NO: 40393 - DNA, 409 bp, Triticum aestivum
  Clone ID: PAT_TA_40393
tacacatgcactcctttggtccaggtggtgtccatgggatccaggtggctgtacacgtgcacgtccgacgtgcggatggcgtccactttttgttaaagggtccaaaataaagcgtctcagtcaattttaggttgagaataataaaacaagccgagatgtaaaaggcttgtttttaggtgttaggtttgtgttgcgtcgagtcatggttataagttggttaggctgcagctcgaggacaagctgcatgtccaggtggggtgtagtgttagagtacgtaatggtcctaatgggcccattagtcttagggtcgcttacttaggggtcaagtaagtcttgcttgggagtcaagtaaacctctctatataaagagaggagatgtatcaatctaatcaagccagaattaagaagg

SEQ ID NO: 40394 - DNA, 369 bp, Triticum aestivum
  Clone ID: PAT_TA_40394
gcttcggtcagctgctaatccttcacaatagggttatatttgggtgtcagtagaattgttccaggagagatggggaaggagcgtgaaggccacatacgatgcgaggtggtgagatcgtcttgagttcaccacggggaatcatggcggagacacacgcagtgtaccattattaatttgagtttgttattatgagcaggagggttgtcacttatgggaccagcaaactttattcgttaatattgtcattgcattttgtagagagaaagaggggactggtaagaataaggtaaggctgtgctgctgctgtatgtgtttgtatatttataacaagtgttggatttttttggaaagacctgttgattgatgttg

SEQ ID NO: 40395 - DNA, 280 bp, Triticum aestivum
  Clone ID: PAT_TA_40395
atggggcggctgcaaaagcaaggctgatcgccggagggagcgccagtcacggggggttgctcgccagaagcattcgatgcaaggcctctcaccggaagcatctgatgctattgacggcgccacttttagggggaggagaaataaaacctgccgtggtgagaaaggcttgttctctagcgcaggggttgggatgcgctttgaatttgaaataagtagctcatgttgaaccatgtacactcgatgcttcttacggaagttaatttcattgacctatataaat

SEQ ID NO: 40396 - DNA, 394 bp, Triticum aestivum
  Clone ID: PAT_TA_40396
aaaaccccagacctgatgtagccaaagggtggagttgccgtgatgtagccattggaaagggggaaaagatttgggcgttcgtgcgccggccggaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaaaaaaagggggggggcgtttggaaattaaggaccccgggggggggggaaaaaaaaaggggtggggaaaaaaacttggaaattcccttttttggggggggggggggttcttaaccaaaattggggggtctaaattggcgggtttcttctaagggaaagggttgatttccaaagaaaaattttttt

SEQ ID NO: 40397 - DNA, 259 bp, Triticum aestivum
  Clone ID: PAT_TA_40397
gggcactacacatgcttacaaaatacaaatcgatcgatacatatatatactaactgaaaacaaaacagagcaacttaaaaaaaacagaggggaaaaaagaggcaatggcacattctaattcatcaagcagggatcaaatggtgaggccatccgtccactgattagcaaactagcacccgacggtgaaccaccttcggccagccgacgcccggccggtgcgctccgcctttcttttttcctcctcgcacgcgcacttggc

SEQ ID NO: 40398 - DNA, 333 bp, Triticum aestivum
  unsure (1)..(333): unsure at all n locations
  Clone ID: PAT_TA_40398
gggggacccacgcgaccgcgcccgacacgnccagcccccacggcgcgaggaaccnacaccaaccaacccgcggagggcaccgacgacagcccgcaccnccgaggcaacgaggacggccccgcccacggcaaccnccacgacggccccagcgcgcacaccggcccgcnccgcaacacgccaanncacggccaggcgggaacccgcggcgccaacggccacgacgccaaccgcagcgacggccacaccaaggacggcgacgccaacaacaacgagggcgcgcccaccaccgcgcccgcccacacgcacaccggccgcaagaaggaggccgacaag

SEQ ID NO: 40399 - DNA, 380 bp, Triticum aestivum
  Clone ID: PAT_TA_40399
gacacttcaaccatgattgatagacgaatatgcaatgagttcacttctcacaaaacaaagtgttgaatttacataataagttcacagctcaaaaaatatatgagctcacagctgagagaaattggagaaattgagttcatataggagatcggcggcgtcatgacgtccaggagatgggggtggcgtccagcgattgacccaagaagtccaggcaatcagggaatgtaccagcaaagaaggcaatgacttccatatcacccatatcatgaatttttcgactgcgaactgtatgatatcatggactctcatgtattggcacgggtctcgccgatcttagcttggcaacaaaacataccagcgtgcaaaatgctctacacggt

SEQ ID NO: 40400 - DNA, 420 bp, Triticum aestivum
  Clone ID: PAT_TA_40400
aaactctccattcccctcaactcgactccgtcgtctcccctccatttcgatcatgagcatcccggtgaacgggcagtcggtggtgccgccggggttccggttccaccccacggaggaggagctgctcacgtactacctcgccaagaaggtggcctcgcagcgcatcgacctcgacgtcatccgcgacgtcgacctcaacaagctcgagccatgggacatccaagagcgctgccggatcggaactggcccgcagaacgactggtacctgttcagccacaaggacaagaaataccccacgggcacgcgcaccaaccgcgccacggccgccgggttctggaaggctaccggccgggacaaggccatctactctgccgctggctccggccgcatcggcatgcgcaagacgctcgtcttctacaa

SEQ ID NO: 40401 - DNA, 215 bp, Triticum aestivum
  Clone ID: PAT_TA_40401
cggcgcttggaagcaagcgtgccacattcatccccagagtgcccctatagatcgagggaagatgttcggcgtgggcggcatcttgagctaccttactgggggcctcctcgttcctcaccttaagggttacgtctatccttatgcgcaagaactctcttgactttaacgactttagctccaccgtcatggacggcatcacctaacttctctgtcgt

SEQ ID NO: 40402 - DNA, 294 bp, Triticum aestivum
  Clone ID: PAT_TA_40402
agtggggggtttatttttgagtttttgtttttttgactattatgtttgttaatggtcttcttccacctccttaaaaaacgaagatccggatgctgttctgctgttgatgttggtagctgtaaaaacagaagaccgcggggatgagcttgccaaggcctttcccggtcttggacccaagctacaaggtccataggatgtaggtcgtcaggttcaacccgcaccacccgaagaagaaatcgggcatggttaggctttccttccgaaggagaacgtacgagggcgatgaaatgaccg

SEQ ID NO: 40403 - DNA, 291 bp, Triticum aestivum
  Clone ID: PAT_TA_40403
gcgagctttcttcctttgggggttttttttgattaccaatctttttattcacttttattttttatattattttttcatgtttttaccacagaccaaaaaaagtgggggggttttattaagcggaaccactgaccgtccaagttaagcgccgccaaaaaatatacaaaagttttattgcaaaaaagttctacagacataaaaaaaagcgctggaacgcagacatgactaaaactaggcgtcctaatttgagcgcggaggaggaatcccctatatgctgggggactcaaaggc

SEQ ID NO: 40404 - DNA, 425 bp, Triticum aestivum
  Clone ID: PAT_TA_40404
cccgcctcctctcgtctctaggaccagttcccctttgtcgacagtttacttgccttgtcgaaatacaaggaaatcagattctcgacacagaccgcactgcgcaatcgaccgggtctcctatcgaccgggtgcgaggtccgtcctgtgctcggatgttttcagactatctatcagagtccaaggaagattcggggataaagaacatcatggtgcttgaacgtgggttcaatggatgggagatttctggccaacccgtgtgccactgcaaagatgctccttgcaaaggcacatgctcttgatcttctggattaccatctggtccatttatactcagcttttgaacgatctgcaattcagcatcgctgctgagctggtcctttctcattgagatgatgatgcataacaatccattgaattccgcaatg

SEQ ID NO: 40405 - DNA, 366 bp, Triticum aestivum
  Clone ID: PAT_TA_40405
agtgctcagcaagtttcaccattggattcttctcatcatagcaaaatgagaatgtctgattaacaaaatgaaaaagattacaaaaatgctatacatcaacagccttgtctgcaatgcctgaattacacaccctgatcagtaacgaatcaacttgcttgctgctcgtcaagtgttgatcgatcggttacttcttgccgctaaggatgttggccctcatggtctccagctctgccatgttggcctcgacgccggcgaaggacggctccgggatcggctcctccaccatctgcgacagcctgacgaggctcctgcaggccaacacggcgcgcgcgtccatggtctccatggccctcaggtagaggcact

SEQ ID NO: 40406 - DNA, 259 bp, Triticum aestivum
  Clone ID: PAT_TA_40406
ccttctctttcgggcgtaccgcgctgcgagcagcaatggcgttggccgcggccgcgcgcagaagcctcgcatccggtggcctctccggtcccctcgcccgccgcctccatccgtcactccctcaactgcttccatccaactccaccggcgatcctcgaaaaccctcgacccttccacccccacccgcaccacgaccggttcacttcgggctcgcccctggggggacattccaaaccctaagcttccccccatgcggtct

SEQ ID NO: 40407 - DNA, 255 bp, Triticum aestivum
  Clone ID: PAT_TA_40407
cgaaccggaaggccggggtacgacccacgcgtacgagaaccaaccggcgggggctgtaatcctaggcgcacctccctcccctggcggggcacccgagcggcgaggccgccaccgcatgctgtctccccaatgtacctcctacttctcgcgatagggtatggtaaagcggattcatgccgaagtcgaacggactgaaggtgccacaacgcgcgacgcgacagccccgcggggaagagccctacaaatttgtagggg

SEQ ID NO: 40408 - DNA, 358 bp, Triticum aestivum
  Clone ID: PAT_TA_40408
ggctcgtcgggtgcgcgcgggacgtgcggaacgcagtaatgcggttgggctcgtcggccgcgtcgggtgcgcgcgggacatgcggggcgccgagggacgtcgggcgtgtgtcgccggcgaagaagaagctcggcgtatgtcgccggggtcgtgacggagcacggtgcgaccggcgtcagtgcgccaggtcgggttcgtggcggtgcaaccggtgtcgatgcgccgggtcaggtccgcgggctgggtcacggccgtgacgacgacaatgacaagagctgcaataactccaacgacggcgagatcatggtttaggcggagtatgttggagtaaaccacattaggtgcgcgcgtgggtgcg

SEQ ID NO: 40409 - DNA, 228 bp, Triticum aestivum
  Clone ID: PAT_TA_40409
acagcacgtaatttaaagcacctctggcctctccccagcgcccgatcttctccccgcgcgcgcctaggttagtgtttggagccccctcctcctgtcgtcctcctgccgcaaccgcatctgctcgccatgagggtccacccggccccgtggaagcgcaccatcgccgtgcagcgctgcgccgcggccgccctaagcgcagcgggcggagccaataagctgcggcgcctt

SEQ ID NO: 40410 - DNA, 212 bp, Triticum aestivum
  Clone ID: PAT_TA_40410
agactcgtgatggaatagaacaccagccccccccctctatctcaaacttgtgatgcgggggcatgtttgctttgttgcacaaactagccatctactaatctacgacagcataacattccttatggagcggtagtgtgatgcgtctgaatcatagccaaataccaattgtttaagcgatcatacttattagcaaaacactgacgtgcaaaatc

SEQ ID NO: 40411 - DNA, 433 bp, Triticum aestivum
  Clone ID: PAT_TA_40411
cccacgcgtccggatcgatcaatcgatatggctttctcccatgggggcacatggccggtgacccctgcagtagttctgctaatgggcggcctgttcgccgccttccctgcggcgtccggcggccacgtcgacgccggtgacatgctgatgatggacaggtttcgccagtggcaggccacccacaaccattcgtacctcagcgcggaggagaggctgcggcgcttccaggtgtaccgaaccaacgtggagtacatcgacgccaccaacaggcgcggcgacctcacctacgagctcggcgagaaccaattcgccgaccttaccggggaggagttcgtcgcaaggtacgcgtcgtcgcacgaagctggcggtggcactagctcggtcatcacgacggcggccgaggctgacggcatgtggtcgtcgggcggtggca

SEQ ID NO: 40412 - DNA, 262 bp, Triticum aestivum
  Clone ID: PAT_TA_40412
gccacatacaataaccacattttttttgaaatgttcccctcaacaaaaaatgccgtttttaacagggtttaaaacagggaaatttccctgtttgaactggtgtttgatttaagcaaataatgcaaatttgcgggggcttctggggggttaactgtttgcaaacatgccacgttggggagcctttccccgtgcaggttggtcaacccaacggataaggaagccccccccggaagggagatgcccacccacattgatccccaat

SEQ ID NO: 40413 - DNA, 424 bp, Triticum aestivum
  Clone ID: PAT_TA_40413
gacgaggcaacccgccgccacgccgccggtggcaaaatcatcgatacaacggcggccggccgccggctttttcgccccatcagcggcgaagttttaccgcgtgactatgtaaatgcctgcatttcggcaaaatgttgacggcataaaaatctgaccgaagctttctgctgagggcgagcggcggaagaacaggcagtgtcctgcagagaatcatcctcatcgtcttcatccatgaggtccgacgtgaggaaggagtcggtgtcggagccgtcacccaaggaatcaaatgaggaagagaagccagaggagaaatcactgtcagaggcttctcctccttggtgatccatctcctgtctgttgtctgttgatgccacgaagtttgcaaagtgcatcgcccagctgctctcgccggccgacatggacg

SEQ ID NO: 40414 - DNA, 370 bp, Triticum aestivum
  Clone ID: PAT_TA_40414
agatgccctcatggcacgtaattcttcccccacccggcccgtcaccaaccggcataaatacccacccctcctcgcctccgaagtccaaactcgccaccgcccccgggaacggaaccaacaaatccccaaccaatctcgtctccgatcgactccaggctcgtcgaatccccaccgcctcaagatgcagatctttgtgaaaacactgacgggcaagaccatcacccttgaggtggagtcgtctgacaccatcgacaatgtcaaggccaagatccaggacaaggagggcattcctccggaccagcagcgtctcatcttcgctggcaagcagctggaggatggccgtaccctcgctgactacaacatccagaag

SEQ ID NO: 40415 - DNA, 425 bp, Triticum aestivum
  Clone ID: PAT_TA_40415
cccacgcgtccgcccacgcgtccggatcaatcaaataattcaagtaccagatactcaagatgtccataaccggggacacgactaatcatgattagtttgtacactttgtaaaggtttgcgcccttttccccacaagactcgatctcgtccgttgtatttctcgcactgcatgatgtttgagaaacggatgaccgagacacagtctttccgaagaggtccacttaaccgatagataggccggtacacctacaatcccctacatctcctagcccatcatgaaaaaggatttccacaatttactcaactatgccagagcccataatggcttgtggctgcacacggaagtttctagcatgaataatcttatgatccctttgagcctgggtggcattccaataggataatcacacagatacctcgggatc

SEQ ID NO: 40416 - DNA, 324 bp, Triticum aestivum
  Clone ID: PAT_TA_40416
ggggcaaacttttctccactttcccacctgtatcgtcacctcacaaatgggcaactgacatgtatccatgaattaatatataggagcctaaagccatcaaaccttcagacacttttcacaaaaaacaaccgaacagaagtcaaaatattatagtatgccatccaagattttagtatgtctagttttggaccagccaaacatgctctataatctatatgaccacccatgtatacagaggtaaaaagaaccgtaaaacagtctttagttctttccatcacatgaagcattccctttttcactttctttctttttttggcttcaact

SEQ ID NO: 40417 - DNA, 326 bp, Triticum aestivum
  Clone ID: PAT_TA_40417
cgcctcgcgcccgaacctgaggatggtatgctcaagaggctgtcctgagaagctgggaggggctcccaaagttgctgttgacaacaaggtctatgccaaggcccaggctgtcaaggttgccaaggttgtgatgttcgggtctatcaagaggaccgcatagaagatcctcacgtctgttacattttaccgccccaagaccctcgtcaaggccagggaccccaagtaccccaggatcatcacccttggcaggaactagttagaccagtacctgatacttaagaacccgcttacccactgagtctgggatgaaaaagattgaagacaac

SEQ ID NO: 40418 - DNA, 431 bp, Triticum aestivum
  Clone ID: PAT_TA_40418
gtttaaagaggacgtatcccacgaggccacgacgatggccgcatcgggaggctcttgcggcgggtgcgcgtggccggacctccagccggagatgttgggcgtcgtgctctcgcgggtgccgtcgcacgccgaccgcgtccgcctcgccgccgtctgccgcccatggcgttccaccgcgcggctgctgcgtcctcttcctcgtgcacggcgacggcaggctctcgcgggggagctgctacccccgctgctcccgtggctcgccctctgcgatggcaccttcctcagcctccccgacggcgccgtgcaccgcctgcccgtcgcggatgacgcctcgagccgagtctccaccggcagcgcgctcttcctcgtgcacggcgacggcaggtgctgcctgatgaacccttcccccgtgacgacgagccccgtccccg

SEQ ID NO: 40419 - DNA, 290 bp, Triticum aestivum
  Clone ID: PAT_TA_40419
gggaccaaacaaaaacaacccatgaaaattgctaatccagcaatactaaaaaggggctcaaaaaaaaaaaaaagtttgaaatttgttaataaacaaaaaagggacgttgtccaaatgccccccctaatgactgtagcccaataggaacttaaactcgccaccctttgaatagaaccattctaccacctcaatttcaatttccatttccatttttaaagccaaccagaaaggatccttccttgggcgttccaacaaagccaacaataacaggggcccgggctgttgtttta

SEQ ID NO: 40420 - DNA, 431 bp, Triticum aestivum
  Clone ID: PAT_TA_40420
gatcggtatgcattggaccggttgaagctcgcatgtgctcagaagttgtgggaaggtgtgtcggctgatacggttgcggatgctttagcttgcgctgagatatacaattgccaagagttgaagagcaggtgcattgactttgttatggcaaaagataatttcaagaagactgtgttgactgaaagtttcattagcttgttgcataaattcccctctattcgtgctgagctgagagcgaaggttgggagttgagacataggttagtgggatgcatctccacttatgtttcaggcgtcaaggattgctttagtacggttttatgatattttgggcttagtttagggactactatatcatatgggaggttgatttcaaactgttccttttgcagcactggattagacgaaaaaaatcgttgccaagtgatactg

SEQ ID NO: 40421 - DNA, 339 bp, Triticum aestivum
  Clone ID: PAT_TA_40421
ggggaaattcttcattcaaattacgaatcagtccaaagtagttgacttttacaagcccactgaaacgcaaacacaaaggaccatgaacacctatagtcccctaagacaaccataacacaagaggatctccggagccctgtgtcatcatccctgaatcttgagagaagacccctgcagcaaaagaatttgcaaccagtcgcaaacaggtcatcatttttgaccacacaaaccgatcgaccgatcaccacacgtccacaccacagcagcagcatggctaccaccagtcatgccctcctaatcgccctggtggtcctcgccggccttgccgacctggaggcc

SEQ ID NO: 40422 - DNA, 429 bp, Triticum aestivum
  unsure (1)..(429): unsure at all n locations
  Clone ID: PAT_TA_40422
cccacgcgtccgcccacgcgtccggagatggaggcggcgccgatggaaccgctggtgccggcgccggtggctgtgatggctgcgccgcccaggcggaggcgcaggtcgatgcgcgtggcggcgcctgcccccgcgccgccgccgncgatgctgagcgcgttcgagaaggagcaggaggacgtcgcgctctgcctnctgatgctctcgcgcgactccaccggcggcatgcggggctcgccggcgccgaagcaggcgcacctcccgaggaacggctacggctacaattccgacgaagactcagctctgttccagtacggcgacgccaagaccaagagcgtggccaagagcaagaagcgaaggaccagccattacgctctcaactccgcctcgccgaagcaacggggcgaggcggcgccgccaccggcgaag

SEQ ID NO: 40423 - DNA, 179 bp, Triticum aestivum
  Clone ID: PAT_TA_40423
agacaataatgtttccagtttggaatttttagttttaacttcctagtcttttcccagggggtgctttttggccatcaactgaccaatgaatttaattttttctactatgggtggctctaagttcttctataatgttaatgttggaacctatggaaaactaaatgccagtacttttcagt

SEQ ID NO: 40424 - DNA, 305 bp, Triticum aestivum
  Clone ID: PAT_TA_40424
aagaccagatgcctccgtgaggcctgtcgatcttggtaggcttgtaaacaatgctatgggtagagatggcgaaactgaagcctcacttgaacctaaggattcacagagtgcgactagggactttatggatgacaatactgaagggctcgcgtgcaggaagcccactcctctttatgggacgactgtgggcacacctggagccgaattttaccacgcacttaaagaaatatcgagcgatggggcaactctatcttccaatagtatcgatgaccaatgctgcgaaacgcctcataacatgttgacag

SEQ ID NO: 40425 - DNA, 427 bp, Triticum aestivum
  Clone ID: PAT_TA_40425
cccacgcgtccggttcgccatgtgcggtggcagacggcgccgtcgcggcggctctgacgcgacggcaggagagcccggcgggtggggtttctgcgcgccagcgctcgccttcctggccctggcggccgctgcggcggtcgcgttcctggagggcaccgccggcggcgtcgcctacgccggcgacgggtggttccacgagtgcgccaagtgggacgccgagggcgggaggttcctggtgtccaccttcttcggcgccggcgtggccgaggtgcgcgtcggggcggggggagaagaagccctggcggagcgggtcgtggtggcggaccccgaggtgaccgggagggtggcgctggggctcgccgtggacgcgcccaggcagcggatcctcgtggcctacgccgaccggcctccgagcttcgggtacgcc

SEQ ID NO: 40426 - DNA, 228 bp, Triticum aestivum
  Clone ID: PAT_TA_40426
cggacgcgtgggcgacaagccgtccaactatggcgccaagctggagcaaagtgcttagaactaccttttgttgagctaccggcaggaatcgactaatgtaacttttcattttttggaccctttgatcttcggatctacgccatgtgtttgcttttcccattgcttcctgcttaatatatgaatgccggcagcgctggatctttcaaaaaaaaaacactctccttatgt

SEQ ID NO: 40427 - DNA, 147 bp, Triticum aestivum
  Clone ID: PAT_TA_40427
gggtgccaacctgaataaagaagcttgattgaaaattacgggttacaccatggatagacaacaaggcacttgttatgctacatcggacattcgttcatggcaaaattgactggaggtggcatcctctgacgttatggtatctagaca

SEQ ID NO: 40428 - DNA, 130 bp, Triticum aestivum
  Clone ID: PAT_TA_40428
aggcccagatgccttgctcaggcctgtcaaagttcgaacgctcgacaactatggaatggcgggacatctcgaaaatgatcccttccttgaacattatgattcacacagtgcgactagtaacactgacgct

SEQ ID NO: 40429 - DNA, 383 bp, Triticum aestivum
  Clone ID: PAT_TA_40429
gattcttgacgaggctggttgatgcaagggataacctgggacgtatttgaattggtgagattcgattcattgaagcaaggtgggattattcgattcgatgtacaatcaatctacgacggactcaattttgagcatggatacaggacaacgaaaatcgaacatcaaacgcagcgaaacagatagtaccaccttgaatagtaaaaatatatcaagaaatcaacatatggagaactatgaaatcttctttactttattatgaggtaaagattcgagcctatagttacacaatttaaccttatttgcattttcccatggggatattaaaccttggcatgttgattagcttttattcagtcactccctctatttcactattactggca

SEQ ID NO: 40430 - DNA, 434 bp, Triticum aestivum
  Clone ID: PAT_TA_40430
cccagagctacccatcatcttcttccctccacaaacatctgctccatccagcagctagcttgcaatggcgcctcagaggcagcagcagcagcagcacaaggccgccgtgatcgccctcttcctgctgtccgccctcgtggctgcgcccgccgttgctgcttccaggcccgaatccggcggttacgcacccgccacgccatccgaggccgcgacgccggccgagcccgccagcagcacgcccgccgacgcggcgtcaccctccaagaaggcggcaggctacactgactctacgccagccgagccctccgccagcacgcctgccgatgcggcgacgcccgccaagaaggcgggaggctacactgactctacaccggccgagtcctcagccagcacgcccgcccaggcggcgacaccgaccgatgccgctgccagca

SEQ ID NO: 40431 - DNA, 426 bp, Triticum aestivum
  Clone ID: PAT_TA_40431
gaaagagaagaaaaggccggcagtgtgaggctccggccaccaaatttcttgcgcgtccattgttgtatatgtgagctgtgagaggcagccaccgaggtagaagaagaagaagcggcgctgcgggaggcggcgccaacatttggtatcaaagccttgtcgatccgaggcgacggtggcggcgcggcagactccatgtgagggggacgttggcggcgcaaggtgaacgccgttggcggcgcgatgctgctagcggccggtgcgtgtctccatcatcgtcgagttgcgtcacgagcgatggagaggggtgtgctgcccggtaagttgcggcatcggcggcaaggtggtgatggccatgcgtggaggccattgccataaggagttccatgtccgagtcttcgataaggtgcgtcatcgtcgacaacatgg

SEQ ID NO: 40432 - DNA, 332 bp, Triticum aestivum
  unsure (1)..(332): unsure at all n locations
  Clone ID: PAT_TA_40432
cttcccccaaattccccacgccgcgccgcgccgccgatcgagcgcagaatcccgagcgccgcccgcgatgccgaagaagatgggcgtcaactccaaggcggaggccgcccgcgagcgccgctccgccgaggagtcggaccgccgccagcgcgccgagcgcgccaaggaggaggagtactggcgcgaggccgaggggtccaagtcccgcgccgcgcgccgncgcgaggaggaggccgagaagcgcgccgaggccgccgcccgcaaggccgagaaccgccgcctcgccgaggccgaggccgccgccgtcgccttcgccgtgtccaagacggacg

SEQ ID NO: 40433 - DNA, 415 bp, Triticum aestivum
  Clone ID: PAT_TA_40433
cccacgcgtccggcgagtcataagctttcgttgactacgtccctgccctgggggggagaagaactgcaaggccaatatgggcctgtggacctacaatatctacatctccaaggtgttgaagcaggtgcacccggaccattgaatgtgctgcaaggccatgatcataatgaactccttcatcaacgacatcttcgagaagctcgcctgcgaggccgtcaagcttgtcctctacaacaagtagcctaaccattactctcatggaggtccagactctcgtccgatttgttcttcccggggagctcgtcaagcacgctctctctgagggctccaaggccgtttccaagtttacctgctcgtatattctattctttgtagaatttttattggtctgctatttttagtggttgttgtcttc

SEQ ID NO: 40434 - DNA, 213 bp, Triticum aestivum
  Clone ID: PAT_TA_40434
aatataattgcaatctttccctaaaaaaatgctgggtgatgaactcaccactcacaggatccggaccgagtgtttagtacatacagtatgcctcacgaaccgaatcccgcaagcaatgaacatccatcttattctaaggataagccaccagtggaccatttggtactattctggcagcgccctctttttaccggatgggattttaacacaatc

SEQ ID NO: 40435 - DNA, 414 bp, Triticum aestivum
  Clone ID: PAT_TA_40435
aaaaactgatgaatatggcgatgttgaaaatcgcgacctctccacttctatttctggcgagaggaaaaatgatgagatagacaagatggcaagctattatgaacaaatagcaaatgagaaaagagctgctttccggggacgttgattgcaaattatctaccacgctagtgcaggagcgacactgttgactgatgtcacattttggggactccttgtgccatgatcttaccgtgataagtttgggctttccatggtcactgatggcatgcactctggtaatgctgctctcctactcatagacacacttcttaacaatatgccttttgcctggtaccggatcgctttcttggtattttggaggtgcttctatgtgaccttccagagggtcattcatgcttacggagctgtatcctg

SEQ ID NO: 40436 - DNA, 433 bp, Triticum aestivum
  unsure (1)..(433): unsure at all n locations
  Clone ID: PAT_TA_40436
gaaaagcagcagtccgtgggactgcagatcctcatctccacgctggagcactcctcccagcactctaccggggcgtacacggacacgaccgagtcgggtgccgtcggccgggtgccgacgccgctgggcctacctgtcgccatccccgacgaggccgcgacctcgcgctcggcgatagcatcggcgcactctgctgtcgaccggttcaagggcgtggtgccgcagaccaacgggcggtggggcgcccagatctacgatcgtcacgcgcgcgtctggatcggcacgttccccgacgaggacgccgaggcgcgcgcctacgacgtggccgcgctccgctaccgcgggctcgacgccgncaacaacttcccgcgcacgggcgcgtcgacggagctcgacttcctggcggcacactccaaggccgagatcgtcgaca

SEQ ID NO: 40437 - DNA, 173 bp, Triticum aestivum
  Clone ID: PAT_TA_40437
aggcccactcagtgtcatctaagtttaagggcgtagtgctgtagcccaacacggggtggggcgcccagatttatgatcgtcacacacgcgtctggatctgcacgttccccgacgaggacaccgaggcgcgcgcctacgacgtggccgcgctccggtaccgcgggcttgacggt

SEQ ID NO: 40438 - DNA, 359 bp, Triticum aestivum
  Clone ID: PAT_TA_40438
cgcaagcggccgacttgttttagatttttagcaaactgactggagagtgggttagtattggaagcgctcattatatatatacaggaggtaattgatcaacttcataatcaggggctcgtgccaacgcagggcagatatacggtgccgatgagccacgcggtgccgcacactgaatgccacgcggttacaccagggacagggcactgcacggcccacgccattcatcatggcaacaccgtctacgcagagggcgcggcctccaacataggcgaccaactaacctacgagctcgtcttagaggatgcaagcttaagcacggctgcatacgacgtcaaaagcgcgctctagttgctcctaaa

SEQ ID NO: 40439 - DNA, 293 bp, Triticum aestivum
  Clone ID: PAT_TA_40439
gctagacatacatagcgataggcctacatttttagcggccctcctttttttttcggggggggttgcttcagttttcggggtgtttaatttacatcccgaacattcggccaatctttggcaaccaaaaagggtcgtcactagcatgtattcctgagcgtggcaaaggcacattccattttcccaatagcatggtgacatgcctgcacagacaaaaacaatcctgccaaggttccgggttagaataaaaaaattaagtccgacatcagcacacaaattctttgatgagacaaacc

SEQ ID NO: 40440 - DNA, 389 bp, Triticum aestivum
  Clone ID: PAT_TA_40440
gcagcaaatgaagctgcagcaggagcagcagatgaagctgcagcaggagcagcagatgaaggagcagcgaatgaagcagcagttggctgagcaggagcagcaaatgaagcaggcggctgagcaagagcggcaaatgaaaatgcagcagcagcagcagttggcgttatcagacgatgacgagggggattcgtttgaggtggagagcatcacgaaacaagtagcagcggcggcggcgggcaaaaccaagcagcttgagacagatcctgcatacgactacagcccgtcaaagacggagaaggcagcatttgcccagttacctcctccggcgccgccaaataagctgcagacgatgcggggagtgttctcagaagaaagacgcgatgagccat

SEQ ID NO: 40441 - DNA, 422 bp, Triticum aestivum
  Clone ID: PAT_TA_40441
cggacgcgtgggttcgccgcttacgaggatagaaggctttgttagtctgtttgcacaagctaaggacaaacgctttttttcgataccatcaagggagctactgagatttctcactgtgttcccttttatagaacacattaaaatgaaagggggggcgttgcagaagagctcctggaactggatacagcagctctttcaagtgatctggaaacagaatttcctttcattactctcaacacttacatgtgttcggaactcatttcttatccatatccagaatctgaattccacaactttgaagaagaccggtcatgtgagaagtttgaaagtggccaaatttgggctctctacaatgacgctgatacattcccgaaagtgtatggctgggtgagcaaagttgagatacaaccatttgaagtgca

SEQ ID NO: 40442 - DNA, 311 bp, Triticum aestivum
  Clone ID: PAT_TA_40442
agtttgtttgtagaggctaatgacatactctttttttttataccattaagtgtgcggccccaaaaatattacttaaacaagttttttggacgggtaaaaatgaatgaatttgcattacaaaggctcttttggaattgaaaaaagaaagagttccaagtgaacagatttacagaaatttctaccattgctttgatctctcacatgaagtttttatcttatgtttaaaccagagggggaaacggggctataaagcattctttttttctatgtaaagtgcgaaaaacctaagtggcctaagtggctctttttaa

SEQ ID NO: 40443 - DNA, 438 bp, Triticum aestivum
  Clone ID: PAT_TA_40443
cccacgcgtccgcatcgggagaggttctgtcgtgctcgctctccggttgctcgcgaccgctctccgatcgctcgcggtggctctccggtcacatgtgctcctcgtcagcggagccgctccccgcccatccagccttgtccttcgctggccaggagttgggttgaggttgtgggccactcgtcgttgtgtgtatcggtgccgccaaggtctcaatctgggtgttgcaaggattccaatgtctgcacctctttggtgtctgctttggagtcgcagcttgccctgctgcgcacggagctccttcaggaggttgagctgctccgcattgagcttcgcgacactctagccaagtttgaggttgcatcggttgtgcctttgctgcctgagctccaggttggttccattgatgaggatgctgaatgttgctttgaagatttttct

SEQ ID NO: 40444 - DNA, 234 bp, Triticum aestivum
  Clone ID: PAT_TA_40444
cccacgcgtccgcatccgggtcactcaggcggatttctgctgtccaacgagttgatctcgcttgcctttgggactatttcgccatgacaagagtagctggcttttcgcattgataattccacattcttatttgtcagattttatctgacaaaattgacacttactgatcagctaatgtctagtatatcagtaagtgtcaatttttgttttacaaaattgttcaattgttcagct

SEQ ID NO: 40445 - DNA, 273 bp, Triticum aestivum
  Clone ID: PAT_TA_40445
gggggttggttggatttatttcattccagaaacacctttttatactataaccaggggcttgacacaaccgtcattctttgagtcttcttggaccgtttctcttttactggcgggggaagggggccaccaccaactttttttttttcaaaaaaatttctctggcactgctgtggagaccaccaagaaaaagaccccaactacgagttcattgcaccttttttttgcccccagccaagaactgatactcttgagacagggctgtttctgaataca

SEQ ID NO: 40446 - DNA, 266 bp, Triticum aestivum
  unsure (1)..(266): unsure at all n locations
  Clone ID: PAT_TA_40446
ccggnccggaaggcccggggggggcgacgcgcgcgcccacgcgnacagagccagcgcacgcaagcggaaaccagcagcccaacaagacgaaggggggaggcacagggagcgaaagcccaggacaagaggagccggcacaacaacaacgcaaacgccacagccgaaagagccagagcncaggggacaaaagngacacccaccgagcagccaaaggcgagccaacaggagcgcaacggcggaaacaaaagcgcgcaacgggccagcgc

SEQ ID NO: 40447 - DNA, 435 bp, Triticum aestivum
  Clone ID: PAT_TA_40447
aacgcctcgagccacccattcgtccactcgtccacatccagctcactcaagcctattttttctttccaacaatttaataagaatgagtctttgaaactatttctccatcacaagcatctctgttttttcgcattaataattccacattcttatttgtcacattttatctgacaaaattgacactcactgatcatctaatgtctaatatattatttaattccaatttttgttttacaaaattttccaattgttcattcttaaataaaaaaataaaatcattgccttcctctctaaaagatccaattctacgtacccgtgcatgcttacatatatcttttctatacctttacctaaatttaatttactttcctttcttttataaacttataactttgaaaaccctatcttttcccaatcttaatctcccttaataca

SEQ ID NO: 40448 - DNA, 405 bp, Triticum aestivum
  Clone ID: PAT_TA_40448
ctctcgccggataacccaaccccagctcctccccttcctgctgcacctacaactactgctccggcgccatctaccggcccctctcgcctctcgccggataacccaaccccagctcctccccttcctgctgcacctacaactactgctccggcgccatctaccggcccctttcgcctctcgccggataacccaaccccagctcctccccttcctgctgcacctacaactactgctccggcgccatctaccggcccctctcgcctctcgccggataacccaaccccagctcctccccttcctgctgcacctacaactactgctccggcgccatctaccgacccctttcgcctctcgccggacaatccaaccccagctccgtcccttgctgctgcaccaacaattact

SEQ ID NO: 40449 - DNA, 262 bp, Triticum aestivum
  Clone ID: PAT_TA_40449
atttccttcagggggggggatagcattttttagattgtatgattagctccctaaacttttttaacaattattgctaaacaataaatactttcactaaatcgcatatttgccacttaaaggcacatttaaatttacccaattttatgtatacatgtttaaatagcttacttaaacactcctatttgattcctttcttataatcaaaaattctccttataatccattccctaaattttttaatatcacaaatcttttcaagacc

SEQ ID NO: 40450 - DNA, 301 bp, Triticum aestivum
  Clone ID: PAT_TA_40450
tttctcccaaccatgtggcaggatttgggggttacaactcaacaacagaagttacaagacactctcacacatgaatacaaaacaccccatgcatgtacttctaaagcacccttaactaaatcaccttgcggtgtttccacaacgcaaggccacactaacaatgatcaaaatgctcaactccacaataagtaataacttatttatgtctactactgtgctactagtatgagagaagggaaggcctaagcgggtgctgatcaaaagcagcctcggaatagccgaaggcctctttttttactat

SEQ ID NO: 40451 - DNA, 428 bp, Triticum aestivum
  Clone ID: PAT_TA_40451
gttttctgagtttcaccatgtgtgtgtgtgccttgtgtgagacaaagagagttgagctgtgagaggcagctcaaggtagtagaagaagcggcgctgcaaggagattcagcgccaacaattggcatcagagccctgtcgatccgtggcggtgactacggtaccggcggctatggtggccggcgtggcggtggcggaggcaacggctgcgacggcggcgacgcggtggactccatgtgaggtggaggacgccgacgcgaggtgatggctggcggcggcgcgatgccgctggtggccggttgcggtgcaatgctgcgaggtgatgatggcgtggtgatcggtgttgcgaaggcgccgtccacgacaagaggtggccactgcgtgtggcaggacgatgtggtgatgggcgccgcgacagcgtcgtcctcggc

SEQ ID NO: 40452 - DNA, 390 bp, Triticum aestivum
  Clone ID: PAT_TA_40452
cgcgtcccctcccttgttcgatccagcagcgcgcctccagatccgctccaaggcccagccagcctcctccaggccccgcggtccagcggcctccaggcccagcgagcacctcgccggttcgctcccgttgacgagcgcgtgggccagcgcccctggcccatcttcccccgcggcctgccaggcctcctccaccgacctgggccgagcccatgggtgagaacccccccaagcgcccctgtcctgtgcagcccggtagactagattcggcccgcatgtattttttttacctgcctgcgaattttgtcattatccgtagaattacagaattgcagaaaaccccctgttgttcatgcatttaataactcacaaaatatgcatcatatgttaatt

SEQ ID NO: 40453 - DNA, 349 bp, Triticum aestivum
  Clone ID: PAT_TA_40453
atacgaattgcccctttttattagatttctataaaaaagacagactaggacactatacactattggagctttatcacacgcgaagaagaaccacatgtgttcgacgcatgcgtgcatcacttgacgaggttggttatggcgatgccaatgatggtcgtctgcaggcagtcggcgctgtacctgggcagcggcgacgggagcccgaccttgacgagcccgccgtcgcaccgctgcaggagcggcgcgacgctcgccatctcctccttggccgccgggtaccggcgcgccctgagctcgtcggaagcctccgcgaaggccaagcccaccttgtcgtacgccttcacgcacg

SEQ ID NO: 40454 - DNA, 351 bp, Triticum aestivum
  Clone ID: PAT_TA_40454
taaggaacaggttaaaagaaaggcttgacaagatgcacaaggagaagctgctagatgggggagatgtacttgatgattagaccaaacacactttaaagaaggttaatttgcttcagtacatgattgtaatgatctatgcagtgaattctggagtaacagggttttcgctgtactcaggaggaagtttctgccaaagtgctggagtttgtggagtctccttgcattaccagagatgtcgttagtagcgatgtgaataaagagaagaatcgcttgaggaaaactaaaggaacttttggagagaagatgatgtatgcagatccttaaacatgcagtttatggtgaaaaagagat

SEQ ID NO: 40455 - DNA, 437 bp, Triticum aestivum
  Clone ID: PAT_TA_40455
agagggctgagcagagaaaccatgtagccattgtggttcaccaagggagtgtctctggcaaagccgttcctcttccttggtatatgtgtgcgtgtgtgtgtgtgttcatgagagagttcttgagagaaaacacaagagaattgtgtgagagggagaagagagttgtgagaggcaactcgaggtagaagaagaagtggcgctgcgaggtgaggtggcgccaacaattggcatcagagccttgttgatccgtggcggcgacgacggtgccggcggctatggtggccggcgtggcgctgggcgcgaggtgatggctggcagcggcgcgatgccgcgggcggccggttgcggtgcgatgccgcgagatgaaggtggtgcgatgatcggcgtcgcgaggacgtcatccacgacaagatggtccgtggtgaccggcgctgcga

SEQ ID NO: 40456 - DNA, 312 bp, Triticum aestivum
  Clone ID: PAT_TA_40456
aggcactcaatgcatatccaatgactagctttctaaagatcaactactcctcagaagaggttttttatcatctcactcccccaaaccatcttttcgctgcttcttttgccatacatgcaaccaaaatatcttcttattacactgtcctaactataaaatttccccccactacttagaaagttcttccaacaatctacagcattccaaacctcgcaagcattgaaaatgcgattacattaaaccttttgatcttgacttacatcaactacctaaatgaataccttaccatctaaatccatcacccaaccttta

SEQ ID NO: 40457 - DNA, 330 bp, Triticum aestivum
  Clone ID: PAT_TA_40457
gagtaacataacatgatagatcaacctgggaaatacaagagtcctgcaagttgcaacgtagtcaaagtataatacaactataaataacttcaactgaatggcaatacattccttgtgctccggcatcgtccacctatgagttgaccgggacgtcttatttattccagcagtgctaactgcgctgcttacgttatccaagcttgccattcagccggccttttcttgcttcagaccattccttccacctttaagcgcattcacacacacacacaccacagaccaccttttcccgcccaagcattcccattcgcattcttatccatggccccc

SEQ ID NO: 40458 - DNA, 210 bp, Triticum aestivum
  Clone ID: PAT_TA_40458
gtcactacttctaacaggcgagaggctgcacgcgatctagcaacctcgcccgcctactggccgtcgcgagtctcttcgcgcgtcgcggaggcagtcaatccccacgaagctcactgctggcagtgctactactcctgcatgcagcagaagtgcggcggctaccgaaacccagccgcccacacagcctgcaacgacagtacggcggtcgcc

SEQ ID NO: 40459 - DNA, 156 bp, Triticum aestivum
  Clone ID: PAT_TA_40459
cttgtcatgtttaaattaggccaaggtaacacacactatgcatataatacgctgcagggaggttgttatctggaaagcaatgtctacgtgggggccttctcttagaatatatatgtacaaagtcagattgctctgatattataataaaacccttct

SEQ ID NO: 40460 - DNA, 352 bp, Triticum aestivum
  Clone ID: PAT_TA_40460
gatttttgtcaagacactgaccggcaagaccatcaccctggaggtcgagtcctctgacaccatagacaacgtcaaggcaaagatccaggacaaggagggcatgcccccggaccagcagcgtctcatcttcgctggcaagcagcttgaggatggccgcacccttgctgactacaacatccaggagtccaccctccacctcgtgctaaggctccgtggtggcatgcagatttttgtcaagacactgacaggcaagaccatcaccttggaggtcgagtcctcggacaccattgacaatgtcaaggctaaaatctaagacaaggaaggcatccccccggaccagcaacgtctgatc

SEQ ID NO: 40461 - DNA, 419 bp, Triticum aestivum
  Clone ID: PAT_TA_40461
tcgcccacttttacgttttattaaagcagtaggtattgactggtgagccgctgtagaaggagtaagagtacttaagacatcatgctggaatacttgttaatttcgcatagggagatcacaatttcaatagccagtagtattatgacacctcactgtgaaaaatttgatcgttcatttctgagcagttttggaaaaaaatgaatattgtgcttcacgaattccagtttgtaggctaagctttgcaaaacgttgatccaggttatattttttcctaagttactgcaaaatgtgattataaaatgcattaattcaaggaattgctgacctgataaaaaaggctgagtctaatgattacactctttagataagtatttgcctttgcctcacaaggtgtaagagcttttttttttttaattgtg

SEQ ID NO: 40462 - DNA, 214 bp, Triticum aestivum
  unsure (1)..(214): unsure at all n locations
  Clone ID: PAT_TA_40462
cgaatcgcaatttcgacccacgcgtacgcttcatacaagggtactatcaaatggagaaccaataatattgctgcctngcccttgatgagtagattctttcagggcacacacactttctccttctttttcaggaacatgagccgaatataaattacaacttccccacgtatgcttgttctatgggcgacttgacaatcaatacttccagattaat

SEQ ID NO: 40463 - DNA, 426 bp, Triticum aestivum
  Clone ID: PAT_TA_40463
agaaaagataaatcgtgctcatttcatgttaaataagatcgagaaagaaaagactcttgaggtagagaatcttgagagggaggtcgtgagcctcactgcacaggtctcctccacacacgaggagagagaaaatgccacagtagatgccatccgggaggtctctgtcctgcgagctgaaaaggccaaacttgaggctaatttcgaaaatgtcagtgcacagttgagacattatgagtctcaactggaggaccttcgcaaggagtccaaaagcaagattaaaggtttggttgattctcttaatgcatccaaacagagcgaggaaatgttgacagcagatgcagaacatatgaagaagttgatggaaactgctaaatccaatgaagacgagttacggaagtcttctggtgaactagagttaaagcttat

SEQ ID NO: 40464 - DNA, 200 bp, Triticum aestivum
  Clone ID: PAT_TA_40464
atccttattagttataaaaggggacaggggaggcgggcttaagaagtggtggatccgcacaaagtcatagcaatgatactgagaaggattcaatgcaatttatggaagagactcctatatctttcacgaagaaccttgttgcattgatttgtaatatgggtaaggttcatttcatacattctgtagtagtggtattattt

SEQ ID NO: 40465 - DNA, 456 bp, Triticum aestivum
  unsure (1)..(456): unsure at all n locations
  Clone ID: PAT_TA_40465
atggaagtgcagggccgcggcactcttgctggcttctacgaggcgtactgtcgagcgtcacgcttcggcgggatagtctgacccaccgcggtctcggtaccaacacananttctacgtagaaatctcgcttgtgcctgagcgacacaaagaaatctcgacagtgagagcatgtcnagtgagggtgaccgaatgctnnagggtcttatgagttgagccatgatagtcgcttcggtgtattgcattttgtgtttcaagttatgcagactggtgcattctaaaancggtaccttctgaaagagagaagctcagtctgagattatatacctcctgtgcagcatacatacattctatgctctatttagtactagctgaaatataataattttgccagaatggatgttaagcaattatgtaatagaatgatagcatgttctcacctaatcccaggttcagat

SEQ ID NO: 40466 - DNA, 415 bp, Triticum aestivum
  Clone ID: PAT_TA_40466
cggacgcgtgggctcgcgaataatccaccgcaataagcacataaacccacctccatccgcgcaatctctcaatcttgcaaaggcatcaatggcgggcgcaaggaacaacgagctgcgcatgaccctgctcggcctggccctgctggggctcctgctggtgagccacaccgcggctccggtggaagctgccgcgggcgtgcaggagaacagcttctccatgaacggcgccggcggccgcagtctcaacagcttcagcatgaacaccgccgagggcgagggcgccaagggggggaaagccaaacccgccgccggcgacttctgatcgacgaccctccgtccgccggcgtcgagtactaattaaataatttatcctccggttaccccgggcttgcatgcatgcatgcacgcatggctc

SEQ ID NO: 40467 - DNA, 287 bp, Triticum aestivum
  Clone ID: PAT_TA_40467
gtacgcgtgggttcgcgaataatccaccgtaattgcacataaacccaccttcggcgggcaatcttcaatgttgaaaggcatcaatggcgggcgcaaggaacaacgagctgttcatgaccctgcttgggctgcccctgtttagggctcctggtagccagccacaccgcatctccattcgggggtgggacattcttgacagtctgcaccttccgcatgtttttcggggcgacaagcataacaaatggttttacgacatacacgggtttctgcttatcgcaaaacttttg

SEQ ID NO: 40468 - DNA, 412 bp, Triticum aestivum
  Clone ID: PAT_TA_40468
cccacgcgttcgaccagcaggagacgaacgagctcgagggctcctccgccggcggcgggggaggcgggcccgagtccggcaacgacccctctggcgccgacgacttgcactccccgacgaccaccggagcgcagcagcacccgcagcagcaagtagtaatgcagcacggcggcggcaggtacggccaacaagagcacggtatgtccggcgtccacccccataagctcgaccccggcgcggggccctcggtggcggacgccgccttcgtcggccttgacccggcggagctccttggcggcgacgcgcacgtgggtgccgcggacgacctgtacgggaggttcgagcccggggtgaggatgaggtacgggcccgccgcgaccggcgcggtctccggcgacgtgtcgcttacgct

SEQ ID NO: 40469 - DNA, 397 bp, Triticum aestivum
  Clone ID: PAT_TA_40469
gaggcatgcgacctgcccctccgccacctgatctatgagctccagcaaaaaggctggagctcatagatcaggaggcatgcgacctgcccctccgccacctcaaccggagaacccaacattttgcctattcccaccgggttcatctggccatagttcaatggataccgatgaagctggaggaagccgattctatgcctgggagcgcgatcgcttcgcgccgtacccattgatgccggtcgactgcgagacgagctggtggagctcacagcagtcccacggcgcatcagaatccacacccgcacctgcaccaaggagactctttgggcagtggatcggcctcggcaggtcgtcgcccgagaatagatcgcccgagggctcatcgtatcgacagatgcac

SEQ ID NO: 40470 - DNA, 357 bp, Triticum aestivum
  Clone ID: PAT_TA_40470
gtgtgcaaggcagcggagcagaggcttccgacagaggagaggagacaggggagccatgcaggcgaggcggtagatccggacgaagccggagcagcgggaggaggaggatgcagtgtcagcggtggcggagacgccgatgagcgcgcggtggagcccggaggcggagatcgggatgcgggtggaggacatctgggacaggctggaccagccgcagttgtgtcggagcgacaagctcaacagctgcttcgacgccatgccggtctgctccttaccgcagaccttaggggcgcagctggtggacatgcactcctacgccacgctggccgagggcgtctacatcctctgccggaaccggat

SEQ ID NO: 40471 - DNA, 228 bp, Triticum aestivum
  Clone ID: PAT_TA_40471
aacgggtagttcggttgggttatttattacatgcaagacaagaacaggggcccagacgcatgggaaataaaaactgtggcgcccaatcgaactccggagaatcttaccggatatgggacggccagcaaccttagtacgattgttgctactactcaacctgatgggatggtttggcccgggatagatctagaaagagcttgatgtcacacggggtgcccgcgcatggag

SEQ ID NO: 40472 - DNA, 404 bp, Triticum aestivum
  Clone ID: PAT_TA_40472
aaaaaaaaaaaaaaaaaaaaaaaattaataaaaaaaaaaaaaaagaaaaaaggtatgggggtaaaagagtttacgtttgggcggatgctacgtttcgtctgttttattgcgccatcttatgtttttctcgtgtccctgtatgcaacttgattgctgtctgttgcctgtgttttactgggttttccttggatatacctttttggatccccttttagtcttttacgtttcggccgttggcgttatggccttttggtccggtcggtttgttttatgggcgcttgcccaggcggtgtgctttttgtttggcccctgggtttggctcattaagtgccccttttccggtgctctttcccaagtcccccgcaccgtttcctttccttttttcttttttttttcgctttttt

SEQ ID NO: 40473 - DNA, 400 bp, Triticum aestivum
  Clone ID: PAT_TA_40473
tacggctttatacaattattttgaactaattcgttttatgacaggtctgtatactgctgcaaatccccttttttccactggcgatgtgtacaccaggaccttggtgataacctacacaaggcaaggcgattgttgatggtttcaagaacccttaggccgcgaacttaaaaaataataacgcaataatgctctgatagttaggtaaataaacacagctggtagagagttgagtaatacatttttcacccgcaaaaaaaaaggtgcatagttcgacatgcagacctgttgtgccaaagttctgaaataagactgcacattattcttaacggggaacttggactctcactagatttgcgtgtgctatctcaagtgttcaatgagataagttcgagggagatgg

SEQ ID NO: 40474 - DNA, 374 bp, Triticum aestivum
  Clone ID: PAT_TA_40474
cgctaatggctgttaggtgctgatcaatctcctctgtcgtgagcgagcgcgactgagctatgagactgtagctgtcaatgcaccataaactgttattttgtttcatagccagccaagaaacattcagtgaatcatttcatgtgtagcaagaaagacgggcatccactctgccatgtattagttggatcatcctttgtgtggttgaatttgctacggctatttctatcgtcttaacctgtctcagattatgtggtgccgcaacggattttgagattcaagtttggtcatcaatttagccaaggaactcactcgcgcacatattattaattgataaaaataaccttcgtggtttaaattcatttaaataaaatttt

SEQ ID NO: 40475 - DNA, 303 bp, Triticum aestivum
  Clone ID: PAT_TA_40475
gattcaacaacctttatgagaggactccaaccgccagctgtgggttatttatcatctgaccttggagacatcagaggctacacctttaagtgcgctaggctcaggtcaggttgattttttcaggatcgatattatcagctgcttggcggtggctttcccaatactgcactgacagttagggaaataaacacagctggtagacgagccgaaacatacatttttcacccgtgaatgaaaaaggagcatagttgcacaggcatacctgatgtgccacagtttctgaaacaggactggacattattc

SEQ ID NO: 40476 - DNA, 284 bp, Triticum aestivum
  Clone ID: PAT_TA_40476
tgaagatgatccttcaccacctgtatatcgtgtattctgagtgaagctcgcggggttgacaagtataacttgctattactctcagaaccttgctccagcattgaaaaatactttgtcggatactcagtttgccagaacatgtacaacctcaagtacggcctccaactctaagacaggatgtgctaaacgcacaccgtctaataagcattcgcccagattatcttctgaccatacttatgatactaggctcatgcgagcgctgaacatttgtgaatttctattta

SEQ ID NO: 40477 - DNA, 406 bp, Triticum aestivum
  Clone ID: PAT_TA_40477
cccacgcgtccgggctagggcagtttttgctagggtgatgtttggcttagcttcgatccagtttattctttcagtttcttttctgttcagtggttagtttggacagcatcatgcagttctccatttgtttagataaagataatgggtgtatttgggacgtaatgtgttatgtgatgatccattttgtaccaggggtttgctaggtctgagtggactgagattttcttaagtctcaatcaattcagaaaagaaagaaaatacaacttgcacttcttcactaaactaaagttgcattttcctagatcgattgagaaacctttatgctgatgaagaacaaagtggtgatagattttacattttcttgtttgctacttcttctgtctcagaatgtaagacttttttttga

SEQ ID NO: 40478 - DNA, 378 bp, Triticum aestivum
  Clone ID: PAT_TA_40478
cccacacgtccgggctagggcagttattgctagggtgatgtatgccttaacttggatgcggtttattctttcagttgctttcctgatcaatggttagtatgtacagcatcatgcagtcctccatttgtttagataaagataatgggggtatttggcacgcaatgcgttatgtcatgatccattttgccccaggagtttgctaggactcattggactgagattttcttaattctcaatcaattcagaaaagaaagcaactacaactatgactctttcactaaactaaatatgtgtttttctagatcgattgaaaaacctttatgctgatgaaaaccatagtggtgatagcatttacattcccttgttatctacatcttc

SEQ ID NO: 40479 - DNA, 289 bp, Triticum aestivum
  Clone ID: PAT_TA_40479
acaatcgacatagcactcagcatcgccggccgggtctcttcccatctggcgggcagcagacgagaccggtctcctccacatcggcctcaaggtcaacgacgcgcacaacctactgactcgactctgccacccggagctacatcgaccacgatggctagtagggcatgtgcaagagcttttggccttacagcgctgacgccgcaggacttggatcgacaggccgttgtagtggcaacacagccgccactcacatatgagtcttcaggtcttctgcgcaaacttgggacat

SEQ ID NO: 40480 - DNA, 306 bp, Triticum aestivum
  Clone ID: PAT_TA_40480
ttattctacttagcactcagcatcgccggcccggtctcttcacatctggcgggcagtagacgagaccgtgctcctccacatcggcctcgaggttaacgacgcgcacaacctacggactcgactctttcacccggagctacatcggccacgatggcgagtagggcatgtgcaagagctcttggtcttccagcgctgccgccgcaggactcggatcgtcaggccgtcgtggaggcaatccagtcgccgctcacatatgggtcttcaggtcgggtgcggaatcttgggacatggatagttactttttgt

SEQ ID NO: 40481 - DNA, 271 bp, Triticum aestivum
  Clone ID: PAT_TA_40481
ataccactgccaaggagacgcgggcaatgaaaaaacaggccacacaaaaaacgaccgcccggaaggttaacgacagggatggagaggaaaaatctgttttaaattgtgcagagatcgatcaaaatgaacgcacacttcatgatagcgctggatcttgcgcaggcagcttacgttgccacgaaagatgattcctcctatgaaggtgctgtagacctaatagacattttagatcgggcagctgatggctgtgaaacagatgcaggtgacaatt

SEQ ID NO: 40482 - DNA, 187 bp, Triticum aestivum
  Clone ID: PAT_TA_40482
ataccacagccaagtcgacgtggataataaaaatacaggccacacagaaaaaggccgggcggggggttaacgtcacggctgcagacgacaaatctcttataaatatagtatagactgaggaagacgaacgcacaattcatgtaaacgcggatttttctcatgcagaataagttaccacgatagatga

SEQ ID NO: 40483 - DNA, 317 bp, Triticum aestivum
  Clone ID: PAT_TA_40483
gtgaataacacttttttatttacagttgttttgtgtttgtcatttacttggtgaacaaggacaccaaccgattttggacaccacctacagtggtgtgaaaaactaaaaatgctggggatggaaccacatattacggcaattgctcataatgggtacaggaaaaaaggcgtgcctatgaactgtgaatagaggggggtggacaagacttttgttagggaattagcgcggccaaggaaggccttttcgtattctgactaattgaaaaaaaaggtcctgacttagatagaagtcgcgtctttggttgggccccctgtact

SEQ ID NO: 40484 - DNA, 326 bp, Triticum aestivum
  Clone ID: PAT_TA_40484
ggatcaaattcagacaatgctagtattattctgaagacagagatgagcactcagacatacatatatgtatatactggagaaaccaggcaacataaaaagatggttaaattggatgatgtcgatccccatctttattgggaggagaaaatacaaaaaacagattaacaaaatgttatggattacaaaacaccaccagacaaaggggaaaaagaatcggcagaacaggaatggcattgaccaaacctccatcttcatatgttgctgccactgaaacttttatgccagtagataaacctccaagctctttggcgctatgctagctacat

SEQ ID NO: 40485 - DNA, 212 bp, Triticum aestivum
  Clone ID: PAT_TA_40485
cccacgcgtacgagtatacaaggcgaaggttgatgcggtactgtcatagatatggacgtgacaggtacagacagagggatcatcatcgtattagcacgaatggtgccctagccttgctgattacaagaggcctgtcacgagacacaagttcttggggcagcacgagccgcaactacagcactaagcatctccggatggggggcagcaacctt

SEQ ID NO: 40486 - DNA, 377 bp, Triticum aestivum
  Clone ID: PAT_TA_40486
ctcctgcgacgaactcgcggtcccgtccttgatctgccctttccccccgcgccctgccttaagatcaggccgtcgtgccgtcaccgacccccggatcaggccgccccggcgccaccggtcttggatccggccgccgcgctgtctacctctgctccttacctatccgactccgcgcccgcacgaggggatgccaagccctcgtgctactcgatcggcagccacaggggggcctcccgcgcaccttcccttcctctctttctctccttccttctccctcacaccctgtctgtgtggtctcctgcaggtacccgccatgtccatcatggacagcagccatgcggcaagagctcgtcatcgaagttcttaagcaccggacg

SEQ ID NO: 40487 - DNA, 206 bp, Triticum aestivum
  Clone ID: PAT_TA_40487
ccatagtctcctctcccgccgcggtagtacgacccacgggaacgcccactgtccccacgggaaccaccatgtacaccgtcacggtagggctggcgatgccttgggaactcatcaaatgtttgtgtgttcttttttctaagttctgaaaacttttgccttcctttttgtccgcctggctcaaatttccaaccaggaggggacatgaa

SEQ ID NO: 40488 - DNA, 411 bp, Triticum aestivum
  Clone ID: PAT_TA_40488
atctgctgctgctccggccgggagacgccgcgagcctgcgagcctgggccgggtgtgggagctctgtagctggttaccccctttcctgcccacgccgcaagggggaggcgtgttagtgcaaggaagacgacgagggcccgcgactggggagcagccggtcggggttgtttcaaccggcggggctggcggagagtggggtgcgtgtcgttatgattttttgctacaaccttcgtcagattttgctaccactgacacaaaattttgctacaaggatttcatggtgaagctgtaagcacggcggcgatgacgaagttttgctacatccattgctggattttgctacgaccgggacaatttttgctacaaggatttcacggcgaagcggcaaccacaacggcggtgacgaagttt

SEQ ID NO: 40489 - DNA, 181 bp, Triticum aestivum
  Clone ID: PAT_TA_40489
ataggagcaggactcaaacgccttgtctttttaagaaaacgcgaacaccaattgcgggcgacaacgcaccgtcttgacctagtatcgatcactattcgctacagtagcatgactaaagacaaactaacctatatgacgccagtataaactcaacgcaagtgtcgtattcgataaaaatcaa

SEQ ID NO: 40490 - DNA, 352 bp, Triticum aestivum
  Clone ID: PAT_TA_40490
gtttctatctagaactagcgctttccatgaatgtaaacagcctggatatcctactaattaatatgtgcacactgcaggctgaggcggcaagcatggaacaaacccacattcactttcttttatatgcggtctggtacaaacaatatgagaattcacggaacgggtctgaggttggcaacatcaattaaaaacagccagtcctagttacagagacaacctaataatagttttggcccatatattagcacgacaattaactaactccatttacaatgtatttcagccattggatttcttaggaccttaaaaaaggcaaactcacatattttctaagttaggcataagaaatttt

SEQ ID NO: 40491 - DNA, 224 bp, Triticum aestivum
  Clone ID: PAT_TA_40491
aactagcattagatcgctggctgaaggcttctacgtgggcgtgccccatcccatgggtgaactctgcgcagctctcaacacggttgtagcggatcactccatgccgggcacagatcaagaggtacaaggcctcatactactctcgcatagtgggctacggctcattcaaacagcacaggtcactgatgaagcttgtcatggccaacatttatcacctcaagcta

SEQ ID NO: 40492 - DNA, 311 bp, Triticum aestivum
  Clone ID: PAT_TA_40492
atcacgcgggaatgcatagatcgccggctcggtcaataacattgaggtggaggtcgacatgcctctcgtcctcaccattgtccagaagtaccagggctgtattttcattaccgttgagacgtcgggacggaatgcaatatgatcagttctaaagtcgggtgaccaagtgctttatactgtgcagtttcttcggtgatgaattggggacggcaaacaagctggtattcaccatgacagacttccaagcaaagccagactctgtatactttgttgtaagctacgttggtggttatattgatgtgacgcccctc

SEQ ID NO: 40493 - DNA, 317 bp, Triticum aestivum
  Clone ID: PAT_TA_40493
cccacgcgtccgccatgagctgccaggagatgagccgccgtcgacgacggcttgcaccatcgccggcggtcgagccgccgatggaggacgagaacctcctctttgagatgctcctacgtctgcccccagatccgtgctccttccctcgcgcctacgttgggtgcaagcgttggcgacgcctcatcttcgaccccggcttgttccgtcgcttccggctacaccaccgtcgcaacccttctttcctcggatccttcagccatttatacttggtacccaccatggaggcccccaatcgtgacccggatgggcacttctgc

SEQ ID NO: 40494 - DNA, 365 bp, Triticum aestivum
  Clone ID: PAT_TA_40494
gaaaatatattgctgtaaatctttatagcaatgctgaagttaacatcaattcataacagatagtttgcacaccaattcgtctcgcaccatggagtacttcacccggaaatttagccaaactgaccttacaaagcatgtaaatatagtactgaaaatcttcctatgaatgctgctgaatttaatgttataactgaggcactgacttcttgttccaaccaggaccctgtggattcatcttccccgtccacagcttaggagtgggatgagagctgcccctactcactaccgttttaagcccgccgcagatccaccctatggcgctcacaccttggcctcctgtagcgccacctcgactactgtccgtc

SEQ ID NO: 40495 - DNA, 287 bp, Triticum aestivum
  Clone ID: PAT_TA_40495
aaaccgtttcttctctcgtgtgcgaacccatataagttgctgttccaaaccagacaatttggaggatgaactcgactctaataacgatgccatggttagcatctgtctttcagtaagactctgtgacaaaccatacattttatttaggcaaaattctggagccgctatcattcatactgtatttggcatggcagtggtccgacagaactcttaccgtcttgcaacatccctagaaataagattctgctgcaatctggtagtatgaatattctgttgtccacggttta

SEQ ID NO: 40496 - DNA, 348 bp, Triticum aestivum
  Clone ID: PAT_TA_40496
gtaaaatgaaccctcccctttctcacgtcgccccggccccgtttgtcttacagatacagaacaacttaccgtcgtaaacacccgacattgctcgttctaaaaaaaaaaaaaaaaaaaaaaaaaaaaaaaaccaaaaaataaaaaaaaaaaaaaaaaaagaaagaaaaaaaaaaaaaaactatataataaaaaaaaaaaaagggggggcggatctgaatttaaaacaagtagcatttgaacttgcgcggggagggggtccatcccggaggcgcaatttaattaccagggtatactggagccgctattagtaaagccgttcaaggtaaaagggccggtgacaaacgtgga

SEQ ID NO: 40497 - DNA, 395 bp, Triticum aestivum
  unsure (1)..(395): unsure at all n locations
  Clone ID: PAT_TA_40497
atttgagagcaagctagtttatcatctcaacagttggataaggtttcccattataggctgagcatagtcaggtgtgatctagacgatgaactaaaggtggtcctgcgaccattgtccaacctgaagtacnnaagagtcaaatactgcgggttcaccaagatagagttccatgctgccaagctctccacctttgtgtataaaggggactgcatacctattgccctccatcaagctcccgagatggaaaatgcagaaatttgtttctgtgcttctacctttcggcgtggttcagctgtggttctcaatgggcttccacatgttcagaacctcactttgaaaatttcagttgaagtgctagagacttcattggacatcagatagccgttacatgttcc

SEQ ID NO: 40498 - DNA, 393 bp, Triticum aestivum
  unsure (1)..(393): unsure at all n locations
  Clone ID: PAT_TA_40498
cccacgcgtccggtgccaggcacacaggtactatctccagggaccaaaggctggccactacgagctgctcgccgacctgccgggctacccggacaacgtgcggcgggacgagaagggcggttactgggtggcnncgaaccaggagaaggggcgcccgggcgtgaccacagcccccgtgaagcacttggttggtgtccggctcgacggcggcggcgttgaggtcgaggagctgacggcggccaagggcgtgacgctcagcgaggtgaccgagaggaaaggacagctgtggctcggctccgtcgagctcgattatatcggcctagttgtctagttacattactaagttttttattagaagattgtcataatgtggtcagttatgtaggttaattt

SEQ ID NO: 40499 - DNA, 390 bp, Triticum aestivum
  unsure (1)..(390): unsure at all n locations
  Clone ID: PAT_TA_40499
gagatcttcctcccctttcactcaaacttgttgatttttggggactcaaggacaagtgcctgatctatactcccaccaaagcaaaagttcattcccacttgtttctttgatggatcttgttactctngcaccttggaggctcctaggtggtaggagtcctcggtgagaaaatgatttatgattgttcccgtcgttcgtgaagatttagaggccgcctcaaggtataccactagtggttgtgaatcaccttcttggtgatatctcaatgagaagagggtgagctttcatggtgttggtgtgccttcatggtaacacccacccctccatcagtgattagttttcctccaaagaagtaaacatcggaatacatcatcgtctccggtgttttcg

SEQ ID NO: 40500 - DNA, 272 bp, Triticum aestivum
  unsure (1)..(272): unsure at all n locations
  Clone ID: PAT_TA_40500
cggacgcgtgggcggacgcgtgggcggacgcgtgggcggacgcgtgggcgccaccaagcctagcccccgccgcggcgctcttcctcgccgcgctcctcctcctgtccgcctccccggcgtccgcggcgnncccgcgctcctcctccaaggcggtagtcgggccgcacgacatcccggcagtgttcgcggtcggcgactccacgctggtcaccgggcaacaccaaccaggtgccgacggtggtatgcgccgtctacccgacttacagacgggc

SEQ ID NO: 40501 - DNA, 329 bp, Triticum aestivum
  unsure (1)..(329): unsure at all n locations
  Clone ID: PAT_TA_40501
aggcaaaatcatatcctcgacatttatttctgattctcactcatccctcactaatcgaacactncgnnnnagaaattcaaactcctaactgcgatccgccgccggcttggtggtgaggccgaagccgaaggggaagagcgggtcgtagagcttgtcgccgtagttcatgggcagctggtccacggacctgacccacgtccgcggcagcttcccggagaagccgtagtccccgaagagcacgtcggcgacgccgtggccctcggtgcccggcagccacgcggcgacgagcgcgtccatggtgtccaggtacggttcgacgaccagcgggc

SEQ ID NO: 40502 - DNA, 396 bp, Triticum aestivum
  unsure (1)..(396): unsure at all n locations
  Clone ID: PAT_TA_40502
atgaacaaacgcaagaagtagttctatggggcaaacatggagaatcatttgatgaagaagcaatacttaaaaaatctctagaaggaattgtgatagctatttttgctggtataactgcaacttcacagnngtttacaggtacaatacaaggatcttcaagttcggcaacacaggtgtatcttgacctcaatatacctgaagttcaacactatcgcagcagctaccaatggaaatttccaactctacaaaagaatctccctaaagtcgcacatctatctccacttgaagcagcaggcaagctgtataccattgaacaaatatctaccttgccaaccacatcttttcagggaggagcaacattcagtactattgcaaaggtgacatccattataccat

SEQ ID NO: 40503 - DNA, 250 bp, Triticum aestivum
  Clone ID: PAT_TA_40503
ctcacaattcggccgcccgctactgcctttggaaccaagcccacaaacctatcgggggaatttgagctagaactcccacctgctcaatgaccaccccatcactttaaaatgacggtaaagctaacccgaacgccgagcgcgaatactaactaggaacggcagccatggagctacaaccaacacttgcgcattctgcttacaacaacacgatgacccgatactaaaacttcaaacagacacacctgttcaa

SEQ ID NO: 40504 - DNA, 345 bp, Triticum aestivum
  unsure (1)..(345): unsure at all n locations
  Clone ID: PAT_TA_40504
cataaaaataatggaatatgaatcagtggagaaaatgatacatgtatcaattaatgtgcattgatatgcagctaggctnnnnaaacataataaaaaaatcatgcacaacaggtttcaagtaagtagtcatttcccccttgttacgtacttcagtgctgcagcaccaccgttcttacatagctcgccaacacagaaagcgacatttctcctattagtagcctcataagatgcaagatctttcaatgtcaaaggcattatctgctgtaaatgattcaaatatgagtaatattaagaggacacttctaattataaaatagcatgtttttttaaggaaatttataggca

SEQ ID NO: 40505 - DNA, 357 bp, Triticum aestivum
  unsure (1)..(357): unsure at all n locations
  Clone ID: PAT_TA_40505
cttgccaaactgaagttgaagtcggtggcggcgacacgcccgagtccaagcggcgtaggctagagtgacctgagcttgttgagatctgttcttgtagtctctctgtttcaatcttgcaggcatcatcntcccagaaaaaaattcttgtaggctttgctagagagctcgtaaccccagcatgttatcggataccaccttttgtatccctgatttgttgatcttttttagaccgggcatcagcagagatgtctttgttagcttggacaagctgaatagcatccgtttccaccatgatcttactcgtcccaagttcttgggctttgtataactctttcacgcaagctttttgttttaccc

SEQ ID NO: 40506 - DNA, 308 bp, Triticum aestivum
  unsure (1)..(308): unsure at all n locations
  Clone ID: PAT_TA_40506
cttttgtcattagttaagctcatcgagactgaatttcctgaccgaccattaatacannctccccacacttatggttctgttctttgtaacatggactatttacatgtggcacacgctggtggcccttttaaaagaagttagcatgtgaagtttagcagaaccagcacagtagaaaaggccatttatttactgaactggtggtgcatggccgtgcatgtacacagtacataaacgctgaatgttgaacgccacagaaaccccaaatgtttactattctttagcatctaatgcgccctgatagaaggttt

SEQ ID NO: 40507 - DNA, 352 bp, Triticum aestivum
  Clone ID: PAT_TA_40507
gccattggaaagggggaaaagatttgggcgttcgtgcgccggccggaaaaatcctcgtgtccagtgtgtctcctttctcctacctctgtccgtgagtgagctgagagaaagagagcagccagactcggcaacaacaattggtatcatgagcttggttgtcttgggcgtggttcgccgtgccggaggcgtgccggcaatggcggtgttcgccggcggctgcgcgatgctccgggccgtgtgtcggaggtgcgcggcgcggtgaggaggccgcggtggcacggtgaggaggccgcggaggacctgcgtggtggcgacttcaacgacacacagcggcatggcggcatggaggtgc

SEQ ID NO: 40508 - DNA, 375 bp, Triticum aestivum
  unsure (1)..(375): unsure at all n locations
  Clone ID: PAT_TA_40508
aaaacacggcagacaagagagagggaggggcgagcgagcgagacagggagagggggcgcgccgagccagccagcccacaccgaccgcggggaaggccggaaccgaccccaaccggggcagcaggaaagacnnccagcgcaaaaacaacaaggcgggcaccgcacgaaacaccagaaaagagggaagacaggccccgggcaaganaggagccccccgccagcaggagaaggaaccgaaaggccaaggacaaagaggcgagnagggccaccccagacgccgacggagaggggcgacagcaggacaaggcaccggaagcaccgccacaaacacacccaaaaaacccgaaaaggcaacagacggaccccggaagaaaag

SEQ ID NO: 40509 - DNA, 300 bp, Triticum aestivum
  unsure (1)..(300): unsure at all n locations
  Clone ID: PAT_TA_40509
cgcacctccaatcaccattccccactccaatccaatggagaccagcagtaagaaaatggcgtcgcatctgacggacatccccgaccacctcctggccgagattttcctccggctgcccgacccggctganntnncccgcgcctccgccgcctgcgtgaccttccgccgactcgccaccgacggctccttcctccgcagattccgcccacgctccaccaatcctnggattcctctgggccggcggcatgttctataccactctgccgcctaacccctncgcgcccggccgccacgcgctcg

SEQ ID NO: 40510 - DNA, 309 bp, Triticum aestivum
  unsure (1)..(309): unsure at all n locations
  Clone ID: PAT_TA_40510
cgcagatgcagcgcaagggcgcaacgcagaatgagtgcatagccgccgcgaatggcgggctcgcaccataggtcgccaatcgggacggggacttcaggtggaaatgctgcaagcttggacgaatcgacgngnnnccgttcaacgtgaaggcgacgaatgaccaatttggtaccatcgccgatgtaaacgctgtggtcacagtcgccacggccggtaagacagagatgtttcagctactgcgcaacgacggtgacaaaaataggaagaggatcaaagcaccgaatgggtgcttgttgcaggcaaataaag

SEQ ID NO: 40511 - DNA, 389 bp, Triticum aestivum
  unsure (1)..(389): unsure at all n locations
  Clone ID: PAT_TA_40511
ccaggtttcatgttggcagctccagtgaggcagcgagagttgtccggtagctgtggtggcacaggatggtgggcggctgatgggatgctgcatttcgaagtgcctggggtggtggtggtggtggtcatggnnnaggagaaatccctgtcggcttgttcggcaccgacacggtgatgcctgcgggtgccgttggtccttcctgaggggcgtcgggtgtatcccttccccactatcccccgtgtaccaggggaaaccctagaacattttcgggcaacaacggtgatgccgtctcatcccttcttgatggtgttgcttggtgcacagcgattcgggatgctggaagcatggtggtacttcttcggagggtgcagcggttgccgggctttctt

SEQ ID NO: 40512 - DNA, 370 bp, Triticum aestivum
  unsure (1)..(370): unsure at all n locations
  Clone ID: PAT_TA_40512
cggacgcgtgggttcttcatgccattcttggacaagaagaacgtcttcgacgaggtcttctccaccgatttcaagatcggcaaaacctaccaaccagaatattgatcgataccgtccaagtttcagttggtcaannccgtcgtaattaattaattcccatgtatgagtcgcgttggaaatatgcgcctgcatgagtggatagtgaataatttaaatatattatgcacatacatgcatatggtaggaaaagcaaggacggatgtgttcccgttgctcgcccatgcatgcatccactgtcgatcgacgcagcacttttcttttgtgtaaccgaatatgctcaagattttgaaatatttgaataatttttgtc

SEQ ID NO: 40513 - DNA, 339 bp, Triticum aestivum
  Clone ID: PAT_TA_40513
aagctataagttcaggtatattctgggacgaaggaagtagaaaagaaaagatacatgacccagccaccaagattagactaacacgactgtcaaattagcagatggaaactgcaagttgttttttcccctacctcactggttcatgaaggccgatggaaattgaataaatgtaatgtacaggtacaagatggtgtagaaaaaaatgattactatgtatgtgttgatctatttaggacgtggagcctctgtctctaatccattttgtggcgacccatttctctcctttgaccactgggcagcttccatgaagtgaagtcggatcaatggtaccatttagca

SEQ ID NO: 40514 - DNA, 385 bp, Triticum aestivum
  Clone ID: PAT_TA_40514
acccccgcagagccgaaagccacacaccttcttcctcctctgctcgcatcccggatcggggagaagaaggatctgaggcttttggcagggccggggacgatggcgccactcctcaaggacgagctggacatcgtcatcccgacgatccggaacctggagttcctcgagatgtggcggcccttcttcgagccgtaccacctcatcatcgtgcaggacggcgaccccaccaggaccgtcatggtgcccgagggcttcgactacgagctctacaaccgcaacgacatcaaccgcatcctcggccccaaggcctcctgcatctccttcaaggactccgcctgccgctgcttcggctacatggtctccaagaagaagtacgtctacacca

SEQ ID NO: 40515 - DNA, 337 bp, Triticum aestivum
  Clone ID: PAT_TA_40515
atataatacttttttgtttcttatatatattgatcattatgcgtcgatacagtacatacttctgtaaccacagtgtgcccaggatcgatctggtagctagtagtatcatatccatttcatgtgttgctaattcgaaactccacttagtatggagtatctatgatctgcattcgtatgcatccttcgtcttacttggaagaggggttgccatcttttactcacgcatctcctcctgggttgacagataccaggcgattcaagccgagggcgccgggcacacgtacagcggcggcacgccgccgttgtcgccgcagctgctcatgaggtcctgcggcag

SEQ ID NO: 40516 - DNA, 328 bp, Triticum aestivum
  Clone ID: PAT_TA_40516
gtcgttgttgaatgggagacctcaacattagtgataagatatcccttaggtgggggcttgcaggcaatagtttacattattagccctcaacataaagaggacacattgtgatgaattgatcaacctggaagcactaaactctgtgcgccatctagtttgtcctcccaatccaaaaggcttgcctgttcttagagcataaacccttgtgatcatttcgcgaacttcgtgcaactcttctacttgtagtaaaaattctagtgtacttgcccgataataagcactagctggttggcgaagcataatcctcgcgtgagggaatgctatacgc

SEQ ID NO: 40517 - DNA, 298 bp, Triticum aestivum
  Clone ID: PAT_TA_40517
aaacaaaaaaaattgacttggggggcaaaggggtagagagggaaacaaaggctgcagttgcagtccttggtgatcttgcaaatacacttggcccaatataaaaagatctgttcaggaaccacctgttccatgtcgaattttttagggagggccttgattcggacaaaaaaatcagggaggcttcatcgtgggcccagggaatgataaaccaagcaggggttgcttaatatgtaaaatcattttctgttgttggttgggggggaggtttctttttgcgcatttgaaaagtccatttgcc

SEQ ID NO: 40518 - DNA, 337 bp, Triticum aestivum
  Clone ID: PAT_TA_40518
aatgcaattgcatattttgcatttatacatagatatatagataggcacactcagttgataacatcacatcatcatacagctatatatatagctggactggaaattatgaaacgtacaggcactgcactcactatacgtcttgtatgctgcagctagccagcctatagtaacggcgacgtacggagggcagagagtcttgacatacacgtcgatcattatcgatcacaaaagtttttcacacaaggacgcaacagagacacagaactatgggacgtacgcgaacgcgatagtagtcgctcccggccccggaatatacgtacgtacgtagggtagaatg

SEQ ID NO: 40519 - DNA, 275 bp, Triticum aestivum
  Clone ID: PAT_TA_40519
cggacgcgtgggcggacgcgtgggtttgcttgcagattctttaacattgaagaatcagatttggtgctcagacctgaaattcagaaagaaagaaagaagcatttgctaggttcaacaaacgacgaccttcactgccattataaaaggccatgttgcacaagtgtttcgggtttcaattcagggaggtgacaccttgatgaaatatttgttctacaataggtgttgctgaaactggagtcatgatggcggtaagaaccttggagggtgttcttata

SEQ ID NO: 40520 - DNA, 380 bp, Triticum aestivum
  Clone ID: PAT_TA_40520
aacacgcgtctggccacgcggtcgaagtctacctaataaaactcgatctggattggtggttgatcggagaggaataaaccgagcgatacacttctggacccgccgatcgtgatgccgccggccgtacgtacccaatcgcagggatatgaacgaacgtggtcttcgcctctctcgatgacaatgcctcggacaccgctgtgctcgcctcctaggagtccaccgtggcaccacacacaacgggatgatccggtgggccaagcaccagcgggactactgcctacagcgccgtgaccaccagggcatcgataggagtgtggttgctcggctactatatgaaccagtgatggacgcaggaatagctggatctgttcgcatgttca

SEQ ID NO: 40521 - DNA, 165 bp, Triticum aestivum
  Clone ID: PAT_TA_40521
gcggacgcggacgatcgcgagcggacaccctaatttataaataaataatagaagcattaaatgaggtaaacaaacaacgaactaaattgccataataaaagatcatgtagaataatagtttagagtttaaatatatgactaatggatttatatataatatttatt

SEQ ID NO: 40522 - DNA, 377 bp, Triticum aestivum
  Clone ID: PAT_TA_40522
ggcacgccggcggccaccgtccacgcgcagcaccacctcgccatggcccggcgggtgctccacctccggccccacctcccgtccctcgctccccgcctcgtcccttcgcggcagtacatgtccgacatgcgccgctccgtcttcctcgaccgcctcctacgctccctacgctccgagatctcctcctgccgcgccgagccggcccctccgctcccgccctccgccgcgccgttcgccatcgaggaccgtcccggcgagcagtatgtccgcctgcgccgcgcgctctccgccgaggaggagatcacggtggacgcctcaatggtcgacggcgccgcggcgcccacccgctcgggcgtcaacgccgaagacggcgggcc

SEQ ID NO: 40523 - DNA, 372 bp, Triticum aestivum
  Clone ID: PAT_TA_40523
gatggcatcaggaaaacattctaattattgaacgaacatgcatgccaccttcggtttccctggtgcttgctctcagactgtatgatactggggaagagcgatgcattgcctgctatctatgggaagatatatgcccaggccaggcactatctatggaggcaaacgaacgtgtagatggcagccgacgaaccacaacattctatatttgcatgaccaaatgcattgactgtggtgtctggcaggaagctcggcctgtgcttgctattgacgcacgacctaactgtgagttatttactgtaactaacggggggctgctgaacagcaaggagtaactgagaacgaacagcgatgggtggctgacctagattgctg

SEQ ID NO: 40524 - DNA, 382 bp, Triticum aestivum
  Clone ID: PAT_TA_40524
cattccccgcccgcctccagcctccagcctcctgcgacccggatcgccttccgttcctccagccgagggatccccaaccctagcccggcaaccgtccgcgcgggatcagcgccggcagcggcgatggcgtcgttctcggaggcacccccggggaaccccgcggccggcgagaagatcttcaagaccaagtgcgcccagtgccacaccgtcgacaagggcgccggccacaagcaagtcatgctgatctgcagggcctaacctgaatggtctgtttgggaggcagtctggcacgactgctggatactcttactctacggccaacaagagcatggctgtggtttgggaggagaaaacactgtatgactacctgcttaatccgaag

SEQ ID NO: 40525 - DNA, 254 bp, Triticum aestivum
  Clone ID: PAT_TA_40525
acatccattatatacaccagcgccctttttttttttattaaaaacacggggggcattcatcagttctcatactaatttcaccttccacaaacatacttaactcgaatcatactactattactctcccactaacattcttttctatctagggcaactaatattctatatcttaccttattcatgaaaacctccaccatctcaacctaaatactcactctcaataattttaaatattctaactaaattaacttatt

SEQ ID NO: 40526 - DNA, 240 bp, Triticum aestivum
  Clone ID: PAT_TA_40526
aataaagacgggcgggggtctgaaattaataggaagctcctattcaattcatcacaacccctggctgtttctttttcttttggagaaccacacaagaatttttacccccggcgaataaaaaccaaaactacttgggtgatcccgatggcaccgacctggtcatttattccaaaacacctgggttaaaataaaagccttttaccactcaaaggggcgccccgaagtggaaaaaagggatcc

SEQ ID NO: 40527 - DNA, 346 bp, Triticum aestivum
  unsure (1)..(346): unsure at all n locations
  Clone ID: PAT_TA_40527
acaggaccggaacgcaagggggggggggaccgacgcgancagaggcacgcgcaggccgacgggcgggccagaagaggaacagaaggggggggaggaggagcagagcgaccaaacacggggagcagaagaggccggaacaggcanggcagagcgcatagcacaggagaaggagaaacacacggaacgcccggcggacgacggccgcaagaagaacgggcgggaggacaccaaggggcggcgaggggaggccagaaaagagaacaggcagcacaacaagaagccgggcgcggaagagcacgaagaacggaagacccggcgggaggccgaccagaccaacaagccaacc

SEQ ID NO: 40528 - DNA, 131 bp, Triticum aestivum
  Clone ID: PAT_TA_40528
cagtgtgtttagcaagctgccatgtatcttgaagggcttagcaatggcgggaaatagtaataaaattgggatgaattcccccctagtgatgatgtgataacttgattgctttagtcggtacttcctcgatg

SEQ ID NO: 40529 - DNA, 354 bp, Triticum aestivum
  Clone ID: PAT_TA_40529
gctacacatccggagctagagcgctagcggtcgtcctttaaaaccggtgggaaaaccaacggaatatggccatacatatactgatgatttgacttatgaccggaacagcaaacgcaacaacacatccgggtatacattgaaagatgaacggatggaagcttgcataaaagattgaagaaacgctcttacaaacaccatggccccgtgcatgtgaccatacatatgattcagcatccagtactgaatgcaacactgaaggataccgtaaggcaatgagtaaaaacatgaggcggaacatactgtcaccatgaactggacgatcgacaggtggtgcgatcgatccaagaatcggac

SEQ ID NO: 40530 - DNA, 144 bp, Triticum aestivum
  Clone ID: PAT_TA_40530
ggtgtaattgaggagtgacttctatgacaggtgatttgttaaacggggggacattagggggaggctatccataaaaaatgtgaatgtgcaaactagcaggctgatgatagcaagattcaataaatcagattgttaattaaagat

SEQ ID NO: 40531 - DNA, 379 bp, Triticum aestivum
  Clone ID: PAT_TA_40531
gttcccttgaatgcgtgcagctctctcgctctctcatgtctgatgcacgcacgctgtgctactgctatctggtgacttgctacgcacacactgcaacaggttcttctttggtgtatcaggccaggcgtaatttgttttcaaagatgctcacatacacacacaaacgacatccagtaggcgcttggacaaccgatagattgaaagcacagaagcaaatatttccaatacgaggccacgatgcccgacagagatgtagccaatatgcgcccaatccttatttcttgatgttggaacaaatcaacagggaaaggctcccctgctccatttgcattagaagcctgaacaaacatccctggcttcctctgaagagtgacatatt

SEQ ID NO: 40532 - DNA, 177 bp, Triticum aestivum
  Clone ID: PAT_TA_40532
ttctctatctataacttgtataacgccgggcgggcgcttgataaagtacccatccatcattctgctgatcacaaccggctgaggtctaaacgtttcttatacgaaaacagactgacgattattgcacaccaggcgaattaaaaccaaccctccttgttttatccggatgacactgac

SEQ ID NO: 40533 - DNA, 346 bp, Triticum aestivum
  Clone ID: PAT_TA_40533
gtcggacgcgtggcggacgcgtgggaatccgcccatccatccacctcctgccccccgcaggcgattccccaacgtctcggcgcggattcgggtgttcctcgcgcgaatcagcgtggatccgagcaacctacggaatttttgacggcattttctgcagcctgcggaacattgtatctgcaatagtaaaacaatatatgggctgactttggcatttcatgggaggttttgaagatgatgaaccaccctcaaaacgcgcaagagcatcctcagtagagtcagcaaatttaccagaaagtttctgttattcgaaatccattaaccctttgggaggtacaatggctagacc

SEQ ID NO: 40534 - DNA, 323 bp, Triticum aestivum
  Clone ID: PAT_TA_40534
ccattatacgtagtacatactagatagtcttatcacagcactgcacaatcagtatcgacgtcaccgtacgaacccgtcctacaagacgaagcagatcaagaacaccctcttcaggtcgaccgtggagttcaacggcatgcagtttgtggggcagccgtgcgccaacaagaagctggcggagaaggacgcggcgggggaggcgatcagctggctcacgggcggggaggctcctccggtgacggccaacgcgagagaccggcaggacgccgaccacatgtcggtgctgacgaagccggctccacgcatgaggcggcaccaccata

SEQ ID NO: 40535 - DNA, 253 bp, Triticum aestivum
  Clone ID: PAT_TA_40535
cttgactaatgggtgtgtgccttgtgtctatccagtgtcccacgggggggggtatgtacagagtttatccattatccatctcaatgggtgtattaacagtctgtaataacctattgaccagaactcagatgtataattattaaactattatactattgtctataaattaatgcatatcaaaaagattaaccttctccaatagtatatcaccataaatttatcaaactttaatggtaaatattttattttaaca

SEQ ID NO: 40536 - DNA, 316 bp, Triticum aestivum
  Clone ID: PAT_TA_40536
cccccgcaaaaaaatgacaatggtttcatgcataaaccatcctacatttttttggcgagtatataaaccattctacatattggcgagagatccatcgttaatgcagaagcctaatcagcccagctaaattactaacaagtttgctactgaacagcatgtgatccactttgttgccatggccgacaccatccatttggattacatggaacagggctatccttttaactaacaacaagattggatcaacttttactcgactttttagaaatatactacggggtgctactactaaattaacgaacgagaaagcttaatt

SEQ ID NO: 40537 - DNA, 299 bp, Triticum aestivum
  Clone ID: PAT_TA_40537
gtgagcaatccttttgtattagatgtcttgtaatccgaaatacttctactctgtgaccatgcttggctagatcctggttgcaatggcatgctaagcaatctcatgttgcatgaattttgtagacagaagccatgcttgaagtcagctgttacttgttacgcaatcgcgattgttcatactggaagcctgttttatcatgatgattgttcttttccaaggtttggctttggggttattgagaatttgtatcatattcttttttatcaagcagctggtgttttagctggctcctttgattc

SEQ ID NO: 40538 - DNA, 244 bp, Triticum aestivum
  Clone ID: PAT_TA_40538
ggaggaattgtgtgctaacatcaaggacagttcatttgctttacacatgtttatcagattgagtttttccatatgaagtgggatattgccaactagcctgctgatgttagcaagatttaatagtttagcttgttaagtattgatgatgtagcaccgctggtcgagctactgtttcccctatatttagcgtctggtatggcaaccttgctggatataatatagtagctggtaattctaccttggg

SEQ ID NO: 40539 - DNA, 278 bp, Triticum aestivum
  Clone ID: PAT_TA_40539
ggaacgagatattgtttctgttcttacacttttatatatatggattttgtacctctatatatacctgcattacattttatacctattaaactctttcatttattaaatgtttatgtttaactacatattctctttatttatcataattgtttccatagtattgttaccaccttttttctttgctctgtggactaattcttttttaacgatatacttttaatttgtaagatcattttgattggcattcaactatacattgtgggggtgttcatgaactt

SEQ ID NO: 40540 - DNA, 383 bp, Triticum aestivum
  Clone ID: PAT_TA_40540
cggacgcgtgggcagtggattcctttttagctggcaactcagcattcatgactcggataaaaactcggtgggagaaactaaaagtttccaactgcagcaaatacagaaggcctaggagagggagcaaaacagagccgtcatagaaaaccatgaccacgtagcagttcgggtcaagtaatgcttcgctattggcggggcgagttccgtgtaggcggacgacgtcgaggaggtgaagacgttgtccccggcgccgccgacgccgagtcgatgggggccagctcggattccggcgcgtccagcggatcgctgtgctcgtcgatcatgtcgagcctgacagacgacgacgcagagtcctccccggtggcgggtgatcctacgccgtc

SEQ ID NO: 40541 - DNA, 368 bp, Triticum aestivum
  Clone ID: PAT_TA_40541
cccacgcgtacgcccacgcgtccgctccaggcggcggaagaaaagaagtggcaaaatggatcgacggagcggctgccgcccgtagcataacacaccggtacttcccgtcgacaaagcatgtactccaccgcgccctgcctttttgacgcacacacacacagaggggagagcctttttgtcttacgtacagtggtctggtctagtgctcatgagcccaccgccgccccaccaaccgtggccatcctcacccggattgtgcttttaaactcttggatctgcagagctgtgtccatcgacgatccctttccccaatggctgcgcgggtggccaagtccctgctcctcgtactcttcctctcgtactgctct

SEQ ID NO: 40542 - DNA, 402 bp, Triticum aestivum
  Clone ID: PAT_TA_40542
gtttggtggaaatttttttggcttaggtggcttcggactcgggggctttggacccgggcttgggcggtggcggcggcggcggcggcggtggtggcggaggctcctgtagcagtccatgatgcacttcttcttgcacttgaagtactttccccagtcgctgccgccgctgtcgtcgtcgtcgtcatcatcatcatcatcatcatccttatcgtcgtcatcatcatcatccttatcgtcgtcatcatcatcatccttatcatcgtcgtccttgtcatccttatcatcgtcgtccttgtcgtccttatcatcgccgtcgtccttgtcgtcatctttgtcgtagtccttgttatcgtcgtcgttggcatcaccgatgtggccgactgcatgatcggtggctggagt

SEQ ID NO: 40543 - DNA, 407 bp, Triticum aestivum
  Clone ID: PAT_TA_40543
cggacgcgtgggtgtgccgcttggaatctgttccgtccatcctctacaggtcagtttctctaccccttctgtacatcccctatttttgatggattcacttacttgatccgatctctgttttgggggaagaggagatcagaggatgagcaccagatgatccgactacagaaactgagagaaatcagagacttgacagccgtgatttattgcttcttatatcacgcaggcattagggctctcccaatctcatcctagaggaataggacaccttgcatgaccgtgagcaccgctgctcatcgcagcttgtcagattaggctggttcaagcagtgtcttaggcatgctactatccaaggcggtcttcgcgcttccaccctacatccacgctatccaccatgtcttctccta

SEQ ID NO: 40544 - DNA, 390 bp, Triticum aestivum
  Clone ID: PAT_TA_40544
cggtgatggaggtgcgtccacacctcctcgtccttctctgcctccttggcgccggcgccggcgccgggatggcgcagtctttgccgccggcgccggtgccgcagtccggggcggcggcggcggcgccgaggcccacgccgttcgggcgcaccatgtccacggtcatcaccgtggccatcagcgtcttcttcttcctgctcttcttctgcgcctacatcaaccagtgccgcctcgccgagaacgccgcgccgcagggggccaacgccgccgcggccggggccggtgcgtccaggagggggaagcgcgggctggacccggcgctggtggccacgttcccgatcatgcagtacagggagatcaaggagcacatgatcggcaggggcgtgctgg

SEQ ID NO: 40545 - DNA, 274 bp, Triticum aestivum
  Clone ID: PAT_TA_40545
gggaaaaaaaaaggcccaaggattaaaaaaccccacaaagggccccttgggggctccacactataatcgggttaccctgggggaagcaaatgagtctacaaagggggggaataatatggccccgggaaaactagccgacatgttattctgaacccactggtggggagaccatctaacgggcagggtaaaacacccaatccaaaggggggggaatgagagctcacaaatcccaccccgggaaaaaagtttgttttttcgggaaaaaaatttacct

SEQ ID NO: 40546 - DNA, 233 bp, Triticum aestivum
  Clone ID: PAT_TA_40546
ggtgggggtgacaggaaaacaattactattcattaattgtctgaacaagcaggttaggcacatgagactggcacatccggttagcacgtcggtccgtaccagaattgccaggcctctacactgcttggggacttctttgggaagtgcatggaagacccgcgccactggaacaagggcttgggacttacattaacacactattttaataacacacactggctacgttattttat

SEQ ID NO: 40547 - DNA, 406 bp, Triticum aestivum
  Clone ID: PAT_TA_40547
cggacgcgtgggcggacgcgtgggcagcgcggggcttgagtccctatggtcgctcctattcggcaccccggaggagatggagcccatgtggttgccgcccaggggactcgacgttggcgccgagtccgcctccgcggtgacgggggccaaaggggctcgtcgccggcgacgatctaggcgccatccccacccactgcggcgccggccttggcggagttcgaccccgccgcgccccattcctcgggaggcgccccagagcttgcaggtacacctccagattattggcgtcaaggtcaacgttgcgcaagaacagaacagtaagcagattggtccatgattagcggtgtatagagtagagaaacacgtaatgtaatgctcaagacaaaccggccaaccagggcagcca

SEQ ID NO: 40548 - DNA, 413 bp, Triticum aestivum
  unsure (1)..(413): unsure at all n locations
  Clone ID: PAT_TA_40548
gtggtgggttatccccaaccatattaaactctacatcgtatgaacaactacangaaaaaattgtaaaaaccaaatctgggattaataactaatnggtccgcataaaggggctgcaaggtgaaacttggccaagaatggaaggttaccatgaccaaacaattgacgtctttgcttcttctattcactgactgaagctctcatagcaacggacgtttacagcgacgcaagagatgttgtcttcgctccttctattcaccagttgctccgtcagatgcttcggaactgcctgtccgcccctctggtgtcattgatctcatcaacagccttttgattggtcatcacctgaattttcaacatacgtagaggtataactggtatagctacaacaagcaaacatctttcaaaacgccctt

SEQ ID NO: 40549 - DNA, 403 bp, Triticum aestivum
  Clone ID: PAT_TA_40549
cccacgcgtccgcgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcggcaggtcggggaccaaggagttcatggaggcactcgctgccggcgctgac

SEQ ID NO: 40550 - DNA, 402 bp, Triticum aestivum
  Clone ID: PAT_TA_40550
gacagcaaagtagtagtcgaagatcgaagcatggccgtcgacttggagcaggcgggctaccatgccatccctgccgacccgcgcgacgacgaggcgccgccagtcctgggcaacgcgccggcggcgaagtccagccacatggacggacccacctttctaatcttgatgctactttcggttggagtgacagcgctcatgttaggccccatgtactacatggagggcgccaacgtggcgtccttctccgtcggtctcgccggctacgagggcatcgacccggccaggcccggccgcgtggtctcgccggcgttcaacctcacgctgcggatgaacaagacgtgcgccgaccgcgccgaggtggtcctgacctactccggcgtcgcgctcggctgggcgcgcgtg

SEQ ID NO: 40551 - DNA, 403 bp, Triticum aestivum
  Clone ID: PAT_TA_40551
gccaaactcactaatcatacacgtacgtgcttggcttaaacccttccggcgaagtcaagcacaatggcgtcgtccggcaagacctgcgccgcctccgtcctcctcctgctgctggccctcgccgtcgccacggcggccgacgcggcgaagaagagcatcacgtcggagcccaagtccatcttctcgaggccgtcgggacccatcatctcgaggccggcgtcggagcccgccatcccgaggccgtcggcggaggtggacgtgtcggcgacgtgcatggggtcgctgctggagctgagcccgtgcctggccttcttcagggacgcgggcacgtccaaggcgcccgcggggtgctgcaagggcctgggcaccatcgtccgagaccagcccgcgtgcctatgccaca

SEQ ID NO: 40552 - DNA, 272 bp, Triticum aestivum
  unsure (1)..(272): unsure at all n locations
  Clone ID: PAT_TA_40552
ttaggtggacaacaccggtgcgattttcattatttatttattttcttataatacattcttttttattcctcatgaaattacatttttttaaactacaaaccgggggaaaaaaaattgtgttaaaaagtaactacacccaagggggggacagcaagcattgactaatggccacacatcttataccccacccacatacatgcaattttttgttgccacctcccgcacgttggaaaaattttncaccgagggcccgggatagaacacccccaaaa

SEQ ID NO: 40553 - DNA, 407 bp, Triticum aestivum
  Clone ID: PAT_TA_40553
caacaaacagaggatttgtcacgcgcggccggcaggcatggcgccgttggccgcctccccgctcctcccctccccctcgccgccgtgccacctcctcctacgccgctgccccgacagtctctggctgccagcgcctcggtcaccgcgattgccgctccgtcgcctctcgcgtgacggcggcggcagcgagtgcctgtctcggctccggcatgtccggccgctccgagccgtgcccgtcatcgcgcccggcgaccagtggggcaactgggcgttcctcctctccgccgcggccttcggcacctgggcggaggagcggacggcgtggggcgcggcgctgagcggggcgctggtgagcatcctggcgggcctggcggcgtcgtcggcggggctggtggcgcccggcgcgc

SEQ ID NO: 40554 - DNA, 335 bp, Triticum aestivum
  Clone ID: PAT_TA_40554
acaatgtctacatcggaacaacaccggcgcgactacaagcagtacagaaggggggcttatacccggtgcccacacacccaacacccactaacagcacgcaccacaccagccactaccacatgaccccgccactaacaagctaactacatccacgcccacgcacagcatgcattgactaatggccacacaactcataccgtgcgcacgtgcatgcagctgtttggtgccagctcccgggggcgggttggccaagaccaaccggccatgaacaagattattggttacaatttcccttctaatcttgacacgggtgggcgtcgacgtcttcacccacc

SEQ ID NO: 40555 - DNA, 285 bp, Triticum aestivum
  unsure (1)..(285): unsure at all n locations
  Clone ID: PAT_TA_40555
cccacgcgtccgcggacgcgtgggttggcagtactactactctattcattcttggatttgagagacaattaaaagtactactcctatgttttgagacaattagtaagtgcgttagctaccttcatcacagtttgaatgtattagtcgtatgatgactacatctcatccgattttggcacatcatgtgtgtttggttcttgtatatatttgtgtgacgctgtgagctagtataattgttgagcttattaactttgaaaaagaaaccaagttnacagaaagtgttaa

SEQ ID NO: 40556 - DNA, 228 bp, Triticum aestivum
  unsure (1)..(228): unsure at all n locations
  Clone ID: PAT_TA_40556
ccaacacgngcggttttttaagagtatcgtataaactcgcgcaggtgtctctgactgtctaggaggctcatcggaggctcaggacaacttactttcgaccatggcagggaccttagtcctgccggttgatcttgagataactttagaaggccgaacaagcggtcagtactgcaagtttatggaaccaggaggacttcctcaatgttggcatagtcattgaaccttcct

SEQ ID NO: 40557 - DNA, 355 bp, Triticum aestivum
  Clone ID: PAT_TA_40557
cccacgcgtccgccactagccagccatggcgaacccgctagaggtgacgtctctgggccatgttcagagtatcgtgaagggctacgacgggatcttcgatctgccggtgcgcatcatctccattgacagcctccgcgacgccgaggagatcgtcgccctgctgtatgacaaggtcagcgaggaaggtggcgagtggcgcataaaggaattcccccttctccaacggctggacaagctccatgactacgttcgcagagccagcacccttctcgacgagatcgactccgcggtcgagaaccacgatgagctgatgatccgaccacagcttcttcgaaacacgggggtgcacaccctg

SEQ ID NO: 40558 - DNA, 233 bp, Triticum aestivum
  Clone ID: PAT_TA_40558
atatgccttatcaacagttattcaatacaatgcatatgccaagtcatgcactccacatctcaaggtaataataatcagtctacataaacaagaatagtggcaatccaaaacacatgcctgaagcatgagtttacaaaacgagcataatcaggattcattattatgaacttaacagacggatctagcgtgggagactagcagacgccatgaactcgcactctaagctataacat

SEQ ID NO: 40559 - DNA, 147 bp, Triticum aestivum
  Clone ID: PAT_TA_40559
gtacaacgggggacacgcgggctttaccttatggagccccaacgtgaacatgttgcgtaacccgaggtggggccacagccagaagacacccggtgaggaccccgacgtgtcccgtcggtacaccgacgtctatgtgcgagggctgca

SEQ ID NO: 40560 - DNA, 268 bp, Triticum aestivum
  Clone ID: PAT_TA_40560
gcaaacactgggggatttggaggttctttcttatcaggttcatgacccaaacctgggatcttcagataagggtcatagggcggaagcccacggcactgcctcctgcgtacccatgggggcggggcacgattaggcataccgggagcttttttaagatagcggcacagcttgcctcggttcactacctcaagcgaggacgtacacctgctgcaaacactctacagtataccacaactacggcttgttcgggttggtttggtgacccaca

SEQ ID NO: 40561 - DNA, 155 bp, Triticum aestivum
  Clone ID: PAT_TA_40561
cggacgcgtggacaagcggatacaaacacaatgagcaatacccggcctctgcatagctaggatgcacacaaccaccaccaacacacacaaaaaaaaactcacgccggcagaaagcaaagtcctacatgactgaagctctgccttggcggaggaag

SEQ ID NO: 40562 - DNA, 427 bp, Triticum aestivum
  Clone ID: PAT_TA_40562
ggcacacctgacagtatccacatgtgacagtcgctgataaggagccaaattggcttcactgtgaagaccagcattccagaatgagatatttgtctgctcaagctgctgaaacaactacaggacgcgtagaagaggattagtcaacagaatatagatgctcttgcaaaactggaagaattgaggaggctttaatctatacagagtcacaagtccaatgatgcacccccagacgcagatatgtactgcaaaccaaaaacgcgagatgatgtgactgctaaatgcgctagttcagtggcagatacatgttgtattgtctctgctgatggctataatgcgcctcagccagtatctggagtcaagattagtgaagtttctattggttccagtgcagaatcaaatacttcaagtgttagtaaaggttataatt

SEQ ID NO: 40563 - DNA, 319 bp, Triticum aestivum
  Clone ID: PAT_TA_40563
cggacgcgtgggaaacaagcctacttttacaagttgtctgacttcattaagtttggttagatctattgatgatgacaccaagatccttcacgatatgacgattgaagtgcgccttccggataataaacttgaactgggatggttggaatcctacgatttgaaatacaatgttgcggttatcaacatcggtcgctaccattctcttcaagtaacatgtctagatcatcagcggcaatttgagtctcacagtaaagtagttgccgtagggcgttgcttcaactcaagaaaactagtggccacagctgggatgttgaccgac

SEQ ID NO: 40564 - DNA, 171 bp, Triticum aestivum
  unsure (1)..(171): unsure at all n locations
  Clone ID: PAT_TA_40564
cccacacgtccggaccgccccgnttttttgctttttttcaaggccaagcacgggaccagccggaagccaaaaagagcagcgcgcgccgaaccgacgcccccggcaacaacggcaggccggccaccccggagccggtggccgaccgcggtgagacagaaaaggtccttgagc

SEQ ID NO: 40565 - DNA, 334 bp, Triticum aestivum
  Clone ID: PAT_TA_40565
cccacgcgtccgcacggcccagccttcctactcccccgtcctctccactttgaccgccggcgcacgcccaaaccctcgttcgccggcgcagatggcggccgacgctctcgccgccccttccttcacagttcgggcgccacgcacctgatcggccgctcctcatctccacgggcggcgatggcgccgggctcccagaagaagaacaccaagggcgtgaaggaggtcgacccgacggccaagctcaccgacgacctcctcgtggacatcatctcgcgcgtgccctacaaagtaacatgctgctgcaagtgcgtctccaggcgttggcggaacctta

SEQ ID NO: 40566 - DNA, 219 bp, Triticum aestivum
  Clone ID: PAT_TA_40566
cggacgcgtggggctcgccgagaacgcctacaaggacaacaagaagtctcgcatcgttcccaggcacctgatgcttggcgtgaggaacgaccaggagctcgggaggctggtggcccgtgtgaccatagtgcacgggggagtgctgtccaacatcaatcctgatctgctccccaagaaaacgggcgggaatgcacccaagtcgacccaaaaggcttgcaa

SEQ ID NO: 40567 - DNA, 338 bp, Triticum aestivum
  Clone ID: PAT_TA_40567
gtcgtggcagggggcgctgagctatgtttcccctcacactaaggtggtcaagggtaacaggattcttccctttcagtgtgagcttgacagtcttcagatgagtattcatgctgatgtcgacgccaatgatggtgccgtggacggtggtgcggtcgtggcagggggcgctgagctatgttataccttggaaattttgcactgcatgcttgtgtgcagtgtaatctggtttcttacttgtacggagcaatattcttattagagccaggaagacattgatattggctgtaccagctgttcttgatgtggaattatgttgttggtgtttgactgatgttgat

SEQ ID NO: 40568 - DNA, 228 bp, Triticum aestivum
  Clone ID: PAT_TA_40568
aaagtctgaaagagtcctaggatttgaccctcctacagccttgccgtcttttcagcgtgtgtaatttgtagtaccaacttttttttaatctttactgctgcgagactgtaatctgtaccttgatgtaccatcatcgtgttgtgttgcacaaaggactgatgctgttgttgagtgctcattgcttgctcaggcatgtttgaggctttcattgctgcatggtttgcaccc

SEQ ID NO: 40569 - DNA, 128 bp, Triticum aestivum
  Clone ID: PAT_TA_40569
tcgccctgcatggcggttttggctctttttttaccccgcaccctgcgccgttcttgtcgcccgtacgttccggcttccccgcgcggtgcttttaggcagtattgctactgctaccttgcctgcacaaa

SEQ ID NO: 40570 - DNA, 192 bp, Triticum aestivum
  Clone ID: PAT_TA_40570
cgcaggtagccctgctcactcccgtttaaccttcttcgcccgcggatgcaaccgctgcgtcctcaatggcagccagctaccgcgccaagctaggagcccagctatactatcggacaaggagatcgcccctgggcgtcacggctagggggcccctgatgcacctcttcatgcggggctccgcgagtctatttg

SEQ ID NO: 40571 - DNA, 427 bp, Triticum aestivum
  Clone ID: PAT_TA_40571
ctccttgccgcggttcttggggaccgccagcgtcgctaatgcggtgccgcgctgttccttgtgtcggtggagccagattccggtgggatttccgcagattcgtctttcccggggcttcgacctgtgagatgcgggcagggattgggctttttagtcggtactatatgtatttacggacttcttttattctgagtttttggggaattactgggaatatatttgtcttgtggtcgaggaatcatttctcacctaccacttcttggctgctatttctagtcgtaatttcttaaactaaaaaaggggtagtatttggcttcttggtttttcaaaaagatgcctagatctggcactaagtcattcgtctttttttttttatgcgggcggctagttcatcgatctgaaacgggcattgccccccgtgagcttt

SEQ ID NO: 40572 - DNA, 137 bp, Triticum aestivum
  Clone ID: PAT_TA_40572
tccatcgttcgccctgagaggaggtgttcacgcattttataccacgcacccggtgcacttttctcaagctcgtacgacatcgctttccgctgaccgtggttttaagccttatggctaacgctaccccgcccacacaa

SEQ ID NO: 40573 - DNA, 439 bp, Triticum aestivum
  Clone ID: PAT_TA_40573
cggacgcgtgggcggacgcgtgggggtagcggagctcttctagcgcgagaagagccaccaccccattcaatcgtccgcctgggtttgcgaagggtcagagatggcggaccgagctaaccacccgtatgtcatgcagaaggttggtggacagagccaccttgcctccaacttcattgagggtgctcgagctcgcaacatctacccttcggtgccatcctatgaaaggcgcttcaccacaagcagatacataactgataactctgacatgagtgtacgaaacatgtcatcttcttcaacgtgagcgcaatgcaccctctgagaagaaaggtgtgacaaactttgcgatcggatcccttatgggaagagcgtcagttgtaattatgcaagactgatgcagctaccattgagcgtgttaagctgcttattcagaaccaggatg

SEQ ID NO: 40574 - DNA, 272 bp, Triticum aestivum
  Clone ID: PAT_TA_40574
tgggaattgtactagcattgcttttgccaacggtgcaaaccgcacaaaactagagcataggattcgaaaaagcggtgtgctcttaaccagactcacgtcaagactgccggtcatagtactgtgattcacaatactgatttctgctccggttacacacgatgaacttggaaggctgtgcacactagcacgacctcatgggcgatgctgagcgtcctgagagctcgtccccctgacccctaggcacatggcataagaagtgtggctccccacta

SEQ ID NO: 40575 - DNA, 209 bp, Triticum aestivum
  Clone ID: PAT_TA_40575
tcgcggacgcgagggcattcgcgccgataaccatggcgccaagcgggagagggacgtctaggtcttcgagatgctgtcttcgagggagtccggccgcttcggaggcggcgatcttcgttcggccgaccgcgcctacgccggcgagtagcaccttccgcaggaaggaccctggggcgtgtaagacatggatagcgcggtctatgtctcgc

SEQ ID NO: 40576 - DNA, 403 bp, Triticum aestivum
  Clone ID: PAT_TA_40576
gtgggcgtctgcagcacccattggacacaaaccccgaaaccctagactccaatcctccttcgccgcatccctcgctacctcgtccgccgccgcaccctctttcccctcctctctcttcagcgtccttcctctttttccttccgggtctctcttgcccgctccttgttgttgctgtgccggggaaccaccacggccgcaccgccggatgaagccaccatccgcggcgctgttccgttgccttggatccgtgcagggggcctccccggggtagcagaggaggcagttggacgaggaggcgcgaggcgagcaggaagttggggtcgccggaggagcacagccgcacgggggctggtcttcgccagagcaaagtgaaggaggtagatgtagggggacccaactcggc

SEQ ID NO: 40577 - DNA, 345 bp, Triticum aestivum
  Clone ID: PAT_TA_40577
cggacgcgtgggctctctctctctctctctctctctgagtgtgtgagtgagccccagtctccccacagctaggcgaacaagatcttatctccccaggggcacgggccctccccgagatcctccagagccgccgccgcgtcgcgaccttcaaaaaatgccggcaccgatcgggggccggcgccggctgtgaggctgctatggcgccggccaagcctaggttctggctcggggcgggcctgctcaccctgctgctctgggccttcgtcgcgcagctcgtccccctcggacgccttcttgaccttttcggacttcccggcggccccaagaatttacaaaagccatggt

SEQ ID NO: 40578 - DNA, 238 bp, Triticum aestivum
  Clone ID: PAT_TA_40578
tgggggtagttagtacggccaggtattcggacagtgaggcgatcctccggagaggagatgggtacgaacgacacacgattggtccaagcgagatccgaggagagcggctgcgggtcatgcgtcatgaaggccgaggagaaggctggcgagatcttcgcatacgatgaggaggaaatcaacattgagatgctgcaacttgacgtagctgtgaaagagaaaatcaggcatgtatattttc

SEQ ID NO: 40579 - DNA, 418 bp, Triticum aestivum
  Clone ID: PAT_TA_40579
cccacgcgtgcgctttcgcgtgggttaaaaccctaaaccctgtggaccggcgtcatcgtcagccatggccctattcgacgacgaccgacgggcggactaatcctcgctgcccgtgattctggccttcacctgctactaccgcggcgctatttttcaagaggcggcctggatcatcccataatttccatggtgcttccagtctgttggtagtatcaccaccaccattattgattgatagatagcaataatttgctgctgctgctgcttggggttggtgatgttcgccccagccttggtccacctgtacccgttaaggtcaaaacctaattttttggtgattaaattataggtggttcagaggctacataattttgtttttttattacctccccgcggggacattggaaattttttttcc

SEQ ID NO: 40580 - DNA, 242 bp, Triticum aestivum
  Clone ID: PAT_TA_40580
cccacgcgtccgtgttgattgatttccaggagaatccaagggctgctcaagacggctcgggagcacgaacgcaacggcggtcgggattgggcatcgttgagttcagtgattggagacgtggccattcgtccccgacagatctgtgccgccatggcctgagagagcctatagaaaggagggttcagacgagcacctgtaggacgacccgtcatcacggtcagcgattgtcgactccgacaaca

SEQ ID NO: 40581 - DNA, 132 bp, Triticum aestivum
  Clone ID: PAT_TA_40581
cctacatgtctgattacgtggtctctgacctgttctcccaagctttacagttcatacataaacaaaagcaacgtaagatggtgtgcacagcttgatgaggggaagatcatcgagtacttcacgaacaagagc

SEQ ID NO: 40582 - DNA, 177 bp, Triticum aestivum
  Clone ID: PAT_TA_40582
catgctacatggaatgcatagaatgtttctactttttctgcactcaaaatattacagcgtggtgtaaaagcactgcgtggttctgcaggactaaaatatgccatagctgcactggccaaagctgcaagggcgatccaatctgcgaagacaatatactagtttcttgtagatgaaaat

SEQ ID NO: 40583 - DNA, 301 bp, Triticum aestivum
  unsure (1)..(301): unsure at all n locations
  Clone ID: PAT_TA_40583
gcggatgtttctcacaagcctgttatttccacacttagtgttgaaaaaacaatacccactaaatggagtatatattgagcacatcataagatgagcccatgcgttcagtccatatattcatttatctagagagaaatangtacnattgaactggtatagtatggtcagaaaggcagaaaagcttaaactacctatgagggtaataaacctacactggtgggaaaatttgcttatttacacatatttactaacggatgttgccaatttgatttattttaatacaaacttcaaagattccaaa

SEQ ID NO: 40584 - DNA, 353 bp, Triticum aestivum
  Clone ID: PAT_TA_40584
agctcatcattgtattcatgaattcgaagtccaaatcataagacctgtacataagagcgagctacgaaaagggacaacaagaacttgcttatgaggccagcgtgcaagttgtcgtctgccctttgttttggatccaccacatactccgccgaatctggaacgccactatcgaccactgcatttgctggtgtcatcggtgaatcagaatgtagcctggttggttcagctccaccgtctacagcttgacctgcaatacaaaacacattccacgtgttagcccagtacaaactaaagagctgaatgaagctctgggacactgggctctagtgggtgtgcaaactgaaccgacggca

SEQ ID NO: 40585 - DNA, 286 bp, Triticum aestivum
  Clone ID: PAT_TA_40585
cccacgcgtccggtcacctgtccatatcccccaagtccacccatccgagatctcccaaatccacccgaccaagccatggccggcggcgacgaggaggccacgacggcgctgctgccgccgccagcggggtcggcggaggcagagcgcccgccttccccgacggccgaccggatcggggtaggctacctcatcttcttcacgctcagcgccgggttcctgctgctctggaacgcctacatcaccgtgcgcgactacttatactacctctaaccgggcgcgcccgttg

SEQ ID NO: 40586 - DNA, 358 bp, Triticum aestivum
  Clone ID: PAT_TA_40586
cggacgcgtgggcggacgcgtgggctgacgcgtggggtagactgatccgctgttacggcaagcacgacaaccactttagaaatttgagctttagtcatgtcgctgcatatttggaacatcataatgttattcctactgaaccttgtgtcagccatttgaataattacaactaaaatgatatgtgaccttctatattccttttgtaaatgtaatattgtaacgaattctatatctggctaaattgactacctaatgtccatgcttatatagcacaaaaagtgaagattaatgtccacgcttatacagcccaccttttcccatacaaggatgtacacgattattttgtttctgaaaatat

SEQ ID NO: 40587 - DNA, 465 bp, Triticum aestivum
  Clone ID: PAT_TA_40587
cccacgcgtgcggttggctctttgacattggagctgcgattcgtgaacgggtgacaacatggtgtattggcttgctggttgtcttggttgttatgttttgttctcttcaaagcgggagctttatacagaagaaagagagtgaacgttctagcggtccggtccaactttccaagttccttggtcgcgaggaggaggaaagcggcaaaaggagtgttatctctggtaaaaagataatgatgaagcttgagaaatccaaagaagataaggcggctgagagcaagcgcaatgaactgttgaagtttctgaatgccagttatgattgacaacttgtcgaaagtggtgatgcttggctggatggcttggatttgtcttgatgccactgcttagtcatgtgtgcgtttggagataccaagaagttttttgtccggttttttaaagttaatgactgtgaccatcagtgcttta

SEQ ID NO: 40588 - DNA, 250 bp, Triticum aestivum
  Clone ID: PAT_TA_40588
agatctcggaacccttgccgtcaccttggtcatggcgaaggagccccccttctccctgcccccggtggtcttcaacccctccacaccggcccaccgtcgccaacctatccccgggcccggcgccgtaccgacacccggcttatagcctgccgagccctacacctgcttcgtcgtcaaccacctggccttcatgtgcttcagcatacccgctgagtccaacttcacgcctgccatctttaccgggcccatc

SEQ ID NO: 40589 - DNA, 332 bp, Triticum aestivum
  unsure (1)..(332): unsure at all n locations
  Clone ID: PAT_TA_40589
gannagcggaagggagggaccgcattttgcattttcttgaaccattcntacagcaggacgagcatcaccaatggcgagaggcaaagaaccagaggatttcaggatcccaacaagcagggctttctgcaaaggcgtcatccgacagcatataggggggggggacaccatggccagcgcagtgaaagaatccagcgaacgccccgagaacaatgggcgagggcccaaccatacaaaacgaatggaaacctagccgcgggctccgctgggggacgcaaccttggggcccctctaaaaatagaacaacacgcctagtgcacccataccgggacaag

SEQ ID NO: 40590 - DNA, 434 bp, Triticum aestivum
  unsure (1)..(434): unsure at all n locations
  Clone ID: PAT_TA_40590
tattttttgctctggagctgtcttgtatttttccttgtcgcgatgatgcgctagctttatgtatcctgggaccatatgttgaatactctctggtgtttcattttccagtgaaagatggaacagggctgtgggcattttgatccttnntttttttcatattctggtgtttgctgaagagcaccaagatcctcttcatgcaccaaacgactgacaagcagttcagtgcctaccttggagccagtcacgcaaggaagcacccaactcacgcttgggccgcctgcaccgtcagatgttattttcgatggctaccgacttttgagtcgccgtggaactgagcacccacattaccattatcgacacgttgcagcaagtaaacgtgcttcgtctatgacattgcagctagcaagatcctacgtcggccatgaggattaccg

SEQ ID NO: 40591 - DNA, 255 bp, Triticum aestivum
  unsure (1)..(255): unsure at all n locations
  Clone ID: PAT_TA_40591
tcgcccacgcgttcgcccacgcgtncgcggacgcgtgggtgtncaactagcccacccccctccccatcccaatccaatttcgttccccaccgtttccttcgttctccaccgcgctcactagctagggttccggccgccgccggtgagcgcctgccatttatggcggatcaagaagctgccgagaggcccatagtctncattcctcgccgtcccccgacgccgctgcttccctggaccccgtcgcgctccgggaca

SEQ ID NO: 40592 - DNA, 362 bp, Triticum aestivum
  Clone ID: PAT_TA_40592
cgcgagagcgatcgattccgaccgtgcgtagcgcacctcctgttccctttccttttctagctcgtttcctttttcctccgccgcagctgccctgccgcttccctcccccctcctcgctgtcggctccttccaccggcgtcggacttatcgtcgtgaacaccgccgccgcactcatcggcgtgaacactgtcgcattcccatccacacagccccgcctagggctgctggtacattccccaccaccacgccgtcggaccctgttgctctacccacgcccattgagacggagggagggaggacatggtcgctgggggtcgccacacgcctggatctgggtgccattgtgcacatccgggcggatc

SEQ ID NO: 40593 - DNA, 359 bp, Triticum aestivum
  Clone ID: PAT_TA_40593
cggacgcgtggggcagaaaaatatcatgcagctcttgcagaaaacagaaaattgttcaatgagatccaggaactaaaaggaaacatcagagtttactgtcggattagaccttttcaacctggggaggatgagggctccaattcagttgaatatattggcgacaatggtgaactcgttttatcgaaccctacaaaacaaaaggaagggggcaagaatttcacattcaacaaaatatttgggcctaccactacacaagatatggtcttcaaagatattcaaccactaattagatcagttcttgatggctacaatgtttgcattttcgcatatggtcaaactggatcaaggaaaacatacac

SEQ ID NO: 40594 - DNA, 156 bp, Triticum aestivum
  Clone ID: PAT_TA_40594
cccacgcgtgcgaagaaaaaaccctttttgtgccctacacacctcgaagacggctggcgggcatacccacaggaaagccggctgtccgcgagctcttactgcttacatccatggccgctactcaaggtgccagtgatggcttgtccatgtgcaaag

SEQ ID NO: 40595 - DNA, 100 bp, Triticum aestivum
  Clone ID: PAT_TA_40595
actagagatagatagcgagcggtctatatagagcaaccaagcttacgcacgcgtgcaagcgacgagatatcttatatatagagccacctaaaatcaattg

SEQ ID NO: 40596 - DNA, 459 bp, Triticum aestivum
  unsure (1)..(459): unsure at all n locations
  Clone ID: PAT_TA_40596
cggacgcgtgggattgtatctcatccttatatttgttacaaggaccaaggagcaccttacctacagaagtacagagtatcatctcaaggaacacagtgttgcatatttattaatctataaagatgcaacacaaaagagatgtttgttggttattacttcagaaaaagatgcatagaacagaacatatgtgtgtcctttccttctagattctgacttaaaggttgcctagtttggattattaattccttgcctcctataagagtatttgctacaactaggacaactgatgggattccaaagatcgagatattgtacttagaattgaggatcaaaaagttaatattagactgtggggtgataaggtcgaccaaattgatgaagattctatgggacgtgttgtcatagtnacatcaacaactgttagaaaactgaaagagtactcggtgtcatctacaggtg

SEQ ID NO: 40597 - DNA, 209 bp, Triticum aestivum
  Clone ID: PAT_TA_40597
tcgcccacgcgttcgaggacgcgtgggcgcagtctaagcccgccgacccggagcttcccaacggtgccggggccccgtaccacccggaaccggagccggcgttgtccgctgtcgccgcgccggcggtagaagaagaggtggcggttagatcggagccgttcaagggcgcggggaccaacgcggacgggtggcgcccctacaccatgggg

SEQ ID NO: 40598 - DNA, 472 bp, Triticum aestivum
  unsure (1)..(472): unsure at all n locations
  Clone ID: PAT_TA_40598
catccgtccgtccgccgtcgcgatctgtccggcccgaccagacccgaaagcccatccacccacccggaccgggccaggcggcgggcgacgaccggggcggaggcggatcgacggacggatgggcggcggcgggcgcgggcagtaagacggcggcgggacgcggctggagcggcgggaggaggacggcggcgcggcgcggcggggcggcggcaccaccatgtctgcggtagtctgcggcaagagagtcttcttcatcttcgcggacgacctgctgctccaacaggcctncttctncccttccttccaccaccacaatagtcccgcggtcaagcgctcgcgctacgcgcaccaccaccaccgtcgggacggtcgggacgcgctccttcaaacacctcggggcgtctttcccgcatggatccccaactgtttgagagggcccttggagcgtttggagatgatttggatgatgcaa

SEQ ID NO: 40599 - DNA, 211 bp, Triticum aestivum
  Clone ID: PAT_TA_40599
cgattccggcacgcgcggcctaaccgagcccaccaccgaagccgagccctctctctcctcgccgtccccagctccgtccgtccacccatgtcgtcctcgtcgtcgctgatccaaggcatctcaatctcggtctccgacgacgacgaggcctccgggaaggtgcgcgtccgcgtgcgccgcaagcgcaaccgccacccggtctcggcccacc

SEQ ID NO: 40600 - DNA, 357 bp, Triticum aestivum
  Clone ID: PAT_TA_40600
ggcggtgagctgctgagaccgaggagcgtgcccccggggctcagccgttgccgcctgagatggcgggggcgctcgcgggagccgggatcgtgtggcagacgccggccaacccgcccgaggcgcaggactacatcttccgcaacgggcggcgctacgtgaggccctattacttcgagttcatctcccatgcgaagaacagatgggctgggaagaccattgtagatctcttcacggatgaattcaaggggcgcccccgtgaatactatgttcatgcagtgaagtgtgggaggcttcaggtggatgagcaaatggttcatgcagactatattgtgaaatcatcacaaaagataagccatt

SEQ ID NO: 40601 - DNA, 474 bp, Triticum aestivum
  Clone ID: PAT_TA_40601
gctgttgattcgattgagggagaaataactcaatccttttcacaacaaaggaagaaaagagaggcagctggtcctacatattatgactcttttgcttatgctcaaggtccatttgcccctgtacctgaagtattccataccaaggcagagtctcctgcccaacaacgagtatatgaggagtttgttcatgtatggcagagtagtcatggccaaagtgttggtgctgcaagttctggtacagctgctgtatcgagcaattttggtgtacctcgagcttacagcccaagtttagcacaagcttccagtggtttcttgtctgctcaaacagcttcacttacattaactcagcctacagagctggtgtatgaggaattgattcctggcgcttcacaactttctagtgattctcctgctcaagttgggaccagcgactcttctggctggcttggtggaaccattggcgatgcatccaca

SEQ ID NO: 40602 - DNA, 341 bp, Triticum aestivum
  Clone ID: PAT_TA_40602
tacgcgttcgaggaagcgtgattttactcattgctgtaaacaccaaacccaggaaagagaaacgggtcattctacatattatgactcttttccttatgctcaaggtccatttgcccctgcccctgtagtctttcataccaaagcaaagttttctgcccaacaacgagtatatgaggagtttggttatgtatggcagagtagtgatggccaaagtgtaggtgcttcaagttctggtacaattgctgtatcaagcaattttggtgtacctttgagcttacaacccaagtttagcacaagctttcagtggttttttgtttgcttaaacaacttcacttacatta

SEQ ID NO: 40603 - DNA, 436 bp, Triticum aestivum
  Clone ID: PAT_TA_40603
cggacgcgtgggcggacgcgtgggctgccatggagggattttgccttgtggtcgattcagttcgccgttctctcctactcgagccgctgcatcgttcaacctttagctttgagtgtaatttgttatcgctgctttggagctgcgcagggggccgccgccaaggacctcccggagatcctctatggtgtcctccacgcccccccgcgacgagcgcaaggaccaggacgacgtcgccgtccagtaccgccgcggcggccccgggggcaagagcggcaaacggcgctgcgtcagcggcgggtgaggccgccaaggcccggcgcgagaaggaggcggagcaaacgcaggccatgctcgcgtgctatgactctgacgaggcctttcgcaacctctatgatggcgtcgctaacctttttggcgggctgctcaagttgggcct

SEQ ID NO: 40604 - DNA, 370 bp, Triticum aestivum
  Clone ID: PAT_TA_40604
agtttatggggggcaataccagatttttggtgttgcaccaaaaaaaaaaaaaaaaaaaggggaaaaaaaaaaaggggaagggggggggacaatttttaatggaaaaattggaataagaaaaaaattagtggcagggttgttttttactcctccttctgcaactatatttacttatttggggggggcggctttaggggatcaaagctttggtacgggggcaggagaagttaaagtttttttttggggggcccgaaaagcatttcccggcgggggtgtttccaccgcgggggtggggaaacccggggggggccccatattattccctttggaagaaatccccttttttccgggggggttttaggagaagggg

SEQ ID NO: 40605 - DNA, 418 bp, Triticum aestivum
  Clone ID: PAT_TA_40605
gacaaacattacaggttgcaagaatacttgcatgggaaattgctcatgcatcgccgtgttcttcgaccaaaaaacaggcaattgcttcatttttgaccagattggtagcttgcagcagaaaggtgcaagtaaaactaatttttcatctttcatcaaggtatctagcagtggctcaaggcaagctgggagtggcagtgacagtggaaatcacaacattattattgttgtcattatagtcgtaactttggctgtcatcggtggccttagttatgtcggtttcttcatttataggaggaagaggtatcctccatcctcacaagatgaggctggttcatcagaagacgatggatatctgcagacgatatctggagcaccagtgcggttcacttacagggagctccaggatgcaacaaacaac

SEQ ID NO: 40606 - DNA, 200 bp, Triticum aestivum
  Clone ID: PAT_TA_40606
cgttcgttcaaccgagcactaacgtcgtctacaccaccatacctctagagccctcgttgtcggagaagcaggcaagcaagcaagatggcctgtaggaaggtcggcgagaggaagaaggctgtgacccggtccgcgaaggccgggctccagttccccgtcggtcgcatcgggcgctttctcaagaagggccgctacgcgca

SEQ ID NO: 40607 - DNA, 315 bp, Triticum aestivum
  Clone ID: PAT_TA_40607
cggacgcgtggtcggacgcgtgggcggacgcgtggtctgactcgtggtgggacacatggtcgcgccgaccgaccacaaaccagcgacggtcacgtcgtcgtttgactataatgaggggaagtagatcttaatagtcttctcgtggctgaacattcggaagctggttaatgatggtttcatttttaggaatccttataagattcatttcaggtcttttacatggtgtgtatttttttccaagcattatgttcgttactcttgatatggtttgcttacgtgttccagggatgcttggctttccaccaagttcctttt

SEQ ID NO: 40608 - DNA, 298 bp, Triticum aestivum
  Clone ID: PAT_TA_40608
cggacgcgtgggcgccgtgctgatgtaaaaccgccgaagggacttccggcgggccaagtaccagatggagcacgttatgcgcacgcacaatggcgcctacgaccgttccttatgatctgtaaaccaagacgtggtccagctgggaaataaggaactgacaatgagcctacttctggtaaaggttgtagtgcatctctcatgagaaaatcaccactttctaaccgattgtgttgccttaaaaggaacttatattggtatgctacctcgtccttttggatcgactccatccatttagttt

SEQ ID NO: 40609 - DNA, 275 bp, Triticum aestivum
  Clone ID: PAT_TA_40609
aaacccaaccagcggcaccgtctccacctccacatcctacaactccgcctggagctccacctcgatccccttcgagctcctaggccagcagctgcacgccgcccgccggcccgagccagtgggcgcgaactggggcccgactcagggttcgtattccgtccccggcctctgctgcgccgacattcatggagctgctgttcgagctgctcctcacggcggcggccaccctcctcgtcgtcgtcctgctcgccaagctcttttccggggccaatgat

SEQ ID NO: 40610 - DNA, 389 bp, Triticum aestivum
  Clone ID: PAT_TA_40610
cggacgcgtggggaaacactgtcgctgccaacaggatccttgatgagatggcgcagaaggggtgtgccccaaatttgttcacctacaatgttttgctggagagtttgtggaaagctggtaggactacagaggtagaaaggttgttggagaggatgggtgagaaaggatatagcttggatacaacaagctgcaatatcattattgatggactatgcagaagcagtaaattagatatggctatggacattgtcgatgaaatgtggaatgaaggaagtttggctcttggcagattgggtagttcgttttcaagtttagcgagtgattctttcctcagcaaaaaatgtctacctgaccgaatcacttacacaactttgatgaatgcattgtgc

SEQ ID NO: 40611 - DNA, 116 bp, Triticum aestivum
  Clone ID: PAT_TA_40611
cggacgcgtgggcaaacactgtcactgccaacaggatctcttgatgagacggcgcagaaggcgtgtgccctaaatttgatcacctacaatgttctgctcgagagttagtggaaagc

SEQ ID NO: 40612 - DNA, 392 bp, Triticum aestivum
  unsure (1)..(392): unsure at all n locations
  Clone ID: PAT_TA_40612
cccacgcgtccgccattttcttgtcaaccttcgatgccgaccaacatcgacgccagaagtttgagggcgaggaggcgaaccagaggagaagaggaccaccggagctcgctcatcatctctgccaccacggagctcacatcggacggcgacctgctggtcagccggcggcggtagccatgtggtccgccggcgctgacaaagttgggtttcgacggaagggcaggctggacgagaacgcgctcgagcgccacttctagtacggggaggcgcacccgctgctcgcctgcatctgctccaacgcgctgctcccttctccatttttttctctgtcgagcaaatcggcngtgggaggaggaggcgaaggcaagcgtcgccggttcaagtacaagtag

SEQ ID NO: 40613 - DNA, 348 bp, Triticum aestivum
  Clone ID: PAT_TA_40613
cccacgcgtgcggcgatgggtggtctaactgcgtccacgcccacgatggcgggcaggagacctggggcgggttttatagccacacgaaaatacgatcaacggagctcggtcatcatctgtgccaccatggagctcacataggactgccacctgatggtcactcggtggacgctgccatgtgggccgctcggatctgcgaagtgaggttccaacggaaggccattctgtactagagcgctcatcgtcaccactatgagaactgtgatggccacgcgctgctagtgtgcctctgctgcggcacgcaggcttcttgtccattttagtctctggccagctagttggcggtgg

SEQ ID NO: 40614 - DNA, 403 bp, Triticum aestivum
  Clone ID: PAT_TA_40614
cggacgcgtgggctgcgccgacaccttcgtcaccgacgccctcctcagctacatctccggcagggcaccctcgctgaagagccttcaactaagcctgtgtgatgaagtatccaacgaggcgctggcagatgcagtcaagggctttcctcagcttgaggagctggagatcacattctgctcactgaacagcaacgtgtgcgagtcagtcggcagagcctgcccacacctgaaatcctttcggctgaacgagcgctggacggtcctccaaagggggtttgcagtctttgagggcatggatgatgacacgggtgcgctagggatcgcgagcagcatgcccgagctccgggacctccagctgatcggcaacaacctgaccaacgccgggctggcggcgatcctcgac

SEQ ID NO: 40615 - DNA, 396 bp, Triticum aestivum
  Clone ID: PAT_TA_40615
cggacgcgtgggctgtaaccaagaaatactgtttggtgaattgattgaagacttgaactcctttttctgtatttttcttgttctaaatctagtatgcatagcagcttaaattctgataatatgctagcacatgcagttaacaatctaacataccacaaaactatgtctgggtctctggggtagagcagacgtttagatgcttaacatgataaaatactcaacaattttgaggcaatgaatctttatatagatgaagttcttccatgaagcttcctgcattatgttaattaccagcttgccaggatgctatgttataaatacccaacattcacaatttcttctatgctgtctatatcctttaaaacaccctttccttctgcaaattaaccacgaaat

SEQ ID NO: 40616 - DNA, 403 bp, Triticum aestivum
  Clone ID: PAT_TA_40616
atctcctcgctgccgccgccacctcctccccgtcccggcccctcccgatccacctcctccccgtcctctcccacccaccgccgacctcgccgtcctcctcgaccacgcctcgccggagagagagagaggcgtcgcccccagcgactacggctgttccccctcctccctcctccttcgcgcctcacccgcgccgcgccgccccggcgcgctgctgctatttattccctccaaatcgccattgcccacagcagcaaggaatcaagatccaatcccgtcccctcccatccaatcctcccccgcggcaacagagatccagccagatccgcctagttccatggcgaccgccggcaacgcccccgctcccgcaagcgcatcgaggccatcgtcctcaagcacgcgcgcg

SEQ ID NO: 40617 - DNA, 293 bp, Triticum aestivum
  Clone ID: PAT_TA_40617
cggacgcgtggggtgagcgtcctttctgcagcgtgcggcgtgcgcgtgcgagcgcgagaaaaaaaaaaaaggaggcggcttccgttgcatgtgagcggagcggaccggaggggcggtagagcatagtagcgtatcgcggctcggggccatgttgttcgcgctgaatagctgtctctttctagtttattggctgtttatatttttgtttttttcgtttatttggtttcttcttttttcttattttatctttattatatattttttttatgtttttttctttggcttctcttttt

SEQ ID NO: 40618 - DNA, 397 bp, Triticum aestivum
  Clone ID: PAT_TA_40618
cccgtaccggatgcgcgacggcggcgacagcgacggcgagggcgagctggaggtgctggtcatcagctcgcagaaggggcacggcatgatgtttcccaagggcgggtgggagctggacgagtccatggacgacgcggcacggcgcgaggccctcgaggaggccggcgtccgcggggagatgggcaaggtgctcggctgctggcactaccagagccgccgctaccagaccacctacgagggcatcatgtacccgctccgcgtcaccgacgagctccagcagtggcccgagatggcgtcccgcaagcgcacctgggcaactgtgcagcaggtcatggagggatgccagcactgctggatgcgggaggcgctcgaggagctcgtcgcccggcacgccaag

SEQ ID NO: 40619 - DNA, 358 bp, Triticum aestivum
  unsure (1)..(358): unsure at all n locations
  Clone ID: PAT_TA_40619
cccgaaccggaggcgcgacggcggcgacagcgacggcgagggcgagcaggaggggcaggacaacagcncgcagaaagagcacggcacgaagcaacccaagggcgggagggagcaggacgagaccanggacgacgcggcacggagcgaggcccacgaggaggccggcagccgcggggagacgggcaaggagcacggccgacggcacaaccagagccgccgggaccagaccaccaacgagggcaccagggacccgcgccgcgacaccgacgagcaccagcagaggcccgagaaggcgnaccggaagcgcaccagggcaacagcgcagcacgacaaggaggaaagccagcacagcaggaag

SEQ ID NO: 40620 - DNA, 393 bp, Triticum aestivum
  Clone ID: PAT_TA_40620
cggacgcgtgggcggacgcgtgggcggacgcgtgggcttctcccgccgccgccccgcgaagcaaagcaggaggagaaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgctgaggagtt

SEQ ID NO: 40621 - DNA, 283 bp, Triticum aestivum
  Clone ID: PAT_TA_40621
cccgtctccccccacacctgcgacctttcaaccaatccgtacatttgttggggggaccactccattaccatccctacattgatgctgattttccatttggaggttggctctgaggcgccaatgctttacacagctgttggttggtttcattttgatcgtgcccaagcgctcggggaggacacctactacactttttctatggagttaacgtctcatccttatcgcattttacttttttttactcgcatgaattgttgatatgatgctggtacaatggtccctt

SEQ ID NO: 40622 - DNA, 385 bp, Triticum aestivum
  Clone ID: PAT_TA_40622
gtccttcctcctctcgatgcggcggcgttactccctcctcgatgcgctgtcgatccgcgacatgatgctgcgggactacttctccgccggtatggtccaaccccctcccctctacacttcctccatagcccctaacggaacggaagaggcacccagccagtctatcgaggggatggcaaaggcgcatggcgcggcggcggctctatcccccgacggcgggtacacgtcggacacgcacgacgagggcgggccgcaagaaaaagaaggagatggcagacgattcgccgccaccgaccaaggtcccaaaccagtgggtcgccacaactccctgagcgaccacgtcagcgagtgggttagtagcattgacagcgaaagcctctgcatc

SEQ ID NO: 40623 - DNA, 344 bp, Triticum aestivum
  Clone ID: PAT_TA_40623
cggacgcgtggggtgagagagagcggcaccaccggcggcaacaccaacacatctatagagccctggtcagcggagaagtacgccggcactcacgatgggctgacggatgggcggacagtggaacaaggcacggacccggtcccgtactgccgggctccagttccctgtttatcgcatggggcgcttacttaagaacggcctttacgtgcagcgcgttagcttcgtcacacaggtttacctgggcgccgtcctatgagtgcctcgcctgctaggtacctgtagctggtcgggcacgctgtcaaggacaacaagaagactctcatgcgaccgcgttaccatgctgc

SEQ ID NO: 40624 - DNA, 378 bp, Triticum aestivum
  Clone ID: PAT_TA_40624
gaagtcgcgctcccaaaccctagctcccaccgcagcggcccccgccccctcccggtgcgcgcttgctgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctg

SEQ ID NO: 40625 - DNA, 394 bp, Triticum aestivum
  Clone ID: PAT_TA_40625
cccacgcgtccggacgatttctccatgccgagcgctcgccttctgttgtccgcatatggatccgggtgccgccgtcccttcccagcctcctccagtgacatggttggtgacaccaacctatgctcacctcctcccatccctccaggagctctcccgtcaccctgtctgacggcctcctctccctgcaaactcccttcgccgaggtccagtatatgttcatccccggcggctcgagtacagttcggcgtacgacggcgtacagtacggcgtattacggcgtgcagtattgcatcccacatcgtacgtgcgcgctcgtgtggctgggagtggactgcatcccacaagcagcaaaggctttttttcttttccttttggattttggatgtgcagaact

SEQ ID NO: 40626 - DNA, 333 bp, Triticum aestivum
  Clone ID: PAT_TA_40626
ctcaagtacgccatgaaggcgagaggcgtggacgcgaggccggggtggagctggtacgcaagccgggcggagcgtccacgtcttagaggtcgacggcgggtcgccggcgcacccggagacgccggagatatacggcgagatgagccggctggtgtcccaaatcaggatggtggggtacgtgccggacaccgtctgtatcgcctacgacatcccctaggaggagaaggagcgtctgctgctctgtcacacacagaagctctgccgtactctacagtatgtgtcggactgacacaagccacacgctccttagggtgtttaagaacaccaggatgt

SEQ ID NO: 40627 - DNA, 299 bp, Triticum aestivum
  unsure (1)..(299): unsure at all n locations
  Clone ID: PAT_TA_40627
gggggagcgacgcgaacgggcgaggacggcgcccncaaagagaagcacgcggcacaggcagcggggacgggggagcgacgccganaacagaggcggcgcgacgccaacgcggaccaacacgaccgggggcagaaagcgaacgccaagcgacggaggcacggaaaccgngcccaggaccacgcacagcacccgccagaagcggcgacaacaagaaggccaggaagaccgaacacggcagggcacggaagaaaaagcggacagaaagaaaaaaagagggccaagaacaccaacacgggggg

SEQ ID NO: 40628 - DNA, 291 bp, Triticum aestivum
  Clone ID: PAT_TA_40628
gcccgctatcctatcatggctcctcacaccgctgtccttctctccctcctcgggctcaccacctgcgcggcggacacgcatcttcactttttcctccatgatgtggtctccggcagcatccctacggtggtgcaggttatcatgggttctgcctagttgttcatattttttcttttcgtgtattttatttgaattttttattttttttttttgttatatctggtgttttttttgtttgttttattttttttttatttatatttttatgtgtttttttaattttcttttatg

SEQ ID NO: 40629 - DNA, 397 bp, Triticum aestivum
  Clone ID: PAT_TA_40629
cggacgcgtgggtggcaaacctgcattctgaatctcaggaagaagtgggtaagcttgttatggatcttcaaaagttaaacgatgagttaagtgaagtgcaggacagcaatctgattgtggaggacttattgtgtgaacttatgaacaccatctctgttttgaataccgagaaagatgcagcacttcttcaactgcagctgtccttagaaagagtaaccgatctgaagtcagaagtctcggagacacagttggaggcagagaaaactgaggagaagttgcaggtactggagcaagaatttgctcagaagaatgtcatggtggattttctgcagtcaagtctgcaagatgagggcaagaaacgtgtggaagctgagacattgctcatgtcaaaagagaa

SEQ ID NO: 40630 - DNA, 393 bp, Triticum aestivum
  Clone ID: PAT_TA_40630
cccacgcgtccgcgaacatgaaccgaccggtcacactgcaatgctgcaacctgatggcgaagctacaaaagtggaacaggagcaactcagtgacacagcaatgctgcaacctgatgatgaaggtggaagagtagaacatgagccactcagcaacgctccaatggtgctacataatgaggaagctagaaatgtaaagcaggaagcactcatcggcactgcaatgccccaaccttacgtggaagatagaagagtaggagcagagccacctagagatgctgcaatggtgcaacctaatgatgaagctagatgcgtaaagcaggagctactaattgacactgcaatgcctctccccaatgaggaggccggagcagctgcaaatcctgtgccattgag

SEQ ID NO: 40631 - DNA, 382 bp, Triticum aestivum
  Clone ID: PAT_TA_40631
cggacgcgtgggttttcaaaatagcggcacaaagctaggagtgctgaaagctgccaatgagtcattgactcgagtggtagtttatgtttccctaatggcgctttacattcttggtggaagcaaagtcagtgcgggcaagttgtctattggaaccatggcatcttttattggttacacattcacactgacctttgctatgttcatttctcctatccactgagatctgatgtggatgtcttaaatgggcttgatcttgtaattgagtgtggaaaagtcacagcacttgttggctctagtggtgctgggaaaagtacagtggtgcaacttttagcgcggtactatgagcctactcaaggtcgcatcacggtggcaggggaagaca

SEQ ID NO: 40632 - DNA, 294 bp, Triticum aestivum
  Clone ID: PAT_TA_40632
ggtgtacgttcacacaacggacactatcgccgtgcgcagctagggtctcgcggatccccacccagttagggttgccagccggaccaattcatggccgccgaacccgtcgaggacgcggacccgggcgccgacacaatcatggaccgctcatcggagctgaagcggaagtacgagatgctggccagctgcacgcgcctctaccagacaaatgaccgagcactattgtgttcctctagactccccacacgtgccagttcaactcgctccgggccaggtgccaacatatagagctaa

SEQ ID NO: 40633 - DNA, 251 bp, Triticum aestivum
  Clone ID: PAT_TA_40633
cccttttcttcccctcgcccccgatcccccaatctcctcctgcggggcgatgcggtggaagctcggcaccgcggcgtacaagcgcgtgccgttccgcgacgccgccatggatcccgacctcgagacgccagagaagacgcccgacggagcaggaggagcaggggcagcaggggcgggcccgtcgtggcgccggtcgctgccgcacgtgtgcgtcgacaccgtcacctccttcctcttcggctaccacacag

SEQ ID NO: 40634 - DNA, 386 bp, Triticum aestivum
  Clone ID: PAT_TA_40634
tttgttttccagaatccattggctccctaagaaaccttcaagtattgagcttggattattgtggttctctgcatagtcttccttcaacaatgacccagttgtgcagtttaagatgtctttctcttgatggtacaaaaatagatcagattccaaaagggatagcaaaactgaagttcctcaatactttacaaggattccctgtaggtgatggaagtgataatgttaatgtacaagatggatgcaagttggaagacttgtcttatgtgtcgcagatgagggatcttggccttgttaaattggaaagagcagctcattgtgctacaaatgcagtgctgacagacaaaatgcatctaaaaaacctaagtctaaggtggactgaacgtgga

SEQ ID NO: 40635 - DNA, 103 bp, Triticum aestivum
  Clone ID: PAT_TA_40635
gttctggggttattgtgtgtctctgcatagtctaccttcaacaatgacccagttgtgcagtttaagatgtctttctctcgatggtctcaaaaatagatcatat

SEQ ID NO: 40636 - DNA, 381 bp, Triticum aestivum
  Clone ID: PAT_TA_40636
taacctctcttgttctgctagaaaacctatctatcatggaatgctttcacctgtgttcttctgcaaatttgacttgctagcttccattgttgattgttttcaaaaagaattgatgatatgttctaagttgatatgtgatttacatgtttccaccagttgaggggaaacattccaagtatccctagggttgtgacaattgataaaatcccatcttaagggttatttttagtttaaccctctggcattggaaatgaccaatttctctagttgttttggtctactctccctctttctagctgtctgtatgtgcagcactaacatagtggcagtgaaagtttactgcacttgtttcttttcttaatcttagattatatgatgact

SEQ ID NO: 40637 - DNA, 390 bp, Triticum aestivum
  Clone ID: PAT_TA_40637
cggacgcgtgggttgagactcccttcctggtggtgaccctgggtgagatagagattgttaatctggagagggtgggctttggaacaaagaactttgacatggctatcgtgttcaaggacttcaagaaggatgttctccgcatcgactccatcccgtcaacctcacttgacgcgataaaggagtggcttgacaccactgatctcaagtactatgagagcaggctgaatctgaactggcgccctatcctgaagacaatcattgatgaccctcagaagtttgttgacgatggtggctgggagttcctgaacatggaggcaagtgattctgaggcagaggaaacagaggaatcagaccaggggtacgagccttctgatgctgagcccgagtctg

SEQ ID NO: 40638 - DNA, 332 bp, Triticum aestivum
  Clone ID: PAT_TA_40638
cggacgcgtgggagaggagagccatggccaaggaggtgagtgaggagccggagcacgccgagccggcgcacaaggactacttcgacccggcggcggtgccgatgttcgacatgggggagctccggatgtgggccttataccgggccctgatcgccgagttagtggtcacgctgctcttcctgtacatcaccgtcggcaccgtcatcggctacaaggtgcagatggcggacgtcccgtgcggaggcgtacgagtgctcggcatcgcctgggccttaggcgacatgatcttggtgctggtgtactgcaccgtcgacatcttggagggccacatc

SEQ ID NO: 40639 - DNA, 135 bp, Triticum aestivum
  unsure (1)..(135): unsure at all n locations
  Clone ID: PAT_TA_40639
cttttagcttcgacctcgacgatctcctgctgttccacttcccctagggttcgacagtatttaatatctcatactccaaactcaaccagataccgaaaagagtctcnnncgactttggtagaggggggagaagca

SEQ ID NO: 40640 - DNA, 254 bp, Triticum aestivum
  Clone ID: PAT_TA_40640
ggctgggcatcgcggggttcagttgttggagaggataagggggacggcagctgcactcggcaccatgggacacccaacgtggttggagaggataaggttgatggctgatttctttgttcgcctttgttgaggtcaatggtttcacatccttcttaatcccttgccatgtggcaataaatcgcaaaagagcagacaccatcctatgctccaccttccatgtacatgtattcttctttgtaccctgaaccgaaggc

SEQ ID NO: 40641 - DNA, 304 bp, Triticum aestivum
  Clone ID: PAT_TA_40641
cccacgcgttcgcaaatccacgcctgggtgccgccgccgcatacgccgctgctcacgggcggctcgctggcgcgcctccatcttcctcggatgaggagacgtcgatggcgcctgcagcggcgccgttgggtagatcgggggcgagaccggagcgacgactagggcggcggtcgatggcggcgatggcgcgaccgaagaggcggcggcgtccctccatgctcgcggagtcctggcggtgcggtcggtcgaccgtgcgcggggacggtggtgcctcttccggcacggaggcggagacactcggaga

SEQ ID NO: 40642 - DNA, 270 bp, Triticum aestivum
  Clone ID: PAT_TA_40642
tcaatggctactcacccagcattggcgcgtcatggtaactatgtatttccagctggtcacatggtccagggcaatgcatggactacacaccctgcaaatattattgctgacggagtcccacactgggcatacaacattgcactccacaatccttcaggtcatgaggcttattcaggaacaatgcgcatgccaaatggtagtttttcaagactatcaagctggcccttctgctacttttcatgggccctttccctcaattaaaccaatttt

SEQ ID NO: 40643 - DNA, 365 bp, Triticum aestivum
  Clone ID: PAT_TA_40643
cccactcgtaaggcggatagcaacgccaaaaggatttgcatacacaactccaaaccctacgcgaggcaaggcacggagcagccatggatgcggccatggattccgatgcggtctcgaaggactactaccagaactactactagaccttcgactccaaccgggccgtgctcgaggagctgtaccagcacagcttcatgctcaccttggagggcgagaagttcggcatccccggcaagatcggctgtatgctcttatatctccccttgcagaagagccagaacaagatctgcaccgtctactggcagcactgggggccccagggctgcgtcctcgtcttcatctccagcaccatcagcaacggcccc

SEQ ID NO: 40644 - DNA, 386 bp, Triticum aestivum
  Clone ID: PAT_TA_40644
cggacgcgtgggagaacggccacttagcagtagccaagccacccacgaccacgcccacgccgacgccgacggaaccgccactgcaaaactgccagaacgtccgcagcgccgatggcgtgttggcggaagaaggtcgtgttccgggcgcgccgtgcgtgggccgccgtctccggccgcctcctccgcggcagcaagtccggtcagtctccctccccgcacccctctccaactcaaccactgtccaggcgtatgttcgtctagaaaaaaacggtgatgatttccggttggtttcttgattggaagcgctagatggccaagattttctctccattttgcttccttcggtgttcctgaaatgaaagaataaacagatgaaatgtgggtct

SEQ ID NO: 40645 - DNA, 241 bp, Triticum aestivum
  Clone ID: PAT_TA_40645
gctccacctaccccagccggacttatccgcgcgccaggcagtcgatccaccgtgggtgccaatggagcccgaccgagcagacctgcttgccttactagcggcgcgagctgctaccgctcgccctgtaccgcggtcaggggcatggtccgcacctgccgggacagggacgggatcatcgtcaccggcctggcatgcataatcaagcccactcagacttaccaggtggaggttgagtttccct

SEQ ID NO: 40646 - DNA, 299 bp, Triticum aestivum
  unsure (1)..(299): unsure at all n locations
  Clone ID: PAT_TA_40646
ccctggagcggagcagaacagcccaccgacaggaagcaagcggggcggcatggaggcggaggcggggnctacgccaccacacgacaccgtcggctggtcaaggccttcaaccccaccgtcgagccgcgcaacttcggcatcggcctcgtcgccggattcctcctcgtcacctgcgcatacttctccaccgccaagttcgacgccatccacatcgcgcccctcgtcagccccttggagacccggattggctcgccggcgaccgccgncgncgncggctccaagacccaattagatttggg

SEQ ID NO: 40647 - DNA, 390 bp, Triticum aestivum
  Clone ID: PAT_TA_40647
cggacgcgtgggcggacgcgtgggcggacgcgtgggcacagctccatgtctcctgagctcaccgccgatcaccgctgaggcgctgagttgcgccgaccgaaaaagatataataatcctaggcgacttccatcgaccgtatgctgtatggcggcgacggtgaggaagctggtggtggaggtggtggaggcgcggaacctgctgccgaaggacgggacgggcacgtcgagcccgtacgcgcgcgccgacttcgacgggcagcgccgcaagacgcgcaccgtgccgcgggaccttaacccggcatggaacgagccgctcgagttcagcttcccgggccccggatccggcggcatcgaccccgtcgccggcgagccgctcgaggtggccatttt

SEQ ID NO: 40648 - DNA, 384 bp, Triticum aestivum
  Clone ID: PAT_TA_40648
cactgacagccggtttgccgttgcagagcatgggcatgctgaccctgtcctgggcgctcccggtgttccactcggacgggtgcaccagcttcacctcgttctcgggcgcgtgctcgccgtcgccggtgcaggtgaccatcttctacgtctcgctctacctggtggcgctggcggaggccgggcacaagccctgcgcgcaggcgttcggggccgaccagttcgaccagcaccaccccgaggagtccgtctcccggagctccttcttcaactggtggtacttcggcatgtgctccggcaccgccgccaccaccatggtctccagctacatccaggacaacatcggctggggcctcggcttggcatcccctgcctcgtcatggtcct

SEQ ID NO: 40649 - DNA, 380 bp, Triticum aestivum
  Clone ID: PAT_TA_40649
cgccaacatgatgcctccactccgtcctatcttataggcgactgccctaatcaccggggcgttatccatttgccatcaaactaatgctttagggactcctcgtaccgaaggcctgcaaataccgaacgacaactacacgtcgaactcgaacggtgatgcgggcgtccgataagcagaagcagcattaggcagggacacaatcaaatttataccatacgttgtgatgatacaaggaaagtaaacatagatgcatattttgttcaacgttacgatacaagggagagttggcctacgtcgtcaactgatctgcggtagcgtggaaggtgagttcaaaagcagcaggagcggctgttctactgctggtcggagggagagcttgt

SEQ ID NO: 40650 - DNA, 285 bp, Triticum aestivum
  Clone ID: PAT_TA_40650
cggacgcgtgggcggacgcgtgggtccccacctactccctcgccgcgccgccgcgcagccgcgagtgcagcgaacatcggcgccagtgccacgcttatggccgccacctcccattccctcctctctccggcgcccacctcgcccccccgcgcccgcctccccttaccctccgtccgggccggagacccccgccgacgctactttttcccggccggtgcggcacccgcctccttgatggcatgctcatatgccgaggagaagaaaggaaccatgctccggtgcggt

SEQ ID NO: 40651 - DNA, 147 bp, Triticum aestivum
  unsure (1)..(147): unsure at all n locations
  Clone ID: PAT_TA_40651
cccacgcgnccgcccacgcgnccgcccacgcgnccggancaagagcgcgagcggccgcncaagaggaaccaagcnnacgnacgcgngcacgcgacgncaaaagcacgcaaaagagacaccaaaaggcaaggcacgggccggcggaga

SEQ ID NO: 40652 - DNA, 307 bp, Triticum aestivum
  Clone ID: PAT_TA_40652
cccacgcgtccgagaatttggtgttcctgtgtgccggtaacagcaacttcaccgtccagctcgagtctttgcagttcaagaaacttcccacacccagaatgaattgctttcatccatttgaaagtgtctatgctgcaggtatctagagttgtattctggttgctgagatgcaggagtgggcttgttgctgaaggtttttccattttgccaacttcgctctgttatctaatttctggacatgattagccaacaggcatgttgaagatacattgactggcttcgattaattagtacttatgttgccgtt

SEQ ID NO: 40653 - DNA, 383 bp, Triticum aestivum
  Clone ID: PAT_TA_40653
aaagtactgtcactgacctccaaagaccagcttaaggttgaagtaactacagtgtttggttctgcggcacctcccctcagagtgaatcttgtccaagtcttgggctctgattctaagatcatcaccactgacagcaaggaacttcagtttgacctcgacaacaatgttcattacttggacattactccattgaaaatagatgtcgggaagtactcgctagtttttgagattactcttcaggattcagaacatgaaaccgtttacactactggagggagaaacactgagtctgtcgtcgttacaggactgatcaaagttgacaaggcagaaattggaatttctgagaatgatgctgggagtgcggagtctgtcgaaaagttaga

SEQ ID NO: 40654 - DNA, 386 bp, Triticum aestivum
  Clone ID: PAT_TA_40654
gccactgcccgcctatctccggccgccaccgccctccctgctccgaccaccgccgggtaagtcctccctcattgccgtccctctgctgtccccttccaaatctgccagtgaccccccaggtcgctgcccaaactgcgccgccccccggaatccccaattcacaaatccagatccggcgtctactccaattccttcctcttcccagcccaatcggatcctcgcaggtatccgagttcaggttgtaattagatttttcttcatatatatatatatacagatctctcagccaggattcgatacggtgcaagtcgacatgtcaaagcgcaagatctcgctccacagctgcagcaccgccgccgcggcggtcgaaatgtcaaagcgcaaaa

SEQ ID NO: 40655 - DNA, 388 bp, Triticum aestivum
  Clone ID: PAT_TA_40655
cccacgcgtccgatgacgacgacactggagtgcactcttctcctaatactgccggagttcacgtcattatcaatgatgtcacttctgaagggcctcctaaggctaatgggactgacgttcaaactgaagttgatctgcggctgcctgaaagcgcaccgcattttcaagatttgtatccgtctgaatcacattgtagtggtgatcagcatcaggatgctgaatcacattgtagtggtgatcagcatcaggatgcctccgcttcccattgtcagccagagcctgaagatggtgcaagattcagtccagacttctctgcagatgaaacaagcaagtcaaatgcctccgcttcccattgtcagccagagcctgaagatggtgcaagattcat

SEQ ID NO: 40656 - DNA, 267 bp, Triticum aestivum
  Clone ID: PAT_TA_40656
cgactacaatccgagacgctggtcctgtcgtactctctgcacggatcagtgctcgccacgacgtcattttcctatacgtccacgtagaaccaaatcggtaaccttagcctttcgacgtcgaaactggaaaagctctggccgtgcgcaaattcatagcgttgcaacacgtgacgctttcgtcagatttacttattgcgaatagtcctgctcagaatgctctatcaaacagtagcgcagactgaatggcggatgggtcgcgtcctgatt

SEQ ID NO: 40657 - DNA, 293 bp, Triticum aestivum
  Clone ID: PAT_TA_40657
gcgagttatacgcgcgggtgttcaccagggagagctccctcgccaacccctctttccgctaatacggggccggccccgccgccgtgcctttagtttgggagtcccagccgggcaccccaaaggacgccacctcctggtgcaggaaggcgctccccgtcgtcccggacataaccccgccggcgtactacaatgcgcgggccttcccagcctattcgaaccttgcagggattcggatttaaggttgtaagagaatggccgccccctgacacatgaggacctatatgtgctgctgg

SEQ ID NO: 40658 - DNA, 387 bp, Triticum aestivum
  Clone ID: PAT_TA_40658
ctgacgcgtacgctgaaatagttgcaacttaactgcacacacactgggcctgagactgcgcccaagtgggccgtcaactctgtcatgtaaccggccacgtggcttggagtaacgctcctgattacaaacctcaccatcacactggccatgtttgagggcgcgtgccagatgtgccgacaactttaccagactagtgacgtgactcacacaggggatcactaaggtgctctatagagctgccgctcgtgcttccagacctggccctaggccgggcactggacaagccaatggagtgaccaaacaagtgaccaaaaccgacaccggggctcactgaggggctctgtggaggctgctgctttggatttcgggacggacttgtggctagac

SEQ ID NO: 40659 - DNA, 277 bp, Triticum aestivum
  Clone ID: PAT_TA_40659
cccacgcgtccgctgaaaagtttttcacataaatgcacacactcagcgcgtgagagtgcccacaactgggcatacaattttgaaatccgaccgggaacgacgcctggatcagagcaccggataacaaaactcaccagcacagtgacaatctttgaagacgatgttcagatgtgccggctattctaccagacttgcgacgggagacagaccttgggtcccaagggtggacgatagagctgccgtattggctgccagaccgggccttaggcatggcaat

SEQ ID NO: 40660 - DNA, 391 bp, Triticum aestivum
  Clone ID: PAT_TA_40660
ccacgcgtccgcggacgcgtcgggagactagcacatgacccagcctcccgatccccttgcagccgtcatcgccgcccgaccatggagtcccggccgccagctccccggagatttccgcctccctaaaagtccagatctccagtccagcgcgccgccacctcctgccccgaacgcctcacctcgcgcctccggtccgccccccgtcgccgcacgccgtcagtccccgccccctgtcgcagcgcgccggcggaccgcctaccgtcgctggctctccccagccctgaggtcacatctctttcgaagatcctctccaactcatagttcctcgcagagggcacccgctcgtaccggcgttttaagaggaggttggtcgccccttcttgcggacgca

SEQ ID NO: 40661 - DNA, 363 bp, Triticum aestivum
  Clone ID: PAT_TA_40661
gaacaatgcgcggtgtcgttcaacgagatcgacaccaactcggtggagcacgcggagacggtcctcaacaccaacttctacgggaccaagctgctgaccgaggcgctcctgcccctcttccggcgatcgccggccaccagccggattctcaacatcagctcgcagcttggccttcttaacgtaagtgcaagcatgttctttcagctcagatggatggtatttcaaagtctgcaaacatgccgttgtgggctcgactagtcgataacacaatcaaactatcaaagtgtgaacgcacgtggctagctacgtatagagacaagataattttcaattctatctcaaaccatatcgcaatcagcaacg

SEQ ID NO: 40662 - DNA, 252 bp, Triticum aestivum
  Clone ID: PAT_TA_40662
cccacgctccggtcggcggagtccggcgcgctgatcgacacgacgggcgtagacattcggctgcccatgctggtgtacgtttcgcgcgagaagagacccgggtacgaccacaacaagaaggccggcgccatgaacgcgctggtcaggacgagcgccatcatgtcgaacgggccctttattctcaacctcgactgcgaccactacgtgcacaactggggggcgctccgcgaagggatgtgctacatgctcgac

SEQ ID NO: 40663 - DNA, 116 bp, Triticum aestivum
  Clone ID: PAT_TA_40663
ctacgctacgaggactcttggtcggacgcgtgagttaaacaagagaaaagtaaaatcttactagcaagcatgaaattttcttcatttaagaagaaatcaacattttatttattcta

SEQ ID NO: 40664 - DNA, 152 bp, Triticum aestivum
  unsure (1)..(152): unsure at all n locations
  Clone ID: PAT_TA_40664
ncgatctttattattttaaaaatctttagcagcagtgccagcaactcatgcagaagatttcttcatagctttatccagcctcacattaaagggagtcgagtgccagtttacccttctgtcctttttggatttgcttgttgaattggggttgc

SEQ ID NO: 40665 - DNA, 375 bp, Triticum aestivum
  Clone ID: PAT_TA_40665
cggacgcggggcggacgcgtgggcggacgcgtgggggctagcatcagtcagtgctgtccttaaggctctagctgccagctgcccgatgcttcaggttgttgagctcactttcgcattctgcgaacccgactggcctaccgaaataggcttcacacaagagggtattgtgacgctcatccaatcttgcccaattcgctctcttttgctaaatggtgccagcattttgtatgacgaggggatgaagtgcctctcatcctcacagttcctggagaagctcgagctcgtggattgcagatctataactgatgctagtatgaatttcattattcaggctccttgcttgagcaatctcacactccgcaaatgcaagaaagg

SEQ ID NO: 40666 - DNA, 371 bp, Triticum aestivum
  Clone ID: PAT_TA_40666
cacgcgtacgcgtgggatttatacaccgttttactagatcttgtatatagtactagtagggtgcagaatttgctattctatagccacgcttatatatataagaataagtaattcttgatcctgagccaacctatctctcagtctgatcccactcacgtgttgtaccttgggggctccgaccctccaccgatttatgacaagcgaggttaattttctacgcgactacgtaagtttttcccttttcttacatccccaaaaacggatacctgttttttttgttcacctaatatatcctctccgatccaactctaatccctgcggatatgaacggcagactcactcgcgttagctggcttcggggtggtggtctg

SEQ ID NO: 40667 - DNA, 378 bp, Triticum aestivum
  Clone ID: PAT_TA_40667
cccacgcgtccggaggacctgcattacctctggctggacggcaaccttctcgaggggaccatcccgtcggcgctcgccaactgctccgcgctgctccacctcagcctccaggggaacgcgctccgcggcattctgccggccgcggtcgcgtccataccgtcgctgcagatactctcggtgtcgcgcaacctgctctccggcgccatcccggccgcggctttcggcggcgagaggaactcctcgctgcgcatcctgcagctgggggacaaccagttctccatggtggatgtgcccggtgggctcggcaagggtctccaggtcgtggacctggggggcaacaaactgggcggcccgttccccacatggctcgtcgaggcc

SEQ ID NO: 40668 - DNA, 381 bp, Triticum aestivum
  Clone ID: PAT_TA_40668
ccgcatgatctggctgcgcgcggggaggagttgtgcttgccaccgggacagacggatccaggcttccgtcgagctcacgcgtcaccatcgccgccaggaggcacaaacggatgaagacgtcgagcgccaccatccgcgccgcttcttctcaacgcctctcttgcgtgtgcgcagctttgaaaggaggtgactaggttggagcggactatgacaaggcatacgaggggttggagcaggactgcaagaccaggtgaggacaagcgttgtttcatatccacctaaatcatcccatggtttgcaaggtctgcttctatgcaaaaagttcttccagtgagcaccctagccaattaattacagttaatcctttatgtctgatttatt

SEQ ID NO: 40669 - DNA, 162 bp, Triticum aestivum
  Clone ID: PAT_TA_40669
ctagcattagaagatttcgtggaatcctgtgtgtacccggcttcttgcaacacctttgttagtacttggcggttacacacaggattctacaggtgtataagcagattgctggtccgtcatcttacaccctatgcttaagggtgaggcttatgcgcacacaaa

SEQ ID NO: 40670 - DNA, 204 bp, Triticum aestivum
  Clone ID: PAT_TA_40670
ggagggagccacaccacgccaatgcactgtttattcctgtactggaccggccgccctttattcttgcatgcacacaatagggacgactaacagctgattaccttgggaccacacaagcgcaggcgaacaaaggtgctagaggcccttgccatgggaggagcacgcatggtgatacgttgatgaagacatggacgtttcacaagc

SEQ ID NO: 40671 - DNA, 218 bp, Triticum aestivum
  Clone ID: PAT_TA_40671
atggcttgctatgttctacatgtgtatacccactgggatagcactgggttatgtttatggtgggttggttgggggtcatctgcactggcgtgctgctctctgcggagagtcaattttgaagcttacctttgccattctgggctgcgagatcaagcccctatacctcaaaggatttactcacaacaaaaacacaaaagagtatggtcaaatgctcagtg

SEQ ID NO: 40672 - DNA, 372 bp, Triticum aestivum
  Clone ID: PAT_TA_40672
cggacgcgtgggatttatacaccgttttactagattttgtatatagtactactagggtgtagaataagctattctatagtcacgcttatatatataagaataagtaattcttcatcctgagccaacctttctctcagtttgatcccacccacgtgttgtaccttggaggctccgaccctccaccgttttatgacaagcgaggtaaattttctacgcgacgaggtaagttttccccttttcttacgttggcaaaaactgttttctgttcgtggggttagcccactctgcctcctccgatccaactctaaatcctgcggttttcagcggcgactcactcgcgttagctggcttcggtgtggtggtcgacgactc

SEQ ID NO: 40673 - DNA, 149 bp, Triticum aestivum
  Clone ID: PAT_TA_40673
cacaatttcaccagcccccctaccaccgcactcgaaaacctctcggtgtctcactccaacagtttgcaggaaagacagggagtagatctatcttgcgtcgccaagatgttcattgagagctacctcttggatagccctaacgtgcggta

SEQ ID NO: 40674 - DNA, 374 bp, Triticum aestivum
  Clone ID: PAT_TA_40674
tgggcctatgggcccgttagtcttagggttaattagagataagggtcgtttgcttaggggtcaagtaagccttgcttggaagtcaagtaaacctctatataaagagaggagatgtatcaatctaatcaagcaagaattaagaaggaaatcccttccctcttgcccggccgtgggcaaaaagacccccggccggccctctcgcgccctccttctagcagcgccataacacatacccattcatgctttcccatgtaattttaatttgtattacgtttgttgatcaatacagtactataatagtgattttttgtaggagatgctggtcgtatttgctttgtctcaggtcgtctatgcggcctgcattttcattggat

SEQ ID NO: 40675 - DNA, 374 bp, Triticum aestivum
  Clone ID: PAT_TA_40675
atttgtgttcagggcatgattcaagacccagaccactttttcagaattttctgcctgaagaagtagaatcacctttatgctctagtagtgacaagaaagcaagtaggcagctcttgagtaatccagcattttgcaatatgttcaaggcatttgtaaaagaatggttagaactaagaccaattgatcagaggaaactcctgggaaagccgttacagcttccattgagccttgagttgtgctatttgacaaatagcatcagccacagtacacaaggattgattaaaggggggagtaagaggcgtatagctccattgagtgttgtcagtgatgatttgcctgaaaatgctgaatggagaaaggtggttttacgtcgt

SEQ ID NO: 40676 - DNA, 307 bp, Triticum aestivum
  Clone ID: PAT_TA_40676
cccacgcttcgaacatattatgatactgagagagagagtgctttgcccagtgtacgaccgatacatgcgatacatacgaagccaagttctaccatagtggacatgcttattttgcttagaagttatgcttgtgttctgaacggaaaggccgaacctaacctagcatgatctggtgcgtgccttcttgatcctggtggctacttaattgtgaatggaaccgacaaggtcatcctaatacaacaacagttattaatgaatcgtgtctattatcgacactgattttaaaggaagggtaacttcttttttt

SEQ ID NO: 40677 - DNA, 318 bp, Triticum aestivum
  Clone ID: PAT_TA_40677
ctcaaattttgggggggtttgtttttttaaagagttataagagctaaggaaatcccgcccacttttttttaaattggaagggtgaactcaccggaaatgttgagttattaagagggctcacaaccctcggttggtggaaaaactctccatacctttaatgtgttgggggggaattttgctttttttgacaatatataagcaaagagaccttgtaacactatacaagggcttgagtgggactttaataattaccttttacaagatatggaagtgatttgatatttttctttaaaaggttttttacttgagttgttttat

SEQ ID NO: 40678 - DNA, 378 bp, Triticum aestivum
  Clone ID: PAT_TA_40678
cccacgcgtcgcatgaatatacaagttacacaagaaaaaacgttgtttgtccactcattatagtactagtgtttggtagagctcatacaagggtatgagcaatacaacaatgtctggaatggacatgcaggaatataacaacatagcccacagcaaagggtacaggctatacaatcataacatagtttttccactaggtacagagtaggtatttaaactggacacaaatagcccctgtgatgattgagtagatacagagtaggagtatgtaggacttgatcatgaggtaatatgaaaatcaactaaacaaagcaaaaaggtattttggagcatcttgaactccttgacacaactgtaagtcaaaatcgaaagtctaga

SEQ ID NO: 40679 - DNA, 345 bp, Triticum aestivum
  Clone ID: PAT_TA_40679
cttctcctcccctccggttcgggttcgggttctggttcggttcgggtccgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggcgagatcctcgacgccaagatcatcaacgaccgcgtgacggggaggtagagggcgttcagcttcttcacgttcggcagggcagcaatgatgaccaattccgtcgaggccttcaaccgcaaggcattggaagggttcaacattttc

SEQ ID NO: 40680 - DNA, 360 bp, Triticum aestivum
  Clone ID: PAT_TA_40680
gtgctgccccgctgacctgcggccaccgacggcgagtggaggcggacgacgggttcccgccgcgggctcttcggcggcgccgcgtcagggctcgcgcgggctggtgctgatttgagggagattcggggccggggccggagccggcgcggcctctggggatggggtggctttcctgctgcaagcggtcgaacggggcccaacccggcaggaagaagaagaaggacacgacatggcggatcttctcactcaaggagcttcagttggcgaccaacaatttcaactacgataacaagcttggtgaaagtggatttcgcagtgtctactggggccagctcttggacggatcacaaattgcggtga

SEQ ID NO: 40681 - DNA, 345 bp, Triticum aestivum
  Clone ID: PAT_TA_40681
tcgaggacgcgtggttcctccctactgctcctcctcctagtagccagtctttccactccggcgtgcgcgacactgtctatcaccaccatagtgatgccgcagctgagatctgctgatcccaagcgccgccaccctcgtacccgacccctagctctttgttcgtcggcgaccgaatccaacgccaggaccccgtcacccctctacacttctttcccaggacatctgcctcttgcttatttatgtgcttgtcccgctgactgtcatctccctctatctctcttcctctatggtacagactcacagggtggccgtcatggacgcccgaggtcctccgctccgaccctc

SEQ ID NO: 40682 - DNA, 330 bp, Triticum aestivum
  Clone ID: PAT_TA_40682
cctactcataaggcgagggtccggcctcgttttcggccacacgtgcggctatgctttctatatgaatatgtatgaactattgctgaatcacctattgactggtgctgagagacccgtcatgttggcatgatcgagccctcataatcgccactttttttcatgtggtgtggaacaaaccctaccgcgtttaaaaattgaatctcgcgaatgattttatgtttaccacaagtctggcctatcattggcatgatgtgtttttagttcagacggagagccaaaattgagccgtgtatcttatcaaaggctttgcttgtgggatttacatgggca

SEQ ID NO: 40683 - DNA, 409 bp, Triticum aestivum
  Clone ID: PAT_TA_40683
ccagatttgtgggcgtgttcccgcgggggaactgatggtgggttacatggagtggtcgcacgactggctgctgtgggacgccttcttggaatgcggagggatccggaggccgccgattagatagcggccggggaggaggagggaggagcggaggaccaggaggaggaggaggccgccattagcacccaccctgccaccaccccgacgcccgactcgccactcaccagccgggcgcccatgggggaggacctcgtcaccaccctctccatggagaacggcggcggcggcgggggccaccacggcctctgcaccctgctctccatggacccctccggccacctcgacgaccgcgccgtcggcgttatggtgcagccccgcgccggagggggcccgccccacgcccacgccg

SEQ ID NO: 40684 - DNA, 416 bp, Triticum aestivum
  Clone ID: PAT_TA_40684
cccacgcgtccgcggacgcgtgggcagatggtgtcctttcgatcgagtcgtcttcatcttttgagactactgttgatgttgaagaaggaatggagattgaccgaggctacatttcccctcaatttgtgacaaaccttgagaaatcaattgtggagtttgagaacgccagagttcttataactgatcagaagatcacaagcataaaggaaatcattccacttctggagcagactacacagttgagatgcccgctgtttattgtagctgaggacatcactggtgaagctttggcaactcttgttgttaacaagctcagaggtattattaatgttgcggcgatcaaagccccaagtttcggtgagcggcggaaggctgtccttcaggatattgccatcgtgacaggcgctgagtaccta

SEQ ID NO: 40685 - DNA, 295 bp, Triticum aestivum
  Clone ID: PAT_TA_40685
tcgaggacgcttgggcggacgcgtgggctatacgcgttggcggcgctgatccttaccggctggggcgactagaccgggcgcgcgtggcaaccccactaccttgccgccgtgttctctctggcgggagggtacgcgctcggagtgatatacctcgcggcgcattctgccggggtcaaagtcgccgcggtctccattgacagtcaacgacgagtatttaacgtttacttcggcgcatacgtcgccacgctcgatgccgcgctctacgaggtctggggcgttcagtttcaccccaagg

SEQ ID NO: 40686 - DNA, 388 bp, Triticum aestivum
  unsure (1)..(388): unsure at all n locations
  Clone ID: PAT_TA_40686
cccacgcgtccgactgtgtctgctgtgctaggctagcccattcactgcgcgcggccgacctcgcctnggtatctccatcctcctccatacgccacaccttcgtggaaggggaaggctccgagccgtgtgagaagacgatgaagaagggggggctgctgcggtgcgtgtcgacgggggcgtgcagggtggcgccgggggccgtggcggagatggccatctcgccgtcggcgtcggggaaggtgccggcggggcacgtgccggtggaggtgggcgcggaaggggaggagacggagcgcttcctcgtgccggccgagctgctgggccgtccgcccatcgacgagctgctccgccgggccgngcaggagtacggttacgcacgacgcggtcc

SEQ ID NO: 40687 - DNA, 198 bp, Triticum aestivum
  Clone ID: PAT_TA_40687
ccacgcgttcggatatcatagtggctgatgaggttgttcactgggcagtgcaaaatggtggctatctatcgagaagtactgttgtttatttcaagcacaaatgattggcttcactcgctagcactttggaaaaacttactcgcggaaacaaacgtaccgagaagatttgtacgctacattgttgtgtaatctatctac

SEQ ID NO: 40688 - DNA, 249 bp, Triticum aestivum
  Clone ID: PAT_TA_40688
cccacgcgtccgcccatacgtacgatcacgcgtccggacggacaccagcccgtacccagtagtctccgtcgacatggtcaccaccgagcgcccgatcgtctccgtcaaggccctggacggggacatgatcaacgacgcggatcggcgttcacatgctgaacgttatgaaggcgctgatccgccccgacatcatgaactccttccacaggtttgtgtacgtgcaacagaccagatgctccttatgtcgtt

SEQ ID NO: 40689 - DNA, 132 bp, Triticum aestivum
  Clone ID: PAT_TA_40689
ggctcgccgccctcacgcgggagcagtcggtgtgggcttggtcccggtagttacaatcgattggtgggggcgggggcaggcaggacaggagagcgccgcggcgatgaaagccctgcggcgatccagcacctc

SEQ ID NO: 40690 - DNA, 295 bp, Triticum aestivum
  Clone ID: PAT_TA_40690
gttggacttactgaagctccattgctgcatgcatattcattttgttggtgcagctgcagacctattttagataccgaatccttgctttggaaactagtgactaactggctgtttagcatgttaaatgggtcaaattcttttagtatatggacagtgaaagttccaacgcgttctcctaggtgctgttttatattgttcaaatgttaagtgcattgtttgtttgatcaaagactattaggcaggaatatggtgtagtttcggtaggggaaagttataccctgtaatctgttgtttt

SEQ ID NO: 40691 - DNA, 109 bp, Triticum aestivum
  Clone ID: PAT_TA_40691
tcaacgcgtgggatttacttccgttttccgcagtaaccgaagccaagtttcgaagtcttcgcctaggaggagcatttgaccatactccatggtccgtaccatgtagacc

SEQ ID NO: 40692 - DNA, 292 bp, Triticum aestivum
  Clone ID: PAT_TA_40692
cggacgcgtgggcggacgcgtgggcgcggcctcgcccttgccatcgccgccgtgcgtgaccgtcggattggtattggacgacggcgcctagatgaagggccttttcaagtctaagtcgtggacgccggccgacgttgtgcggcagacgcgtgagcttcttattttacgtggatcttcacgccggcttacgcggcgccgactccaaacgtgaggaggtgaatgatgctgaattaattcaaaatttttagggaattgtagggtattttggatggtaacggggaacaggagcctt

SEQ ID NO: 40693 - DNA, 414 bp, Triticum aestivum
  unsure (1)..(414): unsure at all n locations
  Clone ID: PAT_TA_40693
gggacagccgccgccgccccttccccttccaaacttgcgctcgccggccatgcttcccgtncgccggcgncgncgncaccgaccagccgnacccgcgctaccatccccttcccgttcctctccgagaagcagcccaagggcagccgcctgccgctcggcacaaacgcggatgcggtggccgaagggggaagcggcgctgctttggcgccgctaagcgccaccaccccccgtcccttcgtnccccgccgcccctttggcttctnccttnccgccacacaccctncctttccctgcgccgttgcgctgctgctccactgggtacgagttccatggctgtccgggatccatggcctccgacttggcgtcgtagccgtcagcctcggcgttgagacagtgccaaggaatttcacacgg

SEQ ID NO: 40694 - DNA, 372 bp, Triticum aestivum
  Clone ID: PAT_TA_40694
cttactctgcccagaaaactctagtcgtcgcctgacagttcgtcgtcgacagagagagcttttcctacaccggcgtaaccatggtgactccagatcataaagaataagaagtttgtgcgtgatcgcgaattctacccacagctgaaagtgattctgacccgtgctcttggcgaggacggctaaccctgcttaaggtacgcttgactcccacgcacacggagatcatgattagggtcacgcggtcgcagaacgtgcttagtgagaagggccggagaatcacggagctcacttacgtggtgcagtaactcttgaactttgcagagaacgggggatgactttactccgagtaggtggtgaaaaaaggctacttct

SEQ ID NO: 40695 - DNA, 414 bp, Triticum aestivum
  unsure (1)..(414): unsure at all n locations
  Clone ID: PAT_TA_40695
cccacgcgtccgcggacgcgtgggctcccacactcaacacttccgccaccttggcctcctcctccacagctagctagcaaagctgagctagtagaaggtagccacccacaaccgcagggcgacgatggcgtcgaccgccgccttcctcccgctgctggcgctcctgctggtggcgacggcgcattgctcgccgctgctgccccagcggtgcccgcaggccgaccggcaggcgctgctccgggtgaagcaggcgctgggcagcccggcgacgctcaagacgtggtcgccggcgtcggcggactgctgcgcgtgggaccacctcacgtgcgacgaggccgggcgcgtgaacaacgtctttatcgacggcgccgacgacgtgcgcggncagatcccgtccgcgctggcggggctgac

SEQ ID NO: 40696 - DNA, 419 bp, Triticum aestivum
  Clone ID: PAT_TA_40696
atgaccttgctgccaacaatcctgttctggtgaccttgaacttctacttgacttacctcagagtggagccagctgacctcgagcttctcgccaagaattgcaagtcactaatttcgttgaagattagcgactgcgacctttcagatttgattggatttttccaaatagctacatctttgcaagaatttgctggagcggaaatcagtgagcaaaagtatggaaatgttaagcttccttcgaagctttgctccttcggacttaccttcatggggacaaatgagatgcacataatctttcctttttctgctgtactcaagaagctggatttgctgtacagtttcctcaccactgaagatcattgccagctcattgcaaaatgtccaaacctactcgttcttgcggtgaggaatgtgattgga

SEQ ID NO: 40697 - DNA, 387 bp, Triticum aestivum
  Clone ID: PAT_TA_40697
cccacgcgtccgcccacgcgttcgtggacgcgtgggcggacgcgtggtgtgaaacagtaggtgaagctcctaaaaaacagaagtttaaacaggccctaaaaagaaatcaggttacgttgctcgtaaacctaaaaagaagcctggggattgtttcaaaaagaagtcaatattctgtgatttggaatactgggagtacaacaagatatggcaaattttagatgttaatgcatattgagaaaaaacatcctgggacaatttatttggagccttacagtgtattgattttaaaagaaaggatgggcttaatgcacgacttgacttgtgataaatttgaatgcaatctagcctttaacctgatgaaggtgattaatggttaatattaattgc

SEQ ID NO: 40698 - DNA, 423 bp, Triticum aestivum
  Clone ID: PAT_TA_40698
ctctcccttgccagccgcctcgtgccctcgccctctccctcctatctgcgactgcgccgccgccccctgtcccagcgtcgctcgctccggcatccacctgaccgacgcctcgttagcatcgactcctagacgacactacgcagagatggcggcgaggagagccagcgcccgcgcgcggcccaacgtgctggtgacggggacgccggggacggggaagacgacgacgtgctccctcctcgccgacgccgcgggcgtggcgcacgtcaacatcggcgacctggtccgcgagaagggcctccacgacggctgggacgaggacctcgactgccacgtcatcaacgaggacctggtttgtgatgagcttgaggacaggatggaagaaggcggtgtactagtagattatcacggatgtgatttctttcc

SEQ ID NO: 40699 - DNA, 329 bp, Triticum aestivum
  Clone ID: PAT_TA_40699
cggacgcgtgggtttttttttcctcataaactggatcacgttttttgacctggttttcctcataaactcgatcattttctttgaatagggatcatattcaggtggggattccccccggtgacatgttcaaaagaaaaaagaaaaacactacaagcaacaaacttgtactgtcaaagaggtaaatcttatatcatcaacaacaataccgttggtatcggcatcttccagtaaggagttgcagcaatctgttgaaataaattttccagaatgtagatttttcgcagcatgaattaaagctcccttggtatcagcaccagccttaagcagga

SEQ ID NO: 40700 - DNA, 262 bp, Triticum aestivum
  Clone ID: PAT_TA_40700
ccgcagtaccggcccggacgacccacgccgacccaggcgtccggcaccctagctaccgcgctcaatggcctgccgtgccacatggtgcatttggcgcggaagcgtgtggtggtgacaagcctagccgtttttggggcggtttccggacggggccgagcgcaaggtggagctgcggcctgagacctggcaccagcgcattgcccggtggggggaccatttttgtcgtggccggtgggggtttggccggaatcaagcggttcat

SEQ ID NO: 40701 - DNA, 302 bp, Triticum aestivum
  Clone ID: PAT_TA_40701
acgcacgcgtgcgggagagacacgaagggacctggtagacttcgactacagacaggaccaagacgaaacgactggcgggacttagacatcaagcgtagacgcttgttatgctcgcatctgcctcttctgggcgggggcgtaatcacaccttttgattgagtgggggaagtgacaatacctgtggtaggagtcggtcacagccttatgatagtgctggtgggtgaaactaaccctggtgcggcagctaacggcggttggcacattaccgacatgtctgagctacagtgacccgtgcatataca

SEQ ID NO: 40702 - DNA, 431 bp, Triticum aestivum
  Clone ID: PAT_TA_40702
ggcgccgtcgtgagagacaggacggaggtgatcgacgtcgtcgccggaaagaaatgagaaggaacgacgatcgtggtgaagacatcaagcggcgaggagttccatgccgccaagtgcatcatcacggtgggtgcgtggacgagcaagctggtgaagtccgtcaccggttccgacctgccggtgcagccgctccacaccctcctctgctactggaaggtgaagcccggccacgagcgcgagctcacgacggaggccggtttcccgacgttttcgagctacggtgacccgtgcatctacagcacgccgtcgatggagtacccgggcctgatcaagatcgccatgcacggcgggccgcggtgtgacccagacagcatggactggaccgtcggcaccaccgagggcgagggtgggctggcggatcccgtggcacg

SEQ ID NO: 40703 - DNA, 418 bp, Triticum aestivum
  Clone ID: PAT_TA_40703
gcgctccgtcgccgtgcccccggtatcccatctcccacaccaaatcccaatccggctccctgccccgcaccagcgcccaaaaccctagctttaaacccccgaatccaaccgattcccccgccgattcccgccatttcccgccggaacggcgatccaccggacctggatcggttccttctgtcgctgaccaactctaggtttgctccggttgtcccgagagctctgttcttgtccctttttctttctaggacggatactccaatccaattcatcctccggtctgtggcaggtttatttcctgcgcggacagcaccaaggtgtctattcccagctaaatttcgaagaaacattgtcccttctctggttcctgtttggtaagcatggagttcgagggcgaggggggcattggtgttggtct

SEQ ID NO: 40704 - DNA, 379 bp, Triticum aestivum
  Clone ID: PAT_TA_40704
tgcagcggaggacatgcagcgggttgtggggtttgggtggaggtgggttagagggatgaccggtggcagcaacggcaactcgggcagaccagggcggcgaggctgtagtgcgggcgttcgtgtgcctggaggaagaaggttacagtccgttggatgcataatatgggagggcggagggaaaactgactgaagaaaaaatcttttcgagcctgaaatagtcgctctcatagaagcttggcacgttttgaagaaccagagttgcctgtgtgttatagagttttttcttgcaactttaaggcctttgtttgctctatcttgaagacctttgttctacacgtcttactatgggtttttaataaatagagttgtgtgatctgac

SEQ ID NO: 40705 - DNA, 362 bp, Triticum aestivum
  Clone ID: PAT_TA_40705
cggacgcgtgggcaggtcggtcgacgggcgcacggccatcgccgccgcgtccggtgccgtggcggccatgggcaacccggcctccgctgcgatcacgcacgttctccacaacaagcaggagttccccctcgccgtcagcatggacgacatcctcgtcctgtccatcggcaccggcgcgttgttctctgccgccacctgcggcaacgggtggagcacgccgatgcccacgcgctcgccgtcgcgagacgagctggcgcgcgtcaccgcccagggagtcgctgacatggtcgacgaggccgtcgccatggcattcggccacgcgagcgacagcaactacgttcgtctacaggccagcagcgcac

SEQ ID NO: 40706 - DNA, 395 bp, Triticum aestivum
  unsure (1)..(395): unsure at all n locations
  Clone ID: PAT_TA_40706
cccacgcgtccgcccacgcgtncgtgaacttcttgtcattgatgaagctgccgctattccattgccaattgttaaagccttgcttggcccgtatcttgttttcctatcttccactgtcaacgggtatgaagggacaggccgatccttgtctttgaaactcctccagcagttagaatcccaaagccagccatcagcttcaagtgatggacccagttccagcaggctgtttaaaaaaattgaattgaatgaatccattaggtatgcctctggtgatcctattgaaacctggcttaatgagttactttgtttggatcttgcaaactccattccaaatatcagtaggctacctcatccaaaacactgtcagctgtattatgtcaaccgggacacacttt

SEQ ID NO: 40707 - DNA, 146 bp, Triticum aestivum
  Clone ID: PAT_TA_40707
ggactcaatccctacgctgtgcttgtctagtgtctgcgcggatcgtgaggtccatgtcaattcctcacgtctttcggaccagagcgggaaccctatcctctagcgacgcgctgtcgagggtcccgcggagcgggttcgaacttctc

SEQ ID NO: 40708 - DNA, 396 bp, Triticum aestivum
  Clone ID: PAT_TA_40708
cggacgcgtgggcggacgcgtgggttggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagcttgtgaccaagatcgacaggcgat

SEQ ID NO: 40709 - DNA, 414 bp, Triticum aestivum
  unsure (1)..(414): unsure at all n locations
  Clone ID: PAT_TA_40709
cccacgcgttcgcggacgcgtgggcgcaagcagaggcaagaatggcgatggcgaggaggagggccctcgcgctcgtgtcccagatcctacagaggcgggttctccccgcgccgcgcttcctctcgtcggcggccggcggcgctctagaccgcctcaattcgccgcccttcgcgcgccaggccgcgcacaggaaccccgctcctccttccccatgggatcggctcggagggcagaagaggaccatgttcatccagacgcagtcgacccccaacccgcagtcgctcatgttccatcctggaaagccggttatggaagttgggagctctgatttccctcatgctcggaccgccatgacatctnctttgggcgaaggcgctgttgcgatagaaggcgttacgagagtattttttggat

SEQ ID NO: 40710 - DNA, 384 bp, Triticum aestivum
  Clone ID: PAT_TA_40710
cagcgggttcggccctgccccgtcgcttgccgccatcatcgccaaccgctaccgcatgcccaccgacgtcaagaccttcaacctgtccggcatgggatgcgccgcgggcatcgtcggcgtggacgtcgcgaggggcgtcctgagggcgcacgccggcgccgtcgactacgccgtcgtcgtcagcgcggagatcgtcacgatcgggtggtacagagggagggaccgcagcaagctgctgctcaactgcttcttccgcaccggatgcgccgccgcgctactgtcgaacaccgcatcggcggcagcgccggtcaagtaccggctcgtcgcgctgaagcgcacgaccatcgcggtcgacgaccgcggctacaacttggccatgaggga

SEQ ID NO: 40711 - DNA, 144 bp, Triticum aestivum
  Clone ID: PAT_TA_40711
ctcccttgcagtttcagccatgggtaaggagaagactcacattaacatcgggggtattgtgcatgtcaactctggaaagacgaccactacatggccatttgatctacaagcttggaatgtatcgacaagtcggctgatccgaga

SEQ ID NO: 40712 - DNA, 266 bp, Triticum aestivum
  unsure (1)..(266): unsure at all n locations
  Clone ID: PAT_TA_40712
ctggaagccactttttgggatacgaagggcacggtgtcattctttatatagggactatggcaaagggcatagggaacggaatacccatcggagcggtcgttaccacacctgatattgctaaggggttaaacaacaaaaactactntaacaccttcggtggtcaccctgttagcacagttgacggccacgcttttattaaggtactggagaatgagaagtatcaggagaatgccttctttgttttcttctacctgaaggagaaactt

SEQ ID NO: 40713 - DNA, 232 bp, Triticum aestivum
  Clone ID: PAT_TA_40713
cggacgcgtgggcctagagataaatttggacaccggcgagcccctgtcagtagagttacaccaagtctatgcttgggtggagtttggtccagatatgatcggcagcactaaccgcgagctgggagaaagcccaaagaactcgacgaagaagggaatgttcttattttttggggagaaataccttgcgactgtacgtgaggaagacaccctggaatatattgcttgattttgt

SEQ ID NO: 40714 - DNA, 365 bp, Triticum aestivum
  Clone ID: PAT_TA_40714
tgcgcgcaggtgctctcaacaagtctatcagagtagagaagattcctggcgggcacttggcggattccatgggtcttaaaggggtcatgtcccatcaagatgtggcccctcctggaacaatgtcaaggaggatggtacatccacgcatcatgcctttggattgtcctgttgagtgcaaaaagggagacatttaatcacttgctgagtcgatgagtgaagaagattggaaggttcctcttgacttcgtggaagacaccatcaagaatctctgtgtgcaaattttgaaattcaagcctgcacctggtatctcatagaatggacacattgacatcgctctgcattatttgagcaacgctggtgtagtg

SEQ ID NO: 40715 - DNA, 340 bp, Triticum aestivum
  unsure (1)..(340): unsure at all n locations
  Clone ID: PAT_TA_40715
tcgcacgcatntgtntcaactgcggcgaaaacacaccagcgctcccctatacgcttggtttgccgccgcaatgtcgaccgacgccattggcgtcgacataccggtgcctgaggcggaggcgaccgccgaccccaacgaggagaccacgactgacgcacacgacgacgacgctaagactaccaaagcgaccaatgccaaggtcgtaaagaccagcaaggcgcccaaggtgaagaagccctggcgcccgaggaagccaaaggccgaaccaacccacccgatctacgctgagatggtggaggaggcgatcgtctagctgaaagagagaggcggtttgagcacc

SEQ ID NO: 40716 - DNA, 137 bp, Triticum aestivum
  unsure (1)..(137): unsure at all n locations
  Clone ID: PAT_TA_40716
ccgtctcgctagttctagggatcgcggnngcggccgcttcnntagaggatctcaacgctttacgtaccgcggttgctatgcgacagtacatagcttcgttctattagtgtcnnacctaaattcaatatcactcggcg

SEQ ID NO: 40717 - DNA, 411 bp, Triticum aestivum
  Clone ID: PAT_TA_40717
gacgaggggcgtgtcaaggaggcgaaggaaggggaggggaacgacgacgacggcgacgacattattgacctgtgcagcgacggggaggaaggggagaggacggcggtggccggcgagatggaaatggaaggggacgaagatggggatgacaaagtgccgctgagccagcgcttcaagcgactacggcgagccgagcccggtgagttggaatcggggaagggagatggacaggggcaaatcgattctgtcagtattctggggaatgatcagcagaaatcttcgtttgtaaagatggaggagcagatgacaagaactgggaagatggcctgtatgcccgaggcttcaaaggtggcagctttcgtgcaggagagtgcagttgtgaaatcagaaaaagttgatgatgagataccc

SEQ ID NO: 40718 - DNA, 351 bp, Triticum aestivum
  Clone ID: PAT_TA_40718
ctcacgcgttctgggacgcgtgggcgttggctggctaggcctgttgttggctcttatcggccaagaagggctttggaagggcctctgccggtagatgcacgaatgacctggtggcaagtacgccgggcgactaccttctctggattgacttcggatagttgggtgacgagaacatgaggattgttaccgagctctaggagcagcagcgcttgctataaaaggtgcttgaggagcaactcaaattgagtagggcgactgccaacatatcgcggttggtgaagtaagtcttcgggctcatgaattacacggacgatattgtcaacctgatcagcgtcatcgattacgactacg

SEQ ID NO: 40719 - DNA, 301 bp, Triticum aestivum
  Clone ID: PAT_TA_40719
cggacgcgtggagccccgacggttaagcccccagacacccgaatggcttcacttcaaccggagagggaaccattgggggcggcaagaacaaacgccttttcaaggggagggagggttgcaaaaagaagggcggcgatcccttcaccaaaaaacaagggtgttacattaaagggcccgttgtggtcaacaaccccaacggtggcgagacccttgtgttcaagacaccaggtaccaagattggcttaaaaggtcttaaacaccaggtggttcaagtatttttaacttgtctttagaaccatga

SEQ ID NO: 40720 - DNA, 258 bp, Triticum aestivum
  Clone ID: PAT_TA_40720
tccaatctttcgcccactcgtccgctgtctcgtggcctcgccgctgataggtatgaggcaatattactgcgcgcagatccaaagcatgtctttgcattcgcctcccctgattacaaagcccaggcacgggttttaccgtggacaagcaccggttggttcgcttcgcaaacattttcgtcatgctcgctctcctaatagtgctacagggccgaacaggtcgccattactctcagcagcgcagcctcaatggcgaatggg

SEQ ID NO: 40721 - DNA, 416 bp, Triticum aestivum
  Clone ID: PAT_TA_40721
cggacgcgtgggccctgccacaaatatctctccctccctccccttccacctacgcttctctctcctcctttgcccctcctctctccctccgatctgctcacctatccccgcctcgggagtcgggtccgtccctttctcgcgttcgctcgagcgggggcaggaaaccagagaaagggcggccgcgaggagcggcggcggcggccagaggaagagggaggcgacggcggccgctagggtttcgatcccggcggcggtgcggcggacgatccacaacatcaaggagatcgcggggaatcacaccgacgaggaggtctacgccgcgctccgcgaatgcgacatggatcccaacgagaccgcgcagaagctccttcaccaagatacctttcatgacgtgaaaagaaagcgggacaagaaaa

SEQ ID NO: 40722 - DNA, 319 bp, Triticum aestivum
  Clone ID: PAT_TA_40722
tgcattcataggaccagctcgtgtttgtatttccgagtctcctcactatgtatggggtttgtctttcaagtcgggggaatgcaattcagatatcgcccgcgtgctgattatcatgtaaaggggtcgcaccccacgtattcctcgcaccgcaccttttccccctttcccggacatggagagaccgcgcgccgcgcaccatgacgagcttcgtctcctgctccccttcccggaaggtgctgagcaagatcgcgtgcctacggctgcagaaggagctcgtcaagtggcaggccagccctcctcgcggtttcacctacaaggt

SEQ ID NO: 40723 - DNA, 197 bp, Triticum aestivum
  Clone ID: PAT_TA_40723
gccatacatcagcactggtccttttagcggagcaccctcaggaggaggaggaggtctctttagccgacgaggaatataccaccaactcccaaatagctcccatagtgaatctccatggaggttgcccttacatccgtttaagagtactacgactttcctcttgacctaaaagctaagctctaccactcttacaagga

SEQ ID NO: 40724 - DNA, 298 bp, Triticum aestivum
  Clone ID: PAT_TA_40724
gatcccgcctccgcttcttaatacgctgactggaggagtaattgatgtgccagcgaacaaaacccattgggaagtttgccttcgtagacatgattcattctaagtggggctttcttaacctggcgggtaaattacccccatatgccctacaggctgaagtacgcctaaagcagcctattgatagggatggcgcaacaacctgttcaaagcgattcagtgactaaagtgatggttaagagggttgatgtgcaacacatgataatgcatctagctgaaaggcgttacctatgttcaaaga

SEQ ID NO: 40725 - DNA, 371 bp, Triticum aestivum
  Clone ID: PAT_TA_40725
gatggtgcagggcttgaagaccgacctacggttacagagcttcgccgggtacacgctggacgaggccgtccaggcctacctgcttgtgctgttcgaggacaccaacctgtgcgccatccacgccaagcgcgtcaccatcatgcccaaggacatccagctggcccgccgcatccgtggcgagagggcctacgctgctttctagaatgctagcgtctgatactggtctcgaggagtacagatgcgttactaggttcatattagcccttgcctgaggaagcaacgttcctcgacaggtgcgttatggcgcgatgtactgtatgcgatggaaccaccttgttatcatcaataatgagaagttagcaatctgattt

SEQ ID NO: 40726 - DNA, 297 bp, Triticum aestivum
  Clone ID: PAT_TA_40726
gggcgggccgacccacccggcgggacgaccagcataccttgctacagatgagcgtgggaggtttcatagagtgctgaaaatatggaacctgaacaatttggctgctgctgtcggagtattcaattgtcagggagctggaaacaggacttgggaggcattacttggaaccagacttcatgagccacgtattgcgaggcggaggattcatccataatgactatagaaggaacattgttgtggggcataacatttggaatgagagacacagatgccctatgaagagtcatgcagtgcatc

SEQ ID NO: 40727 - DNA, 100 bp, Triticum aestivum
  Clone ID: PAT_TA_40727
cggacgcgtgggcagatccacatatcggaagagcgagcgcacgaacatgtggctgcggaagaagacttcatccatactgatctcatagaaagacatcacg

SEQ ID NO: 40728 - DNA, 268 bp, Triticum aestivum
  Clone ID: PAT_TA_40728
cggacgcgtggggattaggaaagcaaagccgccgccgcccgccgattcctccgccttttccactgatcccctccaacccggcgaccgcgctccctccgatggccgttagctcgcggctacccgcccctcccgcgcggggcctcctccgccgctcgccgacgcgtatcctcccttcgagacgcctcgcttgtggcacccgcgctgtctacgggagccctgggccaggcggatcgcccctccccaggcggacgacggcgccgctggactc

SEQ ID NO: 40729 - DNA, 396 bp, Triticum aestivum
  Clone ID: PAT_TA_40729
cagcacaccgcccgcgatggcgctccggctccactctgccctctccgccgccgcctccggacgcctcttctgccaccgggctctctccgcggaggccacctcgcgccctcagtggggtgtgatcgccggcacgcgtccggtcaagtcgccggcgctcggtgcgaccttccacctcgccgagcccccgcgcgcctcccgcctcctcgtccccgaccacctcctcgggtcggggccactcccgggcgtcgacagaggaatcatgggcgcgctcttctgcgacgtccgcaccgtgagcgccgacggcttcctcctcctcaacttcctcgacgtccgcaccacgggccccgtcctcgagagtcagcgcgctgacccatttcgggacgcgaccctttcagc

SEQ ID NO: 40730 - DNA, 146 bp, Triticum aestivum
  Clone ID: PAT_TA_40730
caaaatgctcgaggcttggtaaaaaattgccgtcaaaagaagtttgtcgcttcatcttgccatagtacaattatacttacaactggaaaaattacagaccaaagaatattggctggtttaatcctatcaggtgtataaccaaatca

SEQ ID NO: 40731 - DNA, 375 bp, Triticum aestivum
  Clone ID: PAT_TA_40731
cggacgcgtgggtttttttttttttttgggacaaaggaatatatctttgctgcatccactccagagtgttgtacaaattcagtatgttttgccgtagagctaatgaagtacgtatatacaattaatctctgcatatgcgagcaattcaaaattaatgaccatcaccgcgtacatgatctaaaatcttcagctacaaaatgctaattaaagggagaccaaaacgaaaacgacgccgctcgcttgatcaactatcggacggcgagagctcgaggatacggccggagagtgcggagacgagcgccgccttgaacccggggtccctcgtcagcgtcgctgccatctgctccgccaggttcttcctgtccgcggccgatc

SEQ ID NO: 40732 - DNA, 146 bp, Triticum aestivum
  Clone ID: PAT_TA_40732
acgtgcaatccaagcggtcgacgaagaggggagggggggactagacggctagcgtgtggacgggtgcgggtctcggctcgtcacgcggagacggcacgagacccgatgccgccggcacatcaagccggagcgggcgataagagcgt

SEQ ID NO: 40733 - DNA, 150 bp, Triticum aestivum
  Clone ID: PAT_TA_40733
acctacgcttccacgtacacctggggctaaatcttgataaataatggccttgttgggtgaaggaaaattatgacctccactattaatcttaatgatgaaatatgggaccccccgatccacatggataacattaaacaagtgctggaggag

SEQ ID NO: 40734 - DNA, 314 bp, Triticum aestivum
  Clone ID: PAT_TA_40734
cccacgcgtccgcccacgcgttcgctcctcagcgcagcagcagccagaggcttgggcatccatcccaatggcccgcacgaagcagacggcgcgcaagtccaccggcggcaaggcgccgaggaagcagctcgtcaccaaggcggctcgcaagtcggccccggtcacaggcggtgtgaagaagccccaccgttttcgccccggcaccgtggcgctccgggagatccgcaagtaccagaagagcacggagctgctcatccgcaagctccccttacagcgcctcgggcgggggatcgcccaagacttgaagaccgacc

SEQ ID NO: 40735 - DNA, 277 bp, Triticum aestivum
  Clone ID: PAT_TA_40735
cccccaccggcggcgcacagcccgacgacccgagcgatcctgcggaggcggcagccatggtgcacgtcaacttctaccgcaactatgggaagactttcaagaagccaaggcgtccgtatgagaaggagcgtcttgacgctgagctgaagctggttggggagtacggtctgcgggccaagcgtgagctctatcgtgtgcagtatgccctcagccgcatccgaaatgctgccagggagctgctcactctggatgagaagaacccccgccgtatctttga

SEQ ID NO: 40736 - DNA, 391 bp, Triticum aestivum
  Clone ID: PAT_TA_40736
cccacgcgtccgctttcctcgcatcatggctgcgttgtcgaagagtggtaaagatgttccagaagtgtccaaggaagtctgtggagctatatattttcttgcccgaggttatgatgtggcaatctcatctgaggtggaccattcaaaaaagcgaatctcatctgagctttcaccttttcttggtggtgttattgatgctctcctttctgcttcagaacttgatatgaagacccctttcgggcttccagcatctgcatctgcttatggcgcattgattgaggttgtgagagtaagcaacatatgggatttgaaagctgtactagctattatagttttaatgcctcgtatcatgagaagattaaacaccgtgcttgatgccaaagcaatttca

SEQ ID NO: 40737 - DNA, 180 bp, Triticum aestivum
  Clone ID: PAT_TA_40737
cggtcgtgtgggtggatgcgtggtctggagcggccactcttttgcttcgggttgtcctgccttcgacctaggagctggatcgtcaaaatgcaccaaacatgtgggttgatttcatttgagggggctttcttggcaggctcagattacatgctaactttgaacggcttgatttcctgcacc

SEQ ID NO: 40738 - DNA, 390 bp, Triticum aestivum
  Clone ID: PAT_TA_40738
gctgttcctctgctttcttgagtgcgctgcttgctttcttggcgattcatcactgtgccgcccctctggtttcttgattggctgccggaggccggggaagaccgggatccgccgaggtggcgaccggcatggcgctcgatttgggagccctcgctctcaagtacaccgggctggcggtgtcggaccacgactccatcgtcgccatcaacatcttcatcgcgctgctctgcggctgcattgtcttcggccacctgctcgaggggaaccgctgggtcaatgagtccaccaccgcgcttgtcctggggctcatcactggtggcgtgattttgatctgcaccaaaggggtgaattcacggatccttatcttcagcgaggatatttttttcatct

SEQ ID NO: 40739 - DNA, 389 bp, Triticum aestivum
  Clone ID: PAT_TA_40739
cggacgcgtgggctctactatactagctccgtaactaaatataagagcaacatgtaaaacaatttaaacttatagtacttagttacagaggtagtagttcctaaagatctctaccaaaacccctcaaaagaaaaatctctctaccaaactagattacatctgatatgagatagatcagcatggttgtacttttaccattcttctatctcatcttcatcttcttcacagttactcccttcagcaccaagcatatcaatggagtttgggccacctgcgacgtcgtggcacgaggggttgtttctggccatatcattgtgggggcttatccatctctcgaaaggcctgaagtcagtgaccacgtcggagaagttgcgagaaccagacgtgct

SEQ ID NO: 40740 - DNA, 358 bp, Triticum aestivum
  Clone ID: PAT_TA_40740
cccacgcgtccgcccacgcgtccggtctctttccattccccagtcccaaatctgaagaactccgcacgggaagaagagacgccgagctccaaggcttcttcaacgaacagattgcttgttactacacgaccaacgagagaggaaggccgacgctgcttgtggaatggacaatatcttcaccacttgttccttgtcgtcttgtctgccgatgatctttgattcatcgacacaagaatgtgtttgcggatggacaatgtttggtgcctcggtacattgtaggaagtggaaattgttcatctctgcaaccagttcatccatcatctgaagggcatccttcatcttcctgttcatggacaga

SEQ ID NO: 40741 - DNA, 386 bp, Triticum aestivum
  Clone ID: PAT_TA_40741
cggacgcgtgggcagcaagttgacaagttttactctttgtctaatggtttctcacgccataatatttcagataatatcagcactgtaagttatccagaaaagctgtggatgagggctgatggggtaaattcagtaagaagtaccaggagtactcctgtagatggttgcattggtagggatggaagaactagtagtgcacataaccatcttgatattcatagtaatttttccttgcaccccgacagaccaaactcccagcttctgcccttggtcatgaaaccatgtgagctgaattataattcagttgacgaagttgctgggcgaatctatatgttggctaaggatcagaatggctgccgctttctgcaaaaagtatttgctcaagg

SEQ ID NO: 40742 - DNA, 376 bp, Triticum aestivum
  Clone ID: PAT_TA_40742
gacgacagcccgcgatatctgccatatgtgccattgtactcagagttacaaactctgcactagtgacataaaaatcgaggagccaggtcttgaggaaagtgcttttcttcattaggaggtggagacccttgtacaaggactggatgatacctaagacggaagagttggctacagtacccttgaggttggattcagggtgacagcatcagtaaggttatggggcgcttgcgtggttactgttggtatgctcctggggacaaacacatttgcatgtgatagttaatctcttgttggcagataaataagtcgtgaggaggatgatcgtatgcatgtttctttcttttgtatttacaattttcttcacttcaccgaatct

SEQ ID NO: 40743 - DNA, 384 bp, Triticum aestivum
  Clone ID: PAT_TA_40743
cggacgcgtgggcaagatggtgacattgtactggtcaacagacagcctactcttcacaagcccagcatgatggcccatgttgttcgtgtgttgcctggagagaagacaattcgaatgcactatgccaattgcagtacatacaatgctgattttgatggggatgaaatgaatgtgcacttccctcaagatgaaatatctcgggctgaggccatcaacattgttgatgcaaataagcaatacattggtccaaggagtggggaggctgtaagaggtctcattcaggaccacattgttggtgctgttctcctgacaaaagtggacacattcttgagccgtgaggaatacagtcagcttgtctatgggtcttgtgtgtcctcatctcgt

SEQ ID NO: 40744 - DNA, 381 bp, Triticum aestivum
  Clone ID: PAT_TA_40744
cggacgcgtgggcggacgcgtggggccggcatttcctcccacttgcggctgcagcggcggcggcggccaccgcccaccgggtgtggaggcgagatgtcgtacatgcgaggcgatctgctgacgaagacgcggaaactggtgaaggggctggccaagcccgcccctgcctggctcaaggccatggagcaggcacctccagtcacattccctagaactgatggtaaaatcgagaagatagaactgccagaggatgtctatgtcaagaggttcttcagaaggcatcctgattcactctaccatgatgcaataaagataagcgggtttgatccaccgccagcaagagtttttgcttggtgtgtcttagagttgaaaggacaggga

SEQ ID NO: 40745 - DNA, 382 bp, Triticum aestivum
  Clone ID: PAT_TA_40745
cggacgcgtgggggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgacccccgaggacggcttcagctacgcgagctacgaggtcatgggcatggacgcctccgccctggcctacggcgacatcgtcaagagggtcctccggtgctttggcccttcagagttctctgtggcggtcaccatcttcggtggccgtggccacgccgccacctggggcaagaagctcgaagctgaggcatac

SEQ ID NO: 40746 - DNA, 238 bp, Triticum aestivum
  Clone ID: PAT_TA_40746
cccaccaaggcatcaactcttgttatattacgtctaggaacagggggactgtggacatctcatggggctaacctatctgtagctggcgacaatatcgcactataaaccaggcatgatctgcaggataaggggaaggttgttgacgttacatattgtataaatgctgcctaactgaatgagcctggtcagcagggagtaaaaccgcttactgatggaggggctgattactcttttgaat

SEQ ID NO: 40747 - DNA, 392 bp, Triticum aestivum
  Clone ID: PAT_TA_40747
cggacgcgtgggcccgggtgccattgctatcaactggatcctcaaggacggtgctggacgtgttggaaaaatgctttttgcacgacaaggaaagaagtttgacaatgacctaaagcagctccgcttttctagtgatctcttgctggagataggtgctgggatagagttagctactgcagccttccctcagtttttcttgcctatggcttgcgttgcaaatgttgtaaagaatgtcgctgctgttacgtcgacgtcaactcgcaccccaatctataaggcatatgcaagaggagaaaatattggagatgtgactgctaaaggcgaatccgtcgggaacattgcagatctgctgggcactggtttgagcatctttatcacaaagcggaacccat

SEQ ID NO: 40748 - DNA, 392 bp, Triticum aestivum
  Clone ID: PAT_TA_40748
ggtggagggaaaagcaccgaaaggcgccgcgtttccgcttctttttttcaccgcacttccctccctttccagcttcagtccttcccatggcgtcctccgcgctgccggcaccgtccgtcgtcgccgtcgccgtcgccgtcgcgttcgtgttcgcggtggccaccctcgctgcgacggcgtcggcagccgtcacctacgaccgcaaggcactagtggtgaacgggcggcgccgcatcctgctctccggctccatccactacccgaggagcgtgcccgagatgtggccggatctgatacagaaggccaaggacggcggcctcgacgtggtgcagacgtacgtgttctggaatggccacgagccctctcctggccagtactatttcgaggggagg

SEQ ID NO: 40749 - DNA, 321 bp, Triticum aestivum
  Clone ID: PAT_TA_40749
cccacgcgtacgagcacgcttaggctcattggaacgcatcattatctgcgccctattagtctgcctgtacagaaagggtgcccataaggcatcaccgtcggctgctgtatgacacccacattcaaccagagacaggtgatatggaaggtttcgagttcttccagattatacttgacagctcctcgagcaggcatgaagctgcctgacgacgttaccagggtgctgctagacggaaataagtccaaaaatgtgaagctactgtaggccctgcatgagcgtaacttatgggacatgaaagaggtgctcgacgcccgcggccac

SEQ ID NO: 40750 - DNA, 153 bp, Triticum aestivum
  Clone ID: PAT_TA_40750
tgctatcagaagcagaccaaggaaatcttgcttagtaataattgccttgcccccaattccatcatttatgctggatggtgggcagaatacaataatgtcaaatattggagtattagagacacagctaaagcatttcttttagtgtacgacaca

SEQ ID NO: 40751 - DNA, 288 bp, Triticum aestivum
  Clone ID: PAT_TA_40751
cggacgcgtgggcggacgcgtggggcgcgattcgctgctcttcctccagcctcctactgctcgcctccggtgtgggggtgcgctgcggtgggcggaggggaggccaggggatcgagaggcgaaccgaggaaggaaatggcggcgtggacctccgtgggcctggtggcggtggccgtgctggtcgtcggcatcgcaatgccggcctcagccgccgtgcagcctgccgcgcccgcgcccttcagcgacggcacgtcgattgatcaggggatcgcatacgttctgatgctg

SEQ ID NO: 40752 - DNA, 121 bp, Triticum aestivum
  Clone ID: PAT_TA_40752
taaaaccattgcttacctagagagatgcacaagcgattttatgaatttgacggggtatcaaggttctacattcaaggaagttttatgcccatctcatgatcggatccacacatacgtggta

SEQ ID NO: 40753 - DNA, 202 bp, Triticum aestivum
  Clone ID: PAT_TA_40753
gtgtcgcaaaaaatcatacagtggttgtaactgatgatgggaagtccttggcatttggccacaacaaatttgtacagttggtgacaggttccctaaataatgaaattgatgcatctaccagttctttctcttgttacagatgtgactggtgttgattgtgttggagtttatacttgtatgtctgtcgtcagtcttgggcttg

SEQ ID NO: 40754 - DNA, 156 bp, Triticum aestivum
  Clone ID: PAT_TA_40754
ggtcctgttgggcagatcattgtccaactactgtcaaaacagttaagggcatttgtcgcgctcgatgtccaaagagatcggccggcagctgggatcgcactagatctaccaatttattttgtcggtcaaagaagcagagtggtgcagttcacagtt

SEQ ID NO: 40755 - DNA, 142 bp, Triticum aestivum
  Clone ID: PAT_TA_40755
ctcacgcgtgcgtttacgattattttcatacgaacgaatcattatcggggttatttcgaattgaaggggcaacaagggttctccataatctatgtttgtcccatgctttaagaccaccacatttctacacagtttgaatgta

SEQ ID NO: 40756 - DNA, 315 bp, Triticum aestivum
  Clone ID: PAT_TA_40756
ctagccaaaccaccaagtgccacaccatggcgtacgcgtacgatcgggaggacggtctcgctccgtggaaggcggacggggggcggcgcggcgactactacaatccgaactacgtgccggtcttgttgaagacatttgtggtgtacctggaccggcgcattcagaacgagaacgtataggagattcacctgatgtacagagggcgggttgcagcggctcttcgacgcggctttgctgacacgcgcggggcgcgaggcgtggcacgggaagtgtaatgcgacggtgaccacgtcttgctaggagtataccgcgagc

SEQ ID NO: 40757 - DNA, 154 bp, Triticum aestivum
  Clone ID: PAT_TA_40757
caccctcccaacgggatttcggaaccggaacttgggttttttttggctcctcccctggccggacgggaaggtcccctttttcttcgggccgcttttcccttccgtccccgtggggttttggttcaccggggcccggtttccaaaccttggggtt

SEQ ID NO: 40758 - DNA, 373 bp, Triticum aestivum
  unsure (1)..(373): unsure at all n locations
  Clone ID: PAT_TA_40758
ctcacacaactcttcttctcccatcaaacacatagctagaaactagaaagtcgtcactacgccttcatctgtccatccaaaactcatacttcgattccttttgagatctctcccaaaatggcgtcgaccaccaccaggctcgtgtgtgcacccctgttcctgctcttgctctccatgtccaatgccaactcagtccaagagaccggcagctccctcaaaagctccactcagaagaatgtgttcgtcctcgacaactacggcgcccgtggcgacgggaagcacgacgacacgcaggccctggccaaggcgtggaacgcggcgtgttcctcgtnccggccggccgtgctggtcgtcccaagggcaaaacctatct

SEQ ID NO: 40759 - DNA, 379 bp, Triticum aestivum
  Clone ID: PAT_TA_40759
cgccctgcccgtctctgtcctccccgctcccttcgccgccgggtccaaaccgaaggagccgcgcccgtggaaacctagggtttcgccgtccccgccctccaaaggtttttggagaagagctgtttgttcagcgacatgaggccaattttctgcgggaaccttgactatgatgcccgccagtctgaaatcgagcgtcttttcggcaaatatggaagagtggagcgagttgacatgaagacaggatttgcgttcgtctacatggaagatgaacgtgatgctgaagatgctatccatagacttgacagaactgactttggtagaaaagcgaggagactgagagtcgaatggacaaaagaggatcgcaggtgttgtccgaaag

SEQ ID NO: 40760 - DNA, 389 bp, Triticum aestivum
  unsure (1)..(389): unsure at all n locations
  Clone ID: PAT_TA_40760
cggacgcgtgggtgaacgaggagctctggaacgaagcacggacatatggagacatccaattgatgccatttgttgattattacagcttgattctttggaagacgattgccatttgcatatatgggacaaatgtactttcagccaagtatgttatgaaaaccgatgatgacgcttttgttcgtgtagatgagatactttcgtccctacatcaagtaaatatcagccatggactgctgtatggtcgtgtcaattctgattctcagcctcaccgagatctgtatagcaagtggtacataacttcagaggaatggcctgaagagagttatcccccatgggcacatggnaccaggtacattgtatctgaggacatagcanaagaagtttacagg

SEQ ID NO: 40761 - DNA, 384 bp, Triticum aestivum
  Clone ID: PAT_TA_40761
ccacggcgccgccgcctcctccccttctgccctgctctccaccgcgctgccgcctcctcccttatgctccccaccgcgccgcctcttcctccccttcactgttctctccagcggcggcaaagatctggcggcaaagggagacgacgagggcgctcgatccgatctgctgaagacaaggaaggagaggagggagaaagagagaggaaagaggagagggaggtgtggtggcggatgagagagggtcaccggaaggagcgtgacgacctgcaggcaaagggcggcggcggcgccgctcgatttgatctgcgggagagagaagatgagagggggaggaagagggagagagagaaggaaggagaggagcggcgagagaaagagagagga

SEQ ID NO: 40762 - DNA, 324 bp, Triticum aestivum
  Clone ID: PAT_TA_40762
cccacgcgtccgaatcccctccaatcccaccttcggagcagctagcatcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaaacgcatctccgggctgatctacgaggagacccgcggcgtgctcaagatcttgctagagaacgtcattcgtgacgccgtcacctacacggagcacgcccgccgcaagagcgtcaccgacatggacgtcgtctacg

SEQ ID NO: 40763 - DNA, 224 bp, Triticum aestivum
  Clone ID: PAT_TA_40763
ggggccagcagtggaggcgcaccagccctttctcccgctctttgctcctcttctcgcagtaatcggggagggtggtggtggtggtggtggtaccggcgccatctaaatttctacggagctcgtcatgaaaagcatcgacggcagaaacaactcctccatccaccagatggccagccccaatcatatgtactacatcttcgtcctgatgtacgaggacacccacg

SEQ ID NO: 40764 - DNA, 338 bp, Triticum aestivum
  Clone ID: PAT_TA_40764
cggacgcgtgggcaccggcgggggccgtcggcggcggcttccgcaaggggcttcttgaatgggcaatgggaggaggcgaaccacccaggggccggacagcccccacggaccacgccgagccaagcaccgcagccgacatgtacatcgactccggcagagaccatgcgggcggggatccgggtgccaaaaggaggcgcggcggcggcagcggcgatgatgcgcacgtcgtggtccagaggccggagaagcgccggatcctcgcgtggagggtgcgccagtaccggtccctggtggccgaagccacggcggcggcaaggagggcaagaatcccggcggtg

SEQ ID NO: 40765 - DNA, 291 bp, Triticum aestivum
  Clone ID: PAT_TA_40765
cccacgcgtccggccaaaggatgaccggcttcttcatcacgcgccactgtaaaaaaaacatcttacattatgggaccgagggagtagataggaaagcgccgacaaccccccccccctccccccggccacacatgggaaccctgccctgctttgggctgcgagtgccccgcgtgatgcacaagatctctcttaataccccctccgtccagaattacttgtcgcgaaaatggatcaaaatggatgtatttagaattaaaatacgtctagatacatccatttctccgacaagta

SEQ ID NO: 40766 - DNA, 253 bp, Triticum aestivum
  Clone ID: PAT_TA_40766
cccacgcgtgcgcggacactaaagctagggcatagagtacatttaacaagagaggatacagcatgcgtatgcgcaggtgccgcaaagcaatgctaatgtggataagcaactaccagtcggtcgttatgggtatccagccatggttgctctcaacgtcaagaaaggcgcatacgctgcacttattaacgccttcgagctcgccgaaattaccgagtttgtgaaggtggcggttcgcggcggaaagggcatcctt

SEQ ID NO: 40767 - DNA, 208 bp, Triticum aestivum
  Clone ID: PAT_TA_40767
cccacgcgtccgatccctgttaccgttcccatggcgccagggctcaggcgcttcaccgacgtcgtggcagacggcacgccccgtcttgacgacgccgtcggcttggagctcgagtgcgtggagcgcgccgtcttggtcgtccttgttagcctctcgccggtgcttcgtgtaaccctttttaatcaccaccaggagggtgatttggttt

SEQ ID NO: 40768 - DNA, 331 bp, Triticum aestivum
  Clone ID: PAT_TA_40768
tctggtattccccccgacgcgacgccgcggatctaattacagccgccggcgtggccgtgccataccttagcctcaatccaacctctcgggggcgcgggccgccttcgccccagtccggcctccatcatcactgccgccatcgccgttccccttcttcctcagccgccgggacatccagctgccccgtccagtgtttggccgttgggtctccttccatacttccttcctctgaggtcggacatacatctagatctgccgcccctgtatttgtatgtattaccatggagactgtacatagtacatgaatcatggcggtggcacgacggctact

SEQ ID NO: 40769 - DNA, 374 bp, Triticum aestivum
  Clone ID: PAT_TA_40769
actccgtccactccaccgctgtgtgctcctgatcgccaccaccagtccaccagcactatgcagcccggcagcgccaacggtcccgctgcctccgtcgccgcctcgttgcaaatggcgcctgcggacgcgtcggcgtcggcgtcggagtgggacaacgactggggccgcccggccttcctcaacgtgtttctgcccaccagcgtcccagttccggcgacggcggtccgcgcgaccaccccagagcgggagcgtcggacgacccgcccggccttcatcaacgtgttcatgcccccggctccccctctcccgaagatgaccatggccgacctgcagcgacgcttgcaggacccctcggtcgagatcatcacgcaccc

SEQ ID NO: 40770 - DNA, 437 bp, Triticum aestivum
  Clone ID: PAT_TA_40770
agcaaagataaggccctgctggtcagggcggatgccctccttgtccttgatcttggccttgacattgtcaatggtgtcagaactctcaacccgagtgacgtatgcatgcatgcatgcatgtgtgtaccatgctgcggccgaaatcagtgttttgaccctttttggaaaagctcagcacaaaatgaaccatgttggaataagagacgagtggatgccggaggctcctcagcgatcgcggttctcagccgttggatcgggccgcttgatgcgttttcgtccgttggatcaacatctggaggaatctgcgccgtcggatcaaaatcggatcgaaaaaatctattgctggcgcctccccccgctcgtttttacttcgtttttaccgttctaaagtcgctgatgtgtgggtccgttcgcgggtgggccttcgttgtcagcga

SEQ ID NO: 40771 - DNA, 385 bp, Triticum aestivum
  Clone ID: PAT_TA_40771
gtttttatgcttgtttgtagattgctgtcgagttcatcaatttaggggttagactattgaaatgatctatatccagaaggcatatatgtgtgtgtgtgatgttgtgggtctgattgcacatggattaaatcttacatatgtgcaaactgcaaaggacttgtatatgtgtttattttgcagatatgacaccactcaattacctatctgttcggtttcatttccgaggtgaattgcatcatgatgaaagtgaatggaagtatttgaatggaaggtcaggaatgtccacaattgagtgtgacaaaatgtgtctacaatagttgaagaaacaccttgcagatcatgtttcctattctgatgaagtactaaatgtgacaactttgtactg

SEQ ID NO: 40772 - DNA, 316 bp, Triticum aestivum
  Clone ID: PAT_TA_40772
cggacgcgggggcgaaactagattttccctaatttagtcttgtacaaacatgctcgcatggcatttgcctggcttaagatcgaattagcgtgaccgtgcgtatgagtggacaaactctaactgggggaaatgtagggacagaagtgcgatgtgatctcattgataagtgcagaatgcatggttgatgttccaaaaagcaaaaagacgctggctgatattgagtgtgcaggcttacctacgcatgcatgcgggctcatatcttttctatagcgtgaactcgattgagtctactggctcggggtcaacaccagcttga

SEQ ID NO: 40773 - DNA, 356 bp, Triticum aestivum
  Clone ID: PAT_TA_40773
cgtccggccttggctggtgacagagctgacataagggtttcatgcttacgtactcgtacttgcggcggatgagctcttttatggcggcacctaactgcaacctactggccggcgttttacaacacctggcctgacaaaaccagggctgtaccaaactgactctcctaggattgcattgtactttcatcaggttgtgttcatgtgaatgggtgtgcaccggccgcgcggtcagccatacgctcattctatatgtcacttggaacgcaccctggacctgcgcattatgcgcgcagaggttgggaggtacgcgctgggattccagtacactggctagcgccttagcgacctgtaattca

SEQ ID NO: 40774 - DNA, 265 bp, Triticum aestivum
  Clone ID: PAT_TA_40774
gtcggcagcagcagcaccggcagcgcaaggattagagatctcttgctttgtgagggaagaggggggagggtggctgaaaagagggaggtagattggagtatcaccaccaccactcaagaaatggcggccgagactatcttcttcacctttgagtttgtgaacgagggccaccctgtcatgctctgtgactaggattaagtcactgtgcttgacgcgatgcctctctcaagtttctgtctgttaggctgcctttatgacaatcacc

SEQ ID NO: 40775 - DNA, 255 bp, Triticum aestivum
  Clone ID: PAT_TA_40775
ggtagagccatccagccgagcagagcagaggagagcagatccagccagctgcaaggagatctcttgtactggtaccggcgctggcacttgactggagccagtagagtagtacagtacagtacgctcttccccttctccctccctccttagtccgtccagttacagagagagcagagcagatcggagcggagcagagctgttgctcaccagtagcagagatcccaagcaagcaaggtaaggcagaggatgaaggag

SEQ ID NO: 40776 - DNA, 209 bp, Triticum aestivum
  Clone ID: PAT_TA_40776
agcgcgcgtgctcgcataaaactaaggctgccatctactaagggagccaaggggctatggacatgcattcggacactgctattaccatctccaggcacagggactatggactaaaccatttctgtttcaaatgagcttattaacgaattattaggcggagctactttgtcgcatgtgatgcatgtcggtgataatgctacacttagatc

SEQ ID NO: 40777 - DNA, 244 bp, Triticum aestivum
  Clone ID: PAT_TA_40777
cgcgccccgccggcaaaccctaacagtcctgaagcagacggagagctggaatgcggtgggagacatgctatgcgtacccgctcaggtacaccctgtttattagaaggccaaggggaaggagcaagtgttcaagctcgggttcgggaggcatgcctgttggaatgcccggtggcttctccattcccatgaggcatgtatggaaatgcctggttgtttatctggagggatgcctgttggttaccct

SEQ ID NO: 40778 - DNA, 434 bp, Triticum aestivum
  unsure (1)..(434): unsure at all n locations
  Clone ID: PAT_TA_40778
cggacgcgtgggcgacacctccagcgcgtcgctgcctcctgccacgccccaccctgcctcaccgcgcgccgctggccgccgccgcccacctcgctggcgcgcctacccctaccccgagtgcccccacacccgcagccttccactgccggcgacccgtggcctgccaccgccgacgacgaggaactgtcggatctcgatgaatccggtgaggacggcgcgtaggcagcgaatctggaaggaaggcggccggggcttgaagcacgacggctggacggcacaccatggcattggggggaggggggcgtncgatgctccgcccgtttgggtccgggcgaggagctcacccccaaagaactcctcgggcgtcctgcgggcccaggccggaggcggcagttcccagcgcgggggccgacaggaaggtgccgattcggatc

SEQ ID NO: 40779 - DNA, 202 bp, Triticum aestivum
  Clone ID: PAT_TA_40779
cgacccacgcgtaccctacacttgatctgaagcaatcgcttctcttgacccaaacatacatactcgcacacgggtggggttatctttcctattgcgtaacctaaattcatatacatccctcgaccttctacaacttcccgactgttaatacctattccttaccgaacttaataaactcttaaaacatcttcctttccccatt

SEQ ID NO: 40780 - DNA, 199 bp, Triticum aestivum
  Clone ID: PAT_TA_40780
cccacgcgtgcgcgcactcacagacaatctgcacagacaaaacagaatcctaggagggggaaccttcatatactagacgtcacccaccaatgaaaggacgaagtgggggtgtggccgcaaaaggtggtgcaaatactactgcaagaccagaaacatctggagcaaccacacgaagtatctcgaaggagggggtaccaaa

SEQ ID NO: 40781 - DNA, 406 bp, Triticum aestivum
  Clone ID: PAT_TA_40781
cggacgcgtgggccgtgccctccaccatcccgccgccgccgccgcccccaaccatcccaccgccgctgtcgcacccgccatcccgtcgccgcggacagccctccaccccgaccattgccgcagtcgcccctaactacccaacagcagcactggcagcaccccactaacccggaccaccactgtcgccgagccactcaaccggcgactaccctcctcgaatgccttccctcgccaccactctacttcgcgagattcctcccccgagcaggcttcctccctaagacgatggagccagtagttcttcggatgagatgggtgctgatttaatccttctgaaccccaatgaggctgatagcctaaataaatctttgctccagaaagctttacgaagtgaattcattactac

SEQ ID NO: 40782 - DNA, 250 bp, Triticum aestivum
  Clone ID: PAT_TA_40782
cccacgcgttcgcggacgcgtgggcggacgcgtgggggagaacatcaacaacgggctggagctgttgatgaagagcggcatgtacacgctcggctacaagaccgtccttaagactctgcgcagttgcaagggtaagctgatcattctcgttaacaactgctctttccttaggaagacagatattgagtactaagctatgttggcgaaaattagcgtgcactacttttacggatacaatgtttattttgga

SEQ ID NO: 40783 - DNA, 239 bp, Triticum aestivum
  Clone ID: PAT_TA_40783
atccaggagagcacgctctctcctctcttcgtttacccaaccactacactaaggttcgggcgatatgaacaaggaggaaggatactagcctgtccaagatgtttatatgtgggatttccactcagaccagaatggccacgctcaaagagaactttggaacgtgcgctgagatatttgctgccgtaataatgaaataccgccataccaaaaagacctaaggctcaagattcattacctat

SEQ ID NO: 40784 - DNA, 389 bp, Triticum aestivum
  unsure (1)..(389): unsure at all n locations
  Clone ID: PAT_TA_40784
gagagatatattctagtaaggaagacaaaagtgggtggcgcggttaagaaactgacgaaaatgatggccattgcgccttgcgctcagttacacgagcaagatttgctgcggccggactaattgtacaggtccggttagcgtctcctccggcgcggaagcaactaggactaccactccttctgtgagtgggatactcccggcagggctgaggacaactgtcgggacctcagtactcgagccgtgatgatggggatttcactgatgccgatgagagacgcccactcggatgatgtggagcaccagctgctttcagcacaagctgcgcancatgatcgcacactggtcctgcgttttataagagcccctccgccgcgcagcagctgtatata

SEQ ID NO: 40785 - DNA, 143 bp, Triticum aestivum
  Clone ID: PAT_TA_40785
gtcttttttaacggcggaggcgaacggctaaccctagactaacgcagtacggctaggccgaaactgcgttgaagcatagagctctgtcgttcatggcttggaggcactgtgtctatatgatatacctaacgcctctagaagag

SEQ ID NO: 40786 - DNA, 153 bp, Triticum aestivum
  Clone ID: PAT_TA_40786
gccgcaccaactgcgcagcaacacgcccgccgatgctcccctcccccccgctccgacttgttttctaaaccaaaaatctcgcctttctgtaaaactagatttccccttgctaattcgggtattataccggcggctaatcacactccacccggt

SEQ ID NO: 40787 - DNA, 448 bp, Triticum aestivum
  Clone ID: PAT_TA_40787
cggacgcgtgggttctaacagttggtctgaaatgatattatttgactaatccagtagaactagcccgatgctgccttcaagcatagcgcctgcgcgttgatgtcttgatgtgattgtgtccacatgagagcctcagagcctctagaagaggaaagagcttcatcatttcacattttgtttgacgccataaatttgatttttctctcagcagggagaaagccccttaggaaggtttgagtacgaggacagttttctacagcatttgttgcctccatggtcacaaaaggactacatggacagacagaggtgatgctccgaaacatcttgcaaaccaggcagtgcaatagctatggcatcaagggacacataaggaacaatttttaccaagcccatagaatttagatggtcagcggaaactaaaatgagtgcaaattatgagacccttttt

SEQ ID NO: 40788 - DNA, 209 bp, Triticum aestivum
  Clone ID: PAT_TA_40788
gcctcccctccattccgttcccccctcgccttaatccacagccccgtccccgaccccgggtgtggcgccgatggggtacgtgctgtccgcggtggcgagggtgctggagcatccgacggcgtggggcgcggcctgcgagatggcgctgttcgcggggtcgatcttgacggcggccctcggcggcctgctgctcggatgggcctggaccc

SEQ ID NO: 40789 - DNA, 331 bp, Triticum aestivum
  Clone ID: PAT_TA_40789
gcgcctccagtcgctcccagttcccctccgtccgcggcgcgccgctcccgacaggctgggtcgctgacgccgtcttcggctccgactaccgccagccgacgacgcccttcgacccatgacggcgtcgtcgtcgtcatcaaccgtttatttggccacgctcctaccaaatcggctatcagttgagcaatccaagtgaagcatatggttacatgagaaccgttacaggtaagctgtgagctggaacctatataagccctggatccttcttgcagtttcagggtgtgtagctgctataaaattcaagagcctgtgtcgtgtcttctccgagtgg

SEQ ID NO: 40790 - DNA, 179 bp, Triticum aestivum
  Clone ID: PAT_TA_40790
ggaaagccgggaagacaaaagcgcacgggcaaaccaagcacagacgtttcttaactcacctccctcccgcggggcaaaccaagccaaaggacacaagagaagaagccgcacccaaacgctccaccgacagccactaatggggagcaaacaccccaccaacaaaaccacaggcggaacgc

SEQ ID NO: 40791 - DNA, 331 bp, Triticum aestivum
  Clone ID: PAT_TA_40791
gccgcccagcgaattggacaagcccccgagctcgccggatccgatggccgtcacgttctttgacctccacaccgccgacgggcttaagggcctcgaggcgcacctcggcgggaagacctacatttccggcgatgggatcaccaaggacgacgtcaaggtgttcgcggcggtgctcgtgaagcccagcgccgagtttctgaacgctgcccgctggtacgacgccgtcgtcggggccgtttttttaaggtttcctggccaggcctatggggtgagtgcattcttgggttctggtggaggttgttctgttgtttttaaggatgaagatgatgac

SEQ ID NO: 40792 - DNA, 180 bp, Triticum aestivum
  Clone ID: PAT_TA_40792
gcgtcgaaaacacgcgcgttttttgtgccttatccccgccgctcaacccgcgcgcgcattactccaccaccatcctctccttttccccagatccaattgaaccgcgccgcgcgaggggccatcaggagcaggaaacgccggcagctggcgacggagacagcactatcacgctacaggacc

SEQ ID NO: 40793 - DNA, 209 bp, Triticum aestivum
  Clone ID: PAT_TA_40793
ccacggtcgaaaaaaaaaaagagcttttttccctatctgtcttccggcggactattggtgtgggactcttatccccacgaaccccttcctcgcgcgcaccacccacagggcggtccggcgagctcggcgggcgcaacacgaccccagctccctaggtcggccaccttccctccgccagaatcgcgctcccgtctacacgaccccgggta

SEQ ID NO: 40794 - DNA, 408 bp, Triticum aestivum
  Clone ID: PAT_TA_40794
cggacgcgtgggcggacgcgtgggggcaagtaactggaggttgcctgagtcttgcagcacgagaattgagccagcttgtaggctagggtatgggtttgtccatattatgctaccggtgttgtcagtgagggagagctgtggaccaatgctgaacacagacaacttcgtggccattacggtggagcctgaacccaggttcttggcataccacaccaccttctcctgtgcagggtcgggcgcctgggtgaggttgaagttgaaccagacagcaaggaggaactggctggggtcagagtcgagggcccggaagccgaaggcaaatccccccgacggggaggtgatgtagccaggggggctgagtgtcgatccggttgtgagcctctgcgctgcaagcagatgaggctggtg

SEQ ID NO: 40795 - DNA, 284 bp, Triticum aestivum
  Clone ID: PAT_TA_40795
ggtaggcgagggccagctattcaatggaattaatgggggagacaggttagtctttcatggggcaaacaaatactttagattgggagggatgctaacaaatggcattgcagggtcatggttaaatggagcaaatagtgtactgaaaatgatattcaggaataccacccttgcctacattgtgttgccaaataattgcaggatgtgaggaggcactcatcacagtgctcattacctctcacatctatagcagcaacaccagtagtcaaacaagttgcttgatctgt

SEQ ID NO: 40796 - DNA, 277 bp, Triticum aestivum
  Clone ID: PAT_TA_40796
cccacgcgttcgcggacgcgtggtcgcggtgcgacgccagagggacctgtcggacgcggctcgctcgctacaagtgcaacgcgggggccgtgcaccaacctcggcagcggccgcactagctctcgcgggtttcttcgctcttgcgggcggcgctccgaggagggacggagcatgggcgagcgggggcacgtgcggcggaggcgagcggaccgtgaggcgagatcaccaagctcgatgctgtagctggcgcgaccagtaaatgagcttgcacagcagt

SEQ ID NO: 40797 - DNA, 366 bp, Triticum aestivum
  Clone ID: PAT_TA_40797
cccacgcgtccgctccttttattatcctgagagtttcttctttggggtgatttttctttcttggtaggagtaacaatagttttggctctcctcatccagaggcgaagcttcagggtttgtaaattttccggatctaatcaactaaccaaaaaaacccaaaaaaaggaaccatgagccacttcgccgccatgaagagccccgtcccggtcgccgccgccgccgccaccgacgcgaagagcccgctcttctgccccaagccgcgccgccccgtcgcgcccctccggtgccaccagagtagccactccgacgcgggcgccggcatggatctgctcgaccttctcctgtcaaagggcgatgagagcaatc

SEQ ID NO: 40798 - DNA, 371 bp, Triticum aestivum
  Clone ID: PAT_TA_40798
cggacgcgtggggcggccttgggcatgaactccggcgacgtgacgaggggaacggcgagtccccagatggaggaggacggggccaactggatctggccggagtagaacggaggcggcggggcgagctcgacggaggcgaagccacagacgcaggggccgtgcgtgtagagcagaggcgggtagcaggagcggcaggaggatggccggcagcgaccggacacgacggcggggcttggtggagctcggcggcctggttccacggacgcggacaaggacggcggcgggcggccgtgagggacctcctgtccaaggcgcagcagtgggagctctggcctgggtagtcgaggacgaagccaaggcccgggagggag

SEQ ID NO: 40799 - DNA, 139 bp, Triticum aestivum
  Clone ID: PAT_TA_40799
agactgcaaaccacaccttttatttatcaggcaaggggcacccggctgggcctcaagcagccaacgcaaactttacaccgatatttcctttctctcccggcaccgccgacaatcttcaatcatggcaattgcttacaaa

SEQ ID NO: 40800 - DNA, 346 bp, Triticum aestivum
  Clone ID: PAT_TA_40800
aagacacggggggaaactttactcttcgaccgcatacaccggcggatgcacacacgaaaagtaaatccctgtatcaagacccgaatacctatatctatccccatccccacggcggaccggctcgcgtgcgccacaacacctgcgcccccgctcgccagctccgctcatacacacctattgcgctagatcttgctgagcgtaccagtgcaccaccccacgtcccttattcgtggcgccggctggtgcaggagctggcgcaccatgctgtccgaccggaacttcgcccgccactaccgaaaggcccgcagtgcggcgcccaggctgggctttcttcacaacaccacca

SEQ ID NO: 40801 - DNA, 351 bp, Triticum aestivum
  Clone ID: PAT_TA_40801
cggacgcgtggggctgcgccacccgtcccggctaaatctagatggacctacacgcgttggacgacgctggtgctgtctagttacaggagcaggttgacaagttcgttcaagagaggatgtcggcgaatccgccgccccaagaactccaccaagacgaccctgaggcgatgaacgaagaggaggacgaagaagttgacatctgtagcggtgtctgcctcttggtgatcgagccgcaacctatgatgcaagaacgtcaccaagacggccctgaggtgatggccgaagaggaagaggaggaagaagttgacatctgcggtggctgctacatattaccgagcgtgccggcaactc

SEQ ID NO: 40802 - DNA, 358 bp, Triticum aestivum
  Clone ID: PAT_TA_40802
ccgaagcctacctcctcgcgccgcgccaccttccgccgcgaattcgtcatcacgcgccggcaccagagatgaccgcggtgcgaggggccgcagtggagggagcgtggtctaatccggcgctgatggagccgccggccgccgctgccgatgggcctcaggtgtctgaggtggactcgttccggcgccaggtcgacgacctcctctccaagaccgacgtgctcgagaagagggtgaacgaggtggtagggttctacaattccaagaagcacagcaatggagggcgcaaggctggcggcaggtacgcggcaaacggtgccagggacagccacggcaatgggatgcccgacctcatgcgcca

SEQ ID NO: 40803 - DNA, 353 bp, Triticum aestivum
  Clone ID: PAT_TA_40803
gaatttcagtttcagaaatatttcagccatagccaaaatgactgaatttcactgaaatttagtggttcagttttggaattcagcgattttggttttcatttcggtcaaagggccaaagtttccacttgaattagattggaatctaactaaatatttcaaaaagttcaaatgtaatttgagaattattcaaatttgtgcatactaccgtagttgctatgagtgaagcaaggggttgggcgtatgagaacctctaccagcgtttaaacatgaaggaaggcgaaagggacatctataagatggccaagatctgagagaagaagacgagggatgtcaaccaagtcaaatgcatcaag

SEQ ID NO: 40804 - DNA, 407 bp, Triticum aestivum
  Clone ID: PAT_TA_40804
cggacgcgtggggaatctggccaccaaccaaggctgtcttgcgatgctcctcggttctcatatgacgggagggaatcggcatcaaaacgtagggagatgccaagattgtcgctggacatcaaggaaggccctcttaggatccgtgaaatggactcgcggccgaagccgaacatgaatgacacagaaaggagtatcagttttggttctgataaagaatccaatgcagagatccagaaagaacaaccagcagcctctaagcgtcttccaagtgtcgttgcaaaactcatgggtttggaagagttgcctgagcccaacgacacaaaggtgatatcaccacaggcacccaaatcagttcaagagaggaagcaagaacatatactgctccctttgagcctctcctcgcataa

SEQ ID NO: 40805 - DNA, 420 bp, Triticum aestivum
  Clone ID: PAT_TA_40805
gagcattcttttgtgaaggaatattacactaaaaaagttgtcatcagtatatatctcaagatgaattgtgtcacgggagccgatacggcggcagacacaagcagagcaaagcgaagccggcgcgacggccgggccctccaagcacacaaccactgcctcctcgccaaaatacgctagcctgcatctacaaggaaaaaaaggaacttgcccgtatggtgttcactaaaaagaagaatctgctaaaaggttggatgtgggctgtacgtggacatgaacttgttcctgggattcagaagggagcacgtgccatggaacttcaagaagacggagaaccatgtgtacctccatgtcgtgctttggcagaagctggatgccgacgagtcagaacctgctgaagaagccactctgctcaccattggt

SEQ ID NO: 40806 - DNA, 296 bp, Triticum aestivum
  Clone ID: PAT_TA_40806
cggacgcgtggggtgttggaatcattgtctaccggggtctgtacttgggactgtatgattatatgaagcccgttctcctgactggcactttccaggacagcttctttgccagctttgctcttggttggctgatcaccaacggtgccggtcttgcatcataccccattgacaccgaacgcaaaaggattatgatgacctccggagaggctgtcaagtacaagagctccttggatgctttgcagcacatccttgcgaaggagggcggcaagtctctctttaagggtgctgggggcaac

SEQ ID NO: 40807 - DNA, 337 bp, Triticum aestivum
  Clone ID: PAT_TA_40807
cccacgcgtgcgcggacgcgtgtgctgacgcgtgtgatttaccggtgagaatgattcgaatctctatgctaccctagacatgctatatgctgggatggaaaaccagactaggttctttggtgctggtgaaaatattacatattacctggctgggatatactgactatgacgaggccatacatcaatagaactgaacaatgctacggtttcagggcccgacaatatataacttactagaacactcatgaaaacgcggcacttatattatatggacgtgatcaaggaccattaacaaactgttagacgccgctctaaccatataagtccagtgctttta

SEQ ID NO: 40808 - DNA, 291 bp, Triticum aestivum
  Clone ID: PAT_TA_40808
gcgcgggacgaggtggagaagcttcggcacgcgggggcgcaggttgtttagctgaggcagattcaaggtttgttcatctataatttgtgttatcctgtcatatgtgatgtttgtttgctggtagaataagcaaataaatttgccttgccataatttgtgctatcctgtcatatgtgatgtttgcctgctatcctttcatatgtgatgtttgcttgctatcctcaaatggttcaaatgtggtgtgccaagtcagggtttattaatctctgtgatggaatgatacaatatttt

SEQ ID NO: 40809 - DNA, 369 bp, Triticum aestivum
  Clone ID: PAT_TA_40809
cggacgcgtgggcggacgcgtgggcaaaggtgtttgctgtattgatgagtttgataagatgtctgataatgcccgaagcatgctgcatgaggtgatggagcagcagactgtatccattgcaaaggctggaattattgcatctttgaatgctaggacatctgtactagcatgtgccaatccatctgaatcacgttacaatccaaggctttctgtgatcgacaatatccaccttcctccaacactgctgtcaaggtttgacctgatttatctgatcttggacaaggcagacgaacaaactgatagacgcctggctaagcatattgtttcattgcatttcgagaatccagaagtagttgagcaccaggtctt

SEQ ID NO: 40810 - DNA, 296 bp, Triticum aestivum
  Clone ID: PAT_TA_40810
ttcgggtacaacgctggctctgggcattacgaggacttgatggcggatggtatcattgaccccactaaggtggtgagatgtggcctgaggcatgccgtgtcgcatgccaagaccttcctgacgtccgacgtgacggtcgacgagatcaaggagcccaaggacgagcccctcgccaaccccatggataactccgggtatggatactgctgagcaacacaggccgcgtttctcctgaggacgtggcttaagtcttggtagcatgaaccaaggtttgaaagattgatggagatgatgat

SEQ ID NO: 40811 - DNA, 373 bp, Triticum aestivum
  Clone ID: PAT_TA_40811
cggacgcgtgggtgccgttgtagtatgaactgtcctcgctgcattagtgtcccctcctggccactcggtcgagcacatggtgggcatggcgagggcaagttctgaagcatctgagacggacacgactgccatgcaggtggaggtggagtaggatcgtgatggggacacaacgaggttggataggggcaccttgttgacatgggtggtgctggcgacggggtagaggcccaatgtcgaacaggtgacgggcgtctcaagcacctggtccgcctcgctctgcatggtggacgcaggcacgccgattggacccgtggacaccggaggagtggtgtctggtgccgcaccgttgtctcctcctgggctcgtcgagcag

SEQ ID NO: 40812 - DNA, 379 bp, Triticum aestivum
  Clone ID: PAT_TA_40812
caagctgcacctaatccaagacatgttcagacgcaagttgagtttgactataccatgtcaactggatgctatctaaccaaatcacaagatgagaaagttgtagaaatagcccgcaaaataaggtctgagattcctttgtatgtggcaatcatgaagaaacttaatgtcaacgtgaaggactgctctatcaacataccattgaggcttgtgagccatttaaaagaggaggcaggtagtgctattatcaaactagaagcccctggtggtaacatatacaatgttcgagctagcaagcacagcgaggatcaagttgtcctccaatctgattgggatgcttttgtagctgctaatcacatacagttgaacgacctcctcattt

SEQ ID NO: 40813 - DNA, 378 bp, Triticum aestivum
  unsure (1)..(378): unsure at all n locations
  Clone ID: PAT_TA_40813
cggacgcgtgggcgccgcgagactctcctcggctcctcctcctcctccgagtgtccaccactaccttcccggagttgcctattcccatggcgctctcccgccgccgcctcctcctcctctccctcgttgccatgacggcggtcactggcacctccaaggtcatcgtgacaaggtgctacccgccgccgacgccccaccccaacggcaggggcgcgttccaccgcagtcttctctcgctcctcgacgacctcccctccgccgccgcaccgacgggcttcgcctccatgcggacccgcggcgcgttcgcccgtggcctctgcttcggcgaccccgcgcccggcccgtgcctncactgcctgtccgacgccggcgggaaga

SEQ ID NO: 40814 - DNA, 275 bp, Triticum aestivum
  Clone ID: PAT_TA_40814
ccgtcggaattcggtgacacgctccgcctggcggcccattaacattggaaccagtgaattcaccatgctggctgcggaatggagatgtaaccaaggacaggcatatgacactctggactgcgagaagcctgctaccaagcaggggttgatgaccaggtgtctgcgacggtgtgtatgaggacatagggcgtggaggcagagacaagctagccctccggtgggcacataccattgcgactctatgtggggggtgtatttcgtgtggtcgtcgattg

SEQ ID NO: 40815 - DNA, 264 bp, Triticum aestivum
  Clone ID: PAT_TA_40815
aacactcgtaaaagaatactgagtttgcgattgccagaagcatagccgagaggaggagcccagggctgacttgcgccttaacatgcagagcctgacttgagctcgcggtggaaggagacagaccatatcagactatgtggcggggtatagaaaaagcaaatggcatgatggggacataaaaaaaatcattgagaacgactaccgcgagcgcatgaagaatatgcagcagcgcaacgagagactcttgattatggaacggctttt

SEQ ID NO: 40816 - DNA, 378 bp, Triticum aestivum
  Clone ID: PAT_TA_40816
cggacgcgtgggcccagcctcccccctccctcgtgcgcctctactaaaccaaggagtagtcggcagggaggggcagcaggggagggagatctgactgacgagtccagggatgatggagagccagccgctgcaggccccgacggccgagccccacggcgccggagccgcggacgaccaggccggagccggggctccccccgccgtcgttcccgggaaggagttcacgcggacctgcaagggcctcgtcgtcgtgctcatcggcggctacgtgctgctccagctcctcccgtcctccctcaactacctcgccatcatccccgccaagacaattccctttgtatggaccgtcttcacagccggttacatcgagcaagtcct

SEQ ID NO: 40817 - DNA, 177 bp, Triticum aestivum
  Clone ID: PAT_TA_40817
acgcccacgcgtacgcgcaccacccggaacccactgcaggggctagggttttacgcagatggccctcgtcgccgcagccgtcggagccatgatgctcctagcgcaactcgcgtccttctgcgacgtgtgcatatacggactaatgccccgtggtacacgcacaagacgacctaccac

SEQ ID NO: 40818 - DNA, 266 bp, Triticum aestivum
  Clone ID: PAT_TA_40818
cggacgcgtgggcccgaacttttctctttcaaagcaccgagaagcttgaggttattatgagcacggatgctatccaacagggactaaaatctcatgatgcacactcacgcgcacaaaacgcgaaacaacgtggcggtcgaacagcaggaggactcacaagcactatcttgaactacacagtcccaaaggcatggaaaacggccgcgagaggaaccaccatagctcatggcttggtgtgcaacacagggactccttccacaaacacc

SEQ ID NO: 40819 - DNA, 360 bp, Triticum aestivum
  Clone ID: PAT_TA_40819
cggacgcgtgggttacgcagcatgttgagtttgtcactcacgatgagaaaagaacctacctgatagatctcttacagaaacaatctttcacttcatctgatggcaagcctcagcagcctctaacattggtttttgtggagacaaaacgagaagctgattcattgaggtattggctatacaacaaaggtttccctgcaacagcgatccatggtgacagaacacaagaggagagggaaagcgcactgagatctttcaagtctggcttgaccccggtcatggtcgccactgatgtagtcgcgcgaggcctggatgtcccaaatgttgctcatgtcatcaactatgatcttcccaagagcatag

SEQ ID NO: 40820 - DNA, 367 bp, Triticum aestivum
  Clone ID: PAT_TA_40820
cggacgcgtgggtcctattgtgactcactgttggattcgaggacgctgaggttacgatgattacaggatgctgtacaagagggactgaaatctgatgctgctgaacctcgcgcaccaagctggaatcaatgaggctgtcaaatagcaggatgctctaaagcataacattgaactgacaggccaaaaggcatggaaatctgacgtgagcggacccaccatagctcaggccttggggttctacagagcgacgagttgcacaaataccattgtcacgagcaggcgccgctacgggagtggacactactgcgcgaccataagcgctgccaagagcactatcgcgctactgacaatatggatgcagatgaat

SEQ ID NO: 40821 - DNA, 306 bp, Triticum aestivum
  Clone ID: PAT_TA_40821
cggacgcgtgggcaagggctactcttatttttacacttgggatcctcgagctgagggcaagataagcgaggctgttaaacaaaacggcggagcttttgaggaaactgcgatatcggggggcaagaagccctctgaagatggccaatttggttattcttgctgcaggcgacacggcactatattatgatatggtccctgcatttagtgtacatggaaagaaccctgtctttctctgggagatgcttaaaggttcaaagatgtaactggtggtcatcatgatcaatgggcagtatgatgaatgctttt

SEQ ID NO: 40822 - DNA, 147 bp, Triticum aestivum
  Clone ID: PAT_TA_40822
attgttactttccgcaaccttcaggagactggggctatattattcacgatcatccacaagtaggactaaaattttatgcattcaagctcggggtctaagcttctatatacgatggtctcaaatcagatgatagcctaaaacattaca

SEQ ID NO: 40823 - DNA, 371 bp, Triticum aestivum
  Clone ID: PAT_TA_40823
gggaagcttcgcgacgctcgccaactggctgacctcctttgggataacaatgacagcaaacttgctgctcagctggagtgctggaggtacctttgtgtgctacacgcttgtgagcgcgttcacgctcgtgttcatcatcctctgggtgccggagaccaagggaagaactctcgaggagatacaatggtcgttccggtgagcttggttgtttccgtcgaatgtatgtcggaattattttcaagtcgggcattgtcttctttttactagtctgattgctcgatggaggccaatcagacaacagttattgtgtgtatacaagtatattcctgtacaggattgtttcagttgactttgtatagaaaggacatgtc

SEQ ID NO: 40824 - DNA, 372 bp, Triticum aestivum
  Clone ID: PAT_TA_40824
cggacgcgtgggcggcgacgcatcattaatcatcggatcagcgagcagagcccgcgtcagccttttatctaataaatgcgcccctcatcttcggagaagagagagagagagaggggcagggcggccagaggaggcacgcctgcccggatcataaccaagattcaaatttgcccgctcatcaatcatggttcttgattcattatcatcgcctcacaggaggtcgcaaaacacattctttctgtcatctcctaagaagcctcaatcatctcgtgatgatgttggtagttggtctgccctggttgagcggcatcgctttctcttgacaacgctagtggtgcttgccttcctgtgcaccatatatctttacttcgc

SEQ ID NO: 40825 - DNA, 211 bp, Triticum aestivum
  Clone ID: PAT_TA_40825
cgcacgcatccgcactctcttttgtttaagcaccacctcaaggacgagagggaggacctgcccgactgcgaccccatggtgctcgaatcgctactaaagatcaagtacgagcgggacccgtccctcacctgccgaccgagctgtcgggagggcatctgaagcagttgagccatgatcatcgacggagacaactgactggaccgccttacca

SEQ ID NO: 40826 - DNA, 357 bp, Triticum aestivum
  Clone ID: PAT_TA_40826
ctgacacatgcacaacggccacttttttttgtgcactggacatgctcacggggggtgacagataaggcgagctgatgaacaaaacggcctatctctaggagtatcttcaaagtcagggaccacgcaacgagcttactacagcctactggtgattgttgctacccgcgaaacgggcatatttcatgctacgccaccaaacacaaattgtgcttgcaaagaaccaaaacgttgtcagaggcgatggcctaacggagccaagctgaaactcatggatgacatcctcacgggcattatgcggaatactcgttctgcccggccctatatgagctaacggtgtggctctgagcaccccacacg

SEQ ID NO: 40827 - DNA, 375 bp, Triticum aestivum
  Clone ID: PAT_TA_40827
cacatttcttgatgccagatacttttagctgttggcacattattcagttgctagttgtctgtcccactggatgctgtgcgtcttttagcagcccagtactcatttgtaggaagggtggcatcactttgttggttgttcttgaaggtcagtaagaccatgtattgattgatcttgtatgctgccatggatactttgcaagtggtgattttccaaggttgttgttaccatggaggtcaacgggcgtcacaagcctacaagagagtatgtcgacagagggtgcaatggtgtaaaaccacacaataattttggcaaagttgatccctggacggcgtgggcgtacagaccgcggaccatctcgttgttgctgatgggtat

SEQ ID NO: 40828 - DNA, 377 bp, Triticum aestivum
  Clone ID: PAT_TA_40828
ggggcacatccccaactaccccaacctgttgccgcagctcatctgccagctgcacgatgtcacaatgcatgctgatgtggagaccgacgaagtgtacgcgcagatgacgctgcagccgctgaatccacaagagcagaacgacgcctacctgccggcggagatggggatcatgagcaagcagccgaccaactacttctgcaagacgctgacggccagcgacaccagcacgcacggcggcttctccgtgccccgccgtgccgccgagcgcgtcttcccccctctgtgtggtttgtaggatttcacgcagcagcctcctgctcaggagctaattgcgcgggacattcatgatgtggagtggaagtttaggcacatcttcc

SEQ ID NO: 40829 - DNA, 372 bp, Triticum aestivum
  Clone ID: PAT_TA_40829
cggacgcgtgggttttttttttttttttttttttttttttttttttttttttttttttttttttttttttttttttttgccaccaacgaactagaataatattttactaagacggggcatcggggcccatttaatccacgaatgttccaacccgcacggaataactgggcccactgggggcgaaacaaaaaccataacaaccttaagtttgggttaagagacgccataataataactagcagcaggctttggcgcctccaccacaaaacatgggctggttagtccacctcctaaattttggggccggggcccccggacccagatggggggttgatgaccatgccgccctccatgtcaggaccagcaccctgg

SEQ ID NO: 40830 - DNA, 141 bp, Triticum aestivum
  Clone ID: PAT_TA_40830
ggggcacctggggtactaccatgcaggggggatatctaaaatctgtcttaggcaataatggtaacttctcgacaaaaatcggtcggcttgccctgaaaccagattgtgattggtgtatgagtaaaaaatggcagcattttc

SEQ ID NO: 40831 - DNA, 382 bp, Triticum aestivum
  Clone ID: PAT_TA_40831
gggagctgctcatggccttccggcgcgcggtcaccgcggacccgctcggcgcgctccgcggctggagctactccgacgactccgcctgcgcctggaacggcgtcatctgcaacgggttcccgcagcagcaggcatccacggtcaacctcacctccgcctcctccgacggaaacgggaacttcagcacgctcgccggcggcagggcgaacggcacgctgctgggcctcaacgcgtccatggcggcggccacggtgtcgcgggtcatcggcctcgtcctccccggcgcgcagctctccggctcgctccccgccgagctggcccgcgtcgagcacctgcgccacctcgacctctccgggaacggcctcaacgggaccctccccgc

SEQ ID NO: 40832 - DNA, 257 bp, Triticum aestivum
  Clone ID: PAT_TA_40832
cccacgcgtccgcccacgcgtccgtccctaaccctaaaccccagcccctcccccgccgtcgaccccatcgccgccgacggctcctcctgccccggagactggtacgtcgggcgcgggccctcgcaccggcaggcaaacatggccaatcagaccttcccgtcctgcaaaacaaactggaacgtgaccagactcgaagacatgaagcttgaacgtaacgatgtcgatcaacaaaaaaaccatggaggggcccacatgat

SEQ ID NO: 40833 - DNA, 299 bp, Triticum aestivum
  Clone ID: PAT_TA_40833
ctggcgggtggacggtccaatcttacaggaccatccactgacatgtgtaacgacgaattttatactatgcatcagcagttatacctgctgcagggcgaggcgtgaaaggggactacgccgaatgatgtgttgctcagcaaataaaaggagccgctgatctccattgcctattggtggcctgctactggtctaatgtagcctcgcgctgttcaagaggagagactctgtcatgaataaggatgatgcagattacctacgatgcatctcatgtgttagaatgggcgccatgatcgactgca

SEQ ID NO: 40834 - DNA, 374 bp, Triticum aestivum
  Clone ID: PAT_TA_40834
cggacgcgtgggcggacgcgtgggtacatccggaaaccaccaccagcttctgcgattgcatcggtcttccaccaacgcctcgcttcatcggaaccggaccccgatgacgtacccaccgatatggcacgcggcgctcggctgctcccgctggtgccgccgccctttgcttcttaccattgatcgccgccgaagcttcgacgcccggtgtgcgctctacggcggggataggatcttacaactcattacggtcgtactagtagttgtcgctcgacgatagctcctggtagaagatcggcttgtggatgatgcatgccaaggcggctcagtattgctgcatttctaaatacagtagagcccgggtgtatattgatgcc

SEQ ID NO: 40835 - DNA, 247 bp, Triticum aestivum
  Clone ID: PAT_TA_40835
cccacgcgtccgcggacgcgtggtttttatgttctggatggagccaaactggggggttttcactggatgcgcaaccagtaacacttgtaaccttaacgtaacaaaccatatcataagaggggaagctgatcttatgcttattggtgaatattatgcactctcccatactaattgtattggaaggttttgatgccatgcatagttcttttacatatgaacagtgacccaataaaagctttccgtccat

SEQ ID NO: 40836 - DNA, 262 bp, Triticum aestivum
  Clone ID: PAT_TA_40836
gaacccccggggcgagccaagcgacccatcacgcctccgaccacacgaccttttattttgatcaaaaagacacacaaggggggggggtttttgacaggagtctcacgacgcctgcactgagaatgacaggactgataaagacatcacccctatgggtggctttccttactatggagaggtgaagggtgactaccttatgatcaaagtctgctgtgagggccccaaaaaaagagtggttgaccctcacttcagtccctgttaa

SEQ ID NO: 40837 - DNA, 245 bp, Triticum aestivum
  Clone ID: PAT_TA_40837
ttttattagctctagtaggttgtatgtctgctggtggtgccattggggtgggagctctgacatgggagtcgtattatctgcatgacattctctacttcacatgaatgctgtttgcaccagaactgacatgatcagtatactcaacaatagcctaagggctttggctgctagcgtgcttgtagatggtgcaggtttatattacctctcaaatcgcttgtcttagattaggatgctagctagcgcta

SEQ ID NO: 40838 - DNA, 376 bp, Triticum aestivum
  Clone ID: PAT_TA_40838
attccgatctcgctctatgtctcaattgaagttgtgaaggtggcacaggcacatttcattaatcaggacattcatatgtttgatgaggagactggcaatactgctcaggcccgaacttcaaacttgaatgaggagcttggccaagttcatacgattttgtcagataaaaccggcactttgacctgtaatcagatggatttcttgaagtgttcaattgctggggtttcttatggtgtgcgtgcgagtgaagttgaaagggctgctgcaaagcagatggcatcaggcgctgctgaccatgataatcctgtggaagatgtatgggagagtaatgaggatgaaatccagttagtggaaggagttaccttcagcgtgggaa

SEQ ID NO: 40839 - DNA, 379 bp, Triticum aestivum
  Clone ID: PAT_TA_40839
cggacgcgtgggtttttttttaaatcatgaatcatcttatcttaagaggcaggtaggagctgagagcatacatgcatacatacatacatacaaaaaggagagaccagaccagaccagaccagaccatgtatatatgctcggctgctttcctttgcccatcatcctcatcctcctcctaacattacattatattggtttagttagttattcaaaagaccagacagactcaatctgaatcatcatcttcatcatcatcatcatcttctggagttagagcagacacacagaaacagcacatgtacatacacaacacatacatggctgggagcagcagcacacaacaagacattttgactttcatttacacccaccaggtagg

SEQ ID NO: 40840 - DNA, 266 bp, Triticum aestivum
  Clone ID: PAT_TA_40840
attacgctgtggatcaaagggatttttttttttgggggtcaggcaccaccgcatcacattgatcatgacatggatatgtttgcttcaaggaataggaatgcggttccagcacatgacttgaactcaattaaggaggaaggatggcagatcatattgtgtgagagtgcactgacgatataccatgacatacagtggatatattgcagggattaatagagaggctcgattatgctgtgactacgactgaggttattaaaaattgttaa

SEQ ID NO: 40841 - DNA, 317 bp, Triticum aestivum
  Clone ID: PAT_TA_40841
acgcccacgcgtgcgctgtcgcacgctctattggctatggacagaatagaatgggagcttagctgtttgaactttctgtaatggtgtcgctttccctattaccctcagcgccattattgggtggagcgggtgggtctcctgcttcttgacccgggggaccaagattgagggctcacagactgctttcatgaggggcgctgtctgcacatttgctcttgaaccatgcatacggggcgcggtagtgacgtattggtgccacttatgacattgccataaactgaatcacatcaactcctattgccttacttacaaagcct

SEQ ID NO: 40842 - DNA, 432 bp, Triticum aestivum
  Clone ID: PAT_TA_40842
cacctctacagaagcagcaaatggagctgcaatattatggaaattgtgccattaactctcttcatctgcactgattggtggcaaggaaggggagagcaacaggttcatggtttgataaattcttggaggcttccattatgtgcataaactgtgaggaccactgctggggcttcctaagctcacttctatctgattggtcgaagtttgggaatagcatcacagaactgaaggaatatcgggatcagggtggctttagactgcaattttctttcaatgttatgcccatcttacaagggcactggtgctttggaaatgttaatagcctgttgattcctcctggttcgaatgggaagtattatctctatgctcattgctgggtgctccaagtttgccaagatagttcacatggactgatcaagaagtccagtgcat

SEQ ID NO: 40843 - DNA, 401 bp, Triticum aestivum
  Clone ID: PAT_TA_40843
aaggcgtcttggaactctactatatacgcgcaaccgatcctgtgcgaccacctcctccccatttggacagcggagcacccaccaaccatctccatgcggcgccatgagggagtgcatgtggatccacatcgggcaggccggcatccatgtctggcaacgcgtgctgcgagctgtactgacttgagcatggcattcagcctgatggccagatgcccggagacaagaccgttgggggaggtgatgatgctttcaacaccttgttcagcgagactggggctgcgaagcacgttccccgtgctgtcttcgtagatctcgagcccactgtgattgatgaggtgaggactggcgcttaccgacagctatgtcaccctgggcagtttatcagtggcaaggaggatgct

SEQ ID NO: 40844 - DNA, 411 bp, Triticum aestivum
  Clone ID: PAT_TA_40844
actaggtctagtcacccagctatctatgcgcatccgtttctttcgatcacctccttcctatgtgagcagcgtagctccctccaaccatccccactctgcgccattggggtgcgcatgtggatccacatgggccatgccgtgcatctaggtcgactacgcgtgctgcgagctgaactgacttgagcatgttatatagactgatggccagattcccggtgacatgaccgtagtgacaggttatgatgctctcaacaccttttttaccgagtctgtggctactaagctcgcctcatgtcctaggttcttagcttttgtgcccacttcgactgtatagttttggacatgcctctcactgacagttatttcaccctgaccagttttttattcccataggtttattcttatatcatt

SEQ ID NO: 40845 - DNA, 408 bp, Triticum aestivum
  Clone ID: PAT_TA_40845
cccacgcgtccggccggcggagctcttccgctcgttcccgatcgtggaggccatcttcgtcaacaacaaccagttctccggcaagatcccgagcaacctcggcgactcgcccgtgaactacctcgcgctcgccaacaaccagttcacggggcccatcccgtcgtccatcggccgcgccgccaacacgctgctggaggtgctcttcctcaacaacaagctcagcggctgcctcccctacgagctcggcctgctcgccaaggccaccgtcatcgacgccggcacgaaccagctcacgggcaccattccggcctcgtacgcgtgcctgcggaaggtggagcagctcaacctggcggacaatctcctctacggcgaggtgcccgacgcgctctgccggctcgcgtacccgtc

SEQ ID NO: 40846 - DNA, 332 bp, Triticum aestivum
  Clone ID: PAT_TA_40846
ggagatattggacatgctgcctctcctggaggccaagagaaaggtggagaaacgggagaagctagagacggcgttgctaatgacgacattaattgggaagaactgaagaatgaaagccgggaagcaccaccaatgacaactcaagaacaaatggatactgataatcaatttgcatgaaatcttgatcattatgcaatggcatagagctggacgttgaattgatgaagatcacatagattcgatgtggcatcgaaggtgccaacaaattacatgggagagcaagttgcatcagggggagagtccgatacaattgatgaagatcacatgttaag

SEQ ID NO: 40847 - DNA, 462 bp, Triticum aestivum
  Clone ID: PAT_TA_40847
atctcatttcctttggcttcaggataggcctaataagaaaacaaataattccaattcatatatgaacatttttgcctccttatttcttgaaaatgtggaattggaattcctttcctttggcttcaggataggcctaataagaaaacaaataattccaattcatatatgaacattcttgcctccttatttcttgaaaatgtggaattggaattccccgaggaattccgatctcatttcctttggcttcaggataggcctaataagaaaacaaatgattccaattcatatatgaacatttttgcctccttatttcttgaaaatgtggaattggaattccccgaggaattccgatctcatttcctttggcttcaggataggcctaataagaaaacatatgattccaattcatatatgaacatttttgcctccttatttcttgaaaatgtggaattggaattcccc

SEQ ID NO: 40848 - DNA, 419 bp, Triticum aestivum
  Clone ID: PAT_TA_40848
cccacgcgtgccggcactccttcaccgacgcgtaaggtacaagtaaagtaaccctggctggctgcatggtaggtacaggcctgttcaaggtgcggcgccaagtgctaccgtaagtgccaaaaacactaaaccataccttgacgggatcggccgttcggcgcctggcgcgtggcgggttttactaacaactgtatgatcttagccacgccatggcgcgggtgagaagcaacctcttatggcttaacgggcgatcattaggagaacgaagcgtctttcagctcatgctaacacacatatccgtgaatgctgtttctacacctatcagcatggagcattcggcctcaaggctcatccaagaatagcgcaccaatttcttgagcaaagcttaggggactcaaaatctgacaaggagaaagagc

SEQ ID NO: 40849 - DNA, 438 bp, Triticum aestivum
  unsure (1)..(438): unsure at all n locations
  Clone ID: PAT_TA_40849
cccacgcgtccgtccacgcgtgcggtcgacgccaagctcgcgtacatcgtgccggtgctcacgcgggtgcacgcggaggaagaagccagaagagccaaggcggcctacgccgcggactgcgcctaggaggaagcctgtaagaacagggcctccgaggaggcctccgacacggcgcccatgaggccgtacttgtcggacgcgtgggaggacgaggagacggaggtgaggcacttgctgatcaacttcaggatccccggcgccgacgacagggctgacctcaaggagaacctgcggatctgggcgcacaccgtggcctgcgtcgtncggtgactgatttgaccaagagcccacctttttttccattatgccgagcagtgagcggaatgattaactggaaatattctttgccatgtgcatgcgcatttttataagatattc

SEQ ID NO: 40850 - DNA, 434 bp, Triticum aestivum
  unsure (1)..(434): unsure at all n locations
  Clone ID: PAT_TA_40850
cattggcgcatctcgcccccgttcggcggcggcggcggcgtagatccggcgtggcgttgcgcccccgttcctcgcccctcgtcgctccgcagcgcccgcgctccccaaggccgcagcacgcgagcggcgcggccttcgttggttattgaagaaacaacactccgccgttctgaagaaatgagtgcgtgtaagaaggccagggcggaagctacatatgttgtgagttcagacagacttagcagtctacctccagagttaaagggcgacatcctttcccgtctgaatgtcgaagaagcggttaagactagcaccttatcaagtacttggagggatgcatggactaatatgccaaaaatatttctgcgcgatggaaattttgcaagaaccaagttcgtcacattangtgatatggtgctatcactccacaacggaac

SEQ ID NO: 40851 - DNA, 244 bp, Triticum aestivum
  Clone ID: PAT_TA_40851
aacacgcgtgggcaaacatatagtaagcattcttatatactttctcctgcaaaggcaggggcatttcatggggtggagtgaaatcaactcacatgccttccatgtccaacctaatgaacataattgccctcacaaagaacaatcttcaaaatcttaaagcacatataccttttgccaacaattccaagtgttataattcccccacctaaaactttacctaatacacttacaacttcaataaaaa

SEQ ID NO: 40852 - DNA, 316 bp, Triticum aestivum
  unsure (1)..(316): unsure at all n locations
  Clone ID: PAT_TA_40852
cggacgcgtgggcgctcacactcactcactgttgtgtcgtgtcccatcccactgctgccacccaagctaattgtggagccagtgataatgccgtccgctggcgccgtcgacccccagagcggctactgcgccgtcacgaggacctttcacagacttcgcgcgcccattccggtggcggccccatacccggcggtcttctttccggccttcggcttnttccttcttcccttcccggttcccggccacgccgtctttcttgatgccggcaccggcgaggccgtcccctttccggccttcctcgggcaggttcgggccc

SEQ ID NO: 40853 - DNA, 359 bp, Triticum aestivum
  unsure (1)..(359): unsure at all n locations
  Clone ID: PAT_TA_40853
tcacactcactcactgttgtttcttaccccatcccacttctnacacccgatctaattttaaatccaattataattcactccactgcccccgtctaccccaagagcttttactgcacccccacgagtacctttcacataactacgctcgcccattcctcttcctcccccatccccgccaatcttctttccgtccttttccttcttccttcttccatccctgttaccctcccacgccatctttctttattccttcaccggctaattcatcccctttccttcctttctttttcaattactgacctcttacatggcccttccttcccatcttcacatattcctctgttacattacctttattc

SEQ ID NO: 40854 - DNA, 430 bp, Triticum aestivum
  Clone ID: PAT_TA_40854
cggacgcgtgggtatgtatgctgatagcgtttagagataccttctaatcaaaaaataagatctgatcgtgcgctatatgttgattctcttacatatgtattatgacaaaattaaggcacatatgttgatattggactgataaccttagtacatgaaaaggtgttggaaaggacccaatccttcaaagatatgtagtactcccgtcccaaaataagtgtcttaaccttagtactttagtacaaagttgtgacacttattttgagacggggatatgttataggatcctagctttatttcgacccatctgttgtaaggagagtatcttgtgcacttattattcttattatttgtgcttttcgcattaatcgcgagctgatgttatttgcatatgagtccaagaacaacaattgctctttgttgtggcattact

SEQ ID NO: 40855 - DNA, 416 bp, Triticum aestivum
  Clone ID: PAT_TA_40855
cggacgcgtgggcgaacgcgtgggcagcccccacctaccctgcctacagcaaactcacaggccccaccaccgaagctgccaaccccacccgaagcggcagccatggcccccaaggcagacaagaagccggccggggagaacaaggtcgagaaggcgacggagaagacccccgcgggcaagaagcccaaggccgagaagcggctgccggcgggcaagacggcgtccaaggaggccggcggcgagggcaagacccggtgccggatgaagggcagcaaggcgaagaagggcgtggagacgtacaagatctacatcgtcaaggtgctgaagcaggtgcaccctgacatcggcatgtcctgcaaggccatgtacatcatgaactccttcatcaacgacatcttcgagaagctcgccgggga

SEQ ID NO: 40856 - DNA, 320 bp, Triticum aestivum
  Clone ID: PAT_TA_40856
ccgcaggcactcctttttcctcgcccgcatccggccatcccgcatcccgcacggcacgggacggccgccggccctcccgcccacctccagtccagcgccggcgccggtggtcaccgctccatggctccatggccgccccgcgcctccgtggcctcctcctccgccgcatcccgcacggtcgccggctctgccgcaggcatcccgcacggcacggcacggccgccggccagctccatgtccgccccgcgcctacgtggccttctccgccgccgcatccctcacggccgccggctctcccgcaggatcggatcccacccacc

SEQ ID NO: 40857 - DNA, 415 bp, Triticum aestivum
  Clone ID: PAT_TA_40857
cggacgcgtgggctgcaagcgacgcgcgggcggtcggcgctagcagggcgcgggcgagctgggccgtgcgtctgcgcggcgagcatggccgggcgctggtgcagaggatggctgtgcggtggcgcggctaggcgagcagggcaaggcggcggcatggatccccggccagtagaaggacggccgacggtcaagtccctgttcctgcagtggagaaggacgaaggacttgattgtttttacttttactttctagggtcctttgtgtaaattttcaggacaactgtgtaacttctctataactccacctacaagtgtaacttctctgtaactccaccagtccacctacaatgaatgaaaggtagcacggccgtgtcgaaaccaaatctaacgtgagctgaacctgctctattgatttg

SEQ ID NO: 40858 - DNA, 440 bp, Triticum aestivum
  Clone ID: PAT_TA_40858
ccctcgcaacggccgccctgcttgcggtgttccagcggtggggtctccgatacggcctgacggtgaacccggggcgcccgtgcgggacgcgggactggatctactccttcgcgcagaacgcatccgtcgactgcagctgcgacggctcgcccgtgtgtcgcatcacacacctgttcatgccccgtcttcccggctcatccgaggcctctgggttttcggctttcccggtgcctttgcttgtgtattgacggctgggatctggatcatgcaggaacatcaccggattctggaatctgaccgagatcccgctggagctcttcaacttaacggagctggtctctctgtgagtcatggcattggtttctattgttgtgcaaactgcttacactaggaaatgcgagaattaaccagcctactagaagcaggacaatgagatcaag

SEQ ID NO: 40859 - DNA, 366 bp, Triticum aestivum
  Clone ID: PAT_TA_40859
cggacgcgtggtcggacgcgtgggcggacgcgtgggcggacgcgtgggaagccgctcgccggggagaagctctccaagaaaacataaccaacacttaccttcatgctccatgggtaaaactatgagagatagagaaagagatatataaagctgtctttctgaatgcaaatcattcattgcgatgatctttctgccagttttatgcactcttttatacggcccatccccatgtatttaataggaataaagctgcggttcttggaactgactaggcacacacacacgttcccgtggaatcttgttagcacactgtgcgactttcatgccatttcacctcggttctactttgaattcacacctttgctc

SEQ ID NO: 40860 - DNA, 211 bp, Triticum aestivum
  Clone ID: PAT_TA_40860
gccgtacgcgttcgccaaagcctacccgcttgcctgcgtttcctggtggcggacgccgtccccacctggggcgagcccagcccccatgacgggcgaagatgaagaccatcctggcgtcggagacgatggagatcccggacggggtgtccgtcaaggtgtccgcgaatatgatctcagacacggtcacgccctgtacgctcgctcgatactg

SEQ ID NO: 40861 - DNA, 222 bp, Triticum aestivum
  Clone ID: PAT_TA_40861
cgttcctgcgcaaacgcgtgggccggctcctcttcacctgccataccgcgttcccggtggcggcatggcctgttgaggaggcgacgcccctccatggtgtgaagcagcacaccaggatctggatgaggaaaaagggatcccggctccccaacggtggatcgatcgatgcgagggggcaacgagcttctcccgacgtgggggagcaactaggcccggaaatcc

SEQ ID NO: 40862 - DNA, 380 bp, Triticum aestivum
  Clone ID: PAT_TA_40862
cggacgcgtgggcggacgcgtgggattctggtcacatggtacccatggatcaaccgaaggccgccttggagatgctcaagaggtggatgtcaggaaacctttcagacgcctcctcgagctctcagaggttcgacttcgccatataatccatccttgcgctggctactagtgtaatgtatctggtgtgcacgcacatgccttgggatgatcttaggtgatgggaagctcgtcggcgaccgtgcatatgctatttcccttgtacggtgctcgaggttgatgagcgtgtaataaaaggctttcagaggattgctggggcaatgcgaatgccgaatgtatcacgaagattatcgccaatgagtgacatgtggactactttatgc

SEQ ID NO: 40863 - DNA, 326 bp, Triticum aestivum
  Clone ID: PAT_TA_40863
atgcgttcacgatctactgacaatgttaaatcgatatgttgctctttacgagcatgcggagaacgatcagacagatattatgcatacacttgtacgagtttaaaccctgacatgtatttcatcagatcaaacatgtgcttaaatttttacttgtggcggcccgtatattcatagctcggtggatactaagctcaactggcgtactggccgtacccatgtgatcattggcgccgcatgtattagagattccatacctaatgcagtggagggcaccaacacttagtgcctgtcaatacactcgcatgagctcaccctatttggtctcc

SEQ ID NO: 40864 - DNA, 383 bp, Triticum aestivum
  Clone ID: PAT_TA_40864
cggacgcgtgggccaatgagtgctccttacctgtttcaccaactaaagatggaaaccatggtgctgttgattctgtggacgctgcaccgaaggaaagtggaaatcttgtccaagaatgccatgttgcatctgatgttcatcctggtagaccctttgccatttttttttagttttgatgaaattctgctcagtttgctataaccatgtttgaattaatgtaattgttgaactacatgaataattgagtatcctggtctaatgtattcttgaatggtttttgtggtgcagatgaagtaccacaggggaatgcagatgaggtgccacatgggaatcctgtgcctctcacaagtgcaatggaagaggctgtcgaccacagtggagat

SEQ ID NO: 40865 - DNA, 315 bp, Triticum aestivum
  Clone ID: PAT_TA_40865
caccaccacaaggaccaggctccttcttcgtctgaccccaaccagatcttcaagatctactgccgttcctcgtaggactactgcctcgccgtccgctacatctatgtggtgctcgcccccgtcaaccccaaggacgagacccatcactggctcaaggacatgcgcttcatcaccaccatcaatgacgaggtgggcatgccttccttcgtgctcgtcaacaaggccaccgtcctcgccttcaagcactccatcttccaatcccaccccgtgaagcttgtgcctttcaaccctgcattctatgacacttctgtgctt

SEQ ID NO: 40866 - DNA, 245 bp, Triticum aestivum
  Clone ID: PAT_TA_40866
ggactgttagtgtgaccatctgtttctactatctaatattcagggcttcttctcaaaaaaaaaatctaatattcagggctatattaaccaacagtctatgcattatccagtttcaaacttattaagctccaagcgttgaacatgttattcctgtgctttctgttggatcttgttggttgtgggcacccatgggtatcttaccattgaatcgttacttgagttatatgcattgaacttccacattt

SEQ ID NO: 40867 - DNA, 414 bp, Triticum aestivum
  unsure (1)..(414): unsure at all n locations
  Clone ID: PAT_TA_40867
cggacgcgtgggcgctcactaaatatatacatgtatgctgcatagacatggtcacatggatgattaacatctttttagcaaaggcatgctaattcaatgaaaaattctactacacgtatgactatgaacgtagatgtccactattgatttttgaggactactttaggatgtgatcattggtgttgcttcacaccttctagacaacataacatttgattgttactaatgtgaaaatcaacttaccatttttttatcacagtgtgttcagccactatcagactttggtggtatgctctggctgcaaaactatgctcttccaacctaccggtggaaaggggaggctcaccaagggatgccttattatggaaaaaatgaagcccttcttaagatngtttactactacttatcctcgat

SEQ ID NO: 40868 - DNA, 241 bp, Triticum aestivum
  Clone ID: PAT_TA_40868
attcggtgattcgaatgatgggcagccccgttaccaaaccatactatgcgggggtgttagcgcccacaggttggcattggccttgagagcgttgcaattcttctccaagctagtgagctggctggggaatctacggagaggggggctaacccactggtgcttcagttgattgcgaagctattatcagaaaactcccatcttatccaaggaacagtatatgccctcatatgacgccacgtta

SEQ ID NO: 40869 - DNA, 308 bp, Triticum aestivum
  Clone ID: PAT_TA_40869
cccacgcgtccgccttaacagtgcaaagctatgcatataaagttgtcgtgcttgtataagtgggcagtacataaagctgctgttgtgaccttaaccatccaaaactaatgaaaaaatttgagatgtgctagtgtgtatactatattggaacataatgcatagttcctgtatgtgcagcatttcaattgccctgtgaagtaatagttgatgccatgctggtaagggggccggtttcattaccttaacagtgcaaagctatgcacgtataattaacattttattttgaatttcccttcagcaattacttg

SEQ ID NO: 40870 - DNA, 391 bp, Triticum aestivum
  Clone ID: PAT_TA_40870
tcattcgcggacgcgtggttttaaatctgcagcgtctcaccctcattctttttaggtcggagaccacatatggtgcatcattactaaaataaccaagcagttgaaacactcccttgccactgcaagtaccaaaccaaaccaactatatcacacatgtactcaggtcctcataaacactgcccattaaacagacacgatgtcttactgcatcatcctctccttaaataggcaatgctcagaatattatgaactccgcagttcatgcacggcttcatgccatatgatgcgtttaaaacgcgcatccattccattcaaattctgagctctttgaatcgcggaacttgtggtataatccgtacttgtggatggacagctgtcactccaagatgga

SEQ ID NO: 40871 - DNA, 390 bp, Triticum aestivum
  unsure (1)..(390): unsure at all n locations
  Clone ID: PAT_TA_40871
cttcccctcttnctttctttctcccctcgccgtcgcctcctcctcctgctcggcccaaaccctaatcccctctccccccccgcgaaccgaggccgcgggcgcgcaggcgggcaggcgcggggcaaaatggcgggcaaggaggacagccggatcttcgtgggcggcctctcgttccacaccgacgagcgcaagctcgaggacgccttccgccgcttcggcaaggtcgtcgacacccaggtaccggaccgtcgccgcgccgctccgcgtatgctttcgcttgttgttttttatttattgtttcgcgggtatgtatgtgtatatagctgctagatctgcggaattagatggtgttgagggtaggaaggcgaatgtgatgcacatggccaaggt

SEQ ID NO: 40872 - DNA, 312 bp, Triticum aestivum
  Clone ID: PAT_TA_40872
acgctcacttgaaaacacccgagcaaacctctccgatctcccatcccggcgcccggcgctggtcccgcgatggcccgtacgaagcaaacggcgcgcaagtccaccggcggcatggccccggggcagcagctggctaccaaggcggcgcgcaagtcggcccctgcgaccggcggcgagaagaagccgcaccgtttacggccgggcacctttgtgctgtgcgagatccgcacgtaccaaaagagcacggcgatgctcatgcggaagctcccctttcagcgcctgaggcgagagatcgcgcaggacttcaagacc

SEQ ID NO: 40873 - DNA, 367 bp, Triticum aestivum
  Clone ID: PAT_TA_40873
tcggcggcggcggcccataggggccggccagatatagccggatcccttggacggtggtgacgagatcgttgaggaccccggtgatctccgtcggggagtagacggcacggtgaagggcggcgactggccggtggaggcgcccctcggtggaaccgtgcagcgctgcggggagagcgagcggcacggtggagaggtcgggagaggtcggacggtgcggcagatagggttggtgatgcggcggttgtggacagcaacagaggtgtggacaatggcggggtagggccggggcgcacacatgatcagacccaagctaccttttaccaaattggtaagagctaggaccccacccggtttagggccaatgttg

SEQ ID NO: 40874 - DNA, 201 bp, Triticum aestivum
  Clone ID: PAT_TA_40874
gaagagagagccgcccttcgctccccccagaggccagagacggacacgatggcggcgcccacctcctgcgcgggatccaccctcgcccccttctcccaccccaaaaccctagccggcgccaccgccgccggaggctcatcctctgtcgccttctcttcggccgccttccaccccgcatgcgccctatcagtctcgggcgcc

SEQ ID NO: 40875 - DNA, 140 bp, Triticum aestivum
  Clone ID: PAT_TA_40875
gatatagatcgcccccggtcaccataaagggtacatgcttacgagggggggggtgctaatggccagcgcttatttagactaacctacatttactgctctacatgctgtttaaccacaacatcccatgggacaagcgccgt

SEQ ID NO: 40876 - DNA, 398 bp, Triticum aestivum
  Clone ID: PAT_TA_40876
cccacgcgtccgcggacgcgtgggcgatgaccacgacaacggggacgtcttgatgtacaccgggagcggcggccgtccgcgcaacggcggtgaccacctctccgaccaggagttccagcgtggcaacctcgccctcgcctacagctgcaactacgacgtcgaggtgcgcgtcatccgctgccacgactgcgacgccagccccagcggcaagctctacgtctacgatggcctgtacagggtcgagtcctccgcctacggccctggcaagtccggccgcgaggtctgccagttcaagcttgtgcgcctgccaggccaggacgcgctcggcagcaacacctggcgctccgtcagagacctcaccgacgcgctcgtcgccaagatccgcccccccggctacc

SEQ ID NO: 40877 - DNA, 282 bp, Triticum aestivum
  Clone ID: PAT_TA_40877
cggacgcgtgggctcagctccagctccccaatcaagctcgccaaaagccctagcccgcgagctccggcggccaccgttccttccttcccttccccggaacgaccggcgcggcctccgtccgtcccttaaatcggggccgagcaatgccccggcggcggccaagggccgggaagaagcgtatggaccccgcgatcgaccacttcgccgagatgggataccgaaaagccgacttccgccgcgtcgtaaacaagctcctaaaggatgtatatggaaaggatgggt

SEQ ID NO: 40878 - DNA, 389 bp, Triticum aestivum
  Clone ID: PAT_TA_40878
agaacccgcacgacgacctatctccacctcgagcgcatctccacgatggcagtgcgccgccgcggccggcccccgcccctctgccgcgcgtcaccaccgccggccacctcccctccgccgtgcgctgcccccctccaccgccatcatcggccaccgcccctccgtcgtgctccgccccaccccttcggcttcagtggatccgcaccgccgccgcccttcctctccaccgtcacccgtgcctgcccgcgctcatccatcgccgcgttaaggcttcagtgaccacggcgcctcggctgcgacccaggcctgcttggccgccggatggatggataccggccgagctcgtccttggcgccccggctgcgacccatggttgattggccgccggc

SEQ ID NO: 40879 - DNA, 341 bp, Triticum aestivum
  Clone ID: PAT_TA_40879
gatggctgccgccttttcctcatgtagcatcagcttcactttcctagttaagttctcctccaaaacaccatctgccttctcttgctccgatgggtcacacttgaaacgccaccaaaattcttccactattttggaagctgctgttcttacttctggaccaggggaccacttgtagtcctcccaacacaataccggtttctgatcaatttttggaccaattggcggtggatacatctggcgcactaaggcacctagcactgttgatggatcacgagcgctgtatgggtgcctttcccatgccatgccaacgggaactataagcggtctgtcaatttcctcta

SEQ ID NO: 40880 - DNA, 297 bp, Triticum aestivum
  unsure (1)..(297): unsure at all n locations
  Clone ID: PAT_TA_40880
nctttagatgagaaggcagatcataatagccacccatttaacattttatttaggagtttacacacatgccttcacagaccggaaagggaatttaatttcaaccgccccgacaactattgttctgcattacctgatctaaactaatccaaacactacggtatggtgactatctataatgttgcacctccagatgtctacaaaatagccatgcttaacaactgcatttaccatgctgacatatggaccgctccaaaactgccacttgtagataatgactgcatgagcgttattaaaata

SEQ ID NO: 40881 - DNA, 402 bp, Triticum aestivum
  Clone ID: PAT_TA_40881
cccacgcgtccgcccacgcgtccggccacagaaatgattctgaggcatcacactatgtaaagaaacatttcaagatacccagttcagctcccccgagcacctgatttacggggaaaatctggaaacgcctcgaaggtacatataacggatggacggtgctcggccttgtgcaacctaggaagcgtattttgtaatgattgtgcattattagcagtagaagctagggaaccatacgctagttctgattcatgggcattggattgattggttgcttctgcccaggaaagatttagatgtcttacccttgtttctgtggggagtttttagctggattttgatgacatttctgactgatgggaatgttggtctgtttgtgtggtttcagaactgatgcctacaatt

SEQ ID NO: 40882 - DNA, 383 bp, Triticum aestivum
  Clone ID: PAT_TA_40882
ggacgagaacttggggcgatcagatcagccagattgggtcactgttgaagctacaatttcacacatcaaaactgagaaattttcttatccagcttgcacaagggaggttaatggtaagcgctgcaacagaaaggtaacaaataatggtgatgggatgtggcattgtcccaaatgccagcagagctctcaaaattgtgagtaccgacacttgtttcagtgtaagatccaggatcacactgggactaccaatgctactgcattccaagaagctggccaggaaataattggcatctcagcggaagagcttttcatgattaaaaatgtagatctagatgacgcacgatttgcaaaaataatacatggtgcctgttatcagcaatttc

SEQ ID NO: 40883 - DNA, 391 bp, Triticum aestivum
  Clone ID: PAT_TA_40883
tgttgtcagactaatacagaagaacaaaaaactaactgttgatgctttgtctgtccagctagccggcaagtcagataaaagtgtcatctgatacgagaaagtactactgtttacatttataaaagatacataagtgttaatttggcaagtctgttagttgataaccttacctgatgttaagagggtgagtggttagtgtaaaataactttgagatcatcttcttttgcagttctgaccaattttttcttcacatcattttgaaattcttagtttgttttttgagttattcatattgtacccatgtcatgctgaatgaacgtgcatgctgtgagagagatagatggaaactgtaattctttagtgtcattgtacattatgtagagttatatt

SEQ ID NO: 40884 - DNA, 176 bp, Triticum aestivum
  unsure (1)..(176): unsure at all n locations
  Clone ID: PAT_TA_40884
aagatcgccgaggccaagcgccgcctcctcgaagagctccccgactcgtggaagggccccccggaggaccgcaccgtgcaccctgactgcatcaacgcctccaacccctatcatggctgctccgagtactgctttaagaagattgccgacgccaacgcagccnnnnngcgcgggga

SEQ ID NO: 40885 - DNA, 267 bp, Triticum aestivum
  Clone ID: PAT_TA_40885
cccacgcgttcggtcaactccttttgttcttctacctaggcggggagccaaactccattcataatcgccaagctgcacgcaatgggcgccgtccctgctctgatactagccggtctactcgccgtgctcacgtacgtgctttgcgcgctccactccatcgagtgggtgccgcaccgcctggagcgccagctgctctgtcagggcatccggaggcctctctgcagactgctgtccggatacgcggccgaatacatagccatgaccaaa

SEQ ID NO: 40886 - DNA, 202 bp, Triticum aestivum
  Clone ID: PAT_TA_40886
cggacgcgtgggattgttcgcacaaattggcaaggtcgatgacgttcgcctggctacccatgaagatcgccatcccatgcgatgtcgtgatggctagtacgctacgggtggacatgctcacaaagcgctcgattcactgtatggtggtgatctaacgctcccggcagagagacttgacatgggtgatgaaagaggtgcagct

SEQ ID NO: 40887 - DNA, 328 bp, Triticum aestivum
  Clone ID: PAT_TA_40887
gttcgggtttttttctttgagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggtgagatccttgacgccaagatcattaacgaccgcgagacggggaggtcccgtgggttcggcttcgtcacgttcggcagcgaggagtctatgcgccaggccatcgaggagatgaacggcaaggagcttgactggcgcaacatcaccgtcaacgaggcccattccc

SEQ ID NO: 40888 - DNA, 272 bp, Triticum aestivum
  Clone ID: PAT_TA_40888
acgcgtacggtggctactctgggcaattctcctactctcgagcggggcaagagtgccaaggtcatggcaggttgtttcaagcacaagcggagcgatattggggggtgctaattttacctcaccatgtttatctagtgccgccgagctgggaggagcatcaatacaactgtcgcggcggctgtcttatgtggagcgcggctctattggtcacaacctgcattcattgatgatgatgatgagctctatcctccaagagaattatcggcaatatt

SEQ ID NO: 40889 - DNA, 403 bp, Triticum aestivum
  Clone ID: PAT_TA_40889
ctgagcagtggcctttatttttcttgtcgacctgagcaacctaaggagaaggcctcgacctttggatccaatgtgatgccatacactggtggtgacaccaagaaatctggagagcttgggaagatgtttgagctccatgctgaaagatctagaaaatctggtcctctaggcaatgcgccttctagaaatcctttatttggcggcgctgccttcaactatggacctgtgtctaatgctggcggacggacaaactactccggttctttttcatctttagtacctggcgcttggaggatcatcatgagcaaaatctaattccggaccactcaatttgcatggttaaccagtaaagcggtcattttgtccccagtctggaggtgtgaccccaatggttcgtcagaat

SEQ ID NO: 40890 - DNA, 390 bp, Triticum aestivum
  Clone ID: PAT_TA_40890
cttctccactccggccaagcattccccgcctgcccgagcccgacaccccactcccgccgcagatccctcccagccgcccgctcctcgccaccgagcgaactcgctcagcctcagcccgccaccgccatgccgtcctagcgcgcctccctccccgccgcccgatttagccccccgcccccccttcttttatggagtccccgcgcggccggcgcactcgcaatgccgccgtcccctccgcctgcttcctactcctcctccccctccttctactcgtcccaaccctcttcccctccgccgtccccatccttcgtcacgtcgtgcaaagggcggccctctcgtcccccttctttgccgtcaggccgcggggggactgccaggagctgcaggccc

SEQ ID NO: 40891 - DNA, 414 bp, Triticum aestivum
  Clone ID: PAT_TA_40891
ggctctttcaaacatggtagtcgtggttcattcagatgtcgattcttgggaaagccacatacaatgcaatgggaggtcaatcttatgggatctgaggaaaccagttaaggcggctattgctgcatctgctgaatatgtatctggtttacttccttcgcatttggcttatagctcagctcatgaaactgcatcagaggactggacatggtctgtgggctgtaatcccttatctattagttctaaaggttggcaactttcagaatttcagcaagatgtgatcgcacggaactatattattactggagtggaggaatccatacgagtagtcaattcagcaattcaacgattggtaacagagaggacatccgaacaaggctttaaaattttcaagaccaaagagagcgtgatggttga

SEQ ID NO: 40892 - DNA, 365 bp, Triticum aestivum
  Clone ID: PAT_TA_40892
ccaagtcgtccgcagtggtctctgtatttcgatctgtgtaacaaatgttcaatgcaatgaacagagggaaccatatggggcacgctatcgtttactatgatgcttcatatgatgctacgaaggaccggatgcatgaccgaaaccctgatcggaccgctaatcaaacggtatatgagctggtcattgagcgcatcatagagcgcgtagaccaacgcgccaacctgctgatcaaactcattattaacaagatcaactgcaagctgctttggggactgattgttgacaatcatggtgagacctatcgttgaacctacgcattgattgactttaagaacgaatgcaacgtcggctgtgctttgatctat

SEQ ID NO: 40893 - DNA, 242 bp, Triticum aestivum
  Clone ID: PAT_TA_40893
cggactctgcttcattgcccaagatgagaggagttgtggtggtggccatgctggccgcggccttcgccgtgtctgcgcacgccgagcaatgcggctcgcaagccggcggggcgacgtgccccaactgcctctgctgcagcaagttcggtttctggggcaccaccttcgactactggggcaccggctggcagaggcagtgcaacggctgcaggggcggcaccccggtaccggtaccgaccccc

SEQ ID NO: 40894 - DNA, 204 bp, Triticum aestivum
  Clone ID: PAT_TA_40894
cccacgcgttcgcggacgcgtggggcgtggtggccgcagtggagcggcgccattgtttatatcctcgttccgcgcagcttgagcgagggtggtgtggtggatatagacatacaaccgtctcggaaggttctgctctccgaccacgacggcgcgaacatgtagcccgtgtcgcatccgttcaagtcttaatacgagcaatttaag

SEQ ID NO: 40895 - DNA, 106 bp, Triticum aestivum
  Clone ID: PAT_TA_40895
tggaaatttgtaaacttggtcaaactatgggcctgggacgtcaaaataattattcattacaacaaggattctaaatgcattacttaagcccattggggcctttcca

SEQ ID NO: 40896 - DNA, 241 bp, Triticum aestivum
  Clone ID: PAT_TA_40896
cccacgcgtgggcgcacatttgctgtattctgaaaaagcacgaggccgataggcgctactcctgcggggagatcgttgcaaaaggggagccggaaacaaataaaaactgtttatatctaatgtagaaccacctggctgcaaaacaacattgtgctcgcagtgaattgcttccaatgactgccaacactcgagaatggaatcaagataacagttttgatatgcttgcccagacgctgaagaa

SEQ ID NO: 40897 - DNA, 368 bp, Triticum aestivum
  Clone ID: PAT_TA_40897
cccacgcgttcgacgacttttccttgtgcatggtcatccccgacgcgctcaagggtatgaggctgcggcctgggcacaggtactgcctcctcggtcaggtatttaaggaggtcggatggaactacgccgacaccatcagggagctggaggaaaagaggaaggagaaggtcaacgtcttcgtacccaggataaagcaactggccaagctcctttgtaaggcccggaaggcagtcgaagagaagctgggaactcagctggagatcctgggttcgatcaaacactaatagaaatgaaagactgtctagccccatcaaattatgggaaacctctgctcgattctaagggattaggaaactctcaatgggcaa

SEQ ID NO: 40898 - DNA, 393 bp, Triticum aestivum
  Clone ID: PAT_TA_40898
cggacgcgtgggcggacgcgtgggcggacgcgtgggttgtggaggaaatgagtacatttaccagactcttgctttgcttgaagctagagcagagcgctttgaacaagcacggactttattccagctagctactcaatgcaatccaaaaagttgtgcaagttggctatcttgggctcaggtagaaatgcgtgcagaaaacaatgtcattgcgaggaagctctttgagaaagctgtccaggctagtcccaagaacagattttcgtggcatgtttgggcactctttgaggccaatcaaggtaacactgacaaagcaaggaagttacttaagattggccatgctgtgaaccctagggaccctgtaattctacagtcacttgcactgctggaatacaa

SEQ ID NO: 40899 - DNA, 147 bp, Triticum aestivum
  Clone ID: PAT_TA_40899
cggacgcgtgggcggacgcgagggttgtctcttgggatgtgtgcagaaaaagtgcagggaccagactgttgctctgctggaagcacgaggccatcgctctgaacaaacacggactttattgcaggggggtactcaatgcaagccaaa

SEQ ID NO: 40900 - DNA, 175 bp, Triticum aestivum
  Clone ID: PAT_TA_40900
cggacgcgtgggcgagatcgagctttgcctgtcgacttttcctacccgtcgcgcccggacgtgatggtcttcaaggagttcagcctgaggatccgagctggccagagtcaggcgcttttgggagcgagcgggtctgtgaagagcactgtcattgcactcatagagcgtttgtact

SEQ ID NO: 40901 - DNA, 412 bp, Triticum aestivum
  Clone ID: PAT_TA_40901
cccacgcgtccgcgctccccctttcttctgctccttctcaattccaagcacttcacgagccttaagccaagatgaacagcgcggccgagacggacgccggcggctacaacggcagcccggccgccccggtgctggtggtggagcgcgtggtgacggtggagtaccttgagcagtccatgtcgcggggcctcctcggcaagttccccgactcctccgcctacgacttcgactactgccagagcggcatctggtccccggtcaacaagatcccgagcgagtcgccggcctccggctccagagacttcctcatcgccaagctgaagcgccgggcgagggccgggagcaggctcaaggacgctgccggcggaggcggcagcaggtcgaggtggcggcgcccgcggctgcggcggga

SEQ ID NO: 40902 - DNA, 342 bp, Triticum aestivum
  Clone ID: PAT_TA_40902
tcgcccacgcgtccgctacgtttccgttttcgccgacatgggtatcgacctcgtcgccggcggccttaacaagaggaccaagcgcaccgcgccaaagtcggacgatgtctacctcaagcttctggtgaagctttaccgctttctggcgaggaggaccaagagccagatcaatgccgggatcctgaagcgcctcttcatgagcaagaccaaccgcccgccggtctcgctttgtggccttggtaagtgtatggatggcaaggataaccaaatcccttgggtagtgtggaccatatcctacaacaagagagtttcgaggtgccggcgatcaatgtggcagctttt

SEQ ID NO: 40903 - DNA, 169 bp, Triticum aestivum
  unsure (1)..(169): unsure at all n locations
  Clone ID: PAT_TA_40903
aaacgaaaggccggcgacgacccacgcgnccgcccacgcgaacgagcgacataagatttcacaccaccgccccacaggggggaagggaacctacgcgcgggcgcaacgtcatagcactggtatagagccacccaaacgcaagccactgggcgagggaaaacaacgagca

SEQ ID NO: 40904 - DNA, 252 bp, Triticum aestivum
  Clone ID: PAT_TA_40904
cggacgcgtgggcacccgctccgttatccatggcgccaagcggaagagggacgtctcggccttcgagatgctgtcgtcgggggagtcccgcccgtcgggagggggccggttttggttgggcgaacgggcctacagcggccggaaggaacttcccgaggaagggcccttgtgcgttgaaaaacatgattggcggggccttttttcggaaattctcaaacaccgcttcatttttcgttgccgggtttggggaaa

SEQ ID NO: 40905 - DNA, 244 bp, Triticum aestivum
  Clone ID: PAT_TA_40905
gttgcagcaggggtgcccgctgacgtggagtttggccaaatgacacgcgcgcgcccgtctgaggtggtaggcgacttaaaggggacctgctgatacctggtggtggaaaggatacattcagcataatggactggttttgaattgaccgaagttgcataatatgatgcccctttgcatgttgtgagctagaacaattgcaaaaaattttgttgtgtttggtgatatccataaaagcgtgtatttt

SEQ ID NO: 40906 - DNA, 269 bp, Triticum aestivum
  Clone ID: PAT_TA_40906
acgcgtacgcatagacatgacactgcgcgagcttccacaccgctctcaaccagataagggacaccatcgggagcagccaccttggctactgggtcgaggcgcgcatcttctacaacggcatcggcagcagcgactatctgaagatgtacgtgatgacgcactacaagatcttcatcaagtgcaactgcgaccaggactccacccttctgagacagcagtacagcgagcagctcaccagccttgacaacctgaacatccgtaggtgcgac

SEQ ID NO: 40907 - DNA, 256 bp, Triticum aestivum
  Clone ID: PAT_TA_40907
tcgcgagcttctgtcccttggcaccggcaagaggaaataacaggaagggagggggacaagggaacccgaacccgaacccgagaaccaaccatgggacaagggaaccaccccctttgcgactttttaaatgacaggataccaccaccaccctatttgttaacagcccggctggagcattccataattttcattgtgctttcaacctgttggttgtatcaccaccaccattattgtttgatagatagcaataatttgc

SEQ ID NO: 40908 - DNA, 256 bp, Triticum aestivum
  unsure (1)..(256): unsure at all n locations
  Clone ID: PAT_TA_40908
ggggcgacccacgcgaccgcccacacgnccgcccacgcggacgttgattatgaacatagaggccacacaacggccggaggaaggagaccacgcaggcgggacactaactaacaccaaccaagaaaaaagaaacccaccctgacgaggcaccgaaggacaagcgcaagacaaaggaacaccagccgaacaaagaccgagaaggaaagggcggcccgaacacacaaagagaagacaggaagccggccacgaacaacaa

SEQ ID NO: 40909 - DNA, 414 bp, Triticum aestivum
  Clone ID: PAT_TA_40909
cggacgcgtgggcggacgcgtgggttcatttcaatccaataaagaaagagaaacttttccttttgtgctcgggcgattagggatttggtggcggaggcggcaggaggctcaggcggcgcgggtcaatcgctgctggggcaggcggacgcgccgcgtcagatccaccggagagcctatgacctattctccttcagcgacacaactcgttgaaggactcactggggtgttcactcgcaatgacaagtgacaagggaaggacttcaaagaaggccgctgagggttcaccctctgctttggctgtgcctgatggaagagccagcagtggaccacagaaggggcggttgtccaatgggaggacaacgggtccagcaaggcgctcgaccaaaggaaattggaccctggaagaggacgata

SEQ ID NO: 40910 - DNA, 275 bp, Triticum aestivum
  unsure (1)..(275): unsure at all n locations
  Clone ID: PAT_TA_40910
cggacgcgngagcggacgcgaggttttattttaanccaacaaagaaagagaaacgaaggcgccggcgcccgggcgaggagggaacgggcggcggaggcagcaagaggcacacgcggagaggggcaagcgccgcaggggcaggcggacgcgccggcgaagaagcaccggagggccgaagacccaggccagaacagccacacaacgcgccgaaggacacaacgaggggcccacncgcaacgacaagcgacacgggcaggacaaaaaagaaggccgcc

SEQ ID NO: 40911 - DNA, 407 bp, Triticum aestivum
  Clone ID: PAT_TA_40911
gagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctctttctctacatcaccgtcgccaccgtcatcggctacaaggtgcagtcggcggccgacccgtgcggcggcgtcggcgtgctcggcatcgcctgggccttcggcggcatgatcttcgttctcgtctactgcaccgacggcatcttggggggccacattaaccctgccgtcaccttcgggctgctgctggcgcggaaggtgtcgctgctgcgcgcggtgatgtacatcgtggcgcagtgcgcgggcggca

SEQ ID NO: 40912 - DNA, 199 bp, Triticum aestivum
  Clone ID: PAT_TA_40912
cggacgcgtgggcggagggttatttttacctggaggcaagctgcccttcggtcctgactgagcttctcaagtctgtccatgggagaaagtgctgaaaggtagccatattgctagactttcaggatctgacaatgcgtgtagtctttgtttgtgcttgttgagaaaagttttattgcattctataaactttttgtttttt

SEQ ID NO: 40913 - DNA, 380 bp, Triticum aestivum
  Clone ID: PAT_TA_40913
cttgcgcgtcttatcgattttctaatggaagggggagagaggggcggccagagggacaatcttggtctggaatttgaactaagattcaaaagaagatccgcgtcttggccggatattcagccggatcttgagacgatggctgggaataaggttcgtcattacctccctcttttcgtgcttgtcttctcgcttgtcgtctccttcgctgagagacaccgtgatagtcacggctatattgatggcttattggaccgctcattggagcgttacctggaggatcaggccgaggaccaggccatttacaaaggacttgcagaagtttctgcctttgttggtgttttactaggtgctatactaactgctatgttttctgcacagtt

SEQ ID NO: 40914 - DNA, 268 bp, Triticum aestivum
  Clone ID: PAT_TA_40914
gtcacagaaagccgaagaaagtatttatttttgcgccatcccaaaaaccgggtggggagatcaacgaacttccggccgcccacttcttagtgggggtcaataccactaaacaatgtggagatttcaaaacgcacgagatgtaatgcatcggtactctcggcgagcgatcctgaagcatggtgagggtggagttcatgatggactttgagttccactggcgtattctaactttcaatcgattttattagcaccggttctgctgaggaaa

SEQ ID NO: 40915 - DNA, 376 bp, Triticum aestivum
  Clone ID: PAT_TA_40915
gatcccgaaccagggaggattccatctctcggagggcaaaggaagagaaggggtgactacggagcccagcgcgcgcacacgacagcaggcgccgcgatctagcgcaggcacgaagaggggtctcacgctcacgaagctgctcaggcggctcttcgccaagaaggagatgaggatcctcatggtcggagtcgaggcggctggtaagaccaccatgctctacaagcttacgctcggggagatcggcaccaccgttcccacaatcgggcgtaaaggcggaactgtaccccacaagaacattaaggttaccggttgggatgtcgggggtcaggacaaggacaggcccctgtggaggcacttcttccagaacacccagggg

SEQ ID NO: 40916 - DNA, 381 bp, Triticum aestivum
  Clone ID: PAT_TA_40916
gttctagatcctgagcttattacttccattgatttcaccgaaccgcaccccccacttcctttcccgccgccgaagacacatgcttggctcctctctgagatatttcttagcatagtgtctgggaaaagtcagattgaatcttgaattgaggttagacttgcgcatcacagcagcaaagatggggatctctgagtctatggaatggaccttatgcttcacaacttccttctgagctggagttagtttggtcttgttcacggtaatgtaaccatccttcaactgctccttctgaattgaagatagcctgaccttcttcttcctgacggtgaaattggaaccaggcacttcacgtactccatattcttcttcatcttcacgtac

SEQ ID NO: 40917 - DNA, 437 bp, Triticum aestivum
  Clone ID: PAT_TA_40917
cgtcagcttaaaatggaacgaatattaggttattgtccacggcacatgagctatgctagaatccgccggaatagtcataccagcgctcctaacgaagagcggcctcatccacactgcgggatggtacaccgcgggcgagcaggccattcttagggccaagaccacgatttccgaaggtatgctcattgggccagaccgtgccaagggcactgggaccatccttgaacaacacaccgtgttacttaagcggagacttccccatagactacgactgtgtcatccgtgcactcttctatgacccggagacatttgatcagaaccgggagcgtggagacacccagaggaacatgggctaatgtggatgctctgggatgcaacatacccataaaatactgtccaataacggttaaaaaactcgtagaaagcgtataacacaa

SEQ ID NO: 40918 - DNA, 423 bp, Triticum aestivum
  Clone ID: PAT_TA_40918
ccaaaaggccaaaaccctaaaccatggcttcgctcaccccctccgccggcgcccgcctcctccgccgcctcctctccaccgccgccgaggtggcacgggaggcgccggcccccgccgcgaagaacacgaagaaggcggcggcacgccccgtcaggaagcgggcggcgcgcgccgtcgccccccaggacgcgaaggaggcggcagaggcggcgccggatgcggagggcgcgaagaaggcggcagaggcggcgccggatgcggagggcgcgaagaaggcggcggcggcggggaccaaggactcgcgcccgctgtaccggcgactgtcggcgctggggaacgccggggaggggagcgtctccgcggtgatgaacaagtggctgcgggagggccgggagacgcgctccgtggatctcgagcgctacg

SEQ ID NO: 40919 - DNA, 431 bp, Triticum aestivum
  Clone ID: PAT_TA_40919
aagacgcatgcgaaacataggaagctctagttttaccattgggtacatgcctattatgcttagaagttatgcttgtgttctgaatgggaaggacgaagctgaactagcaagatatggtgagtgccctcttgatcctggtggttacttcattgtgaaaggaaccgagaaggtcatcctaatacaagaacagctatcaaagaatcgtattattatcgacactgataataaaggaagggtaactgcatctgttactagcagcacacatgaagtaaaaagcaagacagtgatttgcatggacaaagagaaaatttatctacatctgaatcagttcactaagccgattcctataattgtggttatgaaagccatgggaattgaaactgaccaagaggttgtacaaatggttggaagagatccaagatatggtgacc

SEQ ID NO: 40920 - DNA, 427 bp, Triticum aestivum
  Clone ID: PAT_TA_40920
cggacgcgtggggaagcatttgcgttcatctaacatatttttatggtatttttaaaaaagatcaaggttagagctatggcgctgtatgaggctatcattagtatggaagataaattaatgttaaaatattatttgagtttccttcattctgtaaaccgcaatacaagctacgtttgcgccatgattctattacaattttttttaacaactggcaattaacgacacatcaaatgttttgtattgaaatggatcattttgtcaggttgggtttagtaggtcataatggttttattctacgacagggttaattttgtttatattgtaaccagttcaagtaatacaggggaaaacaacagtttttggtttgtttggcaagaatagtccggtaatgatcttaatgaagcactgcatttatttcatacaagtc

SEQ ID NO: 40921 - DNA, 230 bp, Triticum aestivum
  Clone ID: PAT_TA_40921
cggacgcgtgggggaactctagggtatttgcaccggacgcgcaagacgaggtgaggagagggaagctgaaagatcacatcgacctggacaggaataggcacccaggggttcggttacggtggaaccgaacaaaatgaggcatataatagatgccggcgtagacaacactaaatgtatcataatgccctaaacgatacatgaaaaggccagtagtaatagaccacccgggt

SEQ ID NO: 40922 - DNA, 313 bp, Triticum aestivum
  Clone ID: PAT_TA_40922
ggtacacaagcgggccgtattcgatgttcacccagcagcactggccagactcttcttaatagattggtacagagagaggatcaatggcaagcaggaggatatgattgggtattcagactcacgcctggattcagcgcgtctttcaccaacttggtagatgtacaacggctcggaggaccttgtcaaggtcgcattatcaatctgcagtgaaattgacgatgatccatggacgaggtggcactgtaggaaggggtggtggccccactcatgctgctatctcgcctcaaccacacgacacaagcaatggatcact

SEQ ID NO: 40923 - DNA, 428 bp, Triticum aestivum
  Clone ID: PAT_TA_40923
ggatgacatctgcttccgcatcgtttgtgctctcgtgatcgtcgccgtcctcgccaccgtggtcaccctgctcgtcatcgccttcgtcccccgccctttcggcgtcagcgtggaggacgcggccctcgcccgcctcgccctcgccgacaagaacgccacggccaccgcgctcgcctacaacatctccatcgccgtcggcgttcacaacgagaactggataatgcgcgccaagcacaccgcgcggctggacgcggatctgctgttcgccagaacgcgcttcgcccgtgtcggactggcgaccgcaggggccgtggtccggccccggcgcagggaagtgtaccacgccacggcagcggccgacagcgcaagcgtcgctctggggagctcaggcatggccgacttcctcaagcagtccgaaacggggaagg

SEQ ID NO: 40924 - DNA, 453 bp, Triticum aestivum
  unsure (1)..(453): unsure at all n locations
  Clone ID: PAT_TA_40924
cggaaacccggggcgacccacgcgaccgcggacgcgaggggccgacaccatattcttaccgngcccccagcgcaccccggggcgggcgcagcccccataccgcctcccccgctgccggggcagacggacgggagagccgcacacgagacgcctacctcgccgagcgaacaggaagacagcaacggngtgggagaaccgcaagaagagccgaaagacgacgccaggcgatgcggagaagccgcccgaccgagaggacgagggcactgtgggcaggcccgagaagtacgactaccccaaactccgccaagggaagatagaagagcctgcagcgagggcgcaaaagagtaagcatcaagcggagcgcaccggagcaggaagagcaaccacaccaggcatacactgattccgaggcccaaagggtgcgaggacactgcagcgcgcaggaaaaggagc

SEQ ID NO: 40925 - DNA, 426 bp, Triticum aestivum
  Clone ID: PAT_TA_40925
cggacgcgtgggctcgcctttcgtaccgtcggtgacacctccttcctgatctgcggagtggttgtgtcggctgcggtctttcttggcgtgctcggcctcttggctgtgtatgccgccggtgcccgtgcagccaagagtgctgcgggcgactacgtggatgagaagcttactgaagtggagatgatcgtggagaagaaggtgctgaccagcatcaagaagacatgaacttgttgcgtcacgccgacatgaagctcgacagccgggcggctgcgatcaaggccaaggaggaggaactgcgtgccaggcaggcggccatcacgttgaagaaaactcaagggcgagccaccaagaatggcgaggaggaaaccgtcaacggtcaggtgcagggacccttttaccggatcctgaagtacgttggactggggt

SEQ ID NO: 40926 - DNA, 390 bp, Triticum aestivum
  Clone ID: PAT_TA_40926
cccacgcgtgcgcccacgcgtatgtatagatcggaaaatcatcgagctcgcccagacggatccgatgcatgccatggcggagcccgacggtgcgctcgacccccctccagctgcatgctcttcgggtgggccgaccccgacgtctcagtggcccaaggacggggcgctcgaccccgctgcttccggctctgcggttgctcataccccggcggtcgagtggcccaaggacggattgctgactcggtactgggtggtgacgcttaccgtggtcctcaactgatgctggcggagcatgccgccgcaccagttatcttcggtgctcttcgcgagactcgtccggcggattgtctatgtcaggatcgtcaatctgcaacgagagcccaacatttt

SEQ ID NO: 40927 - DNA, 419 bp, Triticum aestivum
  Clone ID: PAT_TA_40927
cggacgcgtgggcgcgcgcacacatattaagcagccgaggttgcatccttccagggttcggcgcaggagatggaggagggcgctgccggaggaggagggggtgggtggcggctcgtacaaccatctcaagaatcgaaatggctcgtctaactgcctgattgacaagctagccaaggctgttgccctcaagccatcatatgtgagataaaacgcactggacctatttcatttgatcctgatgcgctggaactacctgaaatatgctactctctagcgtgaatatgcaatctattactgtgcatgggcatataaataataatggaaaggatcgtattgacaaagcctaccatgttggtgatatagacatccattgccatcaccaaggatgcggagaactacgggtctttttatgacaccaa

SEQ ID NO: 40928 - DNA, 171 bp, Triticum aestivum
  Clone ID: PAT_TA_40928
cggacgcgtgggcccgcgtttttttattttagaggacaaggatgaatccttgcaggttccggagcaggagatggacgaggaccctgccggaggaggaggccatggctactgtttagaagaatcatattaataggcttaatgcctcctttatactgtatgcttgacaagctt

SEQ ID NO: 40929 - DNA, 371 bp, Triticum aestivum
  unsure (1)..(371): unsure at all n locations
  Clone ID: PAT_TA_40929
annncggcgacgccaccgagcgaatagagctcccggccccccgccaagacgggggggagaacaagaagaccagcgagaacaaaaccaaggaaggcaagcaaggcaagagagaaagagacgggacagacaggcacaaggccgaaggaacggcgaacaggccgacacagagcgaggcaaggacccggccccaaaggcaagaaccggaccaggagcgaggaagcacccaccaagacgggaagaggacaggcgagggcagacgaaccaagaagaacaatacggccggaacacgggaggcagcgggaacccaagacagagaaagcacacacgggagagaacacggggacggcaaaaacgtgaaggggaggaaagga

SEQ ID NO: 40930 - DNA, 316 bp, Triticum aestivum
  unsure (1)..(316): unsure at all n locations
  Clone ID: PAT_TA_40930
ccgacgcgtgggcggacacgtgngttcttcacccacgctccacccgccgcagccgcaatgggcacgcgccagtgctccccccgtcacgagaacatcaccctccaggccgggcacggcgcgcccgttgttgacacaccccgaccggagacagccgaatgggggcgccggacatcgaccctccttagcttagctgaaacccgtcacgtcccgccgccgagccgtggcctgcccaacctgcagcggatccgaccaggggcttggccctcctcgcgttagatccagacgaacgccacggggtgcgatccccatcctactg

SEQ ID NO: 40931 - DNA, 431 bp, Triticum aestivum
  Clone ID: PAT_TA_40931
cggacgcgtggggcaagagttgactgaaatggtgcagggtctagcaaaggaggttgagcatcagaagtctgaaaagcagcgcatacctgccatgctagctgaacgagatggtctgcgacaggaactaattcgtaccagggccgctcttgattatgaaaagaatgcaaaggcagagctgatggcacaggtgcaggcagtggagaaggatcttgtaactatggctcaggagtctgagaagcttagggctgagcttgagaagagaaagccacctagtttcagcggccatggagcttacggaccacctatgacaactcttgggatgggcttgcaagacatctacgacagcggctattcttacagagagaaccgctacggtgctggaccatgggacccccctggctatccgcacccatgatttgggcttttgatcc

SEQ ID NO: 40932 - DNA, 383 bp, Triticum aestivum
  Clone ID: PAT_TA_40932
gcggttttgtcgaatcagtgtttattttctggtgctgggacatcatggcttgattgccagagatacagatcttccagtttccggaaactggaaggccgtccctagtgcgacttgacgtattcctgcacgatgtgaagaccctcggaatcttcgccgtagtccttcacaacgacacatgagcagcccaccacctagactgactcgcattctgcgtccagggtgcgacgagcaccccagtccccaacagtttttctcctgcgagcagcggccgagtgtacggggttctcaacactgagggtcttgatcagctaaacgaagttgcccttgctgttgcggtcaatacccacacagttgtggagcccattgtctttaagaccgttctg

SEQ ID NO: 40933 - DNA, 434 bp, Triticum aestivum
  Clone ID: PAT_TA_40933
cccacgcgtccgccctccttgcctttacttcgccagcggtccatgggcaagtcaagcaagaagtccgcggcccctactgtcgtggcgccggcggccgtccttaccaaggggaaggccgggaagaagcgcgaagccgatgacgagatcgagaaggctgtaagcgcaaagaaacagaaggctgcgccggcaaaggcggtgcccgggcccaaagaggccgccaagaaggccaagaagcagccgccgcccaagaaggttgagagcagcagctccgaggaggagtcatccgagtccgaggaggaggaggttcctaagaagactgcaaagcctgtcaaacacgagtcttcagatgatagcagcgacgattcctcctttgacgaggaacctgcaaagaagccttctgctaaacctgtgaccccagctgccagcaacggctt

SEQ ID NO: 40934 - DNA, 426 bp, Triticum aestivum
  Clone ID: PAT_TA_40934
cggacgcgtgggttcacctctggtttctttaacagttggtcagttattgcgcaatgacttctctcgggaacattggatgggagttcttgaaaacaatgagtggcaaaaggagggaaatgttgatgacattatgccatcattaaggattagctatgattaccttcactttcatctaaaaaaatgtttttcgtatttttccttgttccctgaagattataagtttaagaagatagatattacgtatttttggattgcattaggaatcattgaaaaagatgagaattatatagaagaacttgtagagaatggttttctcatgaaggaagatgatgagtttgaaggtcaatactatgtaatgcatgatttgttacatgaactgtctcggagtgtttcatcacaagagtgcctcaacatatgtagttcaaa

SEQ ID NO: 40935 - DNA, 431 bp, Triticum aestivum
  Clone ID: PAT_TA_40935
cggacgcgtgggtgaggatgaaattatgctagggagaaatattgctggtagaaaaacaggcctcccatgccatcctgaccaaaaatgtattccccgatttggttaaacagacccgtattagcccctggctgcctcaactggtggatgccgtcggctgcccaatgaccatcaacacatatgagctcggtttaatcagaggtgaggccttgcttcttctgcagttttcttctcttcttttgtgtggatttgcatctagcaaaattgaaatttcatggtgggtcagtttggaggcttcatatttcacaattattattgtgtggttcaccctagaatttgattttaacgcgtgcttgcgcatatttggttaggattggcatgcttgtttttatatgtaattgctatgtttcgaggctacttattttatttaaccc

SEQ ID NO: 40936 - DNA, 417 bp, Triticum aestivum
  Clone ID: PAT_TA_40936
cgcgagtacggtcgattactgtgatgagctcgccgccgcggcagatggcgcggcggatgctgccgtcggggtggccgccggtggcaatgggggcggcctgtcggggttcgccatggactcgttggtcggcgtcctcgacggcttccataacctcaccggtctgccatggtggataacaatcttcgactacactgtggccatgcggctaattatactccccgccctgatagtacaatttcacaagactgctaaaatcggccaactttttcgaaaatgaaggagttatcgtgaccaatactctcttttccagaagaaaaggcgagagcttggttgcccctcctttctttggaattttgcctacttttcagttcagttcccttgctttatactgtggatggcaagcattcggagtatgtg

SEQ ID NO: 40937 - DNA, 365 bp, Triticum aestivum
  Clone ID: PAT_TA_40937
cccacgcgtccggcgaaatacgcaatccaccttattttaaccctaaccaccagcagaggaggggacgaggcggaccaaatccagccatgttcgacgagaagatgttcgccggcccaaaggccggcgactacgaggcacaccccttcatcgcgacacaggctgtgaaggagatggcggaggcgttcgccggcaaggccagggcggagcggcagccgtacgccctcaaggccaaggcggaggggagcgaggttcgttgtcaaggcggggtgtagatataagaggaacgccgacgaggaccgtgaggaagacgcggcgttcaccttcaaagccaagtcagaggaagaggcggggatcaccttcaaggc

SEQ ID NO: 40938 - DNA, 282 bp, Triticum aestivum
  Clone ID: PAT_TA_40938
cccacgcgtccgcgcgagctttcgtcctttatttcaagcacaaaaggggccgatacttctgcgtagactcgaatgccattctcaaaagaggtgattccttgccgcgcactaacatacatcacgtactcatacacatggctggaaggtcaggtcaatcaattatccggtcctaaagtgcatatcaagaaaatctatttatgcgtgatcacattcacacatgcacaagatcgaggacccatagtcctactatttcactgtgtcgggggctacactctaaacgac

SEQ ID NO: 40939 - DNA, 284 bp, Triticum aestivum
  unsure (1)..(284): unsure at all n locations
  Clone ID: PAT_TA_40939
cgcaccggcagggccccaggaggagaagaaaggcgncgggggaaaacaacaaggagaaacggcccggcggccacaagaaaccggaggacgcngcgccggcgcccgacacgcacgccggcccagcaccagagcacgcgccggcgccagccgccgaggaggagagcagccccgacgcgaaagagaagaagggcccaccgggcaagaacaaggacaagccgcccgggcaccacaagacaggggaggaggacaaggccgcccgcacggcagcgaacacaagcccaacg

SEQ ID NO: 40940 - DNA, 140 bp, Triticum aestivum
  unsure (1)..(140): unsure at all n locations
  Clone ID: PAT_TA_40940
accacgcgtccgcggacgcgcgtatagatttttttctcgccaccancaccagacataaactagaggagcaagagaatgccccaaagcaactgactatacggttgcactcccggagatgaacaacctacaaatagacatca

SEQ ID NO: 40941 - DNA, 443 bp, Triticum aestivum
  Clone ID: PAT_TA_40941
caactaggccaacgacggctgctagcaatgatatatacatatcaacaattccaaggaggtgcatgtgtcagtatgcatagcatagtatatatatgcttgacactgtgactggaggagatccaggaaggggtgaactcaaaatcatctgtgatttgattggaaaatactctccagcatctgaaatatctaaaggcgatcactcgaccaagtatgttatacaatatacccagctcgatgattggagcagtcccagccgctaattagtgctaattagtactccagtgttgaatcacacagctaagtatcaaccctccctcaagacttggctattaacaaagtagtgctaggtcctcagcgttcgttcttactctctattttcttgaagtggtttctctttattcactttttgctttctattttcattatcactattcatttggatc

SEQ ID NO: 40942 - DNA, 316 bp, Triticum aestivum
  Clone ID: PAT_TA_40942
cccaaaacgagcgccgccagagtccaaaaattttcccttcttaagccgatctcgccgcaccatcttcgccgcgcacggcgccgtcagccgaccaggtcgccgccgcgtcgtctgctcctccgctgacctcatgcctccagttccttccccgtccccgtcgccccttctctcgagccgccggctggtgctctctgttcccccgggtcgtccactccgcgccgtcgattcgaaccaggagcggcacgggtagaggcgcagggcgaggagcgtccgccggaggtgctcgatgccccccttctacatccattgtaggcgc

SEQ ID NO: 40943 - DNA, 454 bp, Triticum aestivum
  Clone ID: PAT_TA_40943
ctacgacgacggcaggcttcgaccacttcttacgtgttgcccgataaaagtgctgcaatggcgagcgccaacgtcctcctcctcccggagtccggctcgggccacctcatgtcgctcatcgaggccggcaagcggctgctcgcccacggcggagacgggctcaccgtcactgtgctgatcatccggccagccacgcccgagtcggcctcccaggtcgactcgcacgtcaagcgcgtcgcggcatctgcctgtgggctcggcatccggttccaccacctccccgccgtcgacccgcccacggactgcgccggcaacctgcaggagttcaagtcccgctacatgcagctgcacgcgccccacgtcaaggccgccgtgtcggacctcggcgccgcggcgctcgtcatagactttttcgccaccgccgtcatcgacgtggcgcacgagctcggcgtgc

SEQ ID NO: 40944 - DNA, 373 bp, Triticum aestivum
  Clone ID: PAT_TA_40944
ctcctctccgcctccgcaccaccattagaggaaagccagcgggaaggggggaaatccccatgcccccacccctcgccggaccagatccccggcgggccggcgcggagccttaggcggggaccggcctgaccgatgggcggggaggccccggagccgcggcggctcagccgcgcgcttagcttggacggcagcggcgtcccggaggaggcgctgcacctggtgctcggctacgtcgacgacccgcgcgaccgcgaggcggcctcgctggcgtgccgccgctggcaccacatcgacgcgctcacgcggaagcacgtcaccgtgcccttctgctacgccgtgtccccggcgcgcctgctcgctgcgcttccgcgcc

SEQ ID NO: 40945 - DNA, 320 bp, Triticum aestivum
  unsure (1)..(320): unsure at all n locations
  Clone ID: PAT_TA_40945
cccacgcgtccggcgactccaacgccgccgccgtcgccgtggntgcggctgcggctgcggcttanctcgccccccgtcctcctccactgaccatggcctcctctcccaccgacaatcacccccccgctgatccctgcccagacaccaacccccccagccctgccctccgtcctagctcctctcccgatccagatccagagcccctggctgccgatgctgaggacgaagacggggtctctcctgcacgctaaagatgacggcaccttcctccgctgaagctgccgacacctaccttcgtcttccgagatagccatgggatc

SEQ ID NO: 40946 - DNA, 441 bp, Triticum aestivum
  unsure (1)..(441): unsure at all n locations
  Clone ID: PAT_TA_40946
ccaaacactcgcctgccttccttccttccttgttcgttcctcgacgcacgcacgcagatctcatccatccaagccaaggcaggtcaggtacgagatggctctcaccagaattggtctcgctggcctcgcggtcatgggccagaaccttgccctcaacattgccgagaaaggcttccccatctctgtctacaacaggacaacgtccaaggtcgatgagactgttcagcgtgccaagctagaaggaaaccttcctctctatggtttccatgaccctgcatnctttgtcaactccattcagaagccacgtgtcgtcatcatgcttgtcaaggctggtgctccggtcgaccagaccatcgcaacgctcgcagcacacctggagcaaggtgactgcatcgttgacggaggaaacgagtggtatgagaacacagaaaggagggagaa

SEQ ID NO: 40947 - DNA, 441 bp, Triticum aestivum
  Clone ID: PAT_TA_40947
cggacgcgtgggaagaggttgatatggaaagtgaagatgcgacgccattgaaagtaccacgccgtgccacttctaccagacagtctggtaatcaagggttgtgcattttattatgcttattaatcgccacattggttattgtcattggctggttttcagaaacgcggcctgcaaaagaaacagcacctgggctctcagtagctgtcactaatggaaaataagatttttccatcaaagaagtggatgcgggcgattgattctacatgggtgtaccagcttctcctttcaatttgtacttgtactgcaacatgagtttactttcatgcatgtcgatttggtggctttctgctgtaagggagttcaccagatatgctgtaaggatatatatatttggtccaaggtcaactttgacatctattttccagaacctttgtagtcata

SEQ ID NO: 40948 - DNA, 401 bp, Triticum aestivum
  Clone ID: PAT_TA_40948
cccacgcgtgcgcggttgcgtgggtgggcagaccatccccatgccgttcatcggcgcgcaggccattacattcatgccaccggcgccgccttcgcagcctcacgccacgcccatagcatactccgccgcgccagttcatccacgaccgccgtcttcgcagccacctgccacgcactcgccgcctcaacctcaaccctcgccacggcagcagaagccgccaacaatgccgcccgtgacgccgcagccgcacaagtcgccggctccagcgacgccacagctacagcagcaagcgccggccgtaaattcaagctggatggacatcgtcgtggcgccctcggaagcgccgcacgactcgtcgggctaccacgggttcggtggcggcagcggaccgacatcgtcgc

SEQ ID NO: 40949 - DNA, 424 bp, Triticum aestivum
  Clone ID: PAT_TA_40949
cggacgcgtgggctctacctcgccttcagcccgccaccgccgcgatgtcgtcggagcccgcgcccgcctccgcctccacggaggagctcgaggccgacctctccgccgcgaccatcagcaagaagcagctgaagaaggacgcccgcaaggccgagaaggccgggaaggcgtcgcatcgccagcagcagcagcagccgcaggcggaggaggccgacctcttcgcggccaactacggcgatgtccccgtcgaggagatccagtccaaggccatcttcggcaggtcctggaccgacatcggcgacctcgacgaggccgccgcgggccgctccgtgctcatccgcggctccgcgcagacgctgcgccccgtcagtaagaagatggccttcgtcgtgcttcgccagagcatgagcaccgtgcagtgcgt

SEQ ID NO: 40950 - DNA, 197 bp, Triticum aestivum
  Clone ID: PAT_TA_40950
cggacgcatgggcctttatcctcttgttcgcctaccctcctcctggaactggttggtgtggtggctgctgcgcacatcatcacactaggtgctttgttcgcccctaccaccagtcacattacatagcgcgacgcagagagagatttgattcacagacaaaagaatggcgactcgcgtcataccttacgttttccgcc

SEQ ID NO: 40951 - DNA, 377 bp, Triticum aestivum
  Clone ID: PAT_TA_40951
cgtattcgtactcgtctttctacgtgcaaccgagccttccgcccaccttctcgccattttgccagcggtgcacccaccaaccacccccacccgccgtcatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgttccccgtgctgtcttcgtagatctccagcccactgtgattgatgaggtgaggactggcgcttaccgtcagcttttccaccctgggcagcttatt

SEQ ID NO: 40952 - DNA, 418 bp, Triticum aestivum
  Clone ID: PAT_TA_40952
cggacgcgtgggtttttttttcagtaattcaaagctttctgagtatgcaaggcaaaatagctcaacatccagttcgctatgagcatttctcgtaagtgttgtagacgacaaaatatactacagttagatcccaatactgctataaatcattaacagattacaagattatatacataagcacataaccacaaattgtagaaagagaggccgtatttattaaaagaagaaatgggaggctcagagttggctcgtctatcatatgggcaaaacgcactctgtatccgatacacttggtgatacacgttggagatgcccctgtgtgacatttcagcattccaatggttgctcacggaaagcaagcaatcctcatatgaacgcttccacctagtcacacaaaaccctaacacataccataaat

SEQ ID NO: 40953 - DNA, 230 bp, Triticum aestivum
  Clone ID: PAT_TA_40953
gtcctacatcgctgttttccctctttatctagaactagccagaggcattccggggttggcattttcttgaacttcagaaggtgcgaagagcatgaggccgaggtcatgggtggctgccgtcacatgcatagttgactgctccgtcgaggcggcccacggttagcagccgctttttatgattgtcgtcaagtggaccactctcgccgtttactactccgcgcacgttaagg

SEQ ID NO: 40954 - DNA, 307 bp, Triticum aestivum
  Clone ID: PAT_TA_40954
cggacgcgtgggcggacgcgtgggttagagttagctaactctaaagtacaagagaaaaaggctgttgctatttaaccagacccagacattacacttatacttatattagggatagctcagagcaagatcattgatagccataaccgccgcgttctcctctccgccgccatcgacatctactactacgacgagcaggatggcttcgactacgaccagacgagcgaggagggcgagtggatgatcaaggccgccgccatcgaaatggtcaagctgctcgagctcgacgccttcgcctaccacaaccact

SEQ ID NO: 40955 - DNA, 381 bp, Triticum aestivum
  Clone ID: PAT_TA_40955
cgcgctctacctctacgccctcgccgaccgacggctgcccgacgccgcgctccttcacctccgcctaatcgaccgccccggatcccccgtgcccccctccccgaccgactaccgggccgtcgtcaggtgcctcgtcgcggaccacggtcgcctcgaggacgccgtcgcgctcaaggacgagatgctcgcctccgggttcgccgggcccgatccgcatgtctacagcctcctcatggctgggtttgtggaagccggggatggggccaaagcagtggagctgcaccaagaactgcaagacaagcttggcggcaagcccgtcctcgatggcatcgtgtacgggagcctcatgaaggcctacttacttatgggaatggaggagaa

SEQ ID NO: 40956 - DNA, 411 bp, Triticum aestivum
  unsure (1)..(411): unsure at all n locations
  Clone ID: PAT_TA_40956
gttcaacaaagctcaaggtgctaaaaattgaaggctggtttacacacctcaatctgcatgctccttatcttacttccgtatggatcggattggaactgaattctgacacagatggtgcttcgacaaccagatgcaacttcaatctttctccatttattgcttctctttcagatgttgagactattaggtttcatggacacatccttgagtgcgtagaacatgaatttctgattctcaagcagccaaaattattcaaccggctgacagagataagcctggagatcaatctcggtgatctcaaggaagcaaattttgccttgtgcttatttcagcatgcccccaacctgcgatttgtcaaactaaagctcatttncaggaattccgtggtaccaacagtgcatttctgggaat

SEQ ID NO: 40957 - DNA, 351 bp, Triticum aestivum
  Clone ID: PAT_TA_40957
ctccccctcaccaccacatcagcggtgccacccttggcctcttcttccctgcatttgattgatccgtcgcttgcccggtcgcccgtcgatccgtttacccgccgtccgcccgtccccggcagccgcagccgcaccgcagttgcaggtggactgcgaatgatatagatgcagtttagcagcgtgctgcccctggagggcaaagcgtgcatttcctccgtcaggagagagggctacgtctgctagcgcctcaaggtcggggacagcagcagcatcaggcactagagggccttcaggaggatgtgcaacggtggcaggggcccctccgccaccggcgcgcagtgcgtgctcacc

SEQ ID NO: 40958 - DNA, 160 bp, Triticum aestivum
  Clone ID: PAT_TA_40958
ctccccaaccagggaatcccaccatccatgaagggggccaaattcaagggcgccggcaaggcccacaccaagtttgcggcgaagagcaagggattggagaacccgtctgccaaggggaagaagggcatggcccgtttggaccctaacaagcccaataggt

SEQ ID NO: 40959 - DNA, 429 bp, Triticum aestivum
  Clone ID: PAT_TA_40959
acccccaccgtctcgcctccgccatcaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggcggtgcaccttgtcccaatgtatatcccgaggggcaacctgacgtacgaagcactcatcatctacagccttgaagacagtccacctgctagaggcgccaagaagatctgtgttgcatactcgaactgggcgaagacaccatgctgtttttgtttctggcaattcccttctcgttatttaggatttttatgcacttttatttgactcttttctccaccaaatcatttggc

SEQ ID NO: 40960 - DNA, 276 bp, Triticum aestivum
  Clone ID: PAT_TA_40960
gccgcggaatccgcggggagacacacgcgcgcccacacgcgtgcggacacgtgggttttcccccttatatcagcccccaacctagctctttcttcatcggccggcggctggttgctgcttgaataactcgtcgtcggctgcgtccccaaaaacctcgcctattatattatctctttggcccgctccgtccccaaataaatcgcctatttcatcctttcgttcgtccgctccgtctgattgactgattagtaagccaccgaccgctacctccgaagg

SEQ ID NO: 40961 - DNA, 440 bp, Triticum aestivum
  Clone ID: PAT_TA_40961
gcgagcagagcacacgagcacgtacggcgcattcatcccgtgttcagcagctagcaatagcatggcgagcgggggcatcaagacgatggcctcgggcctcctgttcctgaacctcatcatgtacgtcgtcgtcgccgtcatcgccggctgggccgtcaactacagcatcgaagacagcgcccactcactgaggggcgcgtcgccgccggtgcgcctgttcccgatctacttcccgatgggcaacctggcgacggggttcttcatcatattcgcgctcctggccagcgcagtcggcatctccacctagctcaccggcctgcgcgacgtcaccgagggctaccccgccagcatgatgtcggccgccgcctacggcgtcgtcttctggaccctcaccctcctctgcatgggactggcgtgcaaggagatcagcatcggctgga

SEQ ID NO: 40962 - DNA, 373 bp, Triticum aestivum
  Clone ID: PAT_TA_40962
cggacgcgtggggacccaaagtattgtaaggtgtcgcctcagtggcttgcttttgctgaaaactcgacattgaggaacctgaaaacatattgcccgacctttggcattcatggtgacagtgttgtctaccttttagcaaaggtgaaacctgaagatacaagacatggattggtggtgttgacattgaaaagaagatgttgagactaattcaaccatatacttatgcggaaggtggctatgctctaccaacgttgcttccctctacattctcctattatctgaaaaatacaactccaggtcttttcccatccacagagacaaactactctgagaatgccctcaataatgcaacaatccatggtgatacctctgt

SEQ ID NO: 40963 - DNA, 300 bp, Triticum aestivum
  Clone ID: PAT_TA_40963
gggttgtaagaacagaccgccaacattttcattccagagccaagccaatccgagccgagagtttctttttcgttgccagcgccgccgagcagacgacggcgacgacgatgggcaagatcaagatgccggccctcttccgccgccgttccttctacaagttgcgctccgcgtcgccgccgcctacttcccaggaggaagagggcacccggccggcgtcgggcgcggggtccccggcgcggtcggcggaggaggagatggagcgggtgtttcgcaagttcgacgccaacggcgacggccgga

SEQ ID NO: 40964 - DNA, 235 bp, Triticum aestivum
  Clone ID: PAT_TA_40964
aacagcagcatcacttttatgcgtttgtaacatgcaaaatgggcggctgggagaacatcttacactgctcaaaatgtgaatgttgacattccaaagacgcgaagaacagtcatgcatgtgaagaaagagccatgcatcattactgtacaagatgcttacagtactagctttatcaaagataaggttactgtgtacacacatgtggtcattctattcatggtcacaacatgcaact

SEQ ID NO: 40965 - DNA, 434 bp, Triticum aestivum
  Clone ID: PAT_TA_40965
cggacgcgtgggtgtagcttggcctatggtcagttgaatgctcaagacatgggtagtttagtttcaggttcaggttcagcgagatggctctttgaaccatgagtaggtagcacaacgcatgccttgccggctgacagtagttgtgatgcggctctactactgtaccatgtgttcctactactagctctagtcgtggatgctgggtagctccatgttttctctgtttttatgcaatcctagatagaaccatacaactgtggatgacaaacactgcaatttaatctaaaattgtcatcatgatcctagcaaatactcctcaaattactgtaaattgttgcacgattaggggctagtgtagatgcaaaataaggttgcacttttagaggagataagccactgatgttggatgcttggtagttgtcttgtgttgtgtg

SEQ ID NO: 40966 - DNA, 341 bp, Triticum aestivum
  Clone ID: PAT_TA_40966
agctcccgtcacctgccaagcagttttcgctgttccgggaccacatagtgtcggctgaagggacgaaatggcggcgcttgctggctccaacctgctgctgctcgcggcggcgctgatcctctgcgggccggctagcacagaggcgtacgatacgctagatccgaacggaaacatcaccataaaatgggatcttaatgagtgcactactgatggatatgttgcactggtcacaacatacaactaccatcatatccggcacatatccccgcccgggtggcagctgctgtggacgtgggccaataacgaggtcaatctgaccatggtgggggctcagaccaccg

SEQ ID NO: 40967 - DNA, 342 bp, Triticum aestivum
  Clone ID: PAT_TA_40967
cccacgcgtgcgggttaatgtggattttgctatgcgctgagtggatatcaacagaccgggtacatgatggtctgcgcatggcaattctaggagcgccatggacaatcggtattctgtattgctctacagattgggtccgagatgttagctgggttcttatgctgtacatttggcctcaatggatgctcaacctaatacccggagagagatcagtgagacagtatctgaataagtatggaggtgttgatacgagcccaattgagggtggtggttcagcggtcatctgcaccaagtatgggagaaatctgtggtcagggtttattaaggggataactgatgctc

SEQ ID NO: 40968 - DNA, 278 bp, Triticum aestivum
  Clone ID: PAT_TA_40968
cccacgcgtccggggtttactcctttatgtacaacgcaatttgggggatgacgcataacctacagaacatcataaagtaaatggattcgaacgaccctttcaaaataaaggtgtcggacatgctaatcgctaagctgactaatctgggttttatctcaacaaataagatttcgaggaaatgggataaacttgtggtgagcgccttcgcaaggcgtagactagcaacaattatggtgaagcttaattttttgtgttgaagcgacaaggggctggaccca

SEQ ID NO: 40969 - DNA, 184 bp, Triticum aestivum
  Clone ID: PAT_TA_40969
gcgaggcgtccacctttacaacctttacaaaccaagacccgagtgaggaaaggagcggagctcactttgttcatggctgccaacacacgcgcggtgggtggacctggccatcgacttgtcggaggagagccgggcggtgctgcaaattaatgtgtgcacaaccgagatccacgctcttcaacaa

SEQ ID NO: 40970 - DNA, 244 bp, Triticum aestivum
  Clone ID: PAT_TA_40970
accggcagcggaccggcccggaagacccacgccgacccacgcgtacggggacgcatgggacgtttttatgtgttaatacctggaccacaagcgcatctatgggtaggtctattctgctcatgacagaatcgaaagccaccttgcgaggagagacacaactatgacgtcgctgaaaacacgaagcctgacctgcagacagacaccacacttgctgacattatgacaggatatggagactacatat

SEQ ID NO: 40971 - DNA, 273 bp, Triticum aestivum
  Clone ID: PAT_TA_40971
cggaagacccggccgacccacgcgtcggcatcatgcgattttgagattatttcctgcccagagcacgaaatgattagatctaatttgcttctacgaaacaactagtgtgtttcgggcgtaagaaccatacatggttgaatatccaaaagctggagttcttaaagaaaccggaattggtcacatgaggaacctctaatgactctggttattccgttcagctttctggccttttggccaagtttgcttttggggaaagaaacaaaaaaggcctaa

SEQ ID NO: 40972 - DNA, 442 bp, Triticum aestivum
  Clone ID: PAT_TA_40972
cggacgcgtgggttccaatgctaatcttgagcttaatgataaatatcatcctcatgtcagtgttgaccttgctgatttctaccatcctaaacatgtgctttatagctatgcttatgtaattggatactcgatgatgacttggagggtattatccctaccgcttgcattgtctcttttgtggagtgttctttcaggtttttgctactgcaccgtttactacatgctgaccaggttcgaggtgacattccttgggatcccggtggattcacggtatggtgatgagaagcaaagagcacacatgaggaagagcgaagctggagcttgcatgtggaagcaaaagaagaagagcatcagcttagagagtgatcaagcgagtgctacatgatcaaagcccggtgagctgtttcgtgatccattctgaaattatcattcattgatgctt

SEQ ID NO: 40973 - DNA, 441 bp, Triticum aestivum
  unsure (1)..(441): unsure at all n locations
  Clone ID: PAT_TA_40973
cccacgcgtccgcccactgtccgtttcgccaccttgctctgcctccggcagtcatttcatccaatctggctggtccgctccccacctcggcggctccttcagtccggcagcacaccacgctcaagcctccaccaccccaactcctcaagttacagtagacaaggagctccgctctacctctcatctctctccctgtcctggtggtcacgggctgatgttgctgctcctctccttcagggcttttctttggtgtatcaggcattcaggctggtgtaatttgttntcagaagtgaacatgttgtacagtccaatgtatctacaaaagttaagttatggtgagttgttcatcatgttgcttgcatattttttgtctaacaagctggatacttcagttntgaatataaacattgagtaggtgctcaaatattttgctaatgatag

SEQ ID NO: 40974 - DNA, 415 bp, Triticum aestivum
  Clone ID: PAT_TA_40974
ttcggggaggccagtttgtacgttttccgcgggcccgccgcctcctcctccaagggcgcggtggaggcgatgaaggacaccctgtcgaggtgggggaagtccatggcggagaccaccagcatggtcgagagcctcagccgcgacacgtggcagcacttcaagacagggcctagttttactgaggctgctatgggacggcttgctcaaggaacaaaggtcttagcggaaggtggctatgaaaaaatatttaaacagacgttcgagattctgccggatgagcagctgaaaatgtcttacgcgtgctatctatcaacatccgctggtcctgtcatgggagttatgtacatttctacagctaaaattgcattctgcagtgacaatcctctttcttacaagggcggaaacaaaacagagt

SEQ ID NO: 40975 - DNA, 375 bp, Triticum aestivum
  Clone ID: PAT_TA_40975
ctaagccttggacattttcaagcgtaaaaccaaagagggagtgagagagagagagatgctggtagacaaatgactcctcgatgcgttgcgccgtgctgcacctgcttgtgttcgcgagcgtcctcacagccaaagccatttacattcctaacttaaaaaactcgcacttcataccagttacggccaatgtcgtgctggtgaacgggaccgtggtgaacggcgttaaggccatccccaagtgggagacgtcgggcttcgcggagtacatcgagttcgatcacaagcagggcgacatgctgttggtggtgccgtaaggcgcttactccgtacgtctcgacaacgatgcctccatccttcagtgcattcccgtcgtcc

SEQ ID NO: 40976 - DNA, 169 bp, Triticum aestivum
  Clone ID: PAT_TA_40976
agtatacagttacatcaaattcaggagttcagcatggaattgctaacctgtcacacatgtttaaggtcatcttaaacacattctctgttctgacggattgccatacatcgagagcggaagccaggcaaataagcttcatgatatttgactccactggaaaaaccgcatt

SEQ ID NO: 40977 - DNA, 241 bp, Triticum aestivum
  Clone ID: PAT_TA_40977
attacacggtcaacttttcagataatacaagaacagccccggcattaatatcgtgctcaagtacgacattcgcggcgccgaatagaatactgcacttgacaggccactgaaccaaacaatagtggtagtttggcccacacactagagccgggccgcaccctatactggtttggcggctgagcgccatgaatgaaaagggaaataatgcttgcagtaaaactacccgcggttcataacttct

SEQ ID NO: 40978 - DNA, 335 bp, Triticum aestivum
  Clone ID: PAT_TA_40978
tccgacgacatctaaaaaaaacccttttttgatttttcaagggcccggcaccaaagaggtcacggcggctctgttgacgccgactgcggcagtcttcaaagctgaataccctaccccaccggcggccgaccggctcggagacgactaccttatgttgttcacgcacggcgcggggttcctgctgccctggaacgcctacataaccgccgtggactacttcttatacctatacccgggcgcgccgggcgaccgagtcttcttctgctactacatgcattgctgcctcataccgctgctgcatattatgctggtctttcctaaaaacagcggccggg

SEQ ID NO: 40979 - DNA, 383 bp, Triticum aestivum
  unsure (1)..(383): unsure at all n locations
  Clone ID: PAT_TA_40979
cggacgcgtgggcggacgcgtggtgcctgcgtaacttttgagaccaagttggctaattcaggcagcggcggcgcatctggacggtgccagttaatttctctctctctctctcggtgtcagcctaatgcttgcttgttgatgttgttgtttgttgtatcatgtgatgtaatccccgtgaaaagagtggctaaagacagatgtgatttgggtgaacgaattcacctcgattccacccgctccctccctgtactcctgatagactgtcggccagattggatttgtatattagtctctatctattctttcaaaanngaaaannannnnaaaaacaaagattccaaacaaaaaaaangggggcggccgttttagaggatccaagctta

SEQ ID NO: 40980 - DNA, 342 bp, Triticum aestivum
  Clone ID: PAT_TA_40980
cggacgcgtgggtgccgaacggaagtttctgcttatggaagcacgtacagagactcgcgtttcatatggagcaaatttacagcgaacgagccagcgacacattcaaaattgcacacagaagactgaatatgcaatacactaaatcactcaagccttgctaaacagcaagtcttacagtaaacaataggacttaattacttactctactactaacagcaagcctatgtctagttccaactgaaatttttatcatgctactgtgacatctactgtaaatttcaaacaaatgaaaggagtactgtaggcaccaattgaaactacagcctacgcgtccgcggtcgc

SEQ ID NO: 40981 - DNA, 260 bp, Triticum aestivum
  Clone ID: PAT_TA_40981
attcctcccaccctcgccgtctcgttttcgtcaccaccgcagctagataagagaaaaaaagagagagaagaactcgtcgggagggctcgagatctgtgttcggagaggggaattcttgaggtccgaatgcttacaagcaggcgcgctcatgatcagtgatacccatccactgttatcatgaaccgtgaggggacttgcctatagaacataaatgcacatgaacagctcaaggagacagatttgctgatgaagaagattgc

SEQ ID NO: 40982 - DNA, 175 bp, Triticum aestivum
  Clone ID: PAT_TA_40982
cggacgcgtgggcggtcgcgtgggttagtttctcactcaacagcagcaacagttgctgcttcaagcacagcaaaatattacatcttcatctggagagatggatgctcgagagctcggaatgctaacaagcagtcgcactcgtgatcagtgaaacccaacaacagatatcaggaac

SEQ ID NO: 40983 - DNA, 392 bp, Triticum aestivum
  Clone ID: PAT_TA_40983
acgtatccttttttacgcatgaacagtgtgcgcgttactgtagcgacgagggcagcgacgagggcagcgaaagcgagcaggcggcgcaacaaagcgaacagcgagagaaaaggggaagcgagcggccagcacgagaaaaaagacctagcccgcgcccccgcagccgcctcctctcctgccgccgccgcctcgtcctcgtctcgtttcttgccctcagcgccgcctcctctccttcctctctctccctctgcgccacctcctcttctcttcatgcgtggtggcgtctcgtcatccccagccttctcaatcccctcctcccgcacgaaccctagcagagagagaagatgagagggagagagaagggaagagaggagaggagggagaaagagaga

SEQ ID NO: 40984 - DNA, 454 bp, Triticum aestivum
  Clone ID: PAT_TA_40984
cgccggtccggaattgccccacggacccacgcatccgcggacgcgtgggcggactcgtgggtaagaagaagcagccgcagccgcagcgcgaccccgcgaggaaaccctaccgccgccgcagcaggagcagccatgggtatcgacctcgtcgccggcgggaggaacaagaggaccaagcgcgtcccgcccaagtccgacgatgtgtacctcaagctcctcgtcaagctctaccgtttcctggtgaggaggaccaagagcaagttcaacgccgtcatcctcaagaggctcttcatgagcaagactaaccgcccgccgctcttcatgcgccgcctctccaacttcatgaagggaaaggaggagaagaacattgctgtggttgttggtacaatcacagatgacatgcggatccaagaggtcccagcaatgaaggctaccgatctgaggttcacagaga

SEQ ID NO: 40985 - DNA, 385 bp, Triticum aestivum
  Clone ID: PAT_TA_40985
acaaccccaccgactccagctcggtcgcgtgggcatgcagggagcgagattccgctcccccatgctccctccagctccgcgcgccacgatcccgacccggccggcggggctcccctacaggctgctgcggcgcgccccgaccgccgggcgagcggagggagcctagctagctcggcggcggcctacgacttgcagcacccgattgtctggcgggcggcggcggtgagcaagccgtggaggggttcatggtccttgcggccggatggagtacgccatgttcgggtccaggcgggtcgacgacgacacggggttcaggcgccagcggaccgtcagattccgcgacgagagggcaaaggcaacgatgcccattcaccagaagcaggct

SEQ ID NO: 40986 - DNA, 378 bp, Triticum aestivum
  Clone ID: PAT_TA_40986
cggacgcgtgggctgttttcgtggttattcagggagcgagtaagcgctggaagatggacgcctgcgagctgaagaaggtggacgggaagaagttcggcgggccgaggaagaagttggtgaccaggtccgtcaaggccggcctacagttccccgtcggacgcattgggcgcttcctcaagaagggccgctacgcccagcgcgtcggctccggcgccctcgtctacctcgccgccgtcctagagtacctcgccgccgaggtgctggagctggccgggaacgccgccaaggacaacaagaagacccgcatcgtgcccaggcacctgctgctggccatccgcaacgaccaggagctcgggaggctgctgtccggcgtcacca

SEQ ID NO: 40987 - DNA, 414 bp, Triticum aestivum
  Clone ID: PAT_TA_40987
ggaccttgctgctgtgggggagaattgttaggagtattgagaatcctcttactctcttgaatgatgcgtcctatgttgagccgttggggaactgtgggaagaaggtcctactgtggtggctccgtgttgaagcccgggccgacagcaagttcccacaagggtgggtgattgagccaccgttggaagttgttgttcccgccaagcgcacaccatggccagaaaccaccatggatgtctcatcggagatgttagacgccaagcaagagcaagaggacaggcagctgccaaggaccaacaacaggtcagcccggccccgaagcaccaccacgaagcggaagggcgacgtccacaactgaggcaggataaacagaccatgtaatgtacatctcacaccaccttacacccgcggtattt

SEQ ID NO: 40988 - DNA, 408 bp, Triticum aestivum
  Clone ID: PAT_TA_40988
ggtctcgatggcggtttgtttggcatcaccagcaccttcatcggcatatccgagagcaggccgtggtggctgcagtgagggtgcgtgcggcagagcagatggcgttctgaagagctactacaccttggatcccgatccctcgctgaaggtgctcgatcttggtgtttgaatgctgctaccgtacagcaaggtctgtagcagcttttgcaatggattcctttttatgatggtagagtttattttggtttagatttggtattgttgttctgtccacttaacccagtctatagcaacagattttgatgtccgttccttgccgacaaaggtcataacttatcacgtctgcaaatgattttttggctgtagtatgaatagagaagttcggtcagatgcaaggcatgcttagca

SEQ ID NO: 40989 - DNA, 439 bp, Triticum aestivum
  Clone ID: PAT_TA_40989
cacgcctccggccacgcacaccgccgatcgcgagggtctctcgtatcctgacaggctccagctaccactaaaacgggagagagagcgacgccggcacctccctccagcggagctcgccgtcgtccatggcctccccacaccctcctgctccgcccgctcctactccctccacgcctaccgcacaccattgccgatttcccaaaccagaccgcctccccggttcattccttcctcccctcccacccacccgtctcggcgccgccacccaactcgccgacgaccttacgcatcgccgccgacctacgctcacacccgctgccccaccctctccacctgcccttctccccctaccccggtagcacccaggccaacaacacatgcagcagcaagatccaagatctagcaagctggcctatgcctcaccggaggcgcacacgca

SEQ ID NO: 40990 - DNA, 253 bp, Triticum aestivum
  Clone ID: PAT_TA_40990
cgcaccggcaggcccgggacgaccgacgcgtccgagcgccccggaaagaacacacacatttacagtctcaggcagagaggataggcaatggctaccactaagatgggggctgtggagatcctggcggcgcttatgatgatggcagcatgggagccgacttcggcgcacgcctcccagcatgctggcggcaagaaagatggagatgcctcgcctcatggatggcctgttggagagatcaaagcagtgttgccta

SEQ ID NO: 40991 - DNA, 416 bp, Triticum aestivum
  unsure (1)..(416): unsure at all n locations
  Clone ID: PAT_TA_40991
cggacgcgtggggtgtcgaggaagttaacacatgaagtaatcatatgattctaccatgacttagtgctgcacatatgtagaggtagttacgcagacatctgttctaccaaggttcttacttatatgcacttgtacattctgttgttatagttgattgaaatgctctaacttatggtttgccatatggccatggattgtatatagtttggtttcaacactcccaaataataaatggntcctttgattgtttttgtgtttcatagcaaggattaaataattagaacccaaaagtgagtttcaggatttgtaatgaaatcctatttgtcgccttatgtagaggcagccatgacgctctctgttgctaatataccacaactaattttacaactcaccccaggcgtattccttatgagctg

SEQ ID NO: 40992 - DNA, 429 bp, Triticum aestivum
  Clone ID: PAT_TA_40992
agcaacctgagcgagacctgcatgtaacaaacactcgtcggctagcggccggtcggcatcgattttgggtaccggtggacgctatggctgcgaaaggcaggaccgacatggaggtgggcggcgatgctgttcacgccatgaacaaatacaatctactagtcaactctctctgcattgatgtactgctaagatgaaagtgaaagttatatacaagctcttcagagtacacaagtcaaagctattgctgttacatggaaaggacggaaattgtctggaggatgctatagtagttcctttcgcgatcgctacaggaggagaatggaccaggcaaacgttgcctacatatcacatagacattctcactgtacttcagcaaggaacaacatagccatcaggggctgcaactgatggtctttgtcttgctggagt

SEQ ID NO: 40993 - DNA, 431 bp, Triticum aestivum
  Clone ID: PAT_TA_40993
cccacgcgtccgcttcttttctttaggttttatgtgtattctttctgtacatctggtgtgctgcgacggatccagcagatccaggggtcttcaaatcaaagaagtaccaaagattgtatggaggctgcaagcataggcgcctgaaggagtccatacaaggtgtttcagatgttggattacgactagagggaactggagaaaagagagaacatgaggttgctgatgctaatgaaaagtcaatgactgaactgaagaacaaaagctcatcttgctgcagtgcaattttctctgcatttctccttatattccgccctctttcttttgttttttcctgctgccaatcacgtgaatggtcctctgagcagcaagacagtgaagatgggatgtttttctgcagcctttgtgaagtcgaggtgttgaagtacagtaag

SEQ ID NO: 40994 - DNA, 302 bp, Triticum aestivum
  Clone ID: PAT_TA_40994
gccagcccggccgtccgctcccggtcgaccccgccatgaactaccgcttccagaacctgctgggcgcgccataccgcggaggcgacgccgtcttcgcgggagactcctccgtgctcctatcggcggtggggaaccgagtcgcgaccaccgacctagtcgcctgctcctgcctaacgctgcgattcgagtcctccgccaacatagaccgcactcgcacctcctgcttggacgacttgctcctctgctgcgacgagaagggccgcgcgctatacaccaaccttcgacgacgcgccgtcctacac

SEQ ID NO: 40995 - DNA, 234 bp, Triticum aestivum
  Clone ID: PAT_TA_40995
atttcataacaagtgcttgctatatgtgaacgtgggtgtgcatatattgggcattttatctcagaccctactattccccacccagccatatcgccttctttctctttgtttatctcaaggtcacaaaactaatcatgatttaatctatcctgtggtcatggcatcgctactgattagatctaaatgttggtcctaactagcgctactcattcttgtacaccatataggtggaaa

SEQ ID NO: 40996 - DNA, 408 bp, Triticum aestivum
  Clone ID: PAT_TA_40996
gccggaggtccgctcccccgcagctcggctcccccgcagctccccgcatcgccggagctctcccgccccacgcctcccccaccccacgcctcccccgcagcttccctctccttgttcccctcctccttccccatggtgatccccgacgagaagaagactgattttttctttcgatctgctcggcggcggccatttccaggtcctcctcctcggcgctgcggcggcagctcgcccgcggtggcggagcaggcgagtagcagcagtgggcgcgcgagcatgcggcgaaggaggtcaccttcggcgtcggcgcgcacgccaccatgccgcggtgcgtcaacgacctcgcggacgccgtcaaggtcaccatgggccccaagccaacagcagcagcagaggcaatcagtagtc

SEQ ID NO: 40997 - DNA, 219 bp, Triticum aestivum
  unsure (1)..(219): unsure at all n locations
  Clone ID: PAT_TA_40997
ttntannttnttganaaatatgttctttctcttagaaaaatcatttttataagagggggggttttaacaattgggggtgttttttccctaactaatattatcaccgggaaaataaaaaggcggggaagaagaccccctacattcataaaaaaggcttggtcaacaaacgattttttttcttcccccccggtttcatcacatacccaacgaggggggggg

SEQ ID NO: 40998 - DNA, 285 bp, Triticum aestivum
  Clone ID: PAT_TA_40998
gttggagcaaccagggcagtataagcaaagaaaatcatttggaaaaaaagggaagcaaaaacaattgggggtgttttggcgcgaactaatagaagcacggggaaatgaaaagggcgggaaagcagcccgccaacatccagcagaaagcctcgccaaccgatctctcttctcctcccccgctgtcttcacatccgatccgaggcgaggcggcgatgcaaatccaagtccggtgcgggtgcggcgaggcggcctgccccgagtgggcggtggtggaagtgcaaggcg

SEQ ID NO: 40999 - DNA, 443 bp, Triticum aestivum
  Clone ID: PAT_TA_40999
gtcagaccgtgctttgccaacccaccgaaggaaaggctaggctcagggagggatgctccttcgggcggaagggcgactaatctacactcctgtttatgtgaaaaaagaacacaccccgtaaattacttttttaaaaatcatattattaacccccgtgacccccctcaaattttgtttatataattcatgtgtcacaataactaacccttggacagaagtgggtttactatttgtttatatttattccccctcttttttttttgtttgtgaaataataacctttttttttcttccctttttttaatattgttagggatttcttatataattacataaaataatattttcctcttcttttttttttttaaaacttatatatttcactttttttatgatatatctataatttttttttttttttttgtttgggaacatttaaaatt

SEQ ID NO: 41000 - DNA, 392 bp, Triticum aestivum
  Clone ID: PAT_TA_41000
gttcgggccaccagggactggcaagacaatgcttgctaaggctatagcaaatgatgcaggtgccagcttcatcaatgtgtcaatgtccaccatcacatccaaatggtttggggaggacgagaagaatgtccgagcattgttcagcttggctgcgaaggtggctcctactatcatctttgtggatgaggtagatagcatgttggggcagcgcgctcgctgcggtgagcatgaggcgatgcggaagatcaagaatgagttcatgagccattgggatggtatcttgtcgaagtccggtgaaagaatccttgttcttgccgcgacaaatagaccgttcgaccttgatgaagcccatcataggagatttgagcgcaagtctgttaaatgcagcattt

SEQ ID NO: 41001 - DNA, 338 bp, Triticum aestivum
  Clone ID: PAT_TA_41001
gtgacgcccaccatggactggcatgacaatgcttgctacgactatggcaagtgatacatgtaccagctttatcaatatgacaatgtccaccgtcacatccaaatggtttggggaggtcaagaagaatgtgctatcatcgtttagatttgctgcgaaggtggctccaactatcatttttatagatgaggcagatagcatgcatgggcagagcgctccattgtggagagcaggattctgattccttatgaacttatttatgcaattttttcgattccatttttcgatttgtattgattcgtgcttaaattctccctgctcgaaagttaattccttttttt

SEQ ID NO: 41002 - DNA, 265 bp, Triticum aestivum
  Clone ID: PAT_TA_41002
gccacaccgcgagtcgcgtgtttgtaatatccgatcgctcctgttacctagctggctggctatgacgtatgagacctcctacagtacgcaccagcctgcaagggcctgcccttccgtggccggccacctacttcaaaggcccaccaacagcactatgggcgcgcagaccgaacattccttattctgatcttcctacagtggacactgatcaagacaatgttgactcggcgggctacatatactccaaaatgcttgaggaggatcc

SEQ ID NO: 41003 - DNA, 392 bp, Triticum aestivum
  unsure (1)..(392): unsure at all n locations
  Clone ID: PAT_TA_41003
ccaccaccgccgccgctgccataccagcctcgcatcaacgagccatcgtcgtaccagccccgtatcagcgagccatcgccgtaccagtctcgcgtcaacgagccacagctgtaccagcctcgtcgcacggacgcgccgccaatgttcaacatgcagccgccgtaccagcctcgccagagtgacgcgctgccgtccttcaacatgcagccaccgtaccagcctcgccacagcgacgggccgctcgcgctccctggacagccgncgntgccgccgtaccctcctcgtgccggttttcccggacagcagtactctttccgctctgacgacatgccgccggttcactttgacaacaacgccttgcccgtgtgaagaggggggagaaggagttcaac

SEQ ID NO: 41004 - DNA, 400 bp, Triticum aestivum
  Clone ID: PAT_TA_41004
cggacgcgtgggcggacgcgtgggcacggctcctctcccactcccatcctgctctccaatggcgctcgcctccaccaccgcctcccgcctcatcagccgacgcctcgtcgctcccctcccgcctcctccttcctcttcctgcgccgcgccgcgaggaggagccaggccagggccgcgccggttcgcggtgcgctgggagggcaggccgagagcgctgttgggaggattctcggacgccgacgaagatgtcagcgacgacgaggacgaggaggacggccccggcgcgctcagcggtgggccgccgcggcagcagcaggggtgcgaggacgtcatcgagctcgccgccgctgccttctccgggcccgagcgctgggacgtgctcggactcggccaggccatg

SEQ ID NO: 41005 - DNA, 396 bp, Triticum aestivum
  Clone ID: PAT_TA_41005
acacccttccagatcacacaacggcaccatctagaaaaaaatcacacaccggcgggctcgccgccggccgcctcctctgtcctcttcctgcggcttctcctgttgcccccacctcccccggcggcctgactcttgactcggccagtagcgaaactccgtctccaagttgtttgccgtacgtccatcctgcgccgcgcgacggcgcgccttttcctccccgcttcttcccatcagacagcgtctcctacgcctcctccggtctgcttctctccatagtatttgtcaatcatggtgttcagcaaggtggaagtgaacttgagaaggctgcttgaggcggccccccgccagcagaatcaggctaagcttgtccattacataaccacagccagagagctg

SEQ ID NO: 41006 - DNA, 392 bp, Triticum aestivum
  Clone ID: PAT_TA_41006
acacccttttagataaaacagctgttctatctagaaaaaaataacagaccggcgggctccgcgacagccgggtcctcagtcctcttcctgcgatttctgctggtgagagcacctatcgcgtcagcctgactcttgactcgctcagtaacgaaactccacctccaagttgtttgtcgaacgttcatcctgcgccgagcgacggcgcgccttttcctcctcagatctttccatcagacaggactttctacgcctactaggggctgcatctgttcataagattcgtcaatcatggtgttcaccaagggggaagggagcactataaggcttcttgatgctgtccccccccaatacaataacgcatagcttgttcattacataatcacacacagaga

SEQ ID NO: 41007 - DNA, 241 bp, Triticum aestivum
  Clone ID: PAT_TA_41007
tcccgcagcaccggtaccgattcccgggtggggcacgcgccacgcctgctttaagactgcagaactgaagcgcttctttgcttttgcaaactcggggacgcctcaattgagtgctgaagcaaactaaagttcatggaccgaatacatagtgtatgtgcctccgatagaggtcacagctgctctagtgctagggttgctcacatgatgaccgttatggcactgcaggcgttcatcaggctcc

SEQ ID NO: 41008 - DNA, 205 bp, Triticum aestivum
  Clone ID: PAT_TA_41008
gtttcccgtccgtcggctgatgaccgatactgcctcacaggctcgggatggggtcgttccgagcgacgggcgtgagatcatcaccattccacccaggaggaggagttgactgcgcagcagacagccttctaagtccgatagattcgcgtgtggagctcccatcctcagaagaggctgacgaaggcgcataaaccattgtgcgggg

SEQ ID NO: 41009 - DNA, 396 bp, Triticum aestivum
  unsure (1)..(396): unsure at all n locations
  Clone ID: PAT_TA_41009
cccacgcgtccgcccacgcgtccgcccacgcgtccgcggacgcgtgggcgaggcgagcgagcaacggacggaagcaaacgcaaagggggagggagggaggtcggacgcgccccgccggtttccgtctctccgttcatcccgctcgccgtcgtcgggcggcggcaccgccaccaccatggccatgtccaagccgcagcagggcgaccccgccggcttcctcgacctcgtcggcccggacctctccgcctgcgtcttcgcccgcctccaagaccccgccgacctcgcccgcgccgncaccgtctcccgcccctggcgcagattcgtcgaggggaacggcttcctcaagaaggtgtgcgtccgcaagttcccggagctggccgtcctcacggccgcggt

SEQ ID NO: 41010 - DNA, 191 bp, Triticum aestivum
  Clone ID: PAT_TA_41010
tttacgcgtgggccgatgtcttattcactattccaacacacagtcggggggggagctacgttgggccgcctaccctactctgagcggatctgtcatcatgaccttcgttgacgtataggggacaggctctactctaagtgctactccagtgcgcggtgcgcctgcatggcactggcgattcgcgcttttgt

SEQ ID NO: 41011 - DNA, 403 bp, Triticum aestivum
  unsure (1)..(403): unsure at all n locations
  Clone ID: PAT_TA_41011
ggtggcctcacctccacccaaagtaaagttggcccaaggggcctctcggatgtctgagattgcaaagaaattattcccggcgaagactgagcgaaaagggaatggacagaagaatgattttgacaaacccaacacggctctggctatggtagtagcgggtaccattggggtagaggctgataaaagactggagaacttggataggagcatcgagactttgaagaagcaaaagaatgaaaactcccaccgcaagacaagcgtggggcaggagggagagagcggngaacaatttgtcacaaccttagaagcggngctgcatgtacagccctgcaaagatcaatgaaagtggtagcgtggaattgccgggggcttgggaaccagcccgcagttcaaggtcttttgg

SEQ ID NO: 41012 - DNA, 397 bp, Triticum aestivum
  Clone ID: PAT_TA_41012
cggacgcgtgggtttgatacatcaactcacaatgccataactgaacagttattctgcttgatagtacaaatgtagttacagtatgatgatttcttcaatttagcatcaaactcagaattaatcataatctagttgtagtaatcttgttgtttattcgattcaatactcattttagaacttagtaaggcaataaattagagtctctggtgcgcttcttattagcgtaattcagcgctgtacgttgccaagaggaaacttgggctatgattctggcagaagccattttttgagatggcttttgcattcaacttgtccatacatatcttagcaatgaactgaattttgtttgtataggtgttttagggatgccatgaggtatctgatgcttggtcttttt

SEQ ID NO: 41013 - DNA, 343 bp, Triticum aestivum
  Clone ID: PAT_TA_41013
ggccaaagccgcagacaggacgcacgcacaggccaccggtggcgcttcaaaagttggccggtcggccggcggttttcggcggcatggacgccggcttcttggttatgggggggcccttcttcggcgacgcccccaacggcggggagaaccggatgggcaccaccattgtcggggtattctacccccgggggggggttcttgccgccgacttcaagaccagcaccggaatgtatgtggcaaaccgcgcttctgaccaaaatagtcaactcaccgataaaggctatgtctggcggtctggatctggcgctgatacacaaggtattttaaaatatgtgcgctattt

SEQ ID NO: 41014 - DNA, 151 bp, Triticum aestivum
  Clone ID: PAT_TA_41014
aggtccagtccaatccccatccacaatcgcagcccctcgctctcgccgccggcgtggggattccctgcttgccccccgtagcctgcgatctttttgcctcggagtcgctcggattccgtgctgcggctggttgggattccctttctgcacc

SEQ ID NO: 41015 - DNA, 140 bp, Triticum aestivum
  Clone ID: PAT_TA_41015
cccacgcgtccgctgactcttgatcggaatcgtgggaggaccagtgaaggggggattgacaattgtagcctgtcattatatacatcgttttggggatttttaatttatgttgtagcctggattttgaatggaattttttt

SEQ ID NO: 41016 - DNA, 385 bp, Triticum aestivum
  Clone ID: PAT_TA_41016
tcgcggacgcgtgggtttttttaatacaaatgatgcaaaccttatgggggattgtggtacaatattggctcaatttggggacaccatgctatataaaggttacgaatgcaccttttctaggggtttgggggccttaaggtaccccaaaaccccccaaaaaatttggatctttggctaaatttaaagcccgtaaagggttatatattcctatggtttaaagtgggtaaaagccctttcatgtttaaaatgtataaagggttccggacaaaccccacctttaaaaaaaaaaaaaaaggccccctaaccctttattttcaataaacattggtttgccgttggggggccccaatgactttttttgggggggggagagcattgccctttc

SEQ ID NO: 41017 - DNA, 403 bp, Triticum aestivum
  Clone ID: PAT_TA_41017
cccggcaactggtgggcgtcgtcctcctcttgtgcgcaccaggttcctcctcctctctctctctcctccattcccgcaccctccgtcgcgacacatcgccccagccagaattcccccttgctgtcatctcctcccccaaaagccgcaccgatccagcagcttcctcacaacccaacccaggaacatatcaaaatcaatttatgggaaagacgcaacgcttgtccacaattcttgatgaggaggtgtgatctgagacagtctcacaacagcagggtttctggaggaatgtcatcctctttacctattctgccaaattctctgaaagaaaccttccatgggccttacaatccgcagctcactccgatgcaaaggcaactgacgagtgatcttgtgcccttacatc

SEQ ID NO: 41018 - DNA, 268 bp, Triticum aestivum
  Clone ID: PAT_TA_41018
actgcgtcagtgtatacatacactttgcaatgctgcgcgccaactatccttgggcattatatgtcatgatcacttgatgctatcgtccttggttggttaatcttatcagtgtccaattcgagatccaactttagccgacatcatgcgaatgaccatttgcgtcatcccagtgtagacaagtatgggatagggcaagggaaccatgagtttggtctgcacaccattaatgggaattgtagtctgtcaagatgttcctgcatcacttgca

SEQ ID NO: 41019 - DNA, 400 bp, Triticum aestivum
  Clone ID: PAT_TA_41019
aaatatcttcagatataactgacatcccagcagcgcgtgggagccggtgtcttcggccagagctgggtctccttgccggcgaccttgccatcaccagcctatctgcagttttgcagggatggacatatggattgaatggtaccctcctgaaatctacacagatgtcagatcggagaaagaagagatgaagaacaattttaattgaagagttgaagaagactaagcacgagtccccctgaagtgcttgaccaccggccggttgcagtggaggtcagcatcacctcgctgtggccatcctgggcgccgagagaattagctgaaaattcttgctgagatccaggtcacgggccatccccattcaggtggctatgaaacttgttcctaacgaaagataatttat

SEQ ID NO: 41020 - DNA, 366 bp, Triticum aestivum
  Clone ID: PAT_TA_41020
gtcgtcgccgccgccgccggagagatggactcccggggcttagattccacgggccgcgagttttccagcgccacggagatgtgggcccaggagatcggcgccaccgcctccggctgcgcctgggcctccgaagtccctccgggcgccgccgacgacgccgccgtctgaagcaatggggacgccggcgaggaggcgggcggagaagggaagcgtgaggagtggtactccaaaggaatcgtctactggcagggcgtggaggcgttgaccgagggcgaactgggaggctacgggtgcgtcaacgacgccgacgtcaagggcagagccgtcttcctgcgcgccatgctcgtcgagcgattcggcgccgag

SEQ ID NO: 41021 - DNA, 403 bp, Triticum aestivum
  Clone ID: PAT_TA_41021
cggacgcgtgggcggcgctccctctgccgctcgccgggaagctagctagacttgcgcgcaccgccggaggcgatggcgatggcgatggccgtgcaagccagctggcttggtggccttgcgtgcatcttctccaccagccttctcttccaaatcctggtacggccctgcagcaatggaggaggactcttcttctgcccacagtctccaaatgccccctccatcctcagcagcaaggacaggactgcctaccacttccagcctcccaaaaactggatcaacgatccatgtggaccaatgtactacaatggcatctaccatgaattctaccaatataaccccgatggctccttcaatcccaatacctcctataacatagtttggggccattctgtttcaacagacc

SEQ ID NO: 41022 - DNA, 336 bp, Triticum aestivum
  unsure (1)..(336): unsure at all n locations
  Clone ID: PAT_TA_41022
cggacgcgtgggcggacgcgtgggccagcgcggccatgccgaggctccacctttgctccggatcgtaagcccgaagctcgggctctcatccgtggctgcttgcttgcttggagcggtgggctcggtgcggagcactacaaggaccatgagcaactcgtcgtggacggcgccggggtcgtcggcgctggagacggtggagaccaagatcagccccagcatcctcttcatcgtggcggtgctggcgatcgtcttcttcgtctgcggcctgctgcacctgctggcgcgccacctgctgcggctgcngcgccggcgccgggcggcccgcgacgacgccga

SEQ ID NO: 41023 - DNA, 234 bp, Triticum aestivum
  Clone ID: PAT_TA_41023
ctctcccaaacccctgtgccgatcctcgatctgttctcaaccctacagtgcgaagtcaaggtggccctgtcccactcattatggcttcgatcaagatcactcatcaattctgtttgccccctcggcaggctctcgggatggtgatctgcttgtagccccattatggaacgcaactggaactgcaactgcttattcaccactagctgcatggcctagctgttcaatgtggacact

SEQ ID NO: 41024 - DNA, 280 bp, Triticum aestivum
  Clone ID: PAT_TA_41024
cgcacgcgtgggctcctccgctcaatgcgaggacctggagccttgtactacatgccatattttgaaggatgtacaccatggctcgcatgcacccgattgatgcaggggcccagcgaaatcctccttttaaagaaaaaggtaccactggatcattgacgtgccacagagggatctcgggagcaatatatgctgggggggggcgtccatagaattctccgctgataacacatagacgagtattggccatgcctaaagtcaactcctgaagatgcactttcga

SEQ ID NO: 41025 - DNA, 273 bp, Triticum aestivum
  Clone ID: PAT_TA_41025
cggacgcgtggggcgttttagttggagcagagaaggagaggtgcgaagtaaaggtggcgctgtcaaactcattcggattcggtgggcataactcatcaattctgtttgcccccttcaagtaaactcgggatggtgatctgcttgttgtccgattatggaatggaactggaactggaactgcatatacaagactagtggagtagctaggcggcttctttgaatattacatggaggtctgagctgagaagatcatcgtattacttacaggtgagc

SEQ ID NO: 41026 - DNA, 387 bp, Triticum aestivum
  Clone ID: PAT_TA_41026
ggtgccctatgacccaactctttttgctgaacttgacgcacatcaattgtcctcgtttgctttcgaaacatattcaggccctctctatctgtctctgactggtactgcatccatcatatacgaaccgctactgttgtgtaatattttttgctcgatatgttatctaccgctgctcatctaggccttatgttgccgcacgatctgtcgctgatctagggttaggatacgctattggattggcgactgccgcgagccgataacatatcaggttactagctagccatagacagtatttgcttaatctgctgatgtgcaggagtagaactttgcttaccggtctcctaactaatctgcataagtatttattagtattttgtgctaaaatgt

SEQ ID NO: 41027 - DNA, 353 bp, Triticum aestivum
  Clone ID: PAT_TA_41027
ggtgcgcatggacccaactctgtttgatgaacttgacgcagataaatggccgagtatggcttgggaaacatatacaagaccctctctatatatatctgactgttactgcatggataatataggaacctgtactgttgagtaatatttaatgctcgaggtggtatctaccgctgcttacataagcattatgtcgctgctcgatttgaagctggcctagggtatggatcagatatgggatagatgactgacgtgagtcgataacatattaggtttctaggtagctaatgacagaatactgcttaatcggatgatgtgaagtaatttgaacttccttcccggtctggtcactaatc

SEQ ID NO: 41028 - DNA, 395 bp, Triticum aestivum
  Clone ID: PAT_TA_41028
cggacgcgtgggcttttgcttcttttctttttcttttagctagcaaaagtattttgtccaaagtgggactgggctagataaatacctcgcatttactagcactaccacaaaaagtttgggaggctttcgagtttcttgaaatttttcataagtggaaaggcatttaaatgattgtttaagccactgttatattaaaaaaagggatttaaacacttcacaaaagtgtcgggtcaccaccataatttgttatggaatattggcaacactttgaacattttagtttgcatgtttgagaaatttgaattttggactttagtttgaacttgaatttgaattatgatttggatcaagcgaggattggcaacagtattgtgatgacaaggcaccattagcag

SEQ ID NO: 41029 - DNA, 265 bp, Triticum aestivum
  Clone ID: PAT_TA_41029
cccacgcgtgcgcggacgcgtgggcgacgaacgagagtgacaccgcgacgggcatctccctcgccgactgcgcgcggtccccacatacacgttccctctatacaaaagaagcagtagcactcccgtgcgcgtcacttccacgaccgatcgatcccacctggggcatccggatacgcatccacccttcagcgcagatcggatccacacccatggccgggcgcttggaccttcaaggcaggcacggcaagtcctcggtacgggtctc

SEQ ID NO: 41030 - DNA, 287 bp, Triticum aestivum
  Clone ID: PAT_TA_41030
cgtacacatcgactgatgatctttttcatgcattcgaaacaaacaaaacgttttgagttcaatcttgggctggtctacataaatcacctttcattgactggcgggacgccacagggacaaggcggcttccgattttattaaaattggtcatacttggaactgcatttaaaccattgcttctgccactgcggtcttagaaacccaggatgtaaactcttgccagtcaatgttaggctcaccaccatacttcagtacctaatatctacctacatctatgaacattgtag

SEQ ID NO: 41031 - DNA, 342 bp, Triticum aestivum
  Clone ID: PAT_TA_41031
cggacgcgtgggcggacgcgtgggcagagcaccaccaacctcccgattccaggggacgcaccgccaagtggacgagctagctacctcctgatcttcatcatggacgcctggccatcatccttgccgctgcgcatcgtgatcgtccaggggctcgcgctggtccacctgctcacgtgcctggagctcgccgagcggatcgcgttccggggccaccgagtgtcctacgtatgcacgccgcgcaacctcgcgcgccttccgacgtcggcgccacgcgtggacctcgtggcgctcccgttgccgcgcgtggacggccttccggacggctccgagttcaccaacgac

SEQ ID NO: 41032 - DNA, 307 bp, Triticum aestivum
  Clone ID: PAT_TA_41032
cccacgcgtccgctgactctttagatcaagctagacacataatctgatctcatgggataatacttttggaatgatcttcatttcctccttgcgagcataggcagcacttatgggcatcctcagtacccagtttaacatgaaccttaagaactggagctacttgattattccatagtacatctgcatagggagatgatgcatttgcatcatgaccaaaagatggaccgtggacagactcatgaactacgcgagtcaaattaccatgtttatataccaaaattcaaggaactgtcattctttcggagag

SEQ ID NO: 41033 - DNA, 287 bp, Triticum aestivum
  Clone ID: PAT_TA_41033
cggacgcgtgggcggacgcgtgggcggacgcgtgggcggacgcgtgggatccggccttttttcccctgccaagccgccaccgcggttgtctcctcccgccgccgccgatgaagcccatcgtcgtccacgccgtctccgtggaccgacggtggctgctccctctggccgtcagctccgcgctgtcgctcttacttcctggtcctcctcaccaccgtccctgttcgcttcttgccctcctcctcgacctccccggcgctcttcgtcgagcacaagctcgacccgacccc

SEQ ID NO: 41034 - DNA, 392 bp, Triticum aestivum
  Clone ID: PAT_TA_41034
cggacgcgtgggtacgagtccatcacgtcacgcacgcacgcacgccccgcgcgcggccaggctgtgctggtgctgggagcttcgtccccctccactctcgccagctccccgggcctgccccgccccgcccccactccgccgccgacgtaagcacacccagcaccctcccctcccctcaagatccaaggcacgctcgctcgccccccacccgccccgcgcaatgccccgctcctgaccatgtcctcgctctcgatcccgcctccgctcctgcgctcctcgcactccccatctccgccggcggcggcagcggcgaaggcgaattggaggaagcgcgcggcgcgcgtgcgcgtgcgcgctccggtggcggcgctggccggcgactgcgggtgcgc

SEQ ID NO: 41035 - DNA, 405 bp, Triticum aestivum
  Clone ID: PAT_TA_41035
cccacgcgtacgcggacagagaagcctggaaagccaaaaaagaattcaccagcgcaaaggggaaaggagagagagagaggctaggctagggtttcgttcaattccgccatggattccggcgactcgtggggccgctcctcctccacctcctcctccggcggcgtcgagaggcgcctgcagtcccgctacgatctgtacatggggttcgacgacgcggacgccggcggggaccacgtggaggcgcgcggcgcgtaggcatacaactgccccttctgcggcgaggacttcgacttcgtccggctctgctgccacatcgacgacgagcacgccatcgaggccaacagcggcgtatgccccatgtgtgctacaagggttgggacggacttaataggccacttgacaatg

SEQ ID NO: 41036 - DNA, 387 bp, Triticum aestivum
  Clone ID: PAT_TA_41036
cccacgcgtgcgatatcctgtgatcaaatacatcccatttcctgagtcaaggcctttctcccgagacaaggaagaatctgacgctcctcaatattttcgagatgtggcctgctgcaataatatgatcaagtttgtccacatagaatctcatgacccttgctgcactggaaataaagattggaaagccaccacatggaataggaagctttcttggggatattggcgtcagcgattcacagttaaaggtgatgatatctccgccgaccaaagtattctgctttattgcctgagctgtgggacagcgaaacaggaaagttagatctgaagaaactaaatttctacacccccaccctcagcatgtgcgatgatgattttctttacgtcatg

SEQ ID NO: 41037 - DNA, 277 bp, Triticum aestivum
  Clone ID: PAT_TA_41037
caaagacatgttaacctgaccggtgagaaaggtgaagcgaaaatgtcatggcgcgtcaagggaagcatgggtctgagcatggtcggcgccaagcgccaccgtatggtgctgcgtttacaacattcagtgcatcaccaagccgtccatacgttgcctgcctcgcctaggcgctttgaagcgcattttggggctaatttacaaggagacccgcggtgtgctcatgatcttcctggaaaactttattcccgacgcctactctttaaccaagctctcctac

SEQ ID NO: 41038 - DNA, 195 bp, Triticum aestivum
  Clone ID: PAT_TA_41038
cgtacgcgtgggcgaatccaagataggagcagggcgaaaggaggccgtcggcgatgtcttagaagaagcgcgcccccgacccgcgcaaggactaggtgtttacccttgattacactcatcatctatacaatcatccttcatgtatgcacctttaataagaaggcaccttattccatttagcatatctgtaagttt

SEQ ID NO: 41039 - DNA, 398 bp, Triticum aestivum
  Clone ID: PAT_TA_41039
cggacgcgtgggcggacgcgtgggcggacgcgtgggcggacgcgtggggaagagcagagtccccttgatgatcatttcagtcttgcggatttgtctggatgcccaaatcaagatgatggatatgtacgtcaggctggccctatcatgtttagtgacccatcaaatggtgatcaggcatattatcctatgagaacttatggtaatcgaaaccatgcctatcgggctcttagtgctgaggagttctccgacacaggaaatggtaccaatgcgtattcaggacagcagcaagcttgtccttcagatgaccagaacttgtattctgggctgcagcaagcttgtccttcagatgagcagaacttgtatttgccaaccaatggtctgccatttccacagcaatt

SEQ ID NO: 41040 - DNA, 291 bp, Triticum aestivum
  Clone ID: PAT_TA_41040
agcggaagaggatgtgatcgggggtcaccatcaagagagtgcttccttggctcggtaccaaagtaaaatggtttagtgactggttaggttaggttatggtcttctttccagatacttcttcagtttctaatgcttctcataattcatttttgcacattgatggaattgcaccgattgctttcatcagttgagtacacaccaaacactttcctctcagatctacctttaaatgatagttctctatatttcataaagttaaatgcagcaaatcctcatggtgttctcaaaaac

SEQ ID NO: 41041 - DNA, 384 bp, Triticum aestivum
  Clone ID: PAT_TA_41041
cggacgcgtgggcggactcgtgggcccatatcgagtgggtgccagctcggctgggaaccaacgtgaagtgctttagggactgcttaggctaggttatggccttctttccagatacttcttcagtttctaatgcttctcataattcatttttgcacattgatggaattgcacctattgctttcatcagttgagtacacaccaaacactttcctctcagatctacctttaattgatagttctctatatttcataaagttaaatgcagcaaatcctcatggtgttctcaaaaactatgttttatcaatttcatatagtttagtactccctccgtccctacatataagacgtttttgcagtttgattcgaactgaataatgtcttata

SEQ ID NO: 41042 - DNA, 395 bp, Triticum aestivum
  Clone ID: PAT_TA_41042
cggacgcgtgggtcaccccgtcgccatcaggcacggcggcgggggcaccgccgcacggccatcgatctggcagcaccggaacggaactgctctactgcagtgatgtgcggcccacaatctcttgtacagctcgcgtttggaggcggaggcaagggggaggaggcgctcgcggacaagtcgaggaacggcccacggcgcgagcggcggccggcggcgagactaaggtgcagaaactcttcgtccgacgggaaggcgactccttccccatccccattgattaaccgcccgaccatgactagatttgaagatcaatccacgtcggtgactctgcttgccggtcaaggtaggggaggtcactgcatgtcgcacggactgcaaccccatggctcacaacc

SEQ ID NO: 41043 - DNA, 401 bp, Triticum aestivum
  unsure (1)..(401): unsure at all n locations
  Clone ID: PAT_TA_41043
ttctcttggtaattttctttgcccgcttctcttgcttcagtgcatttgctctttgcttcatataaacaagatttttgaggtaggaatatcagagcatctggcaaataagttgcaacatatgagcattgacttggttgaaaaggcaaattcttcaattacagcagagctggattatgtatcgaatctggtgattggtgtcattgacgtacaacggagtaaggaaaaaggctatgaaacattggtgaaagaaaatttatgtgatgagttggatgaactgaggatggtgtatgaaggattacctgactttctggagcaggtttcagctaatgaaaatgcctncttccctttctcgctcgaatgcagaaaagctccgctaattgtctatgtacaccaaataggat

SEQ ID NO: 41044 - DNA, 365 bp, Triticum aestivum
  Clone ID: PAT_TA_41044
ggaaagagaacattcatccacacaggagaaactggatatggagctgcaagatctggataaaagacttcagcaaaaggaggcggagatgaaacaatttgatactgttcgcaagcaacattatgagacgaagttagacgagatggtacaagaaaagagggctttacagaaagaaattgtggatctccgtcatgcagtagcgaatacatctaactcaactgataagtggtcaaactatcttgagaagctgaacatgattgaaactcaggtctctcagcatgagaaaaagcgggaggctcatgaacagttgctacgacataaacaaaaaagtgatgatgaagctatgcgtttacaaggagaaattcaac

SEQ ID NO: 41045 - DNA, 387 bp, Triticum aestivum
  Clone ID: PAT_TA_41045
cggacgcgtgggcttccagcgcatggctggaatttgattaattttaggccattaattgttggcaatgctacaaaggcatcatctccatgcagcccctgcccgaaaggagcaactacattttgtctttaatgcatgcatgtttggctgaattccccccttctatattttgcagttatattgctctcacaaatcaaacaacctatgaagtggccagaaggaagcggatattctacttaaggggaattcctgatagagttcatccgttcagtaaaggcatatgcagaaacatctatgacttctgcttcactagagagaatggatttgttctcgaggccgcgcccccaattgaggagctggaagccagagcagccccgtacacatgccgag

SEQ ID NO: 41046 - DNA, 415 bp, Triticum aestivum
  Clone ID: PAT_TA_41046
gtgacggtgccgtccaatggccagctcccacagcagaagcttgtcttccggaagacgaacgaggaatccaagccggctgctgctcaagatgagaagttcctgccgacagtttgatgctccatatttttgcagaggatctataaataagtgtagatacatataagggtggcgaactggtagtgtatctctttgggcatatcatagcagggttatgcagccagaattctttgctccaaaattacattagcagtagcacaaccctataaaaacagaggttgccaaagagcctggcacgcctctgcttccagatgtccagcatgctaaggttgtctggccatttgaaaatgttgttttgcttctgctttgagccaagtagaaatgcattcactgcatttccatgttcgttgacgatctc

SEQ ID NO: 41047 - DNA, 348 bp, Triticum aestivum
  Clone ID: PAT_TA_41047
cggacgcgtgggcggacgcgtgggggatgtgtgaagatatatacttcagctgcgacactatcgttgcctgggaaaaaaagaagctgcaacactatcgtttgctcacctgtgtgtttttactagcactataccaaccgtttttgattttaaaaaggtgtagcacccctatgaagtaatgaactttgctgatttggtgctaccacccccaaaatctcaagaaatgaatagctccacttgcactgcaatgttcttttggaagctacacgctccagagcttcatagcattcctgttccagccttattcattctgtgaatacgtcagagatggctccgttgttagctgtaaga

SEQ ID NO: 41048 - DNA, 355 bp, Triticum aestivum
  Clone ID: PAT_TA_41048
tctgcctcctccaccgcgtgcgtgctggtcgcagctccggggggagaccagaccagactacctcgcccgcccgcccgtccgccggcggagggagcccgccccgcctgccgtcctcctcctcccgtacagcggccggcattgggatctcgcggctcgcccccgcgccaccccgtgcaaaccctagccgcccgcaggggtgggtcgcgtcgcggcagcaggatccaacgttactcaacattgattatgcttggtggatgaggatgccacactaaagaacgtgggggtttgataaggctcttgaagctcgccagtgagggtctagaagctgtgcctttgaagactataacccatgtta

SEQ ID NO: 41049 - DNA, 383 bp, Triticum aestivum
  Clone ID: PAT_TA_41049
gatgaacttgcactaactggccacctgttcttctctatgtgtgaggatggctggctggtggcaaggttaagctctctggttccattagcagtcaatacctgagtcccttgctgatggctgctcctttggctcttgaagacgtcgagattgaaatcattgataaactgatctccgttccttacgttggaccgacattgaacttgatggagcgtcttgacgtcactgccggccacttctgatagttgtgacagatcatacatcaagggaggacaaaaatacaagtccccaggcaatgcctatgttgcacgtgatgcctcaagtgcgagctatttcctggctggagctgccatcaccggagggactgagactgtcgaatgttgcgg

SEQ ID NO: 41050 - DNA, 309 bp, Triticum aestivum
  Clone ID: PAT_TA_41050
gttggttcacacacacagcctggattgcttcttgcttcttgtataaaaaaacacatttttaatccaacgtaacctgaaaggtggcttggtctggataaagaaaaaagagtttcatggggtgccatcccatggaacattggaatctttttccaccttttaagttttgttttttctttttgcgagggctttccacatcttagttgaccccgaaaggttctatgcctaaatctaaaaataaaataaaacatgtcaattcgtcatgtatgggaaattagacctgtattaatatattttgagcctgtcttacga

SEQ ID NO: 41051 - DNA, 312 bp, Triticum aestivum
  Clone ID: PAT_TA_41051
cggacgcgtgggcggacgcgtgggcggacgcgtgggcggacgcgtgggttcatgtcatacgttatgctgtttaggattgtttttttccagaaattttatcgtcatgtatatatttggtaccactggttcttgcatatgtcacataccagcaattattttctcaaattcttttgggtaacattgttgtatcttgtattgtagtcatggttttcttagataattgaaaggccacaaagttgtgtccaaagttaatggctggccagacccaaggtacatggacatgtattcgtgtggtgacacgtacagcaccga

SEQ ID NO: 41052 - DNA, 334 bp, Triticum aestivum
  unsure (1)..(334): unsure at all n locations
  Clone ID: PAT_TA_41052
cccacgcgtccgcggacgcgtgggtccgtacctgtctgctccgtccgcctccgaagctttgcggctccagggtttagctagggttctacccacgaccaccgncgccgcccgccccgccgccgncgcagccatggccggcgccggcgccggaaaggaagacgccgcgtgggagcgccccatcagcgcgggcggcaagagggcgccggtcttccccttcttcggccccaaaaccctaacccttgacggggccggcaaggtcttcaacggccggcttcccttggcggggctctttgaacggttccccttgctcgaggagctcttcggcgggggcgcc

SEQ ID NO: 41053 - DNA, 185 bp, Triticum aestivum
  Clone ID: PAT_TA_41053
ctgcaggcagcctggggtcggttcgagcagccgacacctgccacccgcgccggagtttacggggtcgaggggacaattagggttcaacccaaatatttatcggcatggatatatctggcaccactgggtcttggatatgtcacataccagcaattattttctcaaattcttttgggtaacattgg

SEQ ID NO: 41054 - DNA, 211 bp, Triticum aestivum
  Clone ID: PAT_TA_41054
aaaaaaaggaagaggaaaaaggagaaacccggaagccggaatcccaatcgagcgaaggaagcagaactgggggatcgccgacgaggcggagggcggccgcgggagaaccatgaaggagccgtgcaagcaccacaagggcatctgggccctatgtgtgcgtcgggcctcgcccagcgcgccgtcgccggtcttctcggacccgccggcgcga

SEQ ID NO: 41055 - DNA, 147 bp, Triticum aestivum
  Clone ID: PAT_TA_41055
tataaccccgccgggccgaaccggttccctggcggcggcttgacgggcgggccccggcaatcgggggtacccaacgccgggtggcggcgccttcccggcggtgtgcaccggagccaccctcgcccgaaaggaccccggcggcccccg

SEQ ID NO: 41056 - DNA, 331 bp, Triticum aestivum
  Clone ID: PAT_TA_41056
cggacgcgtgggcggacgcgtgggcgccacagcactaggctcccgtgtcagatccgcacggcatggcacctctccagacggggctccagcgaccaccgaattgaggtcggcgtggcctcgctgagcctgtggccttcgcatcctccggtggtgcggaccgttcatgcgtgcaatccgctagctgtggatgtgcagtgtgtgtgtgcaattcggcgtgagctcaaacaaagacacagatcagtccactatgttctctaatgcagaaaaatggaggaaaaaccaattataaaaaaggaaacacaagatgcagttttgctctctcgcggtggac

SEQ ID NO: 41057 - DNA, 331 bp, Triticum aestivum
  Clone ID: PAT_TA_41057
cgcaagcaaatggcggagggagaggacaaccaggccctagtccggggggggggaacaggcaaggggagggccggcagagcgggggacgacgcacccagggccggggccccaaggagcgcggggcgcccgcgccacacgggcgcgacggtggggagggggcagaaagaggcaaaagcgggagacgaggcccaacccaagaggggcaccctcaccggggagcacccgaacgagcacgggacagtcagcaacggggacgacagggagaagatgggggaagacacaatcaacaacgaggaacgagaagcaccagaggagcacccaggacgggggg

SEQ ID NO: 41058 - DNA, 329 bp, Triticum aestivum
  Clone ID: PAT_TA_41058
cggacgcgtgggatataatcctagtgagagagagagagaataaagagagaagcgttgaataagaagaagtggagtgttgtgttcacggagttcttgcactcgatgcgggggcattgctccgtgtgatgcttaaatagcagattagtcatcttcagcgcagcactgcatgaggagatctttctgcatcgcttcctgtgccaatgttgattgatcaaacctgcatatgctggtggtagctgagaaaggagaaccactttttccatctttcggatagttgatggttatggaccgtacgggttggctctggaggcgcaagccttctgataata

SEQ ID NO: 41059 - DNA, 332 bp, Triticum aestivum
  Clone ID: PAT_TA_41059
accagtcgtcctatggcgtgagcgtggtggacggcttcaacgtggggctgtcggtcaccccgcacgagggacgcggcaactgccccgtcctcgcctgccgcaaggacctcacgcagacctgccccggcgagctgcaggtgcccggcggcggcggcggcgtggccgcgagcaagagcggctgcctggcgttcggcaccgacgagctgtgctgccgcggcgcgtacaacagccccgccgcctgccgcccctccaggtactcggacttcttcaagagcgagtgcccgcaggccttcacctacgcgcacgacagccccttcctcacccaccagtgc

SEQ ID NO: 41060 - DNA, 292 bp, Triticum aestivum
  Clone ID: PAT_TA_41060
gttgcacagccttcactagatcacggcggtgtcatattatgtactggttgcttccctaacacgagtactgactttacaaaaactggcactagctacaaaacatggatcatactcatgaactagatacacatatatctagggtggagcacctaaggtaccacatatacatgacctagggagaggtgttcaaattgttattgggacaccagcccactttatcgatatgatctaagctcttgacacaaacatacgccttgttacataccgagtcatggtttaagtagacgatctt

SEQ ID NO: 41061 - DNA, 294 bp, Triticum aestivum
  Clone ID: PAT_TA_41061
aaacgggggggaacagcggcgaacacgcgtcgcccaacacaaaacggagcaggaccccaaaagggggggcaaggaagaggacgccggcaaacaaaaaggggccggaagaaagcggggccaaggaagaaggcgggaccaggaccgcaaggcggcacaggccccgcggacgagggccgcccccaaaagggcgtacgcccacgcgcagctccggcgcccccgcacccgcgacgccagagtaccacgaccgaagcgccggagctgccggaaacgccccaagaaaaagaagagccgacg

SEQ ID NO: 41062 - DNA, 270 bp, Triticum aestivum
  Clone ID: PAT_TA_41062
gcctgcagtaccggcggattcggtcgacacgctccgggacctggcgccgggttccctcggaggaagagcaaaatcatcgtcgtatcatcattataatccctcggggaaggcgcgcacatctgagagctgtatttacgcgggcggcgatctgggcgctgcggccctggcgcggcgccggctctaggctcccatgaccctatcgtctgctgtcaggagcggccgcgcccgcttaccaggaccctaccctaagggaccttacacgacctggct

SEQ ID NO: 41063 - DNA, 333 bp, Triticum aestivum
  Clone ID: PAT_TA_41063
cggacgcgtgggatcggcaaaaagaactggagagaccgacctgaaattggtgaaacaaagtggcgttcagctgggcctcaaccggccagacatggagctccagcaagcacgtgtgcctacccttcttgcccatgagttcctgcaacaacagcagatcgtgtgtgtgtggtaccagccagataaatactacacaaatcatgttcatggtgtatttgttgggttcctgttggcgtgttgaacaaaaattggcgttcagcgttgctatttaaagatggtttgatcaatactagggaaaacacatagatggaaggaaattattgttgggatcaaggg

SEQ ID NO: 41064 - DNA, 266 bp, Triticum aestivum
  Clone ID: PAT_TA_41064
aaccggggggacgaacgacgcggccgacaacgcgtacgcccaacaacaacaacggacgacggagccacaacaaggagcaagcaaggaaaaaagacgccggcaaacaaaagaaggcggccgagaagaaaatcggcgagcaaaaaaagaaagcggggaccagaaccggcaaggccgggcaacagaccccaggcggacgaagcgggcgcaaccacaagaaaggccgctacgcccaagcgcgtagctccggcgcccccggaaaccaagac

SEQ ID NO: 41065 - DNA, 327 bp, Triticum aestivum
  Clone ID: PAT_TA_41065
cccccgcgacccacccctccgccgacacgggcccagctccacccccccccatccccccgtagcggccgcaacacagaggacagagacagagcgagaaccccaactctctgcgccccaagccggacaaaccgctcccaaccctccggcagaaaatcgcagagccctactacgacaagaaggaggccgccaagcaaaccgcacacgccgccgcccacaagacccccacgctccccgaccgcgtgcacccaacatacgaggagaccctcgccgccgccgcagccgccgcccccagccgaacctcgaccatggaggctgacggaccaagca

SEQ ID NO: 41066 - DNA, 304 bp, Triticum aestivum
  Clone ID: PAT_TA_41066
agggcgagagggcgaagacaaggaacacactgtaaccagggatgacagcgggggccaccagcgaaaggcgcgcggtgcgaaggcgggtacacgagcaagggaagggaaggcggacgagctcggacgcgccgacaggagacaagacaagaggacaagcggccgaacaagcaaccgaaggcagaagcaccgggggccggacagggccgggaagccccagagggagggcacacagagggcgcagcagcggaagcacgccaggggcccgatcacaggcgaccagcccggggacaacgaggaccggacc

SEQ ID NO: 41067 - DNA, 266 bp, Triticum aestivum
  Clone ID: PAT_TA_41067
gcgcgccaccaccagcaacacacacacagcagccaagcgaagctcgccgcagatcgaaatgtcgggccgggcaagggcggaaggggctggcaagggtgctctcgcaggtacagtcgcggacagattaagatctttgtgatattgataaagttgctcgcagcagcggtatcggtgtggggccgggatgggcctggggagaggggggtgaggtaggtataggagaagccagagcgggctgaactgaaataagatggtacccgattgag

SEQ ID NO: 41068 - DNA, 283 bp, Triticum aestivum
  Clone ID: PAT_TA_41068
cgggggttcacctgcagatatagacagacactttctaattccaaggttgaagctgttctaatactacctcctcgcctagttcggtaggaacttttgcacgggtgcctgttacgtcaagaacatcctgtactcaggtggtgccgaggctgatgaataaaagtttgcattgcttctggctgaactcaaaggcagtgacatcacagattggattgcatttggatgggagaagttagtcggtgtgcctttaggtgggggtgccattgctgtaggagctccagctgct

SEQ ID NO: 41069 - DNA, 335 bp, Triticum aestivum
  Clone ID: PAT_TA_41069
cccgaattccaagcactacaagtataatatgcaacttggaatcattcttaaacgagaacacctagggataattgagaagaaggaaggtgatattgtcattaaaacccgcccagctttggagtggtttgattattatgataatgatactctagatgataaggggcggactgctgcagatcgtgtgaaggaagttttttggaacttgtttgagatccacgtgaaagatgatgaagatctagacaaggtggaggatgatgctgatcgtgtgttggacaactacgcaatgaaaaaagtgagagacacgatgtatcaactttgtgtggatgctgtgaagt

SEQ ID NO: 41070 - DNA, 347 bp, Triticum aestivum
  Clone ID: PAT_TA_41070
cgggggggaccaacgcgtccgcgatctcgggcctctggaagattcggagccgctattcatgggagataatcctgacagcggacagagcgggtcctcggatgcgacggccggaagcgaaggcccagtcacatgcactttcatgggggagcttgtcgtgaaggacagagcgccgcctaggccggccatcttcaacagggagcagtgcagtgacgattaagaggactacctcatggccacgcagcagactcgggccaatatgcctagggcgtctaacagcgagcagggtcagtcgcagcagaccgacaggaagaacaccgaggacccggcatatatcttggacggctccc

SEQ ID NO: 41071 - DNA, 329 bp, Triticum aestivum
  Clone ID: PAT_TA_41071
tacgcctgcggtacggtccggattcggtcgcccacgcgtcgacttgctgaaggagatatctaccagatttttcggtcatatcactgcttttgtaacatgcagagaagctgcaagctggattcaggaaggcatgttcctccagcacctgccgaccaggaactggcgcaccacgagcttgagatggtcctctgagggcgtcatggcacacgatgtaagagctcgcccagccattcgcactaggagactatgcgtgtgatcatgcctggagcaggtggcgggcagtccacttcgtgtaatgtaactacatataccctcgggagcaacatggg

SEQ ID NO: 41072 - DNA, 188 bp, Triticum aestivum
  Clone ID: PAT_TA_41072
agaaaccaagtgagaaagcacacgacgccacagacaggagacaacaagccaggaggcatcttgatcccaattgacagcaacaggcgaatcacggcctttgatatgaacagaaaagacacacctgataaaacaaacagcaactcggcccgatggcaaaaaaaaaaaaggcggcgtctagaggaccaagc

SEQ ID NO: 41073 - DNA, 282 bp, Triticum aestivum
  Clone ID: PAT_TA_41073
ggggggacccacgcgtccgcggaggcgtgggagcgccgccgcctacaccgcacccccaaaacgctagggcgggaaccgccccagcagaggggcggagcgcaggagccccgcgtgtacgccggcgtgaggcgcggccacaacgacgtggtcacggccatggcgacggccatggacaaccggccgttaagcgcctgctcctcccgcgacaagacgctgcgcgcctgggacctcaccaacccgaaccaggccagccaggacggcagagccgagtacggcggcccc

SEQ ID NO: 41074 - DNA, 288 bp, Triticum aestivum
  Clone ID: PAT_TA_41074
aaaccctagctagctcccttccgactgggggaagacacaaacatcagatgagacccagcccaggccatggaggacgaccacgcacatcctagcgggcgacgacctgatgatgggggacgggatgggtgactacggcggagccgaagggacggggatgaaggtggacgaggagaaagagatcgggaagcaggggcttaagaagaagcagctcaaggagggcgaagggtggaacacccccgaggtcggcgacaaggtggaagaccatcacaatggtaccatcagagatgg

SEQ ID NO: 41075 - DNA, 333 bp, Triticum aestivum
  Clone ID: PAT_TA_41075
cggacgcgtggcgtcccaacaaccaaaccaccccccactgccaaatccaccaacacggagcccaaaggcccggagacgccatcatcagcacccacgacggcgaccccgatgggcgcctccgcctccgacctctctctccccgtggccgcctccttccctggcgcggccaccgatatcgcgggcgccgccggctgcttcgccctaggctacttcctcgccctcgcccgcttccccatccacgcctccgccgcccccgactctggcgacgacgataccgaggacgactcggacgaagatgatgacaaaaattcaggccgcgcccggccggcgaag

SEQ ID NO: 41076 - DNA, 197 bp, Triticum aestivum
  Clone ID: PAT_TA_41076
cccgtcgaccagctccgcgacctgggcgacctggctgcaggggccccaatttatctgcactgcagctccagcctggactccaccccaccacacatccatgtctccgatcccccatccagcaaaccccgctcataaatcataacacatatacacttacgcaacctcggagcaaggcacgcttctccaagggctaacgg

SEQ ID NO: 41077 - DNA, 320 bp, Triticum aestivum
  Clone ID: PAT_TA_41077
cggacgcgtggggcaagctgaaggtcgtctacaagaagtactcgagcgagaagctcggaggagtcgccctgcgcccacctgcgaccgacttgtgcaaatgagctgcccgcctgtttgttactttgggtttggatttgggagtgcgattggaaggattgtctgacatttcgccgtgttggttggttaagaagctgtttgcttgttgtttcgtcgcaagtcaggcatattatccgacttgttgacaactattattaggatttgtgtgataaaaatacatctcttctgaatgttatctacgacagttattcaattatttgaat

SEQ ID NO: 41078 - DNA, 344 bp, Triticum aestivum
  Clone ID: PAT_TA_41078
aacccggggggacccacgcgtccgcccgacgctgaagcaagcagacaccggaccacaacaactccacccgcaacagaaaccatggaggtcggcaagaacaagcgcatatccaaggggaggaagggaagcaaaaagaaggccgtcaatccgttcaccaagaagcaagggcaagacataaaagcgccgcagatgatcaccagccgcaacgtcgaaaaaaccctcgggtccaggacacagggtaccaaaatcgcatcagagggactgaagcacaaggagtacgaagaatcgctagataaaaataaaaacgatgagaaccagacctacaagaagaacagaatcacggc

SEQ ID NO: 41079 - DNA, 252 bp, Triticum aestivum
  Clone ID: PAT_TA_41079
gcacgcgtggggttgactctattatttgaattgatggacggaacatcgagggtcagatgcaccaacggcatggacgacgacatgaaagatgccaggcagtggcttgaggatgtactgagaggccaaggcagtatatgacaggtattgacatagtgaaaggttatggcctgaggaacggtccggacagagacgacagccacattgggtgggggtgcatgaagcacattgtcaagagaggcgaccaggactttg

SEQ ID NO: 41080 - DNA, 330 bp, Triticum aestivum
  Clone ID: PAT_TA_41080
tgttagccctggccaccgatttctttccccctcctggccagatctgtggtcggcctccggcgaaatcgaccttggagcctccagtctgtggtggatccattcatccagttgtagatttggctgctgttgactagcaagagtactccgtgctagtatagtacgagtatatctgaactgttgaattagaaagatgaagaataattgtgtattcatgattgctgcttgttctattgttgcacgtactggatgttactccacatgccgtgttgcatgaagttagcattctgttgacctcaaagttgtatttgtcctgtttattcaagcaaaagg

SEQ ID NO: 41081 - DNA, 285 bp, Triticum aestivum
  Clone ID: PAT_TA_41081
aagatacggaccgaatccgggacgacccagcgacgccagcgacgtgaagcaactgaggcatgacgaggaagcacaagaagagctcaggagcgacggcctgctgactactgggagttgcttgcccaaactggggtgcactgtgctcgtcaacccggaccaggataatgcacaagaccgacggggtgtagacagcacaggctaaagtcacaaacaaagacgacaccagaaagaaataaggacatgtggcagatgccaaccactatagtgtgaacctgacttgggtct

SEQ ID NO: 41082 - DNA, 332 bp, Triticum aestivum
  Clone ID: PAT_TA_41082
gccgcgtcggtgggggctctaggcgcggcagtgatgtacggaagagcgaggaacagtggcaccaacgacatgggggaggacatgaaagcggccaggcagtggcttgtggatttcctgagagggcaaggagttctgacagggatggacatagcgcagaggtttggcctgtggcgcgttcggtacagagacgacggccacattgggtgggtctgcaggaagcacatcgccgcgagaggcgacgaggtcttcgagctgccgctctgaaccatccactccagcgtgcccgacggcccacgaccacaggtgcctccctctcacgtcactctgccgat

SEQ ID NO: 41083 - DNA, 372 bp, Triticum aestivum
  Clone ID: PAT_TA_41083
gtggccgcccgcccgcgccgccgccgacttctccatccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcttactcccatgagttgcctcgctatggtcttgaagttggcctcaccaactatgctgcaacctactgcactggtct

SEQ ID NO: 41084 - DNA, 168 bp, Triticum aestivum
  Clone ID: PAT_TA_41084
ttctatatcttgcactattaggcacgggtgcattccagcaaaggactcttctattagaatgagctaacttcaattaagcgtgagggtgtatcgtccacaagcaccatcaccggtgttgacataagcatgaatacttatcttaagacctaaagctcacaatgaaaggga

SEQ ID NO: 41085 - DNA, 226 bp, Triticum aestivum
  Clone ID: PAT_TA_41085
gggcgaccacgcgtccgacactatctgatcagtcaccatatttcttttctagcacggtaccactaggggtaggtagctaccctcgtagtgtccgaacatctagattgttttaaccaccgttgtgggcaccgactgacttacgtatagcttgactagatcgactcttttcttcgcatgctcgcatcgacgattgatgggagcgattccctaccttctagaactgctt

SEQ ID NO: 41086 - DNA, 242 bp, Triticum aestivum
  Clone ID: PAT_TA_41086
actttctgatcagtcaccacagtttttgtttattacaggggcactaggggtagaggggcaccctcattggtacggacatataattgattacacacgagcgggcaccgctgactacgtatagcttgtttagatcaaccttttttttgcatgctggcataaaatgtttgagcggttctttatcctagactgctatttgttgaataacaacagtcgaggcagaacctatctgagtgctaaattag

SEQ ID NO: 41087 - DNA, 421 bp, Triticum aestivum
  Clone ID: PAT_TA_41087
ctcttgcttcttcctagactatccctagattgatcaaatgtatgtgcaacaaatgaatcaaccaatgcaaatggcatatggggcaaaaaatgtatcggatcttccggcatattgttgaacaacatgtgggcatgccctgcgttttccacttggagttgcgacgagtcgtacactgtctcctcaacggcggcatcttttggaaagctattcaggatgcccggacactggaggacggaacggagtcgggttctgtcgacgagttctttcttgccacggccacaacggacggatcagtcgcagttgccataccgaacgcgcccaagcccatcttcttagcggtcatctccacaccggccctctctgcagctacctttcccatcacttcacactcgcattgcttcctacgagctaccactgggca

SEQ ID NO: 41088 - DNA, 313 bp, Triticum aestivum
  Clone ID: PAT_TA_41088
gcggcagctaccgatgtttaatattagcaatccaagctgcgtgcaggcaaagaggtttaagaaccggtgagggaaagggtcccaatcctctgacccattgtgcagtgactgatgcatgcatctaccattttatagccggacattacattccatgttgttttcttctagctaattatgggcaatatgtcaccgcgatgtagttttttgtgatttgctgcgatttgatctatgacggcacgtggacagtttgatgcccacactggccaattagcctcttaggcacttgcaagaactatgagagatttgctttggc

SEQ ID NO: 41089 - DNA, 338 bp, Triticum aestivum
  unsure (1)..(338): unsure at all n locations
  Clone ID: PAT_TA_41089
cggacgcgtgggggagaatcagaatcattcggtggcgggggcggtgctgtactttttgcgagagagtgcttctgaagttggacatttgcatcgctagccctccttcccttgctgcagggaatctttggagtttggagcacacgtatagaatttacgcggaagaacggtggttgaatgtaaaatatccaccgccgtcgaggggggattcgttctcgctctcctccgccgttgccgccgtttccatggcaatctcgaggccccggagccgcgccgtcccctanatcccgctcctgctcctggtcctcctngncccgtaaatctactccgtttccaggcta

SEQ ID NO: 41090 - DNA, 330 bp, Triticum aestivum
  Clone ID: PAT_TA_41090
cggacgcgtgggtgagaatcataatcattttgcggcgggggcctcgctggactaagggctaaagagggcttttgaggttgtacattttaatggctagacttccttgcctcgctgaagggaatctctggagttcgcaactcacttatagaatttacccggaagaacggtggttgaatgtaaaatatccaccgctgggaaggggggattcgatctcactctgctgcaacgctgccgccgttatcatggagatctagaggccccatagccgggccgtcctattaattcgacttctgttcttttaacacctcgtccttttaattaattcagttt

SEQ ID NO: 41091 - DNA, 132 bp, Triticum aestivum
  Clone ID: PAT_TA_41091
tcgccgacgagtgggtgcacgcactccgtcgagtaccgggtggactacccgttcgggtacctggccgagtaggggttcccggaactggtcgtggacgaggccattgagctgatggggttcgacgacaacgac

SEQ ID NO: 41092 - DNA, 423 bp, Triticum aestivum
  Clone ID: PAT_TA_41092
gaacaagctcgcctagcgcagcgccatctcctctctctctctgctcctccgccggagcttatcattcttcgctgaaccgccggcgacgtacggccagctagccgtggttctttgcctgctagagctgcgcgcggcgaggtggcgtgcctacgcccgcaccgggaagatcgacccttggatgctcttcttgtcgattcatcggatagcgaggtcaatcccgcccggccctcggagatcctagtagcctcgccatcgaagcagactgctggatctctccgacacttgcgaccatgatgcagcacctggacttctcccaggccagcacctccaagaagtggacggccaacagcagcaagaggcagccgggccaagggttcgatgcttcgaggaacagcatggagttcgccatggaggcgccccaca

SEQ ID NO: 41093 - DNA, 365 bp, Triticum aestivum
  Clone ID: PAT_TA_41093
gaacaagctcgtctagcgcagcgccatctcctctctctctctgctggtccggcggagcttatcattgttagctgaaccgccggcgacgtacgggcagctagccgtggatctttgtctgctagagctgcgcgcggggaggtggcgtacctacgtccgtaccgggaagatcgaccctagtatgctcttcttggcaattcatcagatagcgaggttaatcccgtccggcccttgcagattctagtagacttgccatcgaatcagactgctggatctttgcggcacttgcgaccatttttcagtatgtgttcttgtcggaggccagaaccttcaaaaagtggtcggccaacaagctcaagaggtagccg

SEQ ID NO: 41094 - DNA, 99 bp, Triticum aestivum
  Clone ID: PAT_TA_41094
cccacgcgttcagtccacccacacttccatttatcaatcaagccccaccccaggcaagggccttttgatcgagggaggggatacttcattattcacttc

SEQ ID NO: 41095 - DNA, 414 bp, Triticum aestivum
  Clone ID: PAT_TA_41095
cggacgcgtgggccagagatgaatgcctttcgtgctagccttgcagaagggcttcctgctgtcactcctcacatcccaggagaacaagcgattgttccagaacctgttcgcgaacctcccgttgaactgagtgttcaggagctgcttgcccttgacccatttgacaacttgaagaaacagtttatcgtcaaggttactatcacaggcttgggctctgacaaccgctggtggttcctctcatgccggaaatgccataaaacagcctacacctccggaaggcagtaccgttgctcagactatggttgttcttctatcatagcagatccttcatactgcgtgtgcactttcggaagcgatggcgcaaatgaagcagaatttatgttctttgatagggctgcaaaacaagttattggc

SEQ ID NO: 41096 - DNA, 345 bp, Triticum aestivum
  Clone ID: PAT_TA_41096
cccgaattcgagccacgccccacgcgtcccgtggaagagaatgaacatcatagttctttgtcagccgctctttactgtgcgtgcgcttgatcacaacaaccaccccaaccactattgagaatgttacaacactgtggctgaaacaagcgaaaaggctcaatcccccactcgacagagagtaacttccaacggccaccgcatttcttgaatttacaccctcatcacaggaacctgtagtcaactattctctttatctgcagagattaagtattccggctccccagtggtgggtcttgtaatacttgcatatgcgggcaggcacccaccattttagatctttttttt

SEQ ID NO: 41097 - DNA, 327 bp, Triticum aestivum
  Clone ID: PAT_TA_41097
ctacgcttacaagttgatagtaccatccttggtccttagctggattacaatttcacctctagtcaggagaaaacgggggatgatgctaaacatgaggtcaaataacggttgggtactcgggaataccaaccatttcacaaaagccgtttgcagtgtagtaacatacggcgccacctgtaataattatcccttttttttaagtacaagccagctaggcagtcatcctgaagtttgggcttagaaactcctaggaagatgttgtttgggaaacccatacagcatttttttttaagacctagctaataaatcactacccacttggttgcc

SEQ ID NO: 41098 - DNA, 411 bp, Triticum aestivum
  Clone ID: PAT_TA_41098
gtcgtggaaggcggtgaagtcgtctcttcctcctcgccaccgcctccctacggaaccgtcgtcggaaaagcgtacgtaagatgataatacctactccaactagtaatacatggagggaagtagcaaagtatgcagctgcacaagaatctgcatgcatggtgctgcccttgatatgttgatctatccgtgtgagtgtgggttcacatagcttgcaacagaacgaccgcagagttggctgcattatccatcgggacatgagaccaaacaacattcttgtcacacatgattttgaacctctggttggagattctggtctagcacgatggccacccgattgagacatgggtgttgaaacaagagtcatcggcacatttggttttctggcaccagagtttgcgcagagtggacaaa

SEQ ID NO: 41099 - DNA, 253 bp, Triticum aestivum
  Clone ID: PAT_TA_41099
tagaagcttaagattgaggggatttttaaagcgggttggcaaacacctcctgagttaattcctttgaggcctccaacaagctcgcgacacttcgagaagagcttggatatattatatatttcccaaaaaaaaaaaaaaattttccttttttcaccccgggtgataccccccatattttggagaaaaaaaatacacggggtgaacacaataaggagaatctcatttctgctgtaccaaaatgaaaggacttata

SEQ ID NO: 41100 - DNA, 221 bp, Triticum aestivum
  Clone ID: PAT_TA_41100
gcggtgttgcaggttcgtgactagacctttttctaactaaattttttggttgggtactggggaacaagtggccaggctattggttcttcgaataaaccattaacttttaggggtttgctgcggttggcacaaagagggtacttctggggagaaggtggcttaaaacgagaaaaaaaccttttttttttaaaaacaagggcactttggtatcaaaatccagg

SEQ ID NO: 41101 - DNA, 427 bp, Triticum aestivum
  Clone ID: PAT_TA_41101
attcaccacttccctcttgaggccttagattcacaaggttgctcatttgtgcattccttatttctcaccagtatttctattaagccacactcaggaatatccggctttacaatactcagaaggcttgttctgaaatttgttgagatattaggagattttccaggcttgctagcaaaatgttcagaacttgaggacttagtgatcatctggtgctatggtgtgcatgacttaatcataccacacaaactcgataaacttcaacatttgcggatttccggaacggacgtccagatggttgagtttcatgctcctgatctttctcattttgagtacaacgggcaagtgatccctatagtgcttcatggctgcacaaaattagagaaggcaacaataaagtttaatggcactcaagcactggcacatgcat

SEQ ID NO: 41102 - DNA, 365 bp, Triticum aestivum
  Clone ID: PAT_TA_41102
cccacgcgttcagccacgcgttccttggaagggcgcgccgaccgccgtacacggtcgggaggttacgcagaggaagctatcttctttactgacgcgcgttgtcacaaccatgcacactattactaactgtgtccataaatccacatcgaatataggggccgtcgcggctgtccgtctatacatggaaaaacgatcggctttaacaatatttcaacctccattttatcaaactatgaacactccctctttaggtgggacttttaggacaaatttttgcagaacccctatttatttatttttttaaacacattcaaatctatattccctcatgtgacaattacctcgataaattcttaaagaatatt

SEQ ID NO: 41103 - DNA, 423 bp, Triticum aestivum
  Clone ID: PAT_TA_41103
cggacgcgtgggcggacgcgtggggacttcttgaactggactagagttgaccatccgctgtattcatccaatgcctccattatgttagagtgcctggatttcttcgcagtattgccgggaagtaacaatggactggacatgtcttcagcaatcccaaatggcgccaagcatgtcctcaaaatgggcctgaatttcggtgaagacgtgtacgtgataggggtttatgatctcaaacgtgatgtctttgtgccagatactgatgacagtcggctatggccgaggatcgattatggcaatttctatgcttcaaaaacgttctttgactctaaacatggaaggaggatcatatgggcttggactactgagactgacagttcttcagatgatgttgcaaaaggctgggcaggaattcattcattcccc

SEQ ID NO: 41104 - DNA, 429 bp, Triticum aestivum
  Clone ID: PAT_TA_41104
ctcacgcgtacggggggagccgccaccgtcccttccccttccaaagcttgcgctcttgctctattccccgccccaacgcgccggtggccgtcagcccggctactttttatgcttcaggaagcaccgccttgttttctgatcagcggcggccgcagtcgagctcgagcccgggtgcggtggcgcgtttttgagcatggctgcggtccaaagcggtggtagtagaagcacagggcgaggaacacccaccggaggcgctcgatgtggctcccccagcaccctttatacgctgactgtaaatgcttacccagggcccctccttgtcctgcattggcagggttaggatttgctataggattggtgactgccgtgagctgataacatatcaggtcactatgatctcccgtgcctatagatcgaggatgctttggt

SEQ ID NO: 41105 - DNA, 422 bp, Triticum aestivum
  Clone ID: PAT_TA_41105
ggacaaccagtacctgtgtatactcctagaccatctaattggtcggcgccgcatgctcaagtacacaccagagcatatgcattgctttactatgttttgggggcgactgattccacaaaaaaactgcgttctagtactccagagtctttccgtcgataaggtaccatttgacaattctgccaagaggtagagttcaggaatttaacactactagacggtttatgaagaagattaagcttacaggtacactatgcattatatttaagaaacctgtcttaatgaaaggaggagctcacatctgatttataggttgcgtagtgggtatgtgcttaaattcggacagaaagggtgatccgaggtcaggttaacaaggcagcatagctcgaaccacgatgtgctttaaggagaaaaagggaaaatac

SEQ ID NO: 41106 - DNA, 203 bp, Triticum aestivum
  Clone ID: PAT_TA_41106
gactagttttaggcggcgcccatccgttctttatctaaaacaaaaagcttgagagacattggaccaaaccaaagctgtttctttcaatgactatcggaacactcagggtggggctaccagcttaaattaaacttgaagctgcacaagcacttcaccctaccatttgttgctaagcgaaaaaagaacattacattgtacaaggg

SEQ ID NO: 41107 - DNA, 409 bp, Triticum aestivum
  Clone ID: PAT_TA_41107
ctaaaaggtgacatgttcaacaattaggtgtagtggaaatgcgcatgttgagatggatgtgtggccacacaggaaaggaccgggtccggaatgatgatatacatgagtgagttggggtagcaccgattgaagagaagcctgtccaacatcatgtaagatggtttggacatatacaactcatgtgcatagcggacggttaaagcgtgctgataatgtgaagagaggtcgggggtaaccaaacttgacacaggaggagtccgtaaagagagttctgaagcgctggaatatcaccaaagaactagccatggacaagggcgcgtggaagttagctatccacgtgccagaaccatgagctggttttgagatcttatgggtttcagctctagcctaccccaacttgtttggaact

SEQ ID NO: 41108 - DNA, 187 bp, Triticum aestivum
  Clone ID: PAT_TA_41108
cggacgcgtggaccgacccatgggtggagacggtcgccatgagaagaggaggtagaggcaggctcctgctccgcgttctcaaactatgctctggggcgcttattatggtagtaggtgaggcagtccatgccgctgcggactgcgtacatcgtgtgggagaactgcagcactaatccacccgctggag

SEQ ID NO: 41109 - DNA, 435 bp, Triticum aestivum
  Clone ID: PAT_TA_41109
gttgctcatcggcgcatgtcaacaaagaaggaaaagccacgaatcctaattcttggtggtgcacttgaatatcagcgtgtatcgaatttgctttcaagttttgatactttactgcagcaggaaacggattatctgaaaatggcagttgtaaagatcaaagcgcaccaaccaagtgttgtattggtagagaaatctgtgtctcgttatgctcaggatttgtttctggagaaaaacatttcacttgttttgaatatcaaaagaccacttctggaacggatatcccgttgcactggtgctcagatagttccctcgattgattatctgtcatcccaaaagctcgggaattgtgacttattccatgtggagaagtatgttgaagagcatgggactgctggagaaggtgggaagaaaatgctgaagacccttatgtttttt

SEQ ID NO: 41110 - DNA, 282 bp, Triticum aestivum
  Clone ID: PAT_TA_41110
ttgtttttttttttttttttttttttttttttttgggagggcaaaattagcggaaaaggggaccgttttttccttcaaatattttgtcgttgcaaatcaatacagtttttttcaacaggacaccaactcacatacattttaataatggctgggtacagggatacttttggcaatcaaccaccaaatttattaaatgttttttgggtttattttattcattcgggtttggtgggcatttgctgaatccgggggggcttattaaggggattgagttttttattt

SEQ ID NO: 41111 - DNA, 392 bp, Triticum aestivum
  unsure (1)..(392): unsure at all n locations
  Clone ID: PAT_TA_41111
cccacgcgtccgctctcgcctagctttaccatcgggttagttgcgagcggcggcggcagcgatggcggcggaagacgtggagttcgtggactacgagcgggacgacggcgacgacgggatggaagacgaggaggaggacggggaggttttntcccaagcgctaacaaggaccgatataatctatctagcctgtgggagtaacagcatgaagacttttatttgtagaaagctttatgtccgagcctatattgagatgatgtggatactgagttcttcaacagctattggttgcatggataaaatgattcattttaaagagaaatgactgtaggcgggttaagaaaataatggagtggcacatttgaaggccccgggtctaatggcttctgaca

SEQ ID NO: 41112 - DNA, 236 bp, Triticum aestivum
  Clone ID: PAT_TA_41112
cccacgcgtccgtaaactggtactagtttgttgtgtctaactcgtgatctgtctgtggacacagaggggacaattaacagagttccaaccacctggtgcatgacctaaccattgagcggcggaaaatacatgtccggtgaggggcggcgttcatgtagttaaccatggcgtctcttcattaagagttctcgtgggacgtgctgatcttacccgtccagttgagccccaagggcctg

SEQ ID NO: 41113 - DNA, 277 bp, Triticum aestivum
  unsure (1)..(277): unsure at all n locations
  Clone ID: PAT_TA_41113
cgcatatacatgaggctcagagttgntttcgccgtgcaacgctaaatatggccctgaccatgctcgggggttccatcaaccaatgaaaactattccaaatgtactggggatatatggcgcctcagatgcaggaaagagagcttaatcgaggcgtggaaggacacctgattgagatgaagcgatttgggacaacaacgtgattatgtacacgaggtgtacgatatcagcaagggagctcagagggcttttccaacgaaagacaaggatggttaaatac

SEQ ID NO: 41114 - DNA, 244 bp, Triticum aestivum
  Clone ID: PAT_TA_41114
aatgggcttgctttagatgatcctcctccttgtgacgcatgtgtggcaatggtactagcttctctggtgaagtaatctttgaacatggagctgtttatacatgcattttcccaaatggcatgtgcaatcttcagatcattcatcctgatgattcatgcattgtggatgtgttaactgtatgagttctctcgagaccctagaccaaaatgtcttctggagttcattcgagttggttggtgccttt

SEQ ID NO: 41115 - DNA, 343 bp, Triticum aestivum
  Clone ID: PAT_TA_41115
cgaaaagtaaaaatccatcaccacttggtctcggaatgattaaacctataaaaatcaggtgcaaagtattggcccggtcaaactactagttaaatgagagcacatgataatttggatgtttactacgaccgggaagttaggcacccggatcgcaacaaaccaattctatgtacactgtatgaacaacaccacccaagaagcagagcttgctttccccacagatccgcacgatctcaccgaaatgttgccacaatcaggggtgccaaaccgcacgaactggacccctcacctcacattcagcacaattccactagcatagtgtaacaacagggaatgcaactac

SEQ ID NO: 41116 - DNA, 273 bp, Triticum aestivum
  unsure (1)..(273): unsure at all n locations
  Clone ID: PAT_TA_41116
attcgtccacgcgtacgcccacgcgttcgtggacgcgtgggccgccggccataccgatggcggcgccaccggcggagccgccgatccttcgaacccacgacgagctcctcgaggagatcttactccttctccccactgatgctgacttaacccgcgcctacctggcgcgcgccttctttcgccgtcttataacaggtcacgccttactacgacgctaccgaaccctncacccgccccctatgatcggcgtgctcgaagtcgacgacaatgcct

SEQ ID NO: 41117 - DNA, 315 bp, Triticum aestivum
  Clone ID: PAT_TA_41117
ccgaaacggacatggcgctcatcttggatgtcgtgcgcttcaaatacactcttaattggcatacattgacgcttatgtgggatgccatgaacaccactgatgaagcaacatgacttctcatgaggatcatgctaggatcaaggcgcaggtcaagtacttcattgctatacacaacgtgttgcgggcatacaagatggaaaagcatggcaacatattgtgtggaagatgtacccaatctactgacggatgagaatggagacactgttacaactactttgtgccggctagtggaatctctgccaggtaatgctggat

SEQ ID NO: 41118 - DNA, 404 bp, Triticum aestivum
  Clone ID: PAT_TA_41118
gctggtcaccaagagggagagggagaagcaggagctggagagggaactggagctgtgtaagcagaaggtgctgcactacgaggacagggagatgaggaggatgccagccttcaaggacaatgcgcgtagtaccaacggcaacggcacctccgagtcgtccagcggcgaggatagcgatgagaattccgatgactcctgcgagctgggcgagtctccgagcggcaatcttcagagctcgccggacgctgttcttagccccagggcggatcaagagaacgccggtcatcttgtggcgctggatgattccttgacgtacatggagatggagaggctgtctatcttggaggagctcaaggcacttgaagagaggctcttcacgctggaagacgacgatatcaacggca

SEQ ID NO: 41119 - DNA, 333 bp, Triticum aestivum
  Clone ID: PAT_TA_41119
cggacgcgtgggcgagaattcagtgagcccgctagctagctagctagccaccgccatggcttcccctaagcttctcctcctgctggccaccctcctcccgagctgcggcctcctcgtcgccgacttcgcgccgatgaccctcaccgtggtgaacaactgcgcgtacccgatctggccgggcatccaggggagcgccggcagcgaggtcctggaggggggcggcttcttcctcccgtcgctctcccaccgctccttcccggcgcccgcccacgcctggtccggccgcgtctgggcgcgcaccggctgcgcgccctccggcgccggggcccggcc

SEQ ID NO: 41120 - DNA, 391 bp, Triticum aestivum
  Clone ID: PAT_TA_41120
cggacgcgtgggcgcaggcagaggggatcgagaatatcccagcttcccaaacccgactctagctagacccgtgccgattgatttccggctgaaattctgcggaagatgagctccgagtccagggagctgctcggaatcgaccccaacgagctccgcttcgccttcgagctaaagaagcagatctcgtgttcactgcatctgacaaacaggacagaccaatacatcgccttcaaggtgatcgaatcattctgattgctgtttatttgtttcgctcaaaatctgagcaaatttacagtcatcttccatctaagaaacaatatggtcagatggtaccgaaatgagcccgctccccccgcgttgcccccgctcgggcgacttgggcgggaatcgc

SEQ ID NO: 41121 - DNA, 235 bp, Triticum aestivum
  Clone ID: PAT_TA_41121
cccacgcgtgcgcggacgcgtggtcggacgcgtggattgttactaggtgggaagtacggatgtgatagtttgaaacgagttcaaccttaggatacaatatggacagtgccatgcactattggtaaccatcgtgtctttgaaaaatactgtaatcgttataattgaactatatacgattgaatggtcatttattgtatgatcggtcgtacggacatacgattgctgaacttgaaat

SEQ ID NO: 41122 - DNA, 399 bp, Triticum aestivum
  unsure (1)..(399): unsure at all n locations
  Clone ID: PAT_TA_41122
cgaatcgagcccaaccgcatcgtgcgtgcgcacccccactccccccctagggtttcgaggttctccgacgatgtcgctgcggcccaacgagcgggccgaggtgcggcgcanccgctacaaggcgtccgtcgacgccgaggacgggcgccgccggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttacccgcgatggtgcaagcggttctctcggacgacaacgccgtgcagctcgaggccaccacccagttccggaagctgctctccatcgagcg

SEQ ID NO: 41123 - DNA, 398 bp, Triticum aestivum
  Clone ID: PAT_TA_41123
agcagcggcaagtcgagcgtcctcgaggcgctcgttggccgcgacttcctgccacgcggctccgacatctgcacgcgccgcccgctcatgctccagctcgtgcaccagctgcgccgccccgccgacgccaagagggatgagtgggccgagttcctgcaccaccccggctgccgcttctatgagttccccgacatccgacgcgagatccaggtgctggagcagttgagaggacagtgaccggtgttctccaaggcgaggtacactgtcaggtcgttcggtatcaggctatgtttataaagcggtaaagcgaagcgaggcgacgctttacacagactctgaacctgatgggcagtataatagagcaccatgtagtgagacatatatatgttgattctaat

SEQ ID NO: 41124 - DNA, 405 bp, Triticum aestivum
  unsure (1)..(405): unsure at all n locations
  Clone ID: PAT_TA_41124
cccacgcgtccgcggacgcgtgggctagctattttatgattagtaaattgtttgcagtaatgtactacctgcttactcttgggagtgtggatgactatgattttctttatgcttattatgtgcaagcatagtgttctttgcacaagcatgatgatgatcgaataaattatagttctctgaatgcatccttttgtcattaggtgatgttttaggaaaagatccttgtgtgttgttgaattgtttacaagaaaacaactattcgggagtacatagagatagagtgctttttagtagaagcaagatagagttgatgtcgattagacttaaccgggtttcttcaaatgtaatgggttgtcgtatgaaaactatngaactaaaaataatctagcgagcaataataaaatg

SEQ ID NO: 41125 - DNA, 262 bp, Triticum aestivum
  Clone ID: PAT_TA_41125
cggacgcgtggggtagttctgatcatgtacaacggcacactttccagcgtcgacctgagcaaacgatgatgcaaggctgctcctcctcctactgcatgtcttcattgacttgattcttcgacatggagatatttaaagtcttcacttgttcattgtgtcatctgctgattacttctatgttttttgcaaagcatgtaatggttttgagtagttgatcatggcctgatggaatgttttgagtagttgcaaagcatgtcaaggt

SEQ ID NO: 41126 - DNA, 348 bp, Triticum aestivum
  Clone ID: PAT_TA_41126
cggacgcgtgggtcctgtttggtgctgccttcaaactgttactttgttagtgccttcttccatcgtatactgactatatttgttcttccagggtgacctactgacctttgctgggattttcctgtgtttgtttggcggagcagctgattaatagctattcagaggaagtaatcgataggtagaggcgttgtggttcctgtttcttcaggatgtttgtgttccactcttcatatgtccactcttcatatgtccactcttcatacgtgaggtagccggcgatggttccatactcgaggggtggagattgaagttgcggttgtccagcaaggagcaagcctaagaggcttt

SEQ ID NO: 41127 - DNA, 346 bp, Triticum aestivum
  unsure (1)..(346): unsure at all n locations
  Clone ID: PAT_TA_41127
gtagagggttcttggtttctgtggacttggtgctccaatttttcgttcagagatattagctttgattctgaattctctgtttctctgtggggttattggttcttgtgaggggcttggattcttgttcagacatactagctcttattccgaatttttccaaaataattgttgaagaacaggacatggaggacctgaaacctcttcaggaaggtgtcccttgtcgtatttggtttgtcccttcgtgctttagctattgtggtttcaatgtggtaggggagcaggagtgtgctcaaggttgcctttactggagctgtctgtttgattagcgtgaatggngagaactgac

SEQ ID NO: 41128 - DNA, 375 bp, Triticum aestivum
  Clone ID: PAT_TA_41128
cccacgcgtacgcggacgcgtgggcggacgcgtgggttttttttgaaggggaaaaatacattgtttagatattttttttcgggaaatacattctttagacattgcaagggttctacccgttcttgtctatagatgtagctgtgatgtttcagttaggaaattagataacgcatggcatgctggatgcggacactttctattaccggaatattgtaagcgactattgtaaggcgcattgtgcggccgaacagaacgcttcaatcagccggtggtaaagaatagttgaccaaaaaatatcatcttaatttttcatggaagtccttcatttttgttaaggtattaaccttgcttttaaaacgattacatctactttta

SEQ ID NO: 41129 - DNA, 217 bp, Triticum aestivum
  Clone ID: PAT_TA_41129
cccacgcgtacgcccacgcgtctttccacgcgtccgcccacgcgtacggggacgcgttcgaggactcgttttcaaacgcgtggaactcagcataccagctgctcatagccagcctctagtgggaactagagggtctttgaagaacactgttatcgttttcatagagcggttatacgattcaatgggtgggaaggtcatgatagacggaaatgacata

SEQ ID NO: 41130 - DNA, 355 bp, Triticum aestivum
  Clone ID: PAT_TA_41130
gtagctacaggtttatatggtatttggcatttcaccaaccagtacaacatttataactatcaactccagaaatttgtcacagtttctatcattactgacatataaaaatgggaggtacagaacaggaccgattcggtacaaatacccgataactcatatactataaagcaagcacatttgtatgaaaatcgaatgaaaggtgggaatctaccgagagggatggcctcctctcgctgtctgtctgtctgtctgtccggatagtaaaaatttcaacatacaaaatctcacaacaagcatatatatagctaggacacgcatctgatgactatatatatatatatatatggaagctaat

SEQ ID NO: 41131 - DNA, 210 bp, Triticum aestivum
  Clone ID: PAT_TA_41131
acaaaaccgggcccaaaaaaatccaaagcgggctggagggccatgtttttaaggaaaattgcccagcaacgattaagggaacatactgggcctacaactgcacccatatgataccaaatggtttgagaaccgtggcaccaacctaaaacaaacggggggatgcgctaccatgaccaaaaactagtggcgggaaacaaacccccgcgcaca

SEQ ID NO: 41132 - DNA, 286 bp, Triticum aestivum
  Clone ID: PAT_TA_41132
cccacccaaaacaaccatcccctcgccgtccgagcgcctccgcgtgcccgtgacgccgacgcctcctccctcgccgggccgctccgccgacggcggcctccctccctcacccaccaccgacccatcgcccctcgccgccagatccgtccgccctccgcgccccctgccgctcgggcctaggcagatctgcgcgggcggatgcccaccacaaccgggaaggtgaagatggtccattggagaataccacttactgcggaaagaaccgtttctaccgtcggcgcgctgc

SEQ ID NO: 41133 - DNA, 396 bp, Triticum aestivum
  Clone ID: PAT_TA_41133
agattttgaactcgagcagagctctcggcgagggtttgggcggcggagggaggcgggcatggccgggaagaagcaagcggcggtgagcgccgcgccttccgagggcgaggagggcgccgtcgtccccagctccactgccaagcgcggggccggcagacctaagaaggaccccgtccccgccgccgccagccccggctccgctgccaagcgcgggcctgggaagcctaagaaggatcccgtccccgccgccgctgccaagcgcgggtccgggaggcctaagaagggcgccgcccccgccgagtccggcgagggctctgctccggagcccgggaagagcgagatgggggagggggagaagggggcgaccccgaagaacaggggaagggggagaaggag

SEQ ID NO: 41134 - DNA, 396 bp, Triticum aestivum
  Clone ID: PAT_TA_41134
gcagttttcttcgatagttttgttttgccattgctaccagtcatcagattttggtaagttatctaacactgctattagagtccagatgcgccttttaggtttaggagcaccgctgtctagctcagcaggcgagagctctaagtgttgttatgtctgaaattccatggacaaccttgttttgttggcatagttattactagccatgctcggcagtatgacacacattgtggccgatggatttcggttttccttgtggtgtaaaaagaaatatgtattagtgtttttcctatttaattgataactacttggatcgtggagggtggtgttgaacgtgtatgagtgtttgatttacttattcctctcacagatgaggagagtagaaagtagcagttggta

SEQ ID NO: 41135 - DNA, 408 bp, Triticum aestivum
  Clone ID: PAT_TA_41135
ggggccgctgcggggccgtgccccgtggtcaggttcgacatggccgacttcactgtcgccgaccgcgtcagcgtcgggctccacggacggtccgatgagatgatattcgaggccacggtgcgcgatcctagcagtgagctgtacgggtcgacggtggtgttgcggcagctgactagctcacaggcgaagcggaggggccgccgcgcgctagaggtgctgaagaagctggcccgtcgccagatgatgtaccactcttacgcgatgcaggtccatggctacgtcactccgagcaaggccatggaagagggtgatagtccgcttgtcttggtgcacgggtaccatgggagttactccttgcgtcactggttgcaactctcggattggcttccaaccttggaagcaacatta

SEQ ID NO: 41136 - DNA, 299 bp, Triticum aestivum
  Clone ID: PAT_TA_41136
cggacgcgtgggcgccgccgccacctcttcctcgcgccgccaccagcaccactcctttcgagcgcgtgccgcccatcgtcctcctatcctcctatctcgccgcccattcatccgagcccgacgacgccagatccgcgcgcagcccatcgttctgcacctcccgcagcagatccagggcactgccgaatctcactgtcgacagatgcaccgccgccctgcagcctcggcgtcgcggtcggctggctcgccaccgcgcgcgtgcttcattgcgcgccgctccgtcgagcttgatccttgga

SEQ ID NO: 41137 - DNA, 307 bp, Triticum aestivum
  Clone ID: PAT_TA_41137
gaaagtcgtaggcgcacctatagagacagaaaggcagctgaacaaaaaggagttgaaaaagaaggaactggctgaacttgatgctgtgttagctgagttgggaatttttgaaaacacatgcgatgctgcacaagatggaaacaacactgctgataagaaaggtgcgagccaagctcgtgatggagagagaaaggaagactcacctgccccttcagagagcaagaatgccaagaagaagaagaacaagaaggacaagagcgcgaaggaggcaaaggaagcttgtgtggtcgaagaggctaccagtgca

SEQ ID NO: 41138 - DNA, 212 bp, Triticum aestivum
  Clone ID: PAT_TA_41138
cggacgcgtgggcgcattcgtattaagtggaggtggcgtaggtaccggtgccgtcaaatagcggtacagagaactctttatccaaggtaaaaccaacttgtaatttttgcaacaagaaatcatattgtaaaggtaaaatagaagctatttcccataatactggtatcatcacgattccttgatcaagaccgaaactgtattcatctaaaaat

SEQ ID NO: 41139 - DNA, 310 bp, Triticum aestivum
  Clone ID: PAT_TA_41139
cggacgcgtgggtttttttttttttttatgattttagtcaaatcaaatcataggatttattcatgatacccgggtatcaatgtggcagcatggcagaaacttttctgattacagtgtgaatgtgtgactaatcagcacattcatcgcagttgaacaaaaacggaaccagttttggttggatcatgaaattttggcttgaattctgcaaagacaaataacctttttatacatggggaatgcccaaaatcatggtccgagactggttggctataaaatctatgaagatgaacaatgggcttagaatctaaga

SEQ ID NO: 41140 - DNA, 353 bp, Triticum aestivum
  unsure (1)..(353): unsure at all n locations
  Clone ID: PAT_TA_41140
cacacctntactcgacggcaccggcggcgccgccgccgccacgcgcggntggtgttcctcaccgacttgccgccgccctgttgctcttcccctccccgtccgcccccaatcttctccggcgccaccacagcctcctctacctccaacctcctgctgccgtctatctccaatttgcatcgaagtcggtgtccgtgttcgtgcgggacaacttctccaagacggagtgcccagcccgaactccacagggatttggatgccataagaccgagcccttgacggaaatccccagtaaatcacctcgcatcacaactttcgaagaaccgtccaatatcgcgccgaattagccggaagaa

SEQ ID NO: 41141 - DNA, 394 bp, Triticum aestivum
  Clone ID: PAT_TA_41141
gaagaactccaagccacagtgtttcaccttgcaattgcggaaaaaacctacctttgacctgccaaattgcagcagccatgttcctctgctgccgccgccacctcaccttctcaccgctcaccgccgtgccctctcccagtggacaccgccctctcaagccaagaacgctcagagccccaatcctagcatccaagaaccccccaccacggccatggccactgccaaggcggcaatggcggtggcggtgcagcaacaccgatgccgcccaaccgccacccgtcgtcgaggccagtgtgtccggcgacggcgagaagaagagcttctgggcggcggtgagccttatcatcggcacggcggtcgggccaggcatgcttgcgctgccgtcgggcaccat

SEQ ID NO: 41142 - DNA, 389 bp, Triticum aestivum
  Clone ID: PAT_TA_41142
cggacgcgtgggagttctttgagcttgcagcagagttctttggtggtgcaagtaatgatgagggtgatggaaatcaccccacactttgcaaagcgttaatcatgagtgtcacttccatgcttaaagctgaggagctaaacaattctcccttgatggattctgatgttaaaaaaggtgttgacgatgctcagcacagctggcaagctattaccttcaatctggccctcggcttcagtcgcctctgatcaggctgaggccaacatctttctgttccttcataccttctactcctaccaactccttgacaggatggacaccagcgcacatcctcagcagctccaactcgtcaagaactttgcttcctctaaagcatgcacgccgtgccatct

SEQ ID NO: 41143 - DNA, 391 bp, Triticum aestivum
  Clone ID: PAT_TA_41143
gagcccgcccccgcgtcgcccgatccggcgccccgctccccggcgccgtcgccggccaagaggtccgcctggaagcagccctccccctccgccgccgcagccaacggcgccccgcacgccgacgcgccgtcgtcgccggccgtcatggacgccgaccactggcccgcgctcgccgacgccgccaggaccaagaccctgctcccggcccccgcgcccccctccgactcccccaagcctcccccggaccccgccaacgccgccgccgcctcatcggccatggcgaaccagtccaactcgccccggcacggcggcttcgggacgcaccacggccgccacaagacggctaggcgcgggggctcccgcggcagcggcggcggtggggaccactccc

SEQ ID NO: 41144 - DNA, 379 bp, Triticum aestivum
  Clone ID: PAT_TA_41144
cacctttccccgtccaagcattctcatccgcatccttatccatggcccccaggggagccgtgaagaagccggtggagaatactcctgcggggaagaagcccaaggctggtgaagaaggtgccggcgtccaaggagggcggctgtgacaagaagggcatgtttgaaggccaagaagagcgttgagactttcaagatctacatctttaaggtgctgttgcaggtgcaccctgacatttgttttttcttcatggttatttctcattatgaacttcttttattaacgacattttttagtaagcttttcttttgttttatctatcttgccgccttacaactatgttgtccattttcacttttctttgtgattttagtatctttt

SEQ ID NO: 41145 - DNA, 377 bp, Triticum aestivum
  Clone ID: PAT_TA_41145
gctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctctttctcgtctgatgaattctgtagctagctgtgtgtgttctgacagtgtcatctttgtacaatggtgctgcctgaattaatagtcgtgttgctgcttg

SEQ ID NO: 41146 - DNA, 391 bp, Triticum aestivum
  Clone ID: PAT_TA_41146
cctcctccccatccctcgcggtccgccgccgtacatcacatgtcctcctgccgcggcagctgagtagctagctcagctcagctgagagtggggggagggccggcgatagtgcaagggggcagcggccatgagctggaggagagggggaggggacggggccgtggccaggcggtgggtgctcctgctctgcgccgggagcttctccctcggcctgctcttcacctccgggatgtggacattgcccgaggcaaccgaggttgccaagccaaacgaaacaagagggaaagaggccgagctcgccgccgtagactgtgattctactaaggtcggacggaaacatgatttcagagatacgctacaggccttggacactcacaacgctgtacagaca

SEQ ID NO: 41147 - DNA, 162 bp, Triticum aestivum
  Clone ID: PAT_TA_41147
gggagaggtgagacctagccttccttcggcgaacattacattttacgacggcgcgtgcaacagagtagctagctcagctcaacaaatagtggggggagggccacattattgagcttggtggcatctggccattagctagatgagagggtgagggaacagttc

SEQ ID NO: 41148 - DNA, 228 bp, Triticum aestivum
  Clone ID: PAT_TA_41148
ccggagcggctgcagcagtagccggaggcgccggcggccatggacgcgatgcggaagcagctggacgtgctcatgggggccaacctcaacggctacgtgcggtaggtcaaccgcaagtacttcgaccgcgacgtttgccgcctttttctagcatgactctgcccctacgacctgtttcagatcatgaaaatggatctcgcaccctgtcctaaggtccacttgcttcag

SEQ ID NO: 41149 - DNA, 375 bp, Triticum aestivum
  Clone ID: PAT_TA_41149
cggacgcgtgggcgatggggaaggcggggttcggggtggcggcgggttgcgcggcggtgacgtgcgcgatcgccgcggtgatggtggcgcagcgggtggcggccagggcgcgctggcggcgggcggtggcgctgctgcgggagttcgaggagggctgcgccacgccgccggcgcgccttgcgccaggtggtggacgccatggtttttgagatgcacgcggggcttcgccttcgacggttgcagtaagcttaagattcttcttaattttcttcgacgcgctcttttacggtgttttaagaagtgtgtatatttttgccaatttgatcttgggagttaacatatcttttatagtttttgagaggtttaaaattattt

SEQ ID NO: 41150 - DNA, 346 bp, Triticum aestivum
  Clone ID: PAT_TA_41150
cggacgcgtgggcgatgggtaatgcgttgttcggggtggccgcaggtggcgcggtggtcacgtgcgcgatcgactctgctatggtggatcagctcaagtttggtcagtgcactctatttttcgtcgtttgctctttatactgattttgttgtttgttactgatttattgttgggtgctttttgtcctatatatatattgtttactgtttttaaattgtttaatatttttttttctttttttcctcgctttgtgggattatttttctttgtttttttttttttttttattggtacttttttttatttttattgatattattgctatttaattaggtttttattattt

SEQ ID NO: 41151 - DNA, 191 bp, Triticum aestivum
  Clone ID: PAT_TA_41151
cggacgcgtggggcagctactacccaccttcaccgtcaaccggcactgacccgaacactcctggtggcggcggcaacccgccatccccgaccactcctggtgtcgccgactgtccgacagccccgtccacctgcacctcgccgagcacccctggtggtggtggcttctacctattcttgtcttccattgtt

SEQ ID NO: 41152 - DNA, 387 bp, Triticum aestivum
  Clone ID: PAT_TA_41152
cccacgcgtccgtgtcaagctcggggttgggcgaatccccaccgccctcggaaaatcgggggaaacgcagctctaaaaccccgagattttggccccggttctctcccagccgttgcagctgctgttcgcctaggagctggcggtaacccgggatccggccggcgagccattctccccccgcgagccattcttccgcagctccgagctccgtccttccttccgccgcgacatcgcaatccttcgccattgggttgtgaggataaaccataatggccgtcaaggggggtcctgcggacaacaggactagaagcactgtgtctatatgcatagtgattggcttgtgctgcttcttctacatccttggggcgtggcagaagagtggctttt

SEQ ID NO: 41153 - DNA, 350 bp, Triticum aestivum
  Clone ID: PAT_TA_41153
acaatgcgtactcgtggtcaccatgatcgttcgcttcgtccattactatccgctctagctcgccaagaccttcgtgaggctccagctagagagcgagagcgaaagctcccttctgctggtgcagtggcggtccctgtggtgctcatgctctgggccgccatgttcaccggctgagatgctatgtactgtctgtgcatttctgactctaaccctgtggcgatgcataaggccttctacttctcgtgcggcatgggcgccttctgcactcagatcacctgcagtgggccctgtttccattcttttctcgttgtagtccactgctcttacttctgccacagcttctaccataa

SEQ ID NO: 41154 - DNA, 371 bp, Triticum aestivum
  unsure (1)..(371): unsure at all n locations
  Clone ID: PAT_TA_41154
ctccacgtcgtcttgatgcaaccttttatntacatgaattgtatgtcatgttcttacaggaggttatgatgttcatatttcctactttacttataaatgtatctaatttttatgattcctttttatccttataactaattgtcttcatcattattttttttttttacttattttttttttttttttttttttaatattttttttttatttttttttttattttttattttaaataatttatattacattttttttttttaaatttttatttttcttttttttttttatattttatttttttcattttaaattattttattattttttttttttacattttttttttttattttttatttttttttaatatt

SEQ ID NO: 41155 - DNA, 131 bp, Triticum aestivum
  Clone ID: PAT_TA_41155
acaagccgtacatattgctggggatgtctagccagccaagcacacgtcgcaggagaatacgcaggcggaagatgtaatcgacgatcacgcgctgatgagcacaccaggtggtaacgcctgatgcgcacaaa

SEQ ID NO: 41156 - DNA, 169 bp, Triticum aestivum
  Clone ID: PAT_TA_41156
cggacgcgtggatccaaatgtcaattttatgtttgtccaagcctgcaatgggcagcttctatgccgatgatggaaggcgaccactcatcccaagataatggatcatgtggtgtgcaatcccactactcagaaatgggtggccatgtctgccactgactggttcagaatg

SEQ ID NO: 41157 - DNA, 189 bp, Triticum aestivum
  Clone ID: PAT_TA_41157
catggagctactgtagtgttgatgtgtgtgtgggttgcagtgacaagttgctgatagcctactggggatggctctgctgttttgctccgacatggataccttccgtaaatgaacttgttctagcgaaaatgtttctgggctaggatgattgcaataagtaacttcagtgtgtttctgatgtcattttaa

SEQ ID NO: 41158 - DNA, 355 bp, Triticum aestivum
  Clone ID: PAT_TA_41158
gagatggccggggcagcgtcgtcggtagcgcccgttctcgtcatctgcttgctttctcttgctctcttcctccacaggttggccgcacttgttctacatttactcctctagtgaacctttggggatctcgtgtgctgaattaattgctgcagaggggatggcttcttagcctttctttgtcatgaacatgttagatttgctggattagcatgcctgccgtggcagatctgagcaagatttcgctcataaatcagccccggcggcatcctcgggccaccgcgtcgctcgcttaattgagataatttgggtgggcatgactatattaaacgttcttggggctaccatagttgttact

SEQ ID NO: 41159 - DNA, 363 bp, Triticum aestivum
  Clone ID: PAT_TA_41159
gatcccctccttcccaccttcttcctcctgcacagcctcctcccacctcccctccaccttccactgccggcgacgccaggggctcgtgcctccgatgccagagccgtactgccgcctgtctatctcttttgccctgccaacccaccaccccggagcgagatgcgcgcggctcccccgtgcccggcgaccttcccccgccggcgccgccctcccccgatccactttctttccccgctggcgccgccctgccccaatccaccttcttccctcgccggtgtcgccctcccccgatccatctatttccccttccctaggcatcgccgaacttcccctcgcctcgatctgcagcgacgcagacgattg

SEQ ID NO: 41160 - DNA, 123 bp, Triticum aestivum
  Clone ID: PAT_TA_41160
ctccatcttgaacctgaggctgcgtccgatccgaggcaagcaaatatctgcgtggagcgcaaattgtaagacccttcctcaaaactttgagagttattaacactaggtccatgacaagactat

SEQ ID NO: 41161 - DNA, 265 bp, Triticum aestivum
  Clone ID: PAT_TA_41161
gcgacacgctccgcacgcgatctccactcgctccgttcgtacggatcccctttctccctccccagccatgtcgtcgtcgtcggacaaccccaacacggtcaccgaccgcggcctcttgcagcaagagcagcaaggacgacgccgtctacatgaagaagaagcacgaggagaagacagaggaggaggagggcggaggcgggttcatcgacagggtcaaggacttcatccacgacatcggcgagaagatctaggtggctgtggggtt

SEQ ID NO: 41162 - DNA, 274 bp, Triticum aestivum
  Clone ID: PAT_TA_41162
atctgatctgatcctttggacatggcgtaagccatgctctccacagccatggcgccactccaggggggcatgctagagttctccaggctgaggagctcgtcgtcaatgccgatccggcggaatgccacctccgacgactccatgtccgcggtctccttcaagacatacgcggtgagcaccagcgtcaaatcatgaaaggcgccagactgaagccaagctcaaggtagatgagcaacaaacgccagcctcatcgggcacacattcttgtggtact

SEQ ID NO: 41163 - DNA, 252 bp, Triticum aestivum
  Clone ID: PAT_TA_41163
cccacgcgtccgaggacgcgtgtgacgcgatctacccgtaaaaaaaaacccggcgcacatcaagcccttgtctccccggacacagaaccctaacgctctcaccctgtaagtcgggcacaccacggatgattgtggagccaccgtcctcgaccgccggacctcaaagcgccgttactcccttcggtcacatcgagagagaggtccgcgacgttctccagctctgttccctggccttccctttcctaaaccccg

SEQ ID NO: 41164 - DNA, 228 bp, Triticum aestivum
  Clone ID: PAT_TA_41164
ttccgccgcgattatttcccgggcccagccaatttctcgagcaccgccgccgcgcgatcgcccggccatgtccggctacccctacggcggcgccggaggaggaggcggctacggggcccctccgccctacggctcctcgcccgccctctcggcccctccctacggtgacaagccttccaaggaaggcaaggccttcttcccctactacgctttcccgccccagcccta

SEQ ID NO: 41165 - DNA, 148 bp, Triticum aestivum
  Clone ID: PAT_TA_41165
tcgcccacgcgtgcgcctagttgcctatctcttcagttacccctcgccttctcgggcgcctgatcggaggcttggttcgtgcagtcatggcgaagacctaccccgtcgttagtgtcgagtactatgaggccgtctagaaggcccggca

SEQ ID NO: 41166 - DNA, 173 bp, Triticum aestivum
  Clone ID: PAT_TA_41166
cggacgcgtgggcgcgagagtacttcctagtatacatgatggacccatcgaccgcatacctgctcgatgagcttaccgacgactgctgcagcgactaccgcaacctgatggcctcggccgagcacgtcgacttccacacctgctgcctgtacgccagccagcttaagcggcgc

SEQ ID NO: 41167 - DNA, 227 bp, Triticum aestivum
  Clone ID: PAT_TA_41167
gtgtggcggtggtagcgcttcttcttcttgcgcgggttgctgttgtcggggtcgagctcgtcggctgaggcaccctactcattctactctccgactagctccttttattaatttctttgtacactactttaaccacccaacattatttgaatgttattgatattaacaataccactgtgtacatcatgctgctttacaaaaacccttttccttaccttaataattat

SEQ ID NO: 41168 - DNA, 226 bp, Triticum aestivum
  Clone ID: PAT_TA_41168
cggacgcgtgggctggtgtacttttcgcctaccatcagctccatatcctgtgttctggtatgaaggacgggtcaggccatgcctacaggggaagaaatcatgacgaacaagtcaagtcggttcccagtcctgccctctaaggatctggcgaacttctatctttataacgttggaaggcaataatttcttgggattggtggtttatcccaacattcgttttttgtgg

SEQ ID NO: 41169 - DNA, 362 bp, Triticum aestivum
  Clone ID: PAT_TA_41169
gtgcagggagaggaagggggtggctccggcggcggatggagtttcgctgggctgatcaagacgctcgcggaggacttgcctcctcgggacgagcaggaagcctcggaggatgaggacgactagcaagaagtcctgtctaacggatgtggaggccttttatgatttttacatttgaatgcaataatttctgtagagtgtggattttcctaacattcgtttttagtggttgcattgtacttcattagatgttcgttcgttggctttattgttttttaaaacttttactatcatttatgttgtttttttgtttttaatttttttctcttaattttttattggtttattttttttttaaattcatt

SEQ ID NO: 41170 - DNA, 313 bp, Triticum aestivum
  Clone ID: PAT_TA_41170
attggctcatcggcccatcagaggctgtcaatgctgagaagcgggcttggaaatcagctcgctaacaagagtaggaatttgaatctgagaagcacaacctttttgatccaactaggaacatcaaaaccaaatgggaaatcattgtgtggacttcagatggccatgcttacgacaaggaggcctcgctgctggagggggacgtctaccaggacaggcatctactgtcggatctgcatgatctatatgaccaaggacttcccttatattatatacttatgtaggggcgttttttttttttgtatttttagcttat

SEQ ID NO: 41171 - DNA, 269 bp, Triticum aestivum
  Clone ID: PAT_TA_41171
ttcctgaagctggaggaggaggtggtgatcccgactacgttcaaatgtgccattacttatgacttgctcttcaaacctgtggtcttggtttgtggacacaccttcttgttcttgagtattgctgagcatatgagcatcttagttgacactctatgctccttgtgcatgacgcatgttgcacatttttcaaaaatatgttagacttatcatacttttgtttataaattgaaaccagcgttttatgtaagtattttaatttgtattttttt

SEQ ID NO: 41172 - DNA, 277 bp, Triticum aestivum
  Clone ID: PAT_TA_41172
tttctgccatggccactcgcctggccatctcttatgacctacgctccgccttccgtattcgtgccgtcttctcttccccgtgcccccgcgcgccgttccaccgaccgtacccggccgggttactgctcaaccgcgccgccgcctactcgttatacgtcgcggcgcatgccgctccggacacgccgacacccaccttcgataagcacaccggcactaagattaccgatgaattcaccggcgccggtgcggtgggtgaggagtgccaggtcattggggc

SEQ ID NO: 41173 - DNA, 201 bp, Triticum aestivum
  Clone ID: PAT_TA_41173
gccacgcgtgcggactagttgtagctcacgccgacccaaatatggcgtttagaaaaaattgagatcgtgatactgtgtagatttctgtacctgttgatctttcccgtgtggagtattgtttcttggctttattttccttgcatgcttagaggtactaggagatggttgtgttcatggtttaggtgtcttagtccgtcaact

SEQ ID NO: 41174 - DNA, 158 bp, Triticum aestivum
  Clone ID: PAT_TA_41174
cgcagcacctagggcattataagcatgccgggattaattagtacggctaccacatgcgtcgaacacttatcatctagctcattattatcatccgtcgctatgcatatatataatgcataagcgcgcgcgtttaatttgagtttggtacttttttgttg

SEQ ID NO: 41175 - DNA, 239 bp, Triticum aestivum
  Clone ID: PAT_TA_41175
cggacgcgtgggccgaattcctctcgattcctctccccttgccttctcgtgctcccgcttcaaggggatcgccggagaggaatctcaacgtgggctttctcctatcagttaaatcaaagccatggagcacaaggagaccggttgtcattcttgtgggggacctatcctatgcgtcaattacttgaggatttcttggcagtgctggctattcatgaacatgtgtctccatgtgccacaag

SEQ ID NO: 41176 - DNA, 305 bp, Triticum aestivum
  Clone ID: PAT_TA_41176
gtatctgttatagctgtgctccgtactgcatggtggggctagcaaaagagcgagtctgactcgcatgaaaccgagcctacaccaggcacacatccaagagacagacagaggaagtgatctagctcgcttgcttagccgggttgggtttggccaattgctgacatcctatgagccataaccgccattagaccgaccctaaaagacccagatacactcggctgtcgcttgcccgaccggcaaatcgagctccctatcgtgctctggttccgatgtcaccagacgaggagctgctgtacactacctgg

SEQ ID NO: 41177 - DNA, 127 bp, Triticum aestivum
  Clone ID: PAT_TA_41177
cggacgcgtgggcggacgcgtgggttcctaacaagcaccgccgctgacgcatctcgagtagtttccagttcgccggataaggatcaagatggccgtaaggaagggcggctacaggtataaggcggtt

SEQ ID NO: 41178 - DNA, 337 bp, Triticum aestivum
  Clone ID: PAT_TA_41178
cggacgcgtggggtgatacctaacataggcagctgctccagtcaaaaccctggcctgcctgccacagagcgagtggcaaaaccccatctaaggtggccgctgcatgtgctgccgctggcatggcttcagcaggggcactcgaagaacacattcgggactctcgaccaaggatttctggctggctcacttcacgacctacatgagcgactttttctgaggcagctggaaaggcgcttgacttaattaaacctagctctagaggcagagctacaatctatggagtaccttatatgcgtgcacttaagtgttagcgagcttagggactttgttaatgttt

SEQ ID NO: 41179 - DNA, 375 bp, Triticum aestivum
  Clone ID: PAT_TA_41179
gtgagataatggcataaatttcatagagcttggtaacctgtgacataatctgatggggaacgagcttggctacggggagaccaaggtgaggatcaaaaggctcgacaggatctggcggatagcgagcgcatcggggttcaagtgcaacagcacttgtttggaagcgcttagttcagggaaccccgctaaggagcatatcaacccatggatggactagatctaaacataatcggtggtggtttcaacggttttcaaggttggagaattgcttctcctgtggattagatattctacccagaacagctagtgatcaaaacttgccattggaatcgactgtatgcaatatgaatctgttatcagactggtattttaaat

SEQ ID NO: 41180 - DNA, 377 bp, Triticum aestivum
  Clone ID: PAT_TA_41180
ctccttcacctagggttttgctggctcccttccccaccgacggcgtggccgggcgtgtgcaccatggggctgcccaaccagaacaccgtcgattacctcagctttaagctcgtcatcgtcggcgatggcgggactggcaaaaccacatttgtgaagaggcatgtcactggagaggttgagaagaaatacgaacccaccattggtgttgaagttcacccgttggatttgaccactaactgtggaaagatacgattgtactggtgggacactgttgtgcaagagaaggttggtggtcttagggatggatactatatccaaggtcagtgtgcgattatcatggttgaggtcactttaaggcttacctacaagtatgtttc

SEQ ID NO: 41181 - DNA, 209 bp, Triticum aestivum
  Clone ID: PAT_TA_41181
ggcagcggtagcgaaggagggggaacccatcctaaagccaatcttgttggcggcaggcatacccccgggttgttgggccaaaaaagcttctttgacaacaacacccccgggggggggctgaacagtgcgcacccctagaccaaggttggcccagtgtattccaaaaacagcgaaattctggattgacacaccgtgcacccaaggggggg

SEQ ID NO: 41182 - DNA, 125 bp, Triticum aestivum
  Clone ID: PAT_TA_41182
cgtccgttccactacccgacagctgggagcttggttgcaatttcaccacttgaattattcttgggggatactaggcaataatgacagtcatttttttctgggatgcgtacaaagacaaacttttt

SEQ ID NO: 41183 - DNA, 298 bp, Triticum aestivum
  Clone ID: PAT_TA_41183
aggaaagtcaccatggcaagcagcatcaacatcccaacccacaacggtcgggggaaccctggtggggcagggggcgaccggcccgccggggtggttggccttgggaccgggaaacccgcccaattggtggcccaagggggattccccggattattatttcggggtaacaaaaagggacaacttaacggacttaaggccaactttggcaaggttttggggatggccggcattggcaggggtttttttcaacaaacaaaacaaatggttggttggcaaccgggcattgtccttgacgccc

SEQ ID NO: 41184 - DNA, 311 bp, Triticum aestivum
  Clone ID: PAT_TA_41184
gtcattcctcctctggatacggtggagagagtgcctccttgcaccgctgcgagacgagagaggaagctggaggactacttttccggccgtgtggtacaacccgctcggatatacactagagagatagcccctagccggacgggggcgacccccacgcacaatgtaagggggttatccacggcctatgggactggggcgggtactatcacctgcggtgggcacacgtctgacacccacgaggaggtcagtccgcaagaaatagatagagatagcagacgattcttcgcctatgaccaaggtccgaaagcagt

SEQ ID NO: 41185 - DNA, 391 bp, Triticum aestivum
  Clone ID: PAT_TA_41185
agttacaggagaaacttcttgggagattcctaatggattagcttcagtaggtgctgctgatggagtcacttctgcatctgtgcctactcatatggggtactctgtagaagctcaagcacatgtccttccccacagtaatgtcgaagcatatcctagtgatgtgtctgttggaaatggcacagcaacctatactgctatgggaacttatactcatgatccttatgcttacactggagccgttgctagtcatgggagagtggacattgaccccttgcagcttgcaaaatatggtgaggatttactgcaaagactgaagctgctggaaaggccacatgttgccattgacagtcttgagttgataaaaagagaaattgagatacgaatagcagac

SEQ ID NO: 41186 - DNA, 329 bp, Triticum aestivum
  Clone ID: PAT_TA_41186
cgttccacggagagaaccaacatgggactctcctaatgtgaatacactctacgggggtgatgataccggagccactggttgaatttctccatactcatattgcgtgctctgcagaagctgaagcgcatgtacgatacaactggtacgttaaagggcttagtagtgatacatgtgctggctagggctcagaaacctacactgttatggaagcttaccatgaggagacttctgcttacgctgtaaccaatgccagtgaagctggagctcacatccacactgatgatttgggtagcaaaataaaaagatattactgctaatgcagatgatgc

SEQ ID NO: 41187 - DNA, 385 bp, Triticum aestivum
  Clone ID: PAT_TA_41187
cgccgccgctccgcaaaccctaggccgcaccaggtgaaccggcgaccggcgaatcaacccgtccccgcggcgagccatgagtaagctatcgaccgacgccctcaaggaggccatcacccaggtggtggcggacgccaaggagaagaacaggaagttcaccgagacggtcgagctccagatcggcctcaagaactacgacccgcaaaaggacaagcgtttcagcggttccgtcaagctgccccatgtccctcgccccaagatgagggtctgcatgctcggtgatgcccagcatgtgggagaggctgaaaagattggtcttgattccatggatgttgaagctcttaagaagatgaacaagaacaagaagcttgtcaagaggcttggc

SEQ ID NO: 41188 - DNA, 418 bp, Triticum aestivum
  Clone ID: PAT_TA_41188
caaagccggcggcgcttcctcgtctctaccagagagagagagagccccccttctccaaagccggcggcgcttcctcgtctctaccagagagggagagagagagagagagaggcgtgggaggaagagggattggaagaggagcacgaggaggatatggaagcgtcggaggaggaaggggaggatgtggtggtggggcagatgccaacgttcatggtcccaaagcacatcaataagcgcgccctgaagaacaaggccctctccgtctccctcgacaagaaagccctcaaggatttcgtgactgggtttcacaagagaaagaagaagaggagaaaggaggcgcagaggattacgcaggagaaggacagacggaagcgaatcgaggcacgcaagaagagaaagcaagagaaagagattgctc

SEQ ID NO: 41189 - DNA, 129 bp, Triticum aestivum
  Clone ID: PAT_TA_41189
tttcaatcactccagtagactctttttttcaatacatcaccaacatcagggggagttcaccaaggtgggtacagcttcatcaacatttttccttgctttattcactaactacagcatataaagtacacc

SEQ ID NO: 41190 - DNA, 387 bp, Triticum aestivum
  Clone ID: PAT_TA_41190
gggacgcgtaaaacaactaggcgtcttattaaacttatatactcatataggggtagagcgtaccatagtgacagatgcaattattatatttgtatcatgtaagctatataaaatcttttcaaataatagctatacttatgcattggtatgcatttgtaatgtatatcatcgaaaattataatgcctacaaaatgaaaattttatgatgcaccaaaaatttctttattgttgaaacaatctttcatatttctatttttctaatactgcataaatgatgtatgtattcacattggcatatatatgcgtctgaccatatatctttttatattatgttgaatattatcataaagatttctaaattatagacactctaacaaggatttttct

SEQ ID NO: 41191 - DNA, 265 bp, Triticum aestivum
  Clone ID: PAT_TA_41191
accacacgctcgtgttcgcgtggacgcttgacggcgaatgactccttggagccagcgcatctagtctggcgcccctacatcacactcactggcatagggctagacagcactgaggttaccttgcacaccatgcggtccacgcagttgatttagcttagtcacgggtactgcgtccggctgtcgaagctactcatcttcctgaccacgagccaacattgaaggagagtactcggggcatagacagctgcatcgatggcgctctctt

SEQ ID NO: 41192 - DNA, 294 bp, Triticum aestivum
  Clone ID: PAT_TA_41192
cttctctctgccttgtacaagagaacgccatggacgccgagctcgccaaagcccgccgccagggaccccctccggcgctccctcgacccgcgccgccccggatccggttctcccctccgccgcctcacggcctcttgcaccgccgctttctctcctgggcctcttccccgacgctcgaggtgcagcagggtgggcgctgccacgttctcgatccagtcggatctggcgcaagtcgccggcatccggcgccgagcgccgtgattccagatcgggcgtaggtctgcaccaggagag

SEQ ID NO: 41193 - DNA, 432 bp, Triticum aestivum
  unsure (1)..(432): unsure at all n locations
  Clone ID: PAT_TA_41193
cgggggggacccacgcgtccgagatggcgtcgtcccctctgcctgtctggtgtcctcgcctatcttccaaagattgctttttttttactccaacgcatctgaagcggtgatgggtacttgtgcggaggcggcggaggcggcggaggcggcggcggcgctgtatctaaagaggagcacagcgagtagcagcctgggcactgactaggaggcgttggggcctgggcgagcctgggaggaggcgttggggcctaggcgaggaggcgctaggcgcagcgagcctgggagaggagccgatgggcatagcgagctggaggcgctgggtcgaggaactgctggtgctgggcgatggcgacgtgcatgagctgctggtgctgggcgacggtgacgtgcatgagctgctaggagatgcgcctggagnctcgtggcgttggg

SEQ ID NO: 41194 - DNA, 365 bp, Triticum aestivum
  Clone ID: PAT_TA_41194
cggacgcgtgggagcggcggcaaccccaaggcggcggcggcgctggtgccggacttccagcgcgcgttcgagcacatgtgcatccactccggcggcaaggcggtgatcgacacggtggcgaagctgttggggttcgcgccggcggtggtggagcccgcccgcgccacgctgcaccgcttcggcaacacctccagcagcctcgtcttctacgagctggcctacttcgaggccaagcgccgcgtccgcgccggcgaccgcctgtggatgctcgccttcggcaccgggttcaaggcctgcatcgtcgtctggcgcgcgctccgcgactacggccccgtcgccgacatcccttggatcggctgcgcgca

SEQ ID NO: 41195 - DNA, 226 bp, Triticum aestivum
  Clone ID: PAT_TA_41195
gctcgatggggaggagagctcggttgctcatcgggggacgagagcttggtgtggtgcgtcggggaggagagcttgctagatccggcgcgcggcctcagatgtgaccatggcgggtcaggcggcggaggtcgaggtctaaggcacgctggcgcctttcatggccgtacgcgggcggcggggcgcatccttcgccggcctatgctttcggcttgtttccaagattttt

SEQ ID NO: 41196 - DNA, 308 bp, Triticum aestivum
  Clone ID: PAT_TA_41196
ggaacggaaccaacgaatccccattcaatctcgtctccgatcgaccccagggtcgtcgtatcctgctacaccgcctcctcaagatgcaaatctttgtgaagacccttaccggcaagaccataaccctaagagttgtgagctccgacaccattgacatcatactagccatgatccccgaccaggttggcatcccatccatccagcatgaccctatctatgctgtcaagcacatgaaggatggtcgtacacgctctgaacacaacatgcacaaggtgttcacaacactagctacactgctattaaaatgc

SEQ ID NO: 41197 - DNA, 351 bp, Triticum aestivum
  Clone ID: PAT_TA_41197
cccacgtgtgcggccacgcgttcgcccacgcgttcactctcctcttgtgggcggctcctccgatgctcacagaacacatgctggccagcgtagcttcttaggtgtacggacaacgcactcactagcctgccggcttcctccacatcttcttaacatcacccgatgcagtccgtgccattcggtgctccaatacaagggcatggcgctcggacgatgatgtaactaatctagtggtgcacgaaccaaccatggacgctgatgctcggcgcaacgacagcagcatggagggcgtcctcttgtttgggatggtaatggaactgcacataggtgtgggagcggcgaccaggatgc

SEQ ID NO: 41198 - DNA, 365 bp, Triticum aestivum
  Clone ID: PAT_TA_41198
gttccggccgtgccacaccccccatctctcttccctcctcctgtcctccgggcgccctagggactgtggcgccagatcgagggagcccggcaacggaggtcgccgcctctccgtctcgatccgtcggctgctggatccgactgcatggcccgctggtgccctccagggacccctccccccccccgaccccgtgtcggtgaggacagccatggatgggcgccctggagctcttttgccgtcgcccgatctggccgcccgcccagtctccggaccgtgctccggatccggccaacagcctcgcctacaactcgattcagacgcccacagtcttctttcgtcacctgcgccatgcatgcccccagctc

SEQ ID NO: 41199 - DNA, 271 bp, Triticum aestivum
  Clone ID: PAT_TA_41199
catgattccattaaagccctcttccacttccagctgccgcgtggcaccacggacgcttttaccctccctgcaccccaattgcccctcctccatcatccattccttctcctccttcacccccaagctgcctcctcctttcacctcctcgccattctcctataagtgccttgtctccggcttctccctattcgcctcgttaaggaacaacacgtttcagctttgtgcggttcttggtcggtgttctcgttccctttctttgcatctttctttt

SEQ ID NO: 41200 - DNA, 254 bp, Triticum aestivum
  Clone ID: PAT_TA_41200
cccactcgtccgacacctggcacatccagttgtgctcctcatatgctgagggctcatgctcccatgtttacacgccctaagaaaagaaagaagaagacacaatccttcattcattcagcgcacagctgataattctctttcatcccatgacttatgcacttcttcctagaagatcccaccaacttcacatccaatacatccaaacccatgctgattcacaccttctgcacatatagaatgagtctgatctctta

SEQ ID NO: 41201 - DNA, 269 bp, Triticum aestivum
  Clone ID: PAT_TA_41201
cccacgcgtccgcggggaaggtggtaggaagcagcggagtcagccatggggagggggtgggtggagctgtagcggctctataacaagatcaaccgccagtttacctttgccaagcgcaggaacggcctgctcaagaaggcctactagctctcctttctatgcgactccaaagtctctctcatcgttttctccaacctctgcaagctctacgagttctgtagcacccagagcatgacgaaaacactcgacatgtatcaaaaattcaattt

SEQ ID NO: 41202 - DNA, 333 bp, Triticum aestivum
  Clone ID: PAT_TA_41202
tttactcgagggttcgtgccccctgattcagatgaggatttgggtttgaggaccgctcatcggattcgagttgcatgttccaaggggcataatcaaccttgccacataactgcctaactccaatttcaggtacctaaaatctaatgaagagtccaaagagtatgccaaatctaccctaccaacggcgcgtcgtgaagaaggctaagcgtacactgcgtcaccttcttttattcatgtaggtcgcagcctatcgatgctttttccacacattttacacatccacgaatatgccggaccttggccaccctcatgctgtagaaatacctccctctc

SEQ ID NO: 41203 - DNA, 335 bp, Triticum aestivum
  Clone ID: PAT_TA_41203
tacactctaactagctagctaggcgaggctaggccggcgagggagaaggagaaggagaagtaggcgccaagatgttgaggatgcagcagcaggtggagggcgtggtgggcggcggcatcgtgtccgatgcggaggaggcggcggcgtacgagcgggtggctcgcatggccagcggcaacgtcgcggtcgtcttaagcgccagcggctgctgcatgtgccacgtcaacaagcgcctgctgattggccagagagtagcccacaccgtctacgagctgtaccacatgggcggagaagcccaggatatacaggcctcattctttcaaaagctttccctc

SEQ ID NO: 41204 - DNA, 247 bp, Triticum aestivum
  Clone ID: PAT_TA_41204
cgcacgcatcggccgaagcctgctatcgattttgtggcgattgcggaggggcgctctctcccgcggtcgaggcatcattttatggattgctacaatctgacaaagtggaggtgtacgctgaacttccttttttgtgtaaacatgcttcggtttattagagatcagttgaattgctagaagagtactctcgtgcaacaagaaaaatgcttaagtttgtgctaacttgtttgcattaagagcccattta

SEQ ID NO: 41205 - DNA, 348 bp, Triticum aestivum
  Clone ID: PAT_TA_41205
cggacgcgtgggcggacgcgtgggatccttttggtggtattacaggggcaggaaaaacttgtattgtttggaccaccattcaacgtgcaaaaggtgcacaagatctgggcctgtctatcgaacttcttccattgagtaggcctgatgaggatttcaacatgtccctgttttatgcaaatttgattggtctggagggagatgaagtactgcagtatgtgccatctgctggtgaaaagctggaggatatgactgatcaactgagaaagcgaatgatgaaaaagcgcaaagtcaaaactctctcatttgcaattacaaatgatgtttgcatagaggtgaacacatatgcgt

SEQ ID NO: 41206 - DNA, 177 bp, Triticum aestivum
  Clone ID: PAT_TA_41206
gctactgcatgatgaaccgaggattcaagtggtccacgtactccgcggggggggaaattgcgctggaggagcagtccctactattccctgggatggatgttcccggagaaaaggaggtggccctgcatatgcccttgatgcttcctagaaggctattgttggcacttccaagccatt

SEQ ID NO: 41207 - DNA, 175 bp, Triticum aestivum
  Clone ID: PAT_TA_41207
gctactgcatgatgaatcaaggaaacaagtggtacgcgtacaccgcaaggagggaaaatgcaccaaaggagcgttccctcatatacactgggattgatgtaccccgaggaaagaagaaggccctgcatgtgcccttcatgctgacgagaaggctaatcgaggcacaccaagccat

SEQ ID NO: 41208 - DNA, 197 bp, Triticum aestivum
  Clone ID: PAT_TA_41208
ctgactcgtcgtctgactcgtgaggattttattgcctcctccctcaatcgggggctgagtattccgtgatgaaggttactcacgctttcttgtcaaaactaaaatggggcggttcgtactttaagaactatcatactgtcggagtaccaactacccaaatgcgcttcacctatatcgaattacgcgccatccacata

SEQ ID NO: 41209 - DNA, 283 bp, Triticum aestivum
  Clone ID: PAT_TA_41209
ctgacgcgtgtgcagacagcagattaagttgccaatccaatcctacaggtggggccaacaattagggcacttaagccagctttgttgatctcactaacgtgtattgaccctgactctgaaaatatacctaagattgcccaggtctctaggatgctggaacatctagaagtaccatttcgacaggaccggagaaaccgtaggagtctcacaagaagcatggacatggaacttatctcagagggatcaacttcggctgaattcgcaaatcaacgttgaaaggact

SEQ ID NO: 41210 - DNA, 346 bp, Triticum aestivum
  unsure (1)..(346): unsure at all n locations
  Clone ID: PAT_TA_41210
cggacgcgtgggggcgcttcaaacttttgtttctcaatggcatccttccagctggtactggcaacgatcttgcgagggttttgtcttggggtggtggtcttggtgttgttgaaaagcggggaggtttattctcagttttgaaagatgtcgagcatgccgcagntactgttctggacagatggaagatcactataaaggacaatcaagggaagctcatgtgttcaccaaaatttatgaacaattactttggggttggttgtgatgcaaaggttgctctagatatccacaacctgagggaggaaaaccctgaacggttttatagccagttcatgaataaagtgcttta

SEQ ID NO: 41211 - DNA, 262 bp, Triticum aestivum
  Clone ID: PAT_TA_41211
acgtggacaccttgtgacacttcaatcttttgtatatgaatagcctacttggagcgggtactgtcaacaaaataaacacggtacacttgttggagtatcacactggtgttgggacagtgaatgccaccagttttttcagtcatgaatggtgaaagaactggcaatattaagtttcgctgtgatctgaggatggcattcttatgcgcgtctactctgtggcgatgagaaaaggttgttttcatcacccttttttagagatgtt

SEQ ID NO: 41212 - DNA, 366 bp, Triticum aestivum
  Clone ID: PAT_TA_41212
acatgctccatacttcagtcgacagacccaataatacactggctgtaatcagcatgaatgaatcccttttaataatttgtcatgtaaccaaaaatagagattgacccctcctatggtgaaatggtaaatccgcagcaatggctaaaagagacaacaaatgtacatacaacaacacagcaggcatatagtatctcatcaccactctgctactactggactggagtagtaaaacttaccgcagggacagggtcagggcaggatggggtccagatccctccttaagtacacagaccaccaaccaatcaatcaaaacgatgaagaagatgagggcagagttgcattcatacggatcagagcagactcgca

SEQ ID NO: 41213 - DNA, 425 bp, Triticum aestivum
  Clone ID: PAT_TA_41213
ggcccgattcccggttcggcgctacgacctcacgcgtatcgaaaagccttaagtcactgcaggctcaattgacacaaactttagcaggtatcggtattacccgtactcgagaagtatttcaccttaaacggtctctgaacctttgttagtggtgaggagtaacatgtaacaggctcacagccctggctcactggatgcttggcaagctaggggtagctttaggccccaagccatcatctgatgctcacaaggccagggagcgccaaactctgatcctgatcctgaggcacagactgaaatatgctctcacctacccaggagtgcagtctattcttatgcaacgccatatcatggttgatggaaaggtccgtactgacaagaccttccctgctggtttgatgggcattattttcatttccaagact

SEQ ID NO: 41214 - DNA, 423 bp, Triticum aestivum
  Clone ID: PAT_TA_41214
cggacgcgtgggggtgtccgtacctacccaatcccaatccaacatagggagggggggtcgctgaccctcaccgtagacgccgtggattccccccgctgaccttcgccggagctagccggactcgtagggtttcttcagttgtcctctttcctgctggagatccgcaccctaagaaggaaggaagggaggaaggaagcaatttgagttgttgcaaaattattatattacattttttactctaacaattttctaacttataccttatcttaattattattcactacatgagttgctattataatctatatattaatctttattatctttcatattatatatatcatctatattttatatatctatactatattttcatatctttcttcattatattcttatatatatatatttatcatctatcta

SEQ ID NO: 41215 - DNA, 356 bp, Triticum aestivum
  Clone ID: PAT_TA_41215
cacgcccgtccccgcccacgcgtatcgctggacgtctgtgggcttgactccgtgggacaaagcctcgccagcggcgtggtctcctaactcagcgctccgcggcagcaatctctcggcattggcccccgcaccaaagcagacggtcgaggtaagtccaaccggcggcaacggcgccgaggaagcagctggccaccaaggccgcgcgcaagtccgccccggccaccggcggcgtgaagaagccccaccggtttcgccccggcaccgttgcgctccgggagatccgcaagtaccagaagagcacggagctgctcatccgcaagctccccttacagcgcctcgtccgggagatcgcccac

SEQ ID NO: 41216 - DNA, 251 bp, Triticum aestivum
  Clone ID: PAT_TA_41216
gtaattttccaggtatacatcaatgaatcgactccggcatgctcatttctgggtaatgcaagaaggagtcctatataagtatacagtgttcaaagggaactgaacatgcacgagttgatagaaataagtcatatctcgggagcagcacaacatctcaagctaccttgatggacaacaatcctcccatgttcatgaatttacgtttatccaagattgcaagtgcttcctccaaacttgattaaatgcttggt

SEQ ID NO: 41217 - DNA, 286 bp, Triticum aestivum
  Clone ID: PAT_TA_41217
cggcgccacgcctacccgtgcgtatatagcacacagacatacaaagttactagcttcagctagaccacagggacgggcaatccgggcatgtgtcgtgcatcaaccacggcaatggccaccgctgatgtccagaacccgacggccgcgctgacggaggaggcgcccgcggtggagactcccgtcgccgccgaggaggttgctaagacagaggaggtccccgcgccggtggaggccgaagtcgaggcgcctgcccccgtcgtggttgaggcgaccaaagaggaggcac

SEQ ID NO: 41218 - DNA, 162 bp, Triticum aestivum
  Clone ID: PAT_TA_41218
acgcttctcctccccttacggttcgcgtgtactttttcgattccccttcacttccggggagcggcctaattacctaccctactctaccccaatcttacacagcatcgatgcctcctggaggaaaacaaggtagaggatcaccgatgagctatctatatatta

SEQ ID NO: 41219 - DNA, 142 bp, Triticum aestivum
  Clone ID: PAT_TA_41219
ggtaccgagatcccgattccagctacgacctcacgcctatcaaacgagtccatgaagtatgagtcttaatggattcaaacttttaagggtattgttattacgagtactcgataagtatttcctattaaaaggtgtctgaaaa

SEQ ID NO: 41220 - DNA, 277 bp, Triticum aestivum
  Clone ID: PAT_TA_41220
gtaattttccaggtatacatcaatgaatcgactcctgcatgctcatttctggctaaggcaagaagcagccccatttccctatacagttatcgtaaagaaatgagcatgcaggagtcgattcattgatgtaattttgcaggtgtacattccaccttacatgtgacattcatgaacgaacacattccactttgttagcctctgaaatcacagaagtggcaaaatgtcctttggttataaaaaaaaaaaatagggctgtcgttctagatgattcaagctt

SEQ ID NO: 41221 - DNA, 114 bp, Triticum aestivum
  Clone ID: PAT_TA_41221
actgtagaggattcaagcttacgtgcccctccatcccaacgaatatgttttgtatcgagatacctcaaatcaatacacttgccccaattaaacaactgttggcctggcaaaaca

SEQ ID NO: 41222 - DNA, 315 bp, Triticum aestivum
  Clone ID: PAT_TA_41222
cggacgcgtgggcaaaagcgaagagagaggagaggagagagagcccccagcgtacaagccaccggccaccaccagatgtgagacgaacagagccaagccgacgagggtagttttaaaactctgcgccgagaggagatttgcggactgcggaggaagaccaactgggtgaaattctgcgtcggcgcgggggcggccaatgggaggggcggaggcggccgtcgtggaggccgcgtcgaccgctgcggcagcggaggccgctgagggcggagaggacgggcggatggaggggtggctctacctgatccgatccaaccg

SEQ ID NO: 41223 - DNA, 276 bp, Triticum aestivum
  unsure (1)..(276): unsure at all n locations
  Clone ID: PAT_TA_41223
cggaanngcagatgtcgacccacacctacgcgcacgcccacgctttctataatatatcttttccaaaacactaaaacaatcgggttctgcttaattacaagaggccacttccccaacaacatcactttaattatcaaacttccctttgctaccaatattatatcatctaaatagaaactctatctttcttattcaaatccttaactgttaatattactaaaaatcatcaacttaatccttatatttactaccatattttatattcaattaataact

SEQ ID NO: 41224 - DNA, 345 bp, Triticum aestivum
  Clone ID: PAT_TA_41224
ctacgcgtacgcgtgcgtttgtatatggtcgcagtggcgtgagctttttcattactgcatctgtttattcaaactcaatttttctgttgttgtggagaggaagatcataagctcttccatacatattcattaccttcactaaaaaaaaaaaaaaagttctttccctctaatagtatccaagttaacctacgcgttcatcctacttaatcatttttactatagtttcacctaaatttaattaacttcctcttcttttacaaccatgtgactggaataactccttctctacccaactgtatttcctttcatcaaatttccattttcttcttctttcattataactat

SEQ ID NO: 41225 - DNA, 341 bp, Triticum aestivum
  Clone ID: PAT_TA_41225
cacttggcagcaactgtccatgaaggggttcgccggcgacacggccaaggcgcgcgcgaagacgagcatgatcgccggggagggcctcagcaacatccgcaccgtggcggccttcaacgcgcaggacacgatcctggccctcttctgcagcgagctgtgcgcgccccagatgcacagactgcgccggagccagatcgccggcgtgctctacggtctctcgcagctctccctctacgcctcctaggcgctcatcctctggtacggcgcccacctagtacgccaccacgttttcgccttcttcagggttatcaaggtctttgtcgtacttgttattaccggca

SEQ ID NO: 41226 - DNA, 192 bp, Triticum aestivum
  Clone ID: PAT_TA_41226
cccacacctacacactcctaaacaactacccataaattcctattcctaccacacaaacaatccgcactcgataaattttactacccccctcttatttcatacttcacattcaaacctccttattctattttaaaaacttttccctcaaataaaattactttcttctacttaaaacccaccatattaaaatcc

SEQ ID NO: 41227 - DNA, 312 bp, Triticum aestivum
  Clone ID: PAT_TA_41227
acgcggacgcttggtccaagtttatatatgcaaaatacttgcctacttgaagatggttaaaatcgagagatccttgaactaattttcatgtatacaatatcactagcttacatatcttcactggacaccacaatgaaacataaacattactgtccctgaaacaatccttaactggtgttttgccaaaaatgaccaacctgggtttgggacttgctaccacattggttttggcatcaaaaaggacggtttggatcttgtggcgggccgtattcatgttatccaaatagccgaggctgatttgtgagagggttt

SEQ ID NO: 41228 - DNA, 388 bp, Triticum aestivum
  Clone ID: PAT_TA_41228
cccactccttcaattgcttaattttacgtttcatgccaagaaacaggggtggggggtttccaccgcacctatataaacctcgaccaaccctagccgttatggcgcgcctttgatgctcacaacctgggccatagatctgcgacaggggccttccttcttcacccaggcggagcaagtgcctagccatctgaagatttgcagtaacaagcgccggatgaggagaggacaagtaccgcgacccgcggggcaccccagctcgacctttccggctacgttaacgccccggacaagatcaacatgacctctccgcctcttcagttcaatggaagtggaccaccgggaccacacgcttcagcccgacaagcttgactagctctatggtcaagtt

SEQ ID NO: 41229 - DNA, 189 bp, Triticum aestivum
  Clone ID: PAT_TA_41229
acgcgtacgcatggtcctacacttgttttcctagaactactcagtaactatagggagggcgtggctcactcctttggttttaacccaatcttaaacccttagatatggaggtgatcatgtgatgaacaccattatgtatatttattgttgaacactgcctttttccttctattatatcaaccatgttac

SEQ ID NO: 41230 - DNA, 252 bp, Triticum aestivum
  Clone ID: PAT_TA_41230
ctacgcgtacgcatgaaaccacacgtgatcttacatagtaatactcagcagctagagggggggggtggccaactactgggggtgtaacctaattttaaacgcttgatatggaggtgatgatgcgatgaacagcattatgtattcctgtggtagaacactgtttgtatcctgcgattgcattaactttgttactgttacttttgattactgtcaactgatggttcagttgttgaaaggaatttacatgattcc

SEQ ID NO: 41231 - DNA, 406 bp, Triticum aestivum
  Clone ID: PAT_TA_41231
ctgagttatatccatctgactgtttgtagatccacgaacctttgtgggcaggctctgcctattctttcatttgcaataacatgagttattctgaattgatcatttgatgttaccctagcagtgcctccatagaaaattaaatctagttgatgttatcctttgatcaacttctgcaaacataaggagctagttggtctcgctccaataatacatggattaccatttggtctatgtgtttagatgagggtcactatatacatctgcagattagcatttatcattcagattttcaatttacatttgcaaggtatgtgatttgatttatctggaggtaagttgtgctttctgtcggttgcaattactatatgctccaagctgtggcaacaatacttcaaaattatttttc

SEQ ID NO: 41232 - DNA, 255 bp, Triticum aestivum
  unsure (1)..(255): unsure at all n locations
  Clone ID: PAT_TA_41232
cccacgcnttctttgcaccatcacacgaactactctacacaacaatggcaacaactacgcgagggcgaactccaatttgagcaggctcaccccacttcacgaatcatctaaggtggctatctatatcaaaatgaagacatccctatatttcaaaatcatctttacttacacccctaaaataacaatcacgcttatccacatgcatcctactctccttccgaaactccaaactgttgcccacgacacctccaagta

SEQ ID NO: 41233 - DNA, 319 bp, Triticum aestivum
  Clone ID: PAT_TA_41233
cggacgcgtgggtgataagggagatttgattacagcaaatgaggtcagtccgagctgtgatttttacaggaagacagtctccatacataaacggggcattattttttcttttaagaggatgtctatggaatctaaactaagatttaaactaaagaactttacaaatgcatcctaagcgcacacttctatttacattttatcttcaaacatgttctatacagttttccttagttccattaattcttctaattctctacatattatatttcttttttctttgtatagtattatgttttttatacttctcttactaaatatt

SEQ ID NO: 41234 - DNA, 248 bp, Triticum aestivum
  Clone ID: PAT_TA_41234
acgcccacgcgtccggcggcttgctcgcagcggcgtccgtctcctccacgtaaagagagagacatggcatgctgcacctatgaaagacagcaataatggataatgacaatgtccgcatggctactgatacaccttctcgctttctttccttctttcaacaggtgataaataagcaccctcgcatcataataataatcatcctttagagccaagcagtacctattttaacatcaaaatgtgacacaact

SEQ ID NO: 41235 - DNA, 362 bp, Triticum aestivum
  Clone ID: PAT_TA_41235
acgcttacccaagtgttcgtcctgggctgctcatgcctgcatcttcattcactcgggggtgatcatggatctactctccaccaccattataaaggtgctaatgtataccatggatccatgtatccgccatcctgaccagatagctcttattgccaaccacaattgtttctgcacacacctgaccatctcattgacccaatccccgtgctatgcataattaaaattaatgggtaatatgccattaccaaatctaattaccccacattactgttaaacccgacggtggacgacgtgaaaataaccgaggcgatcttggtccctttgcttcccatttatcacggtgaaaaagatcgaggacagca

SEQ ID NO: 41236 - DNA, 264 bp, Triticum aestivum
  Clone ID: PAT_TA_41236
gcccgcccacacccactcgtacgcatatacatatcttgtccaatattttcaacataaaagcttaattacagccgcgtctaaataaatattccttatcctttacaactataacccactaacataaccattttcttcatatcaaaaacactgcttaactcaacttcacacacataattattctaccgctacatacccattaatacattcaagacatatgatgtacactctttaaaagccattaattacatacattacttcattcat

SEQ ID NO: 41237 - DNA, 239 bp, Triticum aestivum
  Clone ID: PAT_TA_41237
ctgacgcgtgggcagcggtggagtcagtgttgggagctcaaatttaccggtgggtgtgtcatttatacatcaacgcctctttattcttcttatttcaacatctatgtggttcaggaacactgcattttcctattctctcatcatgatattttttttttttactagctttttttccaacttttaccacttttttcatttttttcttttcttctatttactatttttcttttttcattttt

SEQ ID NO: 41238 - DNA, 324 bp, Triticum aestivum
  Clone ID: PAT_TA_41238
cttacacatcggcagacgcctcgctcagtccttctccgtcatctaactctgcgacttgtatgtgatttcataacactccctatcaaattcgccgctgctagcactaaactattttatttctctttttattattcttctcgcttcctttacctgcttcaacaagtgataaataagaacggtagcagcatcatcattatcagtattagatgccaagcagtagtaatttaagcgccaagatgtcactgatcgtccctatcaccaggaggcgggaggctgtctggctcggactgcgactctggggcaactttcgaagcctgcgacaac

SEQ ID NO: 41239 - DNA, 350 bp, Triticum aestivum
  Clone ID: PAT_TA_41239
cggacgcgtgggtgcggcaaggtgagcttatcccatttactttgttcaatcgggagggaagattcatatccccttcactgtcatttcatttgtgagaatttattccattgatccatgttggcggcatcctgacaatttatctttttctgccgatcacaattgcttctgaacacaccggcccatctcattgaggaaatccccctgctctgcttaattaaaattaatgtgaaatatgtttctaccaaaactaattacaatttattctttttagtttctactgatgttgactatgaaatattggggcccgagtagttcagttcaatttccggtggatattgtacacacatgta

SEQ ID NO: 41240 - DNA, 299 bp, Triticum aestivum
  Clone ID: PAT_TA_41240
tcccacacatacaaagactcatagcactaatacttccatttcacttggggctggttttttattagactacctcatcacacatttacacttatttactatcaatcaacatctagctaatccaattaacctttctgacattactgacatgcttcttatttattctcttccctacctactcttcttcatccatatcacactttcctcctctctattcgtttttaatcatcttctttaatctttttcaacatcatttcttcattatttttatattttttttttatatgctttttgtgattttt

SEQ ID NO: 41241 - DNA, 428 bp, Triticum aestivum
  Clone ID: PAT_TA_41241
accgaaccggcacagtgtgcccggctcgacccacccatactacaaaagctgttactaaaccagttgaggaattcatgattaaccataggggggcaaagacaacaagagtgacacacgccattcacaattatcaaaaccatacattcaagtcaaaaattgaatcttagcccccgggtactgcaacacgtaactcaggtgcataggatgggcggagaaaactttcaaatttattgaagcaacaaggcgttcattctaaacgggctccaaaaagcagccctccacctaaccaggaagttcctccttttctttaacctcgcggtagactcgcggtgtattacactcatggaaatactagaacgtcacttccaaaagagggcaatggaaaattttacactggagactgttatatatggctttatacatatcat

SEQ ID NO: 41242 - DNA, 155 bp, Triticum aestivum
  unsure (1)..(155): unsure at all n locations
  Clone ID: PAT_TA_41242
cccacacatacgnctcctcctcaacatttaaacactttaaccatacaaaacccacacacttccctgcccggctttttcactggaccaccatccacacattctcacttttccactattccccatcctccaccttcatccatttccactcttctaca

SEQ ID NO: 41243 - DNA, 283 bp, Triticum aestivum
  Clone ID: PAT_TA_41243
acgcatacagattttctcttagttccatattacctatccgggaactctagaactggtgtcgggtattagtggggaaccaatcacaagatcctactcaactacaaagaaaacctcccgcacgaggacctagttaacttatcgccatgcacggacatgtcgacatgcccttcatactagggatgtccaatgctataactgggaccttccagaaggcctctttttccacattagagacgcagactctctccaagcaatagatttcatgcctactcccctttctcca

SEQ ID NO: 41244 - DNA, 444 bp, Triticum aestivum
  unsure (1)..(444): unsure at all n locations
  Clone ID: PAT_TA_41244
gaanngccggggcggcgccacacctcacgcccactcttatctcctttcntgtcctcattcatgttcccatcacctaaaggtctacatcgtacacgtgttctctaccacgctcgtggtcctcacactcacttccacttccccactgtgtccaacttatcacagtcacatgatcatggagtatctaatctagagatggtggtacgatagccatgaacatggctggactggtccctcggtgttcgactgggcttggccctattcatctctcctctcgccggtgctgctgttccagatccccggcaagggcaggatcatggacttcgtctgtttccagaccagcgtcgtgggcatgctcattcactccgacatcttacttcgccctcatcaccattttgcttctcgccgaccgctttcaagtcttttctgtctgaccagctactgctt

SEQ ID NO: 41245 - DNA, 318 bp, Triticum aestivum
  Clone ID: PAT_TA_41245
acgcccacgcgtacggtggactgtggttccaaagactgataaaggcaaggggaaggctctccccgcgtacaaggacaaatttataagcaagatgttcactacaccgggtatatcatacatcatcatccttaggaacccaaaatgagtatgactactctatgtaaaccagaatagattctcttcgctatgctactgttgaaacaatgcctaatgctctgaatcaacgatggtgaaaaacaattattaagcaagcattgcctagtctaacaaatgatactgtgcttaggtgtgataattacttatataacatttttcata

SEQ ID NO: 41246 - DNA, 327 bp, Triticum aestivum
  Clone ID: PAT_TA_41246
gtaccgaaccgcaattccgacccacacccacgcctacgcgtacgcgtaagcttctttattaatgaaaacatacttagcaaatgcgctcggattttttcggcattataaatccaaaaattatacctttgactatacaatacctatgccccaaactgaccctatataatattactacaatcccgcactccaacacaatatgacctgtattctatgattttataccattctaatgtatccagaacgatcgctagctctgagcactctaatttcttcaaagtaactattcctaaaacacgatccgttccattaaaactagcagctccatcc

SEQ ID NO: 41247 - DNA, 339 bp, Triticum aestivum
  Clone ID: PAT_TA_41247
cggacgcgtgggggtttttctgtttatgctgcaggttaagacctgggctgggtacatggtgtgaatagcccgacagcgcagacaatgagctcgatgtcaatcatttgcttggttgatttccatctgcagcgcagacccggcatgctacaatattacccgcgttctctgccttgttaaaagatggctcagatttcgcaagtgttgagaagaacatctcgctctttaaggggtttgggagcacaaataaagaattggtagctgaactttttgtaacactgatgaataagctactatcagtggagagtttatgggagcacgggctctgcgctagcaattttg

SEQ ID NO: 41248 - DNA, 324 bp, Triticum aestivum
  Clone ID: PAT_TA_41248
aatatagggggggaaccatgtgcatcaacattccacctattgctggtacatttgttaaacaaattttcaatacaccactgtgtaccaaatctgaaattccaggttacaacatttggcacaacacgtatactaaaccaagagtgattttgacgtgctcgttgtgttgtaagccatgtaggcagaggacgtgttcatgtcattcaagcccagctcctagtttagctcccagctcctctaatactcgtcaattgttagctgattgtcatcttctagcgaatcttgttgtggggcaataaacgaagccgccaatgcatcatcaagttt

SEQ ID NO: 41249 - DNA, 312 bp, Triticum aestivum
  unsure (1)..(312): unsure at all n locations
  Clone ID: PAT_TA_41249
taccgaaccgccaggccggccacgacctcacgcgtacgcgtacgcgtaggcctactacatcatttgtgaaaacacgaaagctggggtngggtcattcatgcatgtgaatcaacaataataatatttaacttcgaactaaatctgttgctcataagatgttacttagcgctgaacagatgcacgtgacttgggttgcatatgccctcttattccagcattgtgagatttttggtagatcagggacatgcactacatctatgcccccaggagtgtaagcataatatcttcagtagtgtccgatggtctccatgg

SEQ ID NO: 41250 - DNA, 212 bp, Triticum aestivum
  Clone ID: PAT_TA_41250
cggacgcgtgggggattcagaccacctcccgttgggaaaggagctgagagggggccgaacgaggcacttcagacggaccgaatataggcaatgagacgagcccttgggggcgcaagcccaactaatgtccaaagccaacaaggtcaaggtccagttcaacaaggtcattgtcgactacaacaaggagaagagcccttatgctcatggcccaa

SEQ ID NO: 41251 - DNA, 403 bp, Triticum aestivum
  unsure (1)..(403): unsure at all n locations
  Clone ID: PAT_TA_41251
cggacgcgtggggttctacagctcacttttctgtacatcgcatgatccaaactcagcaagatgggtgatatcatcaatattttctgggagcctctactcttccagtgttctgaaaaatccatgtgatgtctttctcttgattggtacttctcgacatctccaacatcctcaggcccaaagaaagaaaatgaatcatcagtggcatcttggaggccatgcatactcatttccagcttctgagcatgctgaagagtttctgccatgctacctccatgacagaccactngattatctaaatatgtaaatcatttctcatcttccagangacccacaacaatgctaaggatattcacgttaactattactggcatgccatgcaatatatctngttatcttgatttat

SEQ ID NO: 41252 - DNA, 207 bp, Triticum aestivum
  Clone ID: PAT_TA_41252
cggacgcgtgggcgaggacaagcttgagttcagcaagatcttggaggctatcaaggctaacttcaacgacaagttcgacgaggtcaggaagaagtggggcggtggcgtcatgggctccaagtcgcaggacagactgaaagggaaactacatggcatatgctctgacaatacttatagggctaggcttagttcatcctctgcgcagcc

SEQ ID NO: 41253 - DNA, 405 bp, Triticum aestivum
  Clone ID: PAT_TA_41253
cggacgcgtgggcgataggcgtgtttgaaaaaaaagggtcagttcgtgttgcaatttcatgaaaacttgcttatgcggtgttattgcactggtacaaaaaatgtcatggtctttttcttcctgtttagatcgccacctacctatgaattacgactctgggcatggcagaatgtcaccataatttttgttcagcaactagatttcatcccaagacgtgccatctctctaatttgactctgagcatgtaatacagttagttaatcatgtgggttggtcttgtgtcttcccgctgcaattgaattagtctaagcaatcgaggtcctactaattaattaagctggctatttgcttgcttcttgtacctacggcatgctctctgattttttttatcacagtatgcaagct

SEQ ID NO: 41254 - DNA, 297 bp, Triticum aestivum
  Clone ID: PAT_TA_41254
gcagaactaagcccattaggctagcttataaattaagcctgcagcctaacatagaccatctcaaatcaaggaggctctgttcgttgtcaacatcgtcattggtcagattctcctattaggtcaaattcttttgttttcaattgaaacaatggcatacaatatgctcgatgcgattaacaatgggaaggattcctggaaagtgaaggtcagagtaattaggctatgggacgccattaaccttaataacaatgaactaattagccctgacatgttcctggttgatgaacagggcacttt

SEQ ID NO: 41255 - DNA, 389 bp, Triticum aestivum
  Clone ID: PAT_TA_41255
cggacgcgtgggtttttttttttttttttttttttttttttttttttttttttggttttttttttttttttttttttttaacagcgcctatgatctgattttatagggggttctggctatggtaagagtatttttttagtttgattttttacggggcttttgatgaatttcttacagggggctttttttaacttctactattattttatcacattaatggggtttttcattttcaatgaaagctgaaattttgatagggggcttttaaccattttgcagggcactttttccatataggtccaggttttttttttttggggccttaaaaccataaaacctggtggagttgttcagtctaacaaacaatggttaaaaacccaagatttttt

SEQ ID NO: 41256 - DNA, 373 bp, Triticum aestivum
  Clone ID: PAT_TA_41256
cggacgcgtgggggaaagatggacatggcaatgcggtgctttgaggagatgcagaagggtgggtgccagccggatgttgctacctatacgtgcttgcttgggggatatgggaatgcaaggcgaatggatagagggactgcgatgttggaagaaatggcacaaaaggggtgcccccctgatggccgaacgtacaatgcactgattaagctggtcaagaacaggaatattccagatgatgcagtaaggatatacaaaaagatgataaataaggggcttgaacccactgtccatacgtacaacatgatgatgaagtcgtatttccttggcgggaggaactatgcaatgggttgctcactgtgggatgagatgcatc

SEQ ID NO: 41257 - DNA, 302 bp, Triticum aestivum
  Clone ID: PAT_TA_41257
ataaatcgttattgagatacaatctatgcattctgatgatatcatacttacagctttaatattatctctgttttgataaaaaagggaatttgatgaaaatctactgaagaaagtatttgaactattgtacgaaaatgagttactggatcttccctatgctccagatgtcggtgactacttagtctccgaggaccctaattttccaacaagcaataaagatcctgcccctatacctgatggtatgagtggaactgaagtagagaagagattgaatgggccggcatatcaaggggacccaaaac

SEQ ID NO: 41258 - DNA, 395 bp, Triticum aestivum
  Clone ID: PAT_TA_41258
ccgcggtgcccgccatcgactgcgactgcggcaaccccaaggcccccaagccctcccacccgcccaagaccaagccccccaccaagggccccaagccgggacccaagggccccacctacccgtcgccggcgcccaagggtcacctcccgcacccgccggtcgtcggcccgccgaagggccacgtccctcgcccgccggtcgtcggtcctccgaagggccacgtccctcacccgccggtagtcggacctccgaagggccacgtcccccgcccgccggtctacggtccgcccaagggccccatcacgcgcccgccggtcaccgctcctcccgtcgtcgtcgggccgccggtgacctaccccacgccgtcagtgactgccccgccggtcacctacccc

SEQ ID NO: 41259 - DNA, 283 bp, Triticum aestivum
  Clone ID: PAT_TA_41259
cactcactcacgcgcgcgcacagagagctagccaaaggaagggaagaggaactgccatttcaggaaaggaagagggggatccatggccgccggagacgtcgcgacggtgttcctcgagatgagcctcggcacccgcctcgccgtcttctttcccgccccgttcacacaccgtggccgacctcaagcgcagagtgagccatgagcacaccgcattgtttccccaccttgtgcagatcgcgcggcaattccatcaagatcgagcacggagggtcgtggttccacc

SEQ ID NO: 41260 - DNA, 398 bp, Triticum aestivum
  Clone ID: PAT_TA_41260
agatcgtggtgattcaaatgtaagatatggatggctgggttctacgaagagtgacatagttaggattctaattaatgggtttggtaacaccggaaaacctgctgagaaggcatgcttgagcgctggtgtttatctttcaccagaagatcgcgcctttaccagtgtcggtctttgtgatgttgacgaaaaagcggtgcagtatatgttattgtgccgagtgatattgggcaacatggaagctatcacgcctggatcacaagattcttttccaagcagcgaaatatatgattccggagttgatgattgctccaacccaaagtgttatgttatgtggccatcccatcttaacactcacatccgtttagaatatcttggtagtttcagactttcaccaaaag

SEQ ID NO: 41261 - DNA, 384 bp, Triticum aestivum
  Clone ID: PAT_TA_41261
aggaggagtttctcagttaggcctgacagcggtagctgttggttgccgagacctggagtacatagctgcctatgtatctgatatcaccaacggtgctcttgaatccattgggaccttctgcaaaaatctctacgacttccggcttgtcctgctcgacagacaaaagcaggtaactgatctgccactcgacaacggtgttcgtgctctgttaaggagttgcaccaagctccggagatttgctctctacctgagacctggagggctctcagacataggcctcgactacatcgggcagtacagcggcaacattcagtacatgctgctggggcacgtcggtgaatctgaccacggggtgatccgctttgcgataggatgcatcaacct

SEQ ID NO: 41262 - DNA, 390 bp, Triticum aestivum
  Clone ID: PAT_TA_41262
gatgtgtctgaggccaattctggaacctcatcagagtctaccagccaaattgccaatgataaagatatcagaagtagcattcaggaaaccggattagctgtttccggtattactcctggcatgttgcctgtgaatcattcagttgcatctgaggggcaagtgaaacatgcagatggagcgaaggatgagtcaagcactgagcaatcaagtgccgcaccaacaggttctgttagaccattatcaagggaaaaacctactgcagagcttacccgaacaaaatctgcagctgggagaaagaagaagcggaaggaaatgctttcaaaagctgatgctgctgggacctcagatctttacaatgcatacaaaggaccacatgaacagtctgatagt

SEQ ID NO: 41263 - DNA, 334 bp, Triticum aestivum
  Clone ID: PAT_TA_41263
ctgactcttggtcggacgcgtgcgcctgctagggttttggtccttcgctttcggcggcgcaagatgggggagagggccaagggaaccgtgtagcggttcaacgtcaccaatgggttcggcttcatctacccgcacgacggcggcgaggaccttttcctgcaccagctctccatcaagtccgacggctaccgcagcctcaacgagaacaactcacgtgatttcgagatcatcaccggcgacgactgacgcaccaaggccaacgtcgtatccccaccatgtaggaggtgcactctccggccgctcccgacctgtctaatgcagtgatgaccgtggg

SEQ ID NO: 41264 - DNA, 234 bp, Triticum aestivum
  Clone ID: PAT_TA_41264
cggacgcgtgggcaaggatgatgccttctacaggtacaagatgcccagaatgttgaccaaattggaaggccggggtattggcttcaagaccatttttgggaccttggttgttttagcaaaagcccttgccaggcctgtttcttaacaaaccaattcctttgatgggaagctggggcacaatcaaagtttgatgagaagaccggaatcttcttggtcaatggagcccatgacact

SEQ ID NO: 41265 - DNA, 350 bp, Triticum aestivum
  unsure (1)..(350): unsure at all n locations
  Clone ID: PAT_TA_41265
gcctaccattgtctttgcggaagcagaccgcacctcaactgcaatatcttgtggatcaaatggcgaataagttgcccaagtggagggctgccctaatgccgaagagtggaaggctgaccttggtacagtccgtcctatgtgccatgccaatacatgcgatgatggcgttggacttgcccatcaagacgatcgaagctatgatcaagatatgtagaggattcctttggtgcagaaggatggaagcgaagggtggaaactgtgctgtggcgtgggacgcagtttgtgctcctaaatgggcaggtggcttaggattgcctaactngcgttggatgaacgtggccatgcagtct

SEQ ID NO: 41266 - DNA, 395 bp, Triticum aestivum
  Clone ID: PAT_TA_41266
cgcaggcaaggagggggttcgatccaatctttctttccacttcctcctgagtcctgaactaccaacgcggctgtaaatctctgccatcgccgtccgcgttcttcctcatcgcaacatcgtgcccctccgcaatatttgcccagtgggttctaaggccatcccagggatgcttctagctcttgtactctctttcgatcatcgcaagagcaaaggtgtggctgttccatcagacttgtctccctcctcaaagcggcgaaaatatgtatggtttgcgctaacaggttatggtgttggcttggtaactgcattggcagctgggatcttgtctcagtctccccagcctgctctactctacctggtgccctcgacactcgggcccatcgtgtacctgtcat

SEQ ID NO: 41267 - DNA, 211 bp, Triticum aestivum
  Clone ID: PAT_TA_41267
cccacgcgtacgcccacgcgtccgtttttttttactgaaccagttgtaggatatcacaattgcaaggctgcaagttacacaggtactagtttatcatgatcaaaagaaacttgtctcttagtctaaggtactgccgtaattctgcctaacggctaacgttagctactccaccagttcagttacacacggttccttaattcggagaatgatc

SEQ ID NO: 41268 - DNA, 151 bp, Triticum aestivum
  Clone ID: PAT_TA_41268
cccacgcgtacttccacgcgtacttttttttttactgaaccagcatgggggggtcacaattgcaaggctgttagctacacatggtctagttttttatgatcaaaagaaacttgtctcttaaacctaggtactgcctttattctgcctaacg

SEQ ID NO: 41269 - DNA, 392 bp, Triticum aestivum
  Clone ID: PAT_TA_41269
cggacgcgtgggatccaaacaaggtttccacctcaaattattgccatcgtggattccttgcacgagcagctggacttaggactattgtgctactgccattcgaagctggagtacttgagttaggcgcaatgcagaatgtgcttgagagtgctgaacctatggaaaccataacgtctgtgtttctaggggcaagcagtaagaagccagcgtgtgggaagcatgatgagtacgggtctactcaaatatcacccggtttggctaagatttccagaaaggattcgaatctcagccgacctctagtcaacacgggagcactcccattaaaaatgaacgaaaggtcatgggatatgcataagaattgtggtggcgagagcctgtcgctccacaatgtc

SEQ ID NO: 41270 - DNA, 406 bp, Triticum aestivum
  Clone ID: PAT_TA_41270
cggacgcgtgggcctcccaccctgcagcggtgcccccatccccgaccaccttccaccccgcggcgcctacctctccccttcccagtggatcccggcccagcggcggggaactgctctggccaactttctcgcccccctgcgccgctgcccaccccgcgttgtgcgccgccgcccgcaccgaccaccaacctgctctgcatctgcctcagtctggcgatatacctcagatccagctctccctcacgctgctggtgagattcacctcgccggatccagtggctgaggccacagatcgttcgatcccgagcggatctgtcgatgtgagccgcgagaaaacaacaccgtttggtggcggagagccaggcccggcgcagtgccctcctctcgatgccgcctctcacccccc

SEQ ID NO: 41271 - DNA, 409 bp, Triticum aestivum
  Clone ID: PAT_TA_41271
ccgccgccgccgcccctcgcatctccgctcgtcccgcaggtatccttccatcgccgccagaagtccgcatagagtcatctcctgcctctgccgccacccccttccgttggtcgccgtcggcagccgcacggactactcctggacaggactgcagatcctcgcgccagagaatcccttcccccagctcaaggtgagcagccccctcctgtaccattgatttggctagtttgtacagtgtatggagctgctctctgctgccgaacgaatcactgctcccgtcgaaagctagcggcggccggcttctcgggaagctggctattccctgaagctggagaagacccgaaggggccctaagcctctcactgacatattgatttgacatgcgccttgagtttcttcatcaattttc

SEQ ID NO: 41272 - DNA, 413 bp, Triticum aestivum
  Clone ID: PAT_TA_41272
cttgtaatacttgcaattgcacctttattagaatcagccaaaaagcttgcatccacaaagggcgatattatgcagggaagtacatgcgagagtggatatcttttagcacgggtgcattggagaatttaatttaaatagtttaaaaatcatactaaaagtaaaaaaaaaaaaagaattcttcatgatcatatggatgtaattactcacgtgtaaagtttggtgattaaataagtaaacacgtgagctatagaaaaatggcaaaattgtgatttctaaatagtgaataaaatgttcatctttacaaaatcatgattttgtcatttttacgtaactcacatggttacttatttcatcatcagaatttgcacacgtgtagtagcacatccatataaacatgttgcttttccggatgg

SEQ ID NO: 41273 - DNA, 368 bp, Triticum aestivum
  Clone ID: PAT_TA_41273
tagctcgcagcctctaaattttcgagctcctggtgccagtgtttgctagcaagctacaatctgcagcagcagcaatggcgaaaacttgcaccctagcgctgcttggcgcgctggtagtgctctcgcttcttgtgagccccattgcttgctcccgcaagctcgccaaggtgggcgggcaccacaaacctgctccagtcaagggccacaaaaaccagaccaccactaacccctcctcgtccgccgcatacggcggcggctggttgcccgccggcgccacgtattacggcaaccccaacggcgacgggagcgacggcggagcgtgtggctaccagaccgctgtcgggcacccgccgttctcgtcgatgatc

SEQ ID NO: 41274 - DNA, 385 bp, Triticum aestivum
  Clone ID: PAT_TA_41274
catcgacaccctcatcgtcaccaccaccctcagcagagggattggctccaatgtcgacatcaactgctgagggtggtggtgacgatgagggtgtcgatgcccacgccttgatcgtcccggacattctggaccggttccggcttgcgtaccagcctgctctatacaaggtggtatttatctctcacatgaagcgcttcatgaagaacctcactgtcaagcttgattgcgatgacctagatgtattaaagaagaatgtctagtcttccacgaagtattttcttaacaagctcaaggacctttacttatttgtcggcgagagcattcattatgatacgcgtttttgtgctccgcgtactactagtagtggagccagctgatccaactt

SEQ ID NO: 41275 - DNA, 300 bp, Triticum aestivum
  Clone ID: PAT_TA_41275
cggacgcgtgggtttttttgaaacaagaccagcattttgattagatctatgtttgcctcccagtcaacacgtgtcgcagttgcacaaaacatatttacattttctcgagaaaacctagctcctatagtttttagtggtcaacaaaaggcaagaagccttctcaaaaccaggggttcaccaacttcactttttaaggtgggagtgtcggcttattttctttcttcttcccaaaacctaaggctcaaaaattcaagggaggcccaaccacattggccattggagattggccgattgggccac

SEQ ID NO: 41276 - DNA, 409 bp, Triticum aestivum
  Clone ID: PAT_TA_41276
cccacgcgtccgtacgactcggtcttggaacatgacctactggagcatatacttgacttaagcatgaaacctagggatctaccgttgtcacttctgaagaacattacaggcaatttctccgaaaagaggaaaattggtgagggtggatttggaatagtctacaggggtgccctcccaaatgcggaagttgctgtgaagaggattattaagaacgtccagacaaatgatgagaacctatttcgtcgggaagttgacagcatgatggaggtcaaccatcaaaatatagttcggtttattggcttttgttctaatacagagcataaaaggatccaacatggagtaccaggaggatacatttacgctgaggctagagagcgaatactgtgtttcgagtacatcagcaatggca

SEQ ID NO: 41277 - DNA, 346 bp, Triticum aestivum
  unsure (1)..(346): unsure at all n locations
  Clone ID: PAT_TA_41277
gtttttgcaaaaaatccctccccaaattcccgacataacccgcgctcctggtcttctccggtcgtctgcccgcgctcctggcatagccgcgtagctccgcctgagctcccctgttcagctccggtgcacaactaccctgctctgccgtgcatcctccgccgccgccgcagctgcctcctgcgccgatccctcccgcctcacgaagctcccctcccccccactcgcctgcctgccacagcaccctttcaccccacaaatccatttttcttgctctacaggcttctacggcgtactccggctccggcgagcctncgatccagcacgcatatcgctcgcgcgcgggatg

SEQ ID NO: 41278 - DNA, 140 bp, Triticum aestivum
  unsure (1)..(140): unsure at all n locations
  Clone ID: PAT_TA_41278
cggacgcgtgggagttttagccctacaaaataaggtctctagcgtcgagtaggatcccaaaactttctggtagacctnataagatgccaaaacaggctgactctgacaacgtcgagacacactctacagaatcttcatcc

SEQ ID NO: 41279 - DNA, 265 bp, Triticum aestivum
  unsure (1)..(265): unsure at all n locations
  Clone ID: PAT_TA_41279
aattaacancattattttctcattttcaactttttctctaaaacatatattcaaaccgcattttttaaaacaacaccctcccttcaaaaatatatacaaatatattatatccaaatctttacacatatacttctctttcttttaatactataccaccatttatatttttctaataactaaaactctccccttttaacactcctcaacatacaaattaacattcacccaaatatctccaattttataacaatttctctatttaaaa

SEQ ID NO: 41280 - DNA, 306 bp, Triticum aestivum
  Clone ID: PAT_TA_41280
cccacgcgttcgcggacgcgtgggcggtcgcgttctatgacacggatatggcggcacggtactagcaggcgttccatctaatcttataaggtgacacttattccctaccacaagtagcccgaattatcataatctttctacttacactaaatcctcacgagcgtctacaatgctttgcccacttacttccgtgtgctccaccaaggacgccatcttatccctaggatgatcctccaccacctcaaggaacaggacagtgcggatttctttcttcttttgcttatcggggatctaaagaattcagtc

SEQ ID NO: 41281 - DNA, 395 bp, Triticum aestivum
  Clone ID: PAT_TA_41281
cgacgccggtgtacggaactccatcgccgagctgcctgtgcaccccgaccggggagcccggatgccagtgcccaactccaacccccacgccggtctacgtggcgccgccgacgccggagctccctcctcccacgccggtgtacgctccaccgacggcgcccgtgtacggtactccatcgccgagatgcttgtgcacgccgaccccggcaccggggtgcgagtgccctgctcccacccccacgccgggctacgggacgccaacaccgacgcctgccgctccggcgtacccacgggcggcgcctgaatacggagcgccgccggcgccagaggtgcccgcaggagtacggcacgcccaatttacactttcctcgggccaccacttagctccattaatg

SEQ ID NO: 41282 - DNA, 297 bp, Triticum aestivum
  Clone ID: PAT_TA_41282
cccacgcgtccgcggacgcgtggggtagccgtcccaatcctcgatctggtgggagaccctcctccgggcgtcgcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtttgacactgtccacggacagtggaagcaccatgaatttaaggggaaggactccaagac

SEQ ID NO: 41283 - DNA, 202 bp, Triticum aestivum
  Clone ID: PAT_TA_41283
cggacgcgtgggcggacgcgtgggttccactccactgccagcgagaactccgctgggtggtccgtgcggccggccctcgagatccagcatgatccctgccggtgctgcagctgctgctggtggaattgttgctcctcctcccggaggggtgatgcgcatccgcgcggtggcatgggctcacattttgcttgggtgggccacc

SEQ ID NO: 41284 - DNA, 338 bp, Triticum aestivum
  Clone ID: PAT_TA_41284
caccattcgttcgggttgacgaggctagtctatggaacaacgtatctcaacagagggaggaggactcactatggcactacactaacaataggactgaatggaagctagggatattggtcaggctagaatgggctggatgtaggaacaaacaacatggccgcgagctagctgattggaggctgcagttttgggaaagtaaggatgcaaggcttgagggatgacacacctggtgcaggtggaggaggaaaccccaagttcagagcgaggagttaatgtgttgcggacagagatcgatctactttcacgtattgttgaaccggcacttggtgtatcttatt

SEQ ID NO: 41285 - DNA, 266 bp, Triticum aestivum
  Clone ID: PAT_TA_41285
cggacgcgtgggcggacgcgtggtttttcctaatagaagagaagtgcatggggccctgtgcgcgggacgagaagaatctgaagagagtgtcatacgaggacattgttaaagctaccaactggttttctttggtccatactatcagtttaacttgtactggttcagattatgttggtaggttcaagtccgacaagagcctatttgccattcaaagtatttaagttgaatgaacctttgtggatacttttgttacctttattgagtgt

SEQ ID NO: 41286 - DNA, 198 bp, Triticum aestivum
  Clone ID: PAT_TA_41286
cggacgcgtgggcttcctagatcaattttctgaagactagaacaggtggagaaagagtatggtattacaccaataatattgctattttgaagggtaatctttacaaggtgactcatattacctaccttatgcgggatctcaccatttatctagttattatattggtttgtttttttcgagtaaagggatattaccgat

SEQ ID NO: 41287 - DNA, 278 bp, Triticum aestivum
  unsure (1)..(278): unsure at all n locations
  Clone ID: PAT_TA_41287
tatatctcctcttaatatcatatcggtcttttgggacattggtatcatancggagagcttgggttcaaatctcggtgcccgcatattccccaatcatttatccacgccaacgttgggcattggtggacgtgttgatcattccatatccacatcggatgtgagggggagtgggtggggtggggggttaagtatactagaggatacatggctcgttgttgcttgtattggatgacattattttttgtttttgatatcatgtagctccttaattatttttt

SEQ ID NO: 41288 - DNA, 242 bp, Triticum aestivum
  Clone ID: PAT_TA_41288
cggacgcgtggggtctgtggaaagcctattattgcagttctaattgaattggagttgtgggtgatggctgatgttctaaatcttgttgacagaatagcatggcatctatcagagatcactgctgctggaatcttgtaacaagtatagtagtacattgcttattgtgaacttaattatgcatgcactgagttgtgatgagtatggttgttctcgctgcttaaaaaggcaggctgtgccctttg

SEQ ID NO: 41289 - DNA, 256 bp, Triticum aestivum
  Clone ID: PAT_TA_41289
gttacgagtccctctagacacgtcctgtcccgcccgatcccatatcctttggcggcgggaaccctcgtggaagaagttatgcacctaatgcctcatctccccctcaacatattcgtagcaggatcagaagtctcccgccgtgagctttatctcattaccacgtcttctctcaggtctctatcgggatcagacattgtggcagtatgcgtgcggtggtgctgcataggacctgtcttccgtggcgatgcttttattg

SEQ ID NO: 41290 - DNA, 391 bp, Triticum aestivum
  Clone ID: PAT_TA_41290
aaagatcactgctagagccatggaacggacaatgaagaaaattggacacctgtcaggattttacattttcttctcttactggagggagttcttcagtggacgctctgacccctaaaatgcagaaggacacactggattcatttcgctccggaaaggtgaacttactatttactacggatgtcgcggaagagggtattgatgtcacagactgctcgtgtgtaataagatttgatttgccaaagactacccgtagttatatgcagtcacgtggacgagcacggcagatatcaaattattttgtttaacattttccctgtcaatcattagtatgtgtgctcaaggagagcagcgacgacgtccgggacgactggttcttgctgggcaggttcga

SEQ ID NO: 41291 - DNA, 379 bp, Triticum aestivum
  Clone ID: PAT_TA_41291
catctctcctccctccgttagggttccactcccattcctcctccggccgggggctgcgcatcgacctcctcggttgccatgggcacggatgaccacgaattccggctgctcacgatccctacgcccatccaccccgaggatccggactctcctcttccggagaccatcctcatcgactcgttcggctacctcagcgaccgcaccaacgccaccactgccaatggccgcaggagcaggaccgagaagaagggcaagcgcatcctggtcaccttctggccggctgccccgccgcgcgtctcctgcttcactgtccactgcccagatctgaaggccgacgcgtacggcagcatccccaaggtctgctacacggaggacgggc

SEQ ID NO: 41292 - DNA, 134 bp, Triticum aestivum
  Clone ID: PAT_TA_41292
gcggggccagcatggacaaggcggacctcgacggcgactgctccgggcctgtgcagaccacggtgccggcatcctatcttcgggagctcttgaagagactgtaggtctgccaccctttcaccatttacgacttt

SEQ ID NO: 41293 - DNA, 204 bp, Triticum aestivum
  Clone ID: PAT_TA_41293
tcgactcgtcccgagcctttaccaccctaccccatcggacctatacctggattgcgggttcctacccccgtggctccttctctctacgtcttcatggttgtagctcgcttactagtttcttacaaattttttacttggactgaggcgtggatattttgggtagcccttctactttatataatttcagacgccttaaatgatgag

SEQ ID NO: 41294 - DNA, 256 bp, Triticum aestivum
  Clone ID: PAT_TA_41294
catgcctgatcctgcgatgcatggtgttgggggtgcgatcacatcgggatgggagatgggagggatgcctatgacatatacctttccctcacaaacagttccaattgaggcattggcttcatgcacttgccaattcacccccagagactcaaagaatcatgcttgacaagaacttggaccctcttgatgatcaactggggcacgaccaggcttccaaggtgaccggaatgcttttcgagatggaccatacttaggt

SEQ ID NO: 41295 - DNA, 167 bp, Triticum aestivum
  Clone ID: PAT_TA_41295
gcgtcaagcgcatctccgtgctcatctaccaaaagaccctctgcgtacttagaaggggggtttagaacgtcatcctttactcctacacctacacctaacactcttgtcttaagacctgtaaggtcatggactttcaattacttgccgtaatcgccagggtctcaccc

SEQ ID NO: 41296 - DNA, 306 bp, Triticum aestivum
  Clone ID: PAT_TA_41296
gctggtctgcctccggcgaggcctttccctcctccggcagcgccagccccggctccggccccgcctgctgctccacctctccgccgagccgatgggggacccggccgtcgcgccggacgcgccctacctggaggcggtgacgcagaagcggatccgcatcttcgaggagatccaggcccggcaggccctcgagcgcctcaacatcggcggcgaccccatcagagtaactttgcctgatggcgcgataaaagaaggcaagaagtggatatcgaccccgatggacattcgcacggggatatcaactgg

SEQ ID NO: 41297 - DNA, 136 bp, Triticum aestivum
  Clone ID: PAT_TA_41297
gtttcatggacaaaaggttttaaacgaaggaaatatgaagtacatggggggggagggtgaggtatgggctctttataagggatggaacatgcattggggttcatattcatataattatagatcctatgtatatgat

SEQ ID NO: 41298 - DNA, 381 bp, Triticum aestivum
  Clone ID: PAT_TA_41298
cccacgcgtccgcccacgcgtccgtacgaacagacctgatgctgtcgaccaagcgcttcgaagaccaggaaggtttgatcgggaaatatatcttggcgttccagatgagaatgcccggaaacagatactggagaggctcactcagaaacttcgattgcccccggaaggccaatttgatttgttgaagatagcaaaggccacggcaggattcgttggtgcagacttgaaggcgttggttgatacagcagggagtgtagctatgaaaagattttttaatgctagaaaagacaagtttctgaaggaaggaaacaacctggactaccggaagcatcctttggataaacatgagatgcagggcctaagtataactatggatgactt

SEQ ID NO: 41299 - DNA, 397 bp, Triticum aestivum
  Clone ID: PAT_TA_41299
cgcaggttccgccaccccctgcagcaacacaaccccgcaatcccctgccccggcggcggtccgaacccctgccgtccgccgccgaccaccaccgcgatcgttcgttgccaccacctgcgctgcctgggctattatgcctggctgcgttttgggcgaaataatctcgctggagacagaggcgggagaagagtcgtcgatttcgttgtgcaatcgggtaagagaggaggagtttgattgctgtttgtgcggcaagcgcagtccaaaaggagtaattattattcggagtttgtgtgttgagaagttgtaaccagatactcctccctctcctctaacaatctcctcccttttggaggagagccggcccaaataaacaaaggagtgggaggagtaggagggg

SEQ ID NO: 41300 - DNA, 225 bp, Triticum aestivum
  Clone ID: PAT_TA_41300
cccacgctccgcccacgcgtccgcggacgcgtgggtgtgtgtttagttcaggtgagctccagaggaacggtacgaacaatacagaaaaaggccagacttcctaacagaatacatattccctggcggttgccttccttctttggcccgtgtagtgtctgccatgagcaagtcatcaaggttgagcatagagcatgttgagaatattgggccccattactacacaac

SEQ ID NO: 41301 - DNA, 268 bp, Triticum aestivum
  Clone ID: PAT_TA_41301
acccgtatccgtcgcctcggccggtcccggcccgaaaccctagctaggcaagcaggggcagcccaagaacacggatgacatccaatcttaacacctagagcttcaccgtgcgagtgaggtacaatcctgtagagagcggcaagtgcggagctgtgtgctacacgtgccaaaccaccatggggattaggtcgttgtttgagggcattgagattggcgcggatctacgccgagaacgccatccggaagcgcaccgagcacatgaactacc

SEQ ID NO: 41302 - DNA, 391 bp, Triticum aestivum
  Clone ID: PAT_TA_41302
cggacgcgtggggtgccaccgccgcgagcgttgccatggagccgaagcggccaccagcagatcagcagccgtgcctgctacttcggaggtcctcacttttttgctgcaatcggtttgtgggaagctgcaaccggccgtctaggagctgcgaccggcgacggccacctgcgggatgcggcggcgctggaaacggtgacatcagggatgctggaacccgtggtgttttttgctgctaccagctgtaatttttgctggaactggtgtgttctttttccttggatcggtgtcggcggtgattttctgctggaaccaagttctatttttgctggaaccagtgatatgttttctgctatgggaagaatttttggtggaactggtgtttcctttgctc

SEQ ID NO: 41303 - DNA, 267 bp, Triticum aestivum
  Clone ID: PAT_TA_41303
cccacgcgttcgtttatgcgttcgcagacgtgtgatcggacgcttggtcggtgtctttggttgacaagttaatgagagaaattttcttgaagaaagtgctagctatattactgtgtgattatattttggaacaaatattttatacttagtaacaacttatttttttgatttgtataccaaaattaactttttatttagatatgatttttgtatatattatgaaggttttttatttgttttagtgtggttttatttataaaatttatt

SEQ ID NO: 41304 - DNA, 384 bp, Triticum aestivum
  Clone ID: PAT_TA_41304
gctaactggaagtaagctcgactgacaatacgcgttatcaaatgcttgctcttctaactaaagacacaggtcatggttctggatctatacttactgaaatgattactatagagggcacacagcttcaaaagtgaagaatgaggggcgtgttatgttgtttatttccgacaggttggttcaatataaaggtgccatttattgaatatagagcatgggctggaatggctatgcagaattaaacctatatgagttcagggtattggataacatacttatatgtagttctcgagtgtgcacacatgtggctgggctacataatatgtagatgcattatacatgcaaagtggttatgctgctgtctgcttctatgggtacctaaaagac

SEQ ID NO: 41305 - DNA, 388 bp, Triticum aestivum
  Clone ID: PAT_TA_41305
gtcaactggaagattgctcgactgacaatacactttattaaatgcttcctcttctagggaaaaacacaggtcatggtgctccacctatacttactgcaatgttacctttcgacttcacacagcttccaaattcaaccatgagggccagtgtcttgtgattcattttccgccagttacttccaatttcaaggtaacatttattcgatatagttaatgggctgagaaagagctatgcacatttaaacctatatcatctcagggtattggataacaaacttttttgtagtttgtgactgtgcacacatgtggctgtacaacttaatttgtacatacatcatacaagcaatgtttttttatgttcctttctgcttctataggtccctaaaat

SEQ ID NO: 41306 - DNA, 386 bp, Triticum aestivum
  Clone ID: PAT_TA_41306
cacgcctcctgggcggccggcggcggctgtcactttcgggggacgccgttcctgacctcggacgcgctcacgctcgccttcatcaccttggtctccctgctctacttcaaggactacaccgctacgctccaccccacctacaaaccaccatgacgacacgcaccatccccgcacccccagcatgcaatcctacttcacttcttaccagagttgccagggcccaaacctgaaagcgagctgactttcaagctttacctgccctcaacagagccaagccaatgccaaagccaagaacactagtgcttacccctgccccacccccagatgccaaccggccagctgattaaccttcccaagccgtgccagaatggatcggcccgtgcacg

SEQ ID NO: 41307 - DNA, 405 bp, Triticum aestivum
  Clone ID: PAT_TA_41307
cccacgcgtccgcgccctcccccaaaaccctcctcctccgccgccgccgccgcggccacgatcgccatgtccgggccaagctgccccaccaccgtccccgtcggggaggacacgacggtgcctctgaggatgctgcacgggctggccccggagacgctgaacctccacacgcacacgatgctctcattcctctactccttcctccccaagccacccgtctccacactcgcccccctgtgctgcgccgccacggccgccgtcgccgacggaagcgcggaccgcctcagctgcctacccgacgatctcctccgtcgcgtcctctctcgcctccccgccaaggacagcgcgcgcaccaccgtgctctcctcccgctggcgcggcctctggcgctctgtgccgctcgtc

SEQ ID NO: 41308 - DNA, 408 bp, Triticum aestivum
  Clone ID: PAT_TA_41308
ccaacaccagcaacacacacacagcagccaatcgaagctcgtctcagatcgaagatgtcggtccgcggcaaggacgataaggtgctgggcaagggtgtctataatcgccacctaaaggttctctattacaacatgcaattctttaccaagccgtccatgcattatatggcacggcgggacatgcgtgaagcgcatgtttgcgcttatttactaagagacccgctgtgtgcataagatctttctggagaacgtgatcgcgaacgccgtcacctacaccgagcacgctcgtcggaagaccgttaccgacatggacgttaaatacgccctcaagcgccaaggccgcaccctctaccgattctgcggataggccttgcctgtacactcatatacacttcgcgccgtcagatt

SEQ ID NO: 41309 - DNA, 392 bp, Triticum aestivum
  unsure (1)..(392): unsure at all n locations
  Clone ID: PAT_TA_41309
gctaccacttcactgcttcctctcccaaactcatcgatcaacaacgagcatctatctagattggccaagtgttcgttgatctacaagccggtttaagatctgggattggccggtcgaattcaacacggagctgagtgtatgtcgaaacatttnatccatcaagcgccgcctcgccgcctccggccaccccgatgacgccctcgccttcaccaacctccactactccatgaggctgggtgcgtgcgcatggcggcgggtctgctgtggtgcgtgcggtggtggcgcggctgggctcgaggagctgcgatgcggcagggagggagctgcttcctcttgtcctgcttcgtgtccctgaggtggttagctgtgcaaggggcgggcgaggagggtgc

SEQ ID NO: 41310 - DNA, 399 bp, Triticum aestivum
  Clone ID: PAT_TA_41310
acctcccagccacagccacccctctccttgttttcggtgcctcctcccacctcgagggccgcgccgctgcctcccccctccagatccggcgtgccccagcctcccttcgccacctggcaagcccccagtggtcagccgccgcctgcaccgccctccacagccactcccaagcctccacgtgccttccccgcgcctccagccgccgcggcccgcgaagcccacggggagtccgccccgggccgcgaccgggcccgaccccgtgcgccttggcccccttgcctgcttgcccactccctcgctcgatcccctcgctgccgcatcggtcctgcgctccggccaccaggggcctcgccggagcaggaacacccgaccttcgcccgacccaggagccaccacagc

SEQ ID NO: 41311 - DNA, 397 bp, Triticum aestivum
  Clone ID: PAT_TA_41311
cggaagctattctagagaaatcgggaatgccctgctcgtcggccccgcagtctcgctccgcccccggcgacctcctcccccccatccacccaaggcagcgagattgctaccccggccccaagtgaagatccatccgggcgtagttccttcttttcttggttcaaatgactttggccagttgggagatgggacagaggagagtgcaaaggaacctaaaaaagtcaatgcactggcaactgagtttgtgaaatcggtgtcctgtggcgcacactgtacagctgctattgctgaacctcgagaaaatgatggcacaatatcgagaagcaggttatgggtttggggacaaaatcagggctcagattaccctcgcctatactggggtgcttttgcaccaaac

SEQ ID NO: 41312 - DNA, 382 bp, Triticum aestivum
  Clone ID: PAT_TA_41312
cggacgcgtgggtggagacatacgtgtgaatattcgaacagccgatccttgggtccatctgcttttggtgttgccagcggcgcacccatcaaccacccccacccgaatcatgagggagtgcatctcgatccacattggccaggcctgcatccaggtcaggaactcgtgctgggagctgtactgcctcgagcatggcattcagcctgatggccagatgcccggtgacaagaccgttgggggaggtgatgatgctttcaacaccttctttagcgagactggggctgggaagcacgttctccgtgctgtcttcgtagatctcgagcccactgtgattgatgaggtgaggactggcgcttaccgccagctttttcatcctgagcag

SEQ ID NO: 41313 - DNA, 331 bp, Triticum aestivum
  unsure (1)..(331): unsure at all n locations
  Clone ID: PAT_TA_41313
gcggcatctcggagaagctcccttcccgcccaaatccgcaccgcctaccttggaggtttctggatctcggatggcgtcagcaatcgtcacggtcgaggccggccggccactcgggtgttcccgggggcgcggggcacgggggttggtggtggggagcgcggtgcggtgnactgggggtgcagctcgccgacaagctcaagatcttaagacgacaacttcaccccgaccctcgtgcagtccaagtgccaaccatgacggaaggaaataagacatttggctctatctgaagatctaaagaaggttcagctgagaaatggcagaagtgttatgc

SEQ ID NO: 41314 - DNA, 405 bp, Triticum aestivum
  Clone ID: PAT_TA_41314
cggacgcgtgggttaaaccccacctcccttcccatctcctccaggccccctgccccttgcgtccccgccgccgccgtcgtcgacgccatggcctcctccgcgtcggcggcctcgccgctcacctgccaccatctgggcattcgccaccgcccccacctcccctcgttctccctccgccgccgctccacctgctcactctcatctaagcccatcttcctctacctctcccactcccattccctccccaagcccctgaccccgtccacagctcgccacctgctcccgcccgtcgccgtggcgccggcatctccccccgcgccggtctcgccgccggcgaagccagccctgcagggcgcggccatcaagccgctgctggccttcattgccacgggggtcatcatctgg

SEQ ID NO: 41315 - DNA, 342 bp, Triticum aestivum
  Clone ID: PAT_TA_41315
cccacgcgtgcggggactcgtgggccagattcctacacttccctgaccctagccaaccctgcacctcccggcggctgctgtgtcttgctgctagcatcattcagcggcaagatgaggtctattctcatgaaggggcactagcgcccgttcacgttcctgaagtacaaccgggacggcgacctgcttgttcttatgcgccaaggaccacacccccaccttctggtacgccgtcaacggcgacctcctcttcacttaccgtggtcacaattgttcggtttggtgctggaatgatttacttttctcttcctttgtttatcaactttttgcttttttcttcgattt

SEQ ID NO: 41316 - DNA, 401 bp, Triticum aestivum
  Clone ID: PAT_TA_41316
aaagaaaagacccgacttttctcctctcctctcctctcccctctccgcctccgtccgactgcgtcgcgggagaatccaagccatggccgggcacgccaagctcctcctgtacattgtggtggtggacgagagtggcgcctccttccgctacacccgatccctcctccacagcacgctccagctcatgggatgcaagcccaggcacgcattcgagattagccggcgggtgttcgatgtggtccgcggcgaccccgcggagatggagatgctcatggccatgtccggcagccaagggggcagaggggtgcagcgttacgagctgccggacgccgccaccagccccaggcagttccagttcgagctctacaagcgccggacgacggtgctcatccccagggacc

SEQ ID NO: 41317 - DNA, 354 bp, Triticum aestivum
  Clone ID: PAT_TA_41317
cccacgcgtccggtcaagaactttgcgattgatttcctcatgggaggagtgtcagctgcagtttccaagactgctgcagctcccattgagcgtgttaagctgcttatccagaaccaggatgagatgatcaaggctggcaggctctctgagccatacaagggtattggtgactgctttgggcgcaccatcaaggatgaaggctttggctcattgtggagaggaaacactgctaacgtcatccgttacttcccaactcaggctttgaactttgctttcaaggattacttcaagaggatgttcaactttaagaaggacaaggatggttactggaagtggtttggtggcaaccttgct

SEQ ID NO: 41318 - DNA, 168 bp, Triticum aestivum
  Clone ID: PAT_TA_41318
catacacctgcctccataccaccttattatacatctctcttaggggattgggtcactcttgtaaattaaaattatctattaaatcatttctgtatcttttttatttaattcaactttcacctacctatctttctatagtataattactattccaattcccttaaatat

SEQ ID NO: 41319 - DNA, 397 bp, Triticum aestivum
  Clone ID: PAT_TA_41319
atttgataaacaagctatgatcgttggagagtacccctcagatatataggtgctttgatctgaaggattggtttgtgatacgtcattgattcatcgttgacacaaatatgaaagcacactagaaagataaacataggagatcatagctgaagggtgggtttacaacgacggtggtgtgctgcctttcttctagtgccgacacgatggctagtttgtcgccccgtaaccctggtggtgggctcccatgactgccttctgggttacctaccacttagcattaatccatcaaggggcatgggcaatgtccttgttctatttcttactgaatccggttccaataaagatgccgacaactttgcagccgaccacctcaccattgccggcaattgctccctgc

SEQ ID NO: 41320 - DNA, 182 bp, Triticum aestivum
  unsure (1)..(182): unsure at all n locations
  Clone ID: PAT_TA_41320
ggaannncccggggcgacgccacgccgtccattcttttttggtggtcacatccctgtgtaagattctcacacgtgagagatcctacgtgtgtgcgtagcctagtaccgccgacctttctcatctttttacaactactttactttactgagctttcttagttggttagaatgaattgcctttt

SEQ ID NO: 41321 - DNA, 429 bp, Triticum aestivum
  Clone ID: PAT_TA_41321
tcgcggacgcttggggccgccttccctcgttcttcttgcttcagatcagttaacgtaaattggcttgacgcataggacattcatccccttgtctgttacatttgaactggaatggtcaatggttgattctttctgatacgttgctttcatttgctttatttcccttaatttgttttattgtttactccattattagtgattttttgttttgtatgatcttattttgttttttttatgtttgtttgatttgtttttatctatttatttcttttttagttttattctttactctttatatttattttttataatttacaattatttttttatttatttttatttttaatatttttattttttcattatttatattatatttctatattttttattatttttatatttattattattaattataattatttt

SEQ ID NO: 41322 - DNA, 287 bp, Triticum aestivum
  Clone ID: PAT_TA_41322
cggacgcgtgggcgccgctagggtgttcgttcacacacttccgccgccgccatccctgggaaccggagagcgaggccgacactctcgtctcgatgagggccaagtggaagaagaagaggatgaggaggctcattaggattctccttatgtttatgcatttattcaagttggttgccttgtatggagggttagcatttttttatatttattttgttttgatctttgagggattttgatcatttgttcaagtttattttcttttttatttttttttttatttttttttt

SEQ ID NO: 41323 - DNA, 479 bp, Triticum aestivum
  unsure (1)..(479): unsure at all n locations
  Clone ID: PAT_TA_41323
ncnngacccacgcgnttccggaaaccagcnaagcaaagactgggtgggagcnntgaaggagcacnnaatctatcgaagggaagggttcagcagtgcatnngcttagagtaaccctcagacnnaaaaggtgnnttgacatgnngctggaacgacccaccagaannggagctnntggtttgnnatggaaagnncagccttgtttctannagatgactnnacgcggctttaactcaaannttttacgagggnnagttcnnaacacnnatacannatgaannnatctanntgacangtnnttcgttngaagaaatgggtncnnttcaagnannaaatctngnnctgaaaagggaatattanntgcatatgnnngcctggagananngccttctttaagtcccaaatcaacgagganannttgtcccaattgtgccaagggggtctggattgttattccagnncagtcactgtcntggaacaac

SEQ ID NO: 41324 - DNA, 379 bp, Triticum aestivum
  Clone ID: PAT_TA_41324
acccttccgcggccccgtgggggcttcgtaaaggccgtcgacccatccatttggcgcatgctcgagatagactgggatgaatctgtggtagggtcactaagaaacaggcatgtcaatgcttggcaagtggaacttgttgggtaccctcccatcctgaagaagctcaagatctccgagacgatccttccccctatgtgctctggcgatgtcagcgtggctgaccccctgctggggccagactgcgagaacatggtgatgctgctggggtcacctattcctgctggcatgcagggagccaggcacatcggcctcactgagctgccctcttcatcttctaccgtgctcacaaccaagcagttcttcccacctagctccagcg

SEQ ID NO: 41325 - DNA, 365 bp, Triticum aestivum
  Clone ID: PAT_TA_41325
gtcttaccataaacaatggagatcgactcttattaccaagaacacaatccggataaaggatgactaaaggtttaaagacataggagagggatcgtcgtcatggcgatggatcgggtcctttgctccatgcatgtatatctcgtcctgctcgcaggatcgctgttttcactttctttctcttatgaggaggccaagaagctctgtacggtgatcggtatcaatctttacatcacctactcatgtgtcggtgtgtacaagaacggttatttttatttttattcttctattgtctagttgtttttttatttactttaatattttgtttttttttatcttatatcttgtacttatatttctcagtgttt

SEQ ID NO: 41326 - DNA, 138 bp, Triticum aestivum
  Clone ID: PAT_TA_41326
cgtcgcggaccgtgggccgagcaccgaccgcgccgcccgcggcgcgcgactgagcatgtgctatccgtgaggagttcagcacatcttgtgtgctaacaccaactgacgtagcaaaatatgtttccttccttcataagg

SEQ ID NO: 41327 - DNA, 296 bp, Triticum aestivum
  Clone ID: PAT_TA_41327
aataagcgcaccacgctcagggactgatgcggttatccgggtccttgcggacgacggcgagggaggtggaagggcgctgttcgtcatcctccggcgtgaacatctccggcatggtgcctgtctcctccagctccagatcgagctcctgctgcccctgcccctgatccccgccattggctgggccgccgttggcctgctcgtcgaagatggcgtccgcaagggcgcgagaggactcggcctcgatgagctgccagttgtcttcgtagagctcgaccaggcgcttgaggacgggggcg

SEQ ID NO: 41328 - DNA, 396 bp, Triticum aestivum
  Clone ID: PAT_TA_41328
cggacgcgtgggcggacgcgtggggtccaaggcgaccatatgccaatgactcctcatggagcacatctgcccaatgttccttttgttgacaacgtgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgactgctgggtatgctttgggtggttcaggtttcccacccgttatgactagctattctccccagagttctgctgcgacacctctagacagtcctatgactccaagctttagtggtaggccatctggttttccttcagcagggaatcttact

SEQ ID NO: 41329 - DNA, 392 bp, Triticum aestivum
  Clone ID: PAT_TA_41329
cccacgcgtccgcccacgcgtccgcttgaatctggcaagtatatagagtatcttaataagcgagatgcaggactgcccctgactgctgtcaccagtcgctcggcatagtttacttgggttattcttattagtgcgccgtaatctagattcttcacacggccgcacatacaccacgtacgcacatgatagttcattcagctaggtgagttaccagacctgtatactgaagtgcgtagtagtaccgtgtttcagcttgcaatatgcaaacacaaatctgatctgaaaaatcattggcaaaggctgtcaaagtagattcgaggaatatgtgccgtgcccactaatgatgcacgaatattacagtacatctgcagcttaacaacatagtatgcatc

SEQ ID NO: 41330 - DNA, 286 bp, Triticum aestivum
  Clone ID: PAT_TA_41330
cggacgcgtgggcggacgcgtgggctgagttaagcttttaaaaccaagagaagcactgaatagaactagagctactgcccaacagtcaaagtactactagatacgacccatcttacaaacaaggacacctatacgataactcatgacgcggtagcattcagttcatgcagctctgaatctctgattgcgctccatcgcctcaatggtcactgctgtgggggccgctgcttgttgctgttgttggtgcggatttgaatgaaaccttggtgcttgttggttggctggg

SEQ ID NO: 41331 - DNA, 357 bp, Triticum aestivum
  Clone ID: PAT_TA_41331
gttagaaataggtttcatgctggttcatttgaagtggaacctatgcgtgttactcattcaatggctgactgctctcaattaatgctttttagtggattaaatacaatctttcatacttatgactgtaaaatagattaatcatcagtatatgggttaattatctacctagaagcatatatattttattttatattaagtattacttattttattatttatttaataaatttttcactattcttaaagtttctcaaatttaattatttataaattattgtttgatttgtgtattaatcttatatttaattttttatattatatctttttaataatattttaatataccttaccaatcat

SEQ ID NO: 41332 - DNA, 223 bp, Triticum aestivum
  Clone ID: PAT_TA_41332
cggacgcgtgggcccagggcggctgcgggaggaggagaaaaaaccagcagagcaccactggattcgcctgcccgcctggatcaaacccaacccaactccaaacccagagggatttcgccgtggcctccgcggggtcgatccgatccggtccgtcgcgcgtgcggcatgcggttgcatcgaggttcgggatcggtcgtgttggcagccgtgttggtgagggctg

SEQ ID NO: 41333 - DNA, 404 bp, Triticum aestivum
  unsure (1)..(404): unsure at all n locations
  Clone ID: PAT_TA_41333
tttttgaagaagccatgcctgttggatctgggggattgggcctttcaggggacctagaaaaggggccggaggcgattattgtttggaaaaatgaaagggcctcattccagaaggggttggaaaggggggccaaaaatcatcgttgctaagggagaggctgtcaatggccgggaaaaaggggaagggtttggtacagggagcgtgaaaggactcaaggcgaggtcctcgatgagaagaactctgagatagagaagctaagacatgctatngatgaaaagatctctgaaacagagaatgtaaaacatgctttggataggaatagctctgagatagagaagctgaaacatgctctggatgaaaagaattctgagctagaaaagctcagacaagctctggatgtgaat

SEQ ID NO: 41334 - DNA, 402 bp, Triticum aestivum
  Clone ID: PAT_TA_41334
cggacgcgtggggccgccactatctttctcaggatccagatccaccactgtggctggggttccccagcgagccaaccctcacatcacagccgcagcctgctccttcctgatccaccggccagccggccctggtctccctcgcccttcaagcccgtccaaaccagtgggccccacgcctccctgcgcgctatccaggaatagcgctcgcccgcctccatgctcgttttggttcgggagaggatctcccgaccgtgccttccacgttgccgcctgctcgccggacgaccagcgctgttgtcggtgaccaccaccaggaacagtgccgccccgccttcctttcattcttctccttttccttcgtcgctcaattcgattctgacctcacagagaccttcaagggag

SEQ ID NO: 41335 - DNA, 177 bp, Triticum aestivum
  Clone ID: PAT_TA_41335
cgggaggaccgacgcggcccacccacttcggttgccaatactatctagctggtttatccagatccaccactctggctcgggggccctatcgtgcccgcccccacatcacagccgcagcctccttcttcctgagccaccggccagccggccctggtcttcattgcccttcaagcccgt

SEQ ID NO: 41336 - DNA, 270 bp, Triticum aestivum
  Clone ID: PAT_TA_41336
cggacgcgtgggctggtcattaacaatggaaatgattgtgtgaaatttaacacattactgggctgcaaactgtttccattattctgctgaacacaacctttttaggggcgcacgggattgctcctttccctttctctgcttgttttcctttctttgcttggagggcgctactgctcttctttctctttctctgcttcgaaggtggggggggtgctgctactgcttgtaggggactgctgcttggaggatgttgctggtcttcttttcctt

SEQ ID NO: 41337 - DNA, 397 bp, Triticum aestivum
  Clone ID: PAT_TA_41337
gttggacgagcaggtggcgtgtttaactgggtagattgttttgtcagtctctcttcatccatgaagtgtcaatttgatatacgaattccgatgaatgtgaaatatgtcacatgatgttgttctcgtagcacaaacttatctagaattattttctaaattgcagacatatggttattacctagcttacttttggatgaacaacaacatgactagaaaagctcttgggatcaaggaggtacacactatatcttttgcatgaaacttatttcatagagtatgcatccaaaggtatcattatgtagttttaacttctttagatataaaattagacacgatagggtaaaaaatgttgtagaagtagaaaaaagtaaagaaaatcatcaccttttgaatcttg

SEQ ID NO: 41338 - DNA, 275 bp, Triticum aestivum
  Clone ID: PAT_TA_41338
gttggacgagccggtggcgtgcttaactgggtagattgtctcgcgcgcaagactaaattcatgacgcgtggattggttgtactgaccttgtaggaacagaaacttttcttatgcgggtgctgttgtcgcacactctcactgtacaagaattttataacttggacacctatcgttaatacctacacttctttcggctggccactcatatgggtctaaaagcgcgcgtgagagcactaggtgcacacacacggctctggcgtgacgcgctagtagca

SEQ ID NO: 41339 - DNA, 321 bp, Triticum aestivum
  Clone ID: PAT_TA_41339
tccactcgtcttaccacgcgtccgtcgactcgtacgtgcactcttgttaggagacgtcgttaaccattactaccttaacctgttctacaggagaagcgtcaacttgcttttcattgtactgacaaacacggtttacctatgtgacaccacaagtgggtctacatcctcgatagtttccggtgattaagacgatggctcagtcactagtgaaagctgggctcctgatgctccagagcattgcatattggccttaacttctctgttgtccaaatatcgtattacagctcgaaccgactgctgagtacactgtaaggtgctcat

SEQ ID NO: 41340 - DNA, 389 bp, Triticum aestivum
  Clone ID: PAT_TA_41340
gcgagatgcacaaaaagctgcctttcattcacctatgaatcgtctcacatggcggtcgtctgcacgaagtagtcggtctggacagacacccatggcaatgcaccccgctagcactctggctaccaagactcgtgcgcagagtcaatccggccccaaggttcattaagacaccatacaggtttcgacggctgactgtgacattattcacgaaccgtaagtgccaaaatcgcagctagctgtgcattcgcaatgctcacgttgcgaatccaggtcactaataacgggcatgctttaataaccgagctagacattgaaaattctgctgttaactctctgaaggaggtcagccagacacacgttgaagagctgttagaggacacaacacttgt

SEQ ID NO: 41341 - DNA, 300 bp, Triticum aestivum
  Clone ID: PAT_TA_41341
atgcgtgcaaacttggtgggctaattcactcgttagaggagaaagcaacgttctagggggcaccctaccgatctacttaaatcacctctaagacatgatcaatctcccgcccctagagacgggcctgattactccctgagcttggcctttaaaacccatagtcgtacttgctaactagactacgaattggaagggacaaacatggtccgggaccacatatgttcgatgcacaagtcggagctctttgaaactgcaagctcacggcttggaagcacatactgtacgcaaaaagttttttta

SEQ ID NO: 41342 - DNA, 287 bp, Triticum aestivum
  Clone ID: PAT_TA_41342
ggcgctcttggggttttaattgactggttagaggtgaagaaaacgtgtgatgtgacatgctactgtgctaacaggaacatttgtgaggtgtgcctgccacccccgctcagggtgagggctgcttactcgctgagcttgccgattaagtgagctagtctcatgaggaaactagtttacaggttgaaaggtaaaatcggtggcgagaactactatgtgtcgttgcagcatcctgctacatttgaaacataattctaacggtgtagaacctatattgtattctaaaagtt

SEQ ID NO: 41343 - DNA, 395 bp, Triticum aestivum
  Clone ID: PAT_TA_41343
gaacaaaccagaggttaatcagaagatgatgaaatctgcactcatcaaagatttatacttcgaaatggaccgcctcaagcaagaactgtatgctgctagggaaaagaatggtatttatattccaggggaacaatacctagccgatgaagctgaaaagaaggctatgtcagagaagctagaccgtttagagcttggtttggagtcaaaagacaagcaactagatgagctccaaggactgtacgattctcagaaagtgttaagtgcggacttaagcgataagcttcagacattgcagaaaaggatgcaggaaactgagtgcgccctagcagtccttgaagagaagtatatgcaggcaaacaatacaataaaagagaaggagtatctgatagaaaatc

SEQ ID NO: 41344 - DNA, 403 bp, Triticum aestivum
  Clone ID: PAT_TA_41344
aggacgcgtgggctgacgcgtggggaaagaaggaggattcactgtgtctgtgccacacacactccttgacaccgaaggtttgtttggatcgtggtgctccatggggtttcttgaccagctgtgggacgacacggtggccgggccgcggccggaccacggtcttggaaggctccggaaggacgcgtacttctacctgtacttcgccatctatgagacgaccgttgtcatgtcgtcgaacgatgtagccggtccgagcgagacgcacagaatcaccatctgccacccgtcaattttgtagcagagagaagacaacagtcgggttcaattgctttgggcggattgagaggttagttatgtgaattgcaattgatagagatgacattgaacttgtcagctgtcaatg

SEQ ID NO: 41345 - DNA, 353 bp, Triticum aestivum
  Clone ID: PAT_TA_41345
aggacgcgtggggaagcgtaaggcttaaagcctacagcctactcttaaaaatggagacccgatccctaaatgggaccataggattgactatgctgaatgatggtcctgatgctgacgccgatcctaggtcagtggtacagcatctgcgtagtgcaagcttgcaagctaacagaacaagcggacgctggagcagcggcttgtaacttaccatgcgctgatgacagaactgttattgatagtcattcacatgacagacgttttctgatacagatgactgattgggttgcacacagacagaccgttcgaagaacggggtaaactgcgctgctgagcttacataggaagctatgatc

SEQ ID NO: 41346 - DNA, 387 bp, Triticum aestivum
  Clone ID: PAT_TA_41346
ctcactcgttgcaccacgcctgctcattccccttctttttggttcgggggagcctccctatagggaaagacaagccctcctccacctcatagtgcccaacctccctactacctgcacgcctgccggattaaggctccactagacagatgctagcccaacgcccataatcaaggggtctctgtgcgaggagcaaggatctcctggaggctaccatccatcatagctacttcctcatctgctcaaatcattctgctcgtaggagacaacgacgcatatgcgccccctgccacccattaatattctataataaagaacacaaaacatggcatcaatgatttttgtcggatttggaggttagttctgcgaattgctctagatagagattac

SEQ ID NO: 41347 - DNA, 163 bp, Triticum aestivum
  Clone ID: PAT_TA_41347
cagaggcgtaggctgcactcgtcttcttcggggaggcaaacggcgtgggggggaacgtctccatgtacatgaataacctcaacgagaagatcaaactcgaagcacttaagaagtccttgaatgccgatttctctcaatttttgaaaatcaatcaggtacttga

SEQ ID NO: 41348 - DNA, 442 bp, Triticum aestivum
  Clone ID: PAT_TA_41348
cggacgcgtgggtgctagggttttggtccttcgttttcggcggcgcaagaggggggagtagggtcaagggaaccgttaaatttttcaacttcaccaaggggttcggcttcattttcccggacgacgaccgtttaggacctttttgttcactagttcctcattaaatccgacagctaccgtaatctcaactagaacgactccttttttgttcgatctaattaccgtcgtcaacaagttacatcatggtcttttttttttttgtcctttaatactcatttgtttgattgtggcttctttttattttttattttatttaaattcctttttttttttcatccttttccttacatattattgattttctttatttgcattataattaatataattctcatttctttcttttctttctttttactttctcgtttaatgtgattttttt

SEQ ID NO: 41349 - DNA, 394 bp, Triticum aestivum
  Clone ID: PAT_TA_41349
cacacgcgtacacctgccgatcgctaaccctaacgccgttgccactaggggagctgtattacgcgagcgctatatttcgacaaacacttatcgcgccataatgtcagctagatggtatctgcctggaaaggattacatacaggaatattaacacagtgtgcttctgccattgatagctcgactacttgctattttaatattataacaactaatgataattcaccatcaccagttgcactagaatgttagctagacatattgtggagctctacagtttatttgcttaaatactgaagtcactttttgtaatcattatctttgaagatgccgataaccaatggagtctcattttaccaaaacttaatttgataatgatcaagtaacacatgtttag

SEQ ID NO: 41350 - DNA, 403 bp, Triticum aestivum
  Clone ID: PAT_TA_41350
tgagaaggctcctccgtgcttaacaggaagagacagggtcacagccgcaccgcacgacggcaggccatggtgagccgcaccgcaccaggtgggctagggcgagctccagggcgagcgagcgcacccgtcgcccacgccggcggtgtcctggccacgagcaacaggaacacagggtccatgaccatggctggatctcctccttctccgtccacatgcgtgcagcaagaactagcagccgcacgggtctgagctcggcctctcaagaccaattaggaggacgcggagtatgtgatggtgagcatacaggagcttggtatcagggacgtccagaaatgctatgagattcggtgcatttaatgaccgagccagccgacgggtccagcgggaacacgggaagtgaaga

SEQ ID NO: 41351 - DNA, 404 bp, Triticum aestivum
  Clone ID: PAT_TA_41351
acgtggtctacgctttcttgaggtaatgaaggcttttgaagggaggaggttggatttttgcgcagggtcatttccaaaacttcgatttctacacatatggggcgcagcacaactcaaccaagttagaatagaagagggtgcgataaaaaccctcgctgagctatggttcacagactgccctgagctaaagtttcttccagatggcatcgaacaccttgcagcccttgagaaattaattctgaaagacacgtccgaagaactgataaagaagctccggcagaagagagattcagatgaatgcagcgaagatgtaatgaagattagccacataaggaatgttacagttgcactgagccataatggatttgaggaaaggatttggtgatcgtcaccattcccaagat

SEQ ID NO: 41352 - DNA, 401 bp, Triticum aestivum
  Clone ID: PAT_TA_41352
tttttccggacaggacccctcctcctgctacattgttagacggatccagggggggatagacggatgccccgcctccattatctccatgccttgatttgattctcgcttcgcccctacatttctcgcgcatcttgattcgatgtccccacaagaattatcttatctagcacgagtggtgcgtacacagtgtacatactacatgtaatctgtactgcaatcaaaaaattcaaggcagctcttgttcatcaccagcaacgaacatctaaagcttgcagagcgcgagcagaggttgcaccaacgccaacagctgctatagcacggacttcggctgcagctacagcacctgccgctccttcaacctgcggaacctgtacaagctgatgctgacatccctaggctcc

SEQ ID NO: 41353 - DNA, 400 bp, Triticum aestivum
  Clone ID: PAT_TA_41353
cttttgttgtagtctatatatatgcaaaaacaaaatatcttcagtctatgtgacttggtaggttcctttctgtttactgtttgtccttgataaaccatatcttctttataaaagttttggtacgaagcaggggcagaaaagatcaatgaggcaccaggaagtgccatctcaaggacctctgagaattgatgctgacaaacctgacctggcagaagagcgtcctgggagcatgctggtaaacaaccccattgttggccaaacctcagttgttccaccaagcacagatgatgacatggtggccctgcgtgaacatctgatcaagcaattccttgaaatcgacaaatacggcgggcggatcatcgggataaaggaaatgggcaaactgaatgtgaaggcattt

SEQ ID NO: 41354 - DNA, 402 bp, Triticum aestivum
  Clone ID: PAT_TA_41354
gccctagccgccgccgccgccgtcagcaatcccctccctcaatcgcccaagggtgggaatggccggcgtcaccaccaccgctccgtccacgtagcgcctcctctatcaccaccacaccacatgcgggtccaagcgccacacccaccaccaccagcagcggctcaggtacgcccccaatccgtcccctctcgctctgcgccggcggctttcgccgacagccggggcggcgctcctgccggaccgcgtgaccccggtctcctacggtgcggacgacgaatccgacgaccacccgcgcgaggagcgcggcctggtgggggtagaggtccacccggacgcctgctcgctctgctacctgggcctgcagaagctgtagcaccgtggggaggatgtcgccgggaacgt

SEQ ID NO: 41355 - DNA, 408 bp, Triticum aestivum
  Clone ID: PAT_TA_41355
cggacgcgtgggaaaacttatcctgatacagtacgtcgttggtgcaaatggcatgtcctaaaaaaggcgaaggaaacactaggaccactgtacagcaagaagggtgacttccaggctgaatttcacaaagttgtgaaccacatgctaactgaggaagagtttgaatcagcctgggcagctctcctcgacaagtacaatttgaggaatcataactacatgacccaaatttatgaaaccagaaggaaatgggcgaaaccatatttccagggtgttttctgtgcaaaaatgacaagcacccaaagaagcgagagcgcaaaccacatgctgaaatcgtacatgccaccagccagcccaacgcatgttttcgtccggcaatacatgaaactgcagtttgatcgagaacaggac

SEQ ID NO: 41356 - DNA, 386 bp, Triticum aestivum
  Clone ID: PAT_TA_41356
ccgagtccctttaccataccttatcccgttccacctccctgttgtggaaaaaggagtgttataaaaaaggccaagctaacactacgtccactgtgcagaaagaatggttacgttcaggcttaatttaacaaagtcgtgaaccacatgctaactgaggaagagtttagaatagcctgaacaactctcctccacaagtacactttgaggaatcataaatacatgacccaattttattaaaccagacggaaatgcgcgaaaccatatttccaacgctttttctgtactaaaatgacaagcacttaaagaagcgagagcgcaaaccatatgctgaaatcgtacatgccaccatgcaccccaacgcatgttttaatccggcaatacatgaa

SEQ ID NO: 41357 - DNA, 287 bp, Triticum aestivum
  Clone ID: PAT_TA_41357
gtttcccgacccgacgacatggggagaaggaagacgcatcatgggcggagcaccgcgcgccgcgcgggctcgcattggccgccgtcccggcctaaatctcggcgcgcctgtctggcgggggagggcggcgtctcatagcagaggttacacggttcaaaattgggagatttaacgccgcaggatgagcctggaggtgttattaccagtcggccttaaatatcggggcagcatatttttgatttggaagctctcattggggagtcgtggaatgattatgtttgtggtct

SEQ ID NO: 41358 - DNA, 384 bp, Triticum aestivum
  Clone ID: PAT_TA_41358
cgcgtcttctcctgcgcatctcggaggtgcttcctagtttccacgatgaagctgatcgctgcctacctcctcgcctatctgggtgggaactcttccccaagtgccgctgacgtcaagaacatcctggactcagttggtgccgaggctgatgaagaaaagcttgagttccttctggctgaactcaaaggcaaggacatcacagaagtgattgcatctggaagggagaagtttgccgctgtgccttcaggtgggggtgccattgctgtgggagctccagctgctgcatctggtggtgccgccgcacctgctgctgagtcaaagaaggaggagaaggttgaagagaaggaagaatctgatgaagacatgggtttcagtctgttcgac

SEQ ID NO: 41359 - DNA, 380 bp, Triticum aestivum
  Clone ID: PAT_TA_41359
cccaagagggctttcaagatcaagaagctctccaaccttgtcaaggacgatgaggtgcctcagttatctcaacacgtaccgctactccttgcttaacaagaacggcaagaccgtgagcacgcatcccaatagctcacttactgcgactaactctagcctctaacactactctctctctattatctccttacaagatccgtttttccatttagtctttgctaggaccattctatgatcttttcttggctccaaatactgcggttccagctgcgcacatcccacctgggttacctcctgttcgagtaatcacctcgaattagacttgcttcttgctcttcttttttgagactgctcatttggagcgcgtttcctttcaattc

SEQ ID NO: 41360 - DNA, 373 bp, Triticum aestivum
  Clone ID: PAT_TA_41360
gggacgcgtggtgtcgatccactagcctgctgctcgcctatgcgcgaggacccaaatagagctgtataattcatgcccatggtcaacgacacattgcccacttacaccttcggacagtataaccgattacgcgaatagcgacatccaccggcagcataggatgctggccatgctgcatacgcagactttctgccctagaaccgatgtagcaatccaggcatacacctgctccgacttcgtgattctactagatgcacatagcacaagaccttggagagatcccgactccaatgcaataccgcaacggttcgatggcaagcaccgctcatatctactgcctctttgagagtcagactagagatcttccgagatg

SEQ ID NO: 41361 - DNA, 404 bp, Triticum aestivum
  Clone ID: PAT_TA_41361
ccgcaaaacccttcttccttctgtcccgctaaccccggagagatcacagcatgtgggggtttctgtcaccacgggcaccatggccagaaccccccgacccacgctctcatcgccgccagaggcaaccatcccaccttcaagatcttctgcaaggccgacgagggctactgcctctctattcgtgacggcaacatcatcctcgccccgtccaacccacgtgacgagcaccatcactgattcaaggacatgcgcttcatcgcccagatcaaggacgaggagggtaactccggcttcgccatcgtcaacaaggccactggcctcgccgtcaagcactcgctcggccagtcccacccggtgaagctcgtgccattcaacccggagtacctcgacaagtccgtgatgtg

SEQ ID NO: 41362 - DNA, 351 bp, Triticum aestivum
  unsure (1)..(351): unsure at all n locations
  Clone ID: PAT_TA_41362
cgcacgcgtgggctgacgcgtggtctacgaacgtgaacctggaagaagagggcacttntccacatgcttgcccactcctacaacaccctcgtaaccattattgtcaaggcggagaactataagaccactgttcaaaaaattttaaaggccatcaagagctaatgtttctacgatcctgaagactacattgagcttgtttctatcaaaccccttgacccgcaccagcacttgtttaaggacatgcgctttatctcccacatcaaggacgaggagggtaaccccgccttctccatcttcaacaaggccactggcctctccgtcaagcactctctcggccagtcccacccggtg

SEQ ID NO: 41363 - DNA, 399 bp, Triticum aestivum
  Clone ID: PAT_TA_41363
gatcacgccgccccgtcgcccctcgagcacgtcgccggcgcgcatcctcaccgctgcagaggcccactgccccctccccactccccgcccttgccgccgccatggcgatcaccgcccaggttccggacatcatgggcgagcgccagtccggccaggatgtccgcacccagaacgtctcggcgtgccaggcggtggccaacatcgtcaagtcatcgctcggccccgtcgggctcgacaagatgctggtggatgatattggtgatgtcacgatcacaaatgacggagccaccattctgaggatgttggaggtcgagcatcctgcggcgaaggttctcgtggaattggctgagctccaagaccgggaggttggagatggaactacctctgtcgtcatcattg

SEQ ID NO: 41364 - DNA, 298 bp, Triticum aestivum
  unsure (1)..(298): unsure at all n locations
  Clone ID: PAT_TA_41364
gaanncccggggcggacgccacgcgtnccgaacgnccaacagcatacagcatatcttagcttagattagtattagatggtagctctgcagagagtgctgtatggaggagagcgctccaacccacttgctgcgatattgcaaattattgtggggatttgccttagcatatctctccacagcgtggtctcattcttgtacatgcaacagtcagaaacactattaggcaactcaagattagaggaggcaccacgcaaccactgaataatccttaccatgcagagcattgtaagtattactt

SEQ ID NO: 41365 - DNA, 245 bp, Triticum aestivum
  unsure (1)..(245): unsure at all n locations
  Clone ID: PAT_TA_41365
cccacgcgttccnccacccttctatgtaatagttctcatataccacaaaggaagtttaattcactatgcatctttttacaacgtcataactggcaaaaccgtacctctacccaacttaatttccatccaatacatacttctttcgccagatgccttcatactgcaaaagccctaacacataacacttcccaacatgttcccaaaacttaatgcacaatagcacgcacactatagccccccattaa

SEQ ID NO: 41366 - DNA, 314 bp, Triticum aestivum
  Clone ID: PAT_TA_41366
gaaagacttgacaaaatatgactttgaggccgactgctttagttctcctggggatgatgtgaataaaaggaagcttgcctacaggcatcatgctattggagacaagtatgccaagagtttgcaaaaaattctggaccaccgcatgttcaaagtctggagtgatttgtatagttcgacagacaaatatactgatggttgactttcttcagctcataagttgctggaagaagcgctgggtaaatcaacagctgagcccgctgtcaaatatttaagtatcaagtgcatagttacttgacggtccctggttccgagca

SEQ ID NO: 41367 - DNA, 258 bp, Triticum aestivum
  Clone ID: PAT_TA_41367
ctcagacgtcgccatcgtcttcggacactcctgttagagaacaccgactaggtctgccgaccgacgagggcatttccacctccattcatgctgctcagggccactaagcatcccaggctatctagattctgttgatcaacgcaatctccaaagtgttttgttggcagctttgctgggcacacaactattctaatggttgactctctacaggacaaaagttgttggacaactggcctgcctcaattaatatatcaacta

SEQ ID NO: 41368 - DNA, 343 bp, Triticum aestivum
  Clone ID: PAT_TA_41368
gagcggtaatggcatgagacaacaataactaagctctgccccgaagaacacaagggttaaaagtactcctggcctaagactttgccacctgagaagaggttgaggcagagcaggcatgcagccagcagcacgcctgggatccaccagctgccgccctcctccgaaaacatggcgcacagcaccaggcagagcagcagcagcatgtagaaccccagcccgcagccccagcccgtccagtcacccccggccccggcgaagccgccgccgtagccccggtgaggcgggtagtagtatatcccggccaggtacaccgccagcagcagcaggagcgcggcaacaacga

SEQ ID NO: 41369 - DNA, 409 bp, Triticum aestivum
  Clone ID: PAT_TA_41369
cggacgcgtgggctctgagagaagaaggcggcgatgaaaatgcgggggacaaggagagcccgctggttctcaagaacaaatcgcctcggtggcatgagcagctgcagtgctggtgcctcaacttccgtggccgcgtcacggtggcctcggtcaagaacttccagctgatcgccgcacccgccccgccaccgccggcctctggaggagaggcagctcccgagccgtctttacagccgcaaccaccccagcagcagcctacctctgctaccgcacaaccccagcctgctggcagttcgttgtctgcatcgtcgtcctcgtcctcaagccaccacgacacggtgcttctgcagttcgggaaggtgttcaaggacaccttcaccatggactaccggtacccgctgtcggcgtt

SEQ ID NO: 41370 - DNA, 310 bp, Triticum aestivum
  Clone ID: PAT_TA_41370
cccggaattccaggggggtccaactcttcttttttttagtttttttttaaagataattgcaggcctaaaaatttagttcacaaggggagcctgtgaattaaaagaaacttttctactggcattcttcttttggagacaagcggggccctgaacttccgtggcctgttcacggaggcctgggtcaagaacttccagctgatgatcgtacccgccccgacaatactcgaagtctggaggttaggcagttctcaaatcgtctttacaggcgtaaccaccccaacagcatcctacctctgctaccgttcaaccc

SEQ ID NO: 41371 - DNA, 268 bp, Triticum aestivum
  Clone ID: PAT_TA_41371
gcagggaggaacgtatcgagtgaacttcgccaaagagtagacctttggctagtgagcggcttctcacgcggcaggcggtggctatggaggaggcggtggatcacacacacgcggcggctaccggagtcttggcctacgtggcgttagctattgaagggccccataatctttataaagaaagcacatactatcaactccaagacaatgcgcttttatgacagtatggaaattatgcagaacttatacgagctcgctcttgtaaacacca

SEQ ID NO: 41372 - DNA, 177 bp, Triticum aestivum
  Clone ID: PAT_TA_41372
cggacgcgtgggcatggacacccaacagacaatggaagcatgcacattttggttggcgagtttctgggcacaatttttggcatactaatacctctatagctgatatgcatcagaaactgtcgtgattatgttgatcattgtacaatgcgtgtcaccttcaattgagagttaagatgc

SEQ ID NO: 41373 - DNA, 238 bp, Triticum aestivum
  Clone ID: PAT_TA_41373
acatccaagaacttacaaattaacttcgccaaatagatacctttccctaaagaggggttttttacacggaggcggtggttataaaggacttccttcatcacacactcactgctgctaccttagtctttgcctacctgtagctccatttttattaaacgaactttttccaactgaagtacatcctataaacatacaacattgaaagattttatgacctcatttatattatccacaacct

SEQ ID NO: 41374 - DNA, 210 bp, Triticum aestivum
  Clone ID: PAT_TA_41374
tacttcctggggggaccgacccacgcgttcgcagacgcgtgggcatacacacctaacagacaatggagcgcatgcacattggggttggcgaggttctgggcgcaccttcttccattcttaaacctgtatagctagaaggccatcctaactatcgaggttattttgatcattagacaatgccggttacccttccatgagaagttaagagcc

SEQ ID NO: 41375 - DNA, 355 bp, Triticum aestivum
  Clone ID: PAT_TA_41375
gatacagccccgtgccgtactgtcgctcgtggggcgcaagcagtgtctactccgggaggcgactctgtgcaagggccttctgcgttttttgaagctggaccgctgaaaggactaccttcttatggaggttgagttcgtcgtgagccattaccggttgccccccagcgagagacatgacggaggaggaccgatctaaggtcgtccaccttacgagcacccatatgagcgttggctcagtcgaggagatcatagtctagaaccacgcgatcgactcgacgtcctgggggcctgagtactacgtcagtgcactggcaatcgtcgacatgcaccaactagagccgttatgcaccatact

SEQ ID NO: 41376 - DNA, 396 bp, Triticum aestivum
  Clone ID: PAT_TA_41376
cggacgcgtggggccggcctccctgccccgccgccgtcatctccttcgcctgccggagctcagcccgagtttggtggcgcggggttcctggcggtcttcctcccgctgctctgggtggcgtgacgcctccgccgccggcaggagggggccgcgggggccgctggacagcccggctaccagcagctcgcgccgcccagctcgtgggacacctccctcctcctccccatcgggactgggcaggaggatgagcgctgtcgcgccgccgccgcacacccctgtcgtcgcgccgccacgaggaggcggccgacatcaccgcgcgccgcccggccaaggtcttctcccgcgtgcgccacctgctcgccaaacctttcccctacgcgcggtcctcgccgactc

SEQ ID NO: 41377 - DNA, 194 bp, Triticum aestivum
  Clone ID: PAT_TA_41377
ccgacgcgtcggcggtttcttggtcgtatgcacaaccaaaaggagctaaactgaagagttattgactacagtcccagatcttgccaaaagcaaaacaacaccatacaaatggcatggtagcagatattttgcataacattatatatttactcccgtttacacccaggggtgggaatacgtgctgtgatcaaaac

SEQ ID NO: 41378 - DNA, 316 bp, Triticum aestivum
  Clone ID: PAT_TA_41378
cgcacgcgtgttgaagaaggtggaggagctccacaagacctattactacatgaaggacatcttcttccaagcccatcactcccttgattgagaagtttagagaattgacgggttatagaatgaaagttcaaaaggctatgttaagaaagacagacatctgcctgacaaatttttgaatctaccaccaactaacaaactagttagacttatcattgaaagatatacatctcttgtcgatgccctcagagtcttggatgatagcctaacgatggagcatttattcgcgggtttaccttctattgaaggagaacttgtg

SEQ ID NO: 41379 - DNA, 407 bp, Triticum aestivum
  Clone ID: PAT_TA_41379
cccacgcgtccgcccacgcgtccgcccacgcgtccgtgaatatataatcccatgtgtaggtgctatccaagtgtcgtgattatttagcacacacaacttgcagggagataactctatactatgaagactttaaaatacgagtgcgtgtcgttggtgtttttgaaaccatcttccatcacgtctaatattgttctatttcataatagtaattgttcagcctttgactaacatatggatgatttttgtaatatatttctttcttccatattaccaggaaatatgtcgaagcacagaatatattccatatgcagtggactaacagaacgacacaacacataaaaagaggagtgtaagtggaaacctttttttctttttaaattcttgaggactgtcacattatgatgaag

SEQ ID NO: 41380 - DNA, 386 bp, Triticum aestivum
  Clone ID: PAT_TA_41380
gtcggatgcagcaaaagttagggggctcgtgggtgatacacttcaactggttgtgcaaaactctgcaacattagttgctggcctggtaattgctttcgtatcaaactgggagctatctcttatcattttggcgttgataccactcatcggcctaaatggatggatccagatgaaatttatccaaggattcaatgccgatgcaaagatgatgtaccaggaggcaagtcaagtggcaaatgatgcagtaagttgcataaggacagtggccttattttttgttgaagagaaagtgattgatttgtacaacaaaaagtgcgaaagacccgttcaaacaggaattaggacagggattataagtggttttggttttggagttttcttttttt

SEQ ID NO: 41381 - DNA, 245 bp, Triticum aestivum
  Clone ID: PAT_TA_41381
gacccgctcaagcgcgacttctactttgaacagtgtcgcctggagcgctggttgtcgcggcagttgcgggagtggggctcgccgttggtgccgtcgttatgtcaagcagtacgaaaccacctatgttgcacgtcgtctccagcgcggcccgactctgcacatggggactggcaattgcgatcggattgcctgtttggcggtggattctgggcgctcatcaggcgcggaaacgacctggtctgtgt

SEQ ID NO: 41382 - DNA, 425 bp, Triticum aestivum
  Clone ID: PAT_TA_41382
cggacgcgtgggatgttttttcttttgcaatgctagacatttgtgctggccaaccatgaatatctgaacaatattttgattcagaaccaactcggcggcaaggacttcccttatgatataatctcctcccagatgtttttcataccagtacctctagaggatggatgggtcgtactgatgtgggacatgatgtcaaggaagccgcacattctggacctgatgatcagaggcgatggtccaactgaaccaacaaaggataagctcgaattgatagcttggaagctacatcatgcactattccattgtctgaacgagtactatgctggctggctggcctacgcaagacggagagtgggaggctcactacgcacttgttgcaatggaacatttgttagggacgaaacagggggatgtgttcttcacat

SEQ ID NO: 41383 - DNA, 187 bp, Triticum aestivum
  Clone ID: PAT_TA_41383
ccttaatatgatgccggccaaaccaacttattttgtaacagaagaagtctggaaaaactggcgatggtaggaccgtctaaaggtcacctgtttagactgactggctctttcgcaacctaagcacacacaagtgttccttctggtccccttgtgcgccgaagatgacctggagtcgttttgcaactaa

SEQ ID NO: 41384 - DNA, 273 bp, Triticum aestivum
  Clone ID: PAT_TA_41384
cccacgcgttcgtccactttttcgaccacgtgtccgttcccgtgggggctgcgcgtcggctggtggtcctccgcgttgcaaactctcgtccaaatttgccggattctgtgtcccaggaaccaaggttgatcgttggttaagagctcgtttaagcttgagcacccgttcgagaggaggcaggtctaggtcttacctcataatggtgatggtcttttgacaggtattttcttggtatttgttgcgaaaggctcggtttaagaggtgtttttttcc

SEQ ID NO: 41385 - DNA, 132 bp, Triticum aestivum
  Clone ID: PAT_TA_41385
gctagcgccatttcgccgccggcgatggctgcttgactgacgcgccttctagaaagcaccacacttctgtgagtggtggcatctctgttatccgtcgtccgcccgtgggatcctgatcgtgttcagccatgt

SEQ ID NO: 41386 - DNA, 404 bp, Triticum aestivum
  Clone ID: PAT_TA_41386
tcgcgcaagaggggaggccatggaggagactagggagaccagccggtccagggagagcaggcggatccccatgtctaccaagaggagacctacgcggatcgtgaggattggaacagatctgtcccagacgagcatgttttacctcccactcgcaatctgccccgtatgctgatgaggctgctacctcaaagattctttactactttctctagaggtactgctcatgagcgcgctgagtatccaccttatcgcaggtctactgctgccaaagcaatgactgggtttttggcacattatgccaataatctctcccatttttctcatggggcagaattctttacaatcagtagtagtgatgaagacgatgagttttatatctttaccaatgatgagtcttctctgga

SEQ ID NO: 41387 - DNA, 150 bp, Triticum aestivum
  Clone ID: PAT_TA_41387
cgccgccgctcgagcccctctcgcccttcgcgccgtcgctgctgcaggcaaccgccggcgtcttttccggaggtgagcccctctcctgacgccatggtgcgtatgcacagcctcgggaagggtatttcgttgtctgtgctgtcgttcaag

SEQ ID NO: 41388 - DNA, 231 bp, Triticum aestivum
  Clone ID: PAT_TA_41388
gagctcttcgtgggtgatgctgggctttttggagttctttgctcatgtcatcagctgaggatgtctgtagctaagttttgtgagcatgcaagagggcctgcagaaaaagctggtgtaattgtcctcatggagaatggcatgagtattgcacattggttcaaatactgcgtaggggttggatcatatgttactgacagtaattgtgaccggccagaatgggcgtgtttagat

SEQ ID NO: 41389 - DNA, 394 bp, Triticum aestivum
  Clone ID: PAT_TA_41389
cggacgcgtgggcgcccgcccgcccccgccgccgtcgccgcctccttccggaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcatcaactatgctgcagcttactgcactggtctgcttttggctc

SEQ ID NO: 41390 - DNA, 140 bp, Triticum aestivum
  Clone ID: PAT_TA_41390
ctccacgcgttcgcccaaccaagacccgtggtcttggagctggtaaggctggggttcgggccttctcttactgtcctctctcccttcatttccttctgtggctcacatcggtcaagatctcggtggttaagtcctcctgt

SEQ ID NO: 41391 - DNA, 266 bp, Triticum aestivum
  Clone ID: PAT_TA_41391
cccacgcgtccgcccgatccaaatcctccagccgcagccgcctcctcctcggtcccctgctcatgctcgagctctctgcctcgatccaccaggcgcccagctcgcacaggagaggagctcctcgatccctttgaccccggccttcttttgaaccccacgccatggatggctgagcccctcgccgagcttctcaaggcgcgccgccaccactcgtctttctggtaccgccgcacctgcagttcgtcgcctcggtcagggccttgtcc

SEQ ID NO: 41392 - DNA, 223 bp, Triticum aestivum
  Clone ID: PAT_TA_41392
ttccactcattcaatctttttttattctatcactgtcatctaaataatttaaagagattcatttattagaaggatttcctttttttaattttttattcttttacaatttcacacaacatactaactttaatcataatttgtaaatcctttcgttcctaataacttagctaactcatattaatttccattcactcactatctcattttacattctacaaaacct

SEQ ID NO: 41393 - DNA, 99 bp, Triticum aestivum
  Clone ID: PAT_TA_41393
cgtcggaacttaattagcagctagcccaggtgcaacataaggcccagactcatttcccgcagtcggccacaaccacggttgatctggtgcggcggtaca

SEQ ID NO: 41394 - DNA, 391 bp, Triticum aestivum
  Clone ID: PAT_TA_41394
gaaaggtggaattttggcacatttgaaaccaattgctgacgagaatgacttgcacagctgcctagcctcgtattttgggccggaagttagtcgcatcaagaatgcaattgacggcaaatgcaagagtattcttgaggaccttttaagctttgttgagtcacacaattcagtacagagattgaaggagttggtgccattcatccaggagaaatgctataagaccatcttgggagtactggacaaattagaagccgtacttggaaacctttctgatgcattgggaacgaaaaagggggatgacaacctgcctgctgcatctggtattgtggagcggtctctttttattggccctcttttgtttggattgagatatttatttagttatgttccc

SEQ ID NO: 41395 - DNA, 205 bp, Triticum aestivum
  Clone ID: PAT_TA_41395
gccttcccctctttcacatggcctttccgccgccggagccggcccaagcaaaccctccgccgcggaggggaaggaggaggacgcggaggcgctcggcgtgacgccacagctcctcgacttcctccggacgctctcccccgacgccttcaagtcgtccgccctccagctccaccaaggggcctccgcggaggcggcgggagagctt

SEQ ID NO: 41396 - DNA, 159 bp, Triticum aestivum
  Clone ID: PAT_TA_41396
tcgcccgacgcctacttcttcggcgtacaagcccttaccggcggcgccggagacgagttcaccgccatacaaggccccgacgcctactctcttggagtacaaggcccccaccccgaggcccccgccttcggcgtgccaccactaagaagatgcaccact

SEQ ID NO: 41397 - DNA, 412 bp, Triticum aestivum
  Clone ID: PAT_TA_41397
cccacgcgtccgcggacgcgtggggcaacctccaacgtgccgccccgttcgtcccggcggcgcggcgggcctagaggctggaacacgcgcctcacaatctcctcagtaccaccagcagggtatcagcagccagcaatcaactccgccctcaccaggatgctcctcaccgtctctgcgctaccgctcccagccgcgacagcgactccgcgcgtacgcgtactccctgggctcaagccctcctcccgcctcgtcgcccgccgaagcgcaggggaaactgtacacgcaacggccacagaagaggaggagcaggaggggaaggagctccaggaggaggggctcccgaggcgggggcagcacgcggaggatgaccacgaccacgagcacgaccccgagatcgcggacattatggggg

SEQ ID NO: 41398 - DNA, 335 bp, Triticum aestivum
  Clone ID: PAT_TA_41398
gctacgctcacgcgtgcggctaggcgtgcgtgtgaatcaatcaaactaaaaaaaaagaagcagttggcggactgactggagatgagcggagccttcttatagcttaccgggccgtcccgtcgctcggtgatccggccggagcgcacagagaggggacaaggcctgtgctttttttggaacagtatacagttgagagctgacactgaagtagccatactgataatgtgaccccaagccggggctcttgatgttttcgagatcttcccagggcaagcacatggtttacagaaatgtgacaagcagtttggaggtgctttgcctgcgatgcgaatgcg

SEQ ID NO: 41399 - DNA, 355 bp, Triticum aestivum
  Clone ID: PAT_TA_41399
atcaaatcgagcctgcccttctcgctcgcgtctccactccatttccctttcccccgaggaggccgccgccgtgacctgagagcacacgcacgcaccatgtggcgccgccttcaaaccctagcccccgcccttcgccgcgctgtcgtcgtagacggcgcggccccctccccggccagcgcccgggccgctccccttttcacggtggtggcggcctttcgccgcactgggctccttctctttgtggacaaagcccgtggcgtcagggaccagtgtggaggacgtcatgcccattgtctccaggttggagcgctaggagcttttatgtggttttttacctggagaagcgcttttacaa

SEQ ID NO: 41400 - DNA, 367 bp, Triticum aestivum
  Clone ID: PAT_TA_41400
acgcccacgcgtgcgcggacgcgtgggagctgcatcaatgaacaatgatggggagaggtttgttcctgagaatgatttgggcgacaatacatggatcgataatgaagtgtgcagttctaacctcatgaatgaggatcacaagcccattgtatcaaaatcaaataatcaggtacctgacgtttgcccagatctacggtctccaattcagggtgagtgaattcttagtgatgatctatgaaataccaaatagaatatgaaggttcacttgcacgcttataatatttgtttaaaactaaaggttaagccagatatgggcaaaccatcatccgggcttacttccttaagtggagaattgcaaacattggat

SEQ ID NO: 41401 - DNA, 397 bp, Triticum aestivum
  Clone ID: PAT_TA_41401
tcgcggacacgtgggcagcagccaagcaatccccacacacatatctccactccccgattactttttgcagctcgtcatggacgcctcatccaccgtaaacaaccccaaggagaaaaaagaagccgccggtcgcaagaacggaagccgcactaagaagaacttgtcgcggcccttcaagaacggcgctctactcagcgtcagccgcataaggcgctctctcaagaagggacgctactcacagcgcgtagggtcctgcgccacattctacttaatggccgtgctcgataacataatatccgagctgctggagctcgccggcaacgccggcaaggacaacaagaagagccgcatcatcctccgccacctgctgctcgtcatcatgaacgacgaggagctt

SEQ ID NO: 41402 - DNA, 255 bp, Triticum aestivum
  Clone ID: PAT_TA_41402
accggtcccatcccacgccttccccagcctccctccacgctccctcgcgcgcaggggctccgggcgcgaggacgcatgcgcgcaaccgacttgactcacccacccacccaccccgaccgcgcgttggagctccccgcggaactcgcaaccatgctgtccgcgcgcaccgtcgtcgccgcgtcccccgacggctacctgtggaagcgcggaggtggcgcgggggcccccggggacagatacactatctggctggag

SEQ ID NO: 41403 - DNA, 112 bp, Triticum aestivum
  Clone ID: PAT_TA_41403
cggacgcgtgggcaaaagtgaaaaaccacatcctccctcctttggagacgccgcccgggccgaccaatggctcccaagatgttcttcgtccggcggaaactggaaatgcaac

SEQ ID NO: 41404 - DNA, 301 bp, Triticum aestivum
  Clone ID: PAT_TA_41404
cggacgcgtgggcggacgcgtgggcggacgcgtgggcggacgcgtgggtccggaagcgtcgccgcctcctctactgtattcctccccgccgccaatgccaaccccgctgaagcgcccctccttcggccggctgctcgccgccctccggtcgccgccccgggtcccggtccaaaccggcttcccaaccgcccttgccgacctcgtcgtcaagaaccatgcccgcttaaggaagcccggaaggccgggccgcccaacaacggccttggggttgcttaagcttccgggggaaacacggggggcc

SEQ ID NO: 41405 - DNA, 306 bp, Triticum aestivum
  Clone ID: PAT_TA_41405
gcaagtttgggaagatcagcaaagccatcagattcccagagaccctgaacttatcttgctacatgaactcaactgatgacaattctcctgtttacagcctatatggaatggttgtccatcatgatgttatgaatgctgccttttctggtcattacgtatgttatgtcaaggacacacatgggaagtggtacaagatagatgacagtcaggtcaaacctgtatctctggaaaatgtaatgtcgaagtgtgcatacatgctgctctacgcaaggtgttcaccaagggcgccaaactctgtacgacatg

SEQ ID NO: 41406 - DNA, 274 bp, Triticum aestivum
  Clone ID: PAT_TA_41406
cccacgcgtacgcggacgcgtgggcgtacgcttgggttggaccatcactcgtggcgtgttcttgcttctgccagggctgacactcaccctatcatttctgagggcgctacgttggggattcatactaatgtactgaccccaacaccacagctgcttggtcatgctccgatactattgatccgcatcgcctgcatgaatgtggagctaacatacattggatcggtggggaacgcttttaacggcagtcagattcaagcccccatcctgtgatgta

SEQ ID NO: 41407 - DNA, 239 bp, Triticum aestivum
  Clone ID: PAT_TA_41407
caggcgcgtacggggttcatgttccgcatgaacgctttggctatctttggcaacttggggagggaaaaagggaggtggctgcttatttggaaatcaacgacatatccaggcttagccaaagatccagcgcgcgctacgacctgcacaataccatcttattccaccgacgcccgctttaccaaatatatgatgaagaaaaagcattttatgacactcacatcacccctattggtgataca

SEQ ID NO: 41408 - DNA, 287 bp, Triticum aestivum
  Clone ID: PAT_TA_41408
atacatgggcggggtgtgatgctccttcttctgcgggaggcacctccaccacggggtcctcgttgtctgctacgcggccgtcttctcaccttcctgcttgatggaggagcactcctgggtgattaagaactaactgatggggaaagaacggggcgaacaaggcttcctacaagttctggggggcctcgagcgtgcccaacaagggcggcagtaactgcttgtgactgagggcgccatgcacgcctccactgaggggagggctccgctctggtctgatctgaacccct

SEQ ID NO: 41409 - DNA, 308 bp, Triticum aestivum
  Clone ID: PAT_TA_41409
gggcaaaaaccactttagacgcacaacgataaggctgtccttaaccattccgcgggtgataaaatgtacagatgtcgtactctatcaacgactgaagatgctggcaagaacaatagagtttgtgggcgagaacctttgctataatggccaagctattccttgatcacaaaacactctactacgatgatggatttggacgtgatctatgtcctgagagaacgcgatgatcggagacgccatatggtgggatattttttcaaggccaaactctctgacggagcctataagatggactgcattctcactct

SEQ ID NO: 41410 - DNA, 300 bp, Triticum aestivum
  unsure (1)..(300): unsure at all n locations
  Clone ID: PAT_TA_41410
cggacgcgtgggggcgagcttgtactcggcgcctactgcggcggcaagggcaaagcgatgcaatacccgccggttgttaaaaactcgggcgcccggccgccatacttcgngtactaatacctctgcctgaccggcataacggggggcgggaaaaagggtgtgcttcccgggcgggacttcttgcccctgttctgcggcggcgggggcggcgccattaattaatacgggccggactttatttacctaggtccgccggtgttcaagccggtggcggctgcaattgtggccacgggggggggc

SEQ ID NO: 41411 - DNA, 171 bp, Triticum aestivum
  Clone ID: PAT_TA_41411
cccacgcgtccgagcattcctccgacccagcaccaccggcggcaacaccaccacacctggagaggcctcgtcggcggagaagcaggcaagcaagcaagattgcccggaggaaaggccgcgagaggaaaaaagcggtgaccctgttcgtgaaagccgggcttcagtttcccg

SEQ ID NO: 41412 - DNA, 273 bp, Triticum aestivum
  Clone ID: PAT_TA_41412
tgcatagaccggggtggcggatggaacatgaggagacacaactcggcgctcaggatcgagatgccgttgtcgcggcgcagggcgattttcactgtggacgctgatctggcgcgcgaccaaaggctgggacgtaaggggcaccacgatcggctgcgcgtctgaccagcctgcctaggacacgctgcggccgcggccgcggccgttctcgcggtactgatcgaccgcatgtgctgtgcggacgccggggacgtgacgatcgaacgctatgtacag

SEQ ID NO: 41413 - DNA, 283 bp, Triticum aestivum
  Clone ID: PAT_TA_41413
catagaccggcgtggcctatgcaccatgaggagacacaactctacgctcaacatcgagatgtgcttgttccggcgcaggggggaatctcacttccgaccgtgatctgcgcgcagctacccacaggctgggacctttaagtggcacaatgatcgggctgggggtctaaacagcgctgcctagtacacgctcgcggccgacagccgcggccgttctcgccgtactgcacgaccgcaggttctgtgcggacgccggggaccaaaccatccaacgcttagtacagca

SEQ ID NO: 41414 - DNA, 240 bp, Triticum aestivum
  Clone ID: PAT_TA_41414
acgcccacgcgtacgcggacgcgtgggttctcccccaaatctcagcccccaacctagctggctctccatcgggcggcggctggctgctccctgaatccctcgccggcggctgcgcccccaaaaacctcgcctattccattctcttgaaggcccgcctccacctcaaattcctccgcatttgcctcctcttgaacaagggccgctactcacataccggtgaatacggcaacgaccgctacc

SEQ ID NO: 41415 - DNA, 289 bp, Triticum aestivum
  unsure (1)..(289): unsure at all n locations
  Clone ID: PAT_TA_41415
cggacgcgtgggcgccgatcgatcagggccagctcgctctctcgttggttggtggcatgcangagcccgggcggcggccgttcgccggcgccgtcgacctgcgccggcccaagggctacccggcgccgtcggcgaccccgcagccgcaagcggaggcgggggcgggggatgcgcacggtgacccctgcccgcggtgcgagtcgcgggacaccaagttctgctactacaacaactacaacacctnccagccgcgccactactgcaagtcctgccgccgctactggaccaa

SEQ ID NO: 41416 - DNA, 453 bp, Triticum aestivum
  Clone ID: PAT_TA_41416
cggacgcgtggggttccaccgcccgcagcaaccaaagccaagtttcgaagccgccggcggcgaggagcaggagaaggcgagaagccatggcccgtaccaagcagaccgcccgcaagttcaccggcggcaaggcgccccgcaagcagctcgccaccaaggcggcgaggaagtcggcgcccaccaccggcggggtgaagaagccccaccgttacaggccaggtaccgtggcgctccgtgagatccgaaagtaccagaagtccacggagctgctgatccgaaagctgccgttccagcgcctggtccgcgagatcgcgcaggacttcaagacggacctccgtttccagtcccacgccgtgctggccctccaggaggccgccgaggcgtacctggtgggtctgttcgaggacaccaacctgtgcgccatccacgccaagcgcgtcaccattatgccca

SEQ ID NO: 41417 - DNA, 386 bp, Triticum aestivum
  Clone ID: PAT_TA_41417
cggacgcgtgggcgcacccgttggtctagaacttgctggaactcgaatgcacctgtcataagatcgatctcactgtttgaacggctcatggaatacaacgactcgctggtcgaacgctacattgaagaaatgtgaatgatgcacgctactgcccgggaacatcctgtgaaatttttgcatggaactgatctggtgtcaaagccgttgcctgggaacgacaacgaccttaaggggaactgaaagtaactaactgaattaggtgctcaaactgacatggaaagaagaaaactggagagtgagaggaataaaaatgatggtcaaacgactcctttaccatggtaggactggagcatgaaaaagccaatgatggtgtacggagttttgtt

SEQ ID NO: 41418 - DNA, 349 bp, Triticum aestivum
  Clone ID: PAT_TA_41418
acgcggacgcgtgggcctcaccttctctttaaagccccccccccgatgccgatggcgacggtcgtgcgggtgcgctggcgacagattggccagccatggcggcggtgctgccacatccgatccaatccgagaggcccgcagcggacctcacggatgcacctcgagcttgttgctccacacgaacacgactcctctattttctcggctcagggtaccttatcgctacgccatcaagatccctcgcctgttttaactgcgatctacgcaggtcagatggggcactgacattgttgctaggtctccttcaaacactatggactgccagatccactggagaccccatttctgc

SEQ ID NO: 41419 - DNA, 154 bp, Triticum aestivum
  Clone ID: PAT_TA_41419
gcgcgccaccccttcgaaactgggcttaatggccagatttctgtgaaatcacctcccccaccacaaaagcttcgggccggtaccggccccggaaagagaaatcataatctgtttttgtggcctactaagtggtggcagataatttgatcaccac

SEQ ID NO: 41420 - DNA, 356 bp, Triticum aestivum
  Clone ID: PAT_TA_41420
ctctctctttcctctccccctttctactgctccggactgtatatataatcgggggggtttatatatctccatggtgggcataggcctgggaaagaccataggcaagatttcagcaattaattttatagagcgagaggggggcatataagagcgtgggagggaagagatagatagagaaagaaaagtatgacatggagatgaaagaaatgagacaacaaccctcttagcctctccccggccctctcctacgccccctctcctccacttctatcccctaagtttcaagcaagagacgaagctagcccggagagactgagccaaaggggaagaagaaggagcactgccaatccaagaac

SEQ ID NO: 41421 - DNA, 345 bp, Triticum aestivum
  Clone ID: PAT_TA_41421
gcgctggccggcaacacgctcctcgcccggagactgagggcgttgctccggaagctcggctcggttgacctggcggggctctcgcaccagcagaagctggccttctggatcaacgtctacaattcctgcatgatgaatgcattcctggagcaagggatacctaccacgccccatgagctcgtggcaatgatgccaaaggcgacggtagatgtgggcgggcgcacgcacagcgccatgtccatcgagcacttcatcctgcgcctgccctacagcgtcaagcaccaggtgagccctgagggcgaaagaaccaaaggcggcgaccaggcggcgcgcgctggcgcgttc

SEQ ID NO: 41422 - DNA, 342 bp, Triticum aestivum
  Clone ID: PAT_TA_41422
tcgaaactgagcttgatggcaagaccccgccacttacaggctgcaccagcattatcgtttggcgcattctctggacgcgcggaacgagctcattacatgggatgacttgacttgctcaatgatgccatgtccttggataacatgtgggatgaaatcagccaggcagcataagcctgatccagtgacaaccgtaacctatatttagtgagctggaacgaccactttttttttctaaaggctgagcgtgatgcatattacatcatcaacacccttgcagaaaggttctacggaggatgcagaccggcctacattttgaaattagacgacaccaccatgatttac

SEQ ID NO: 41423 - DNA, 444 bp, Triticum aestivum
  Clone ID: PAT_TA_41423
atcttatagtcgcttacaacaaaaaaccatggtggaaaaactcctggctaaactgtcgtgatgttctcactgagctttatgcatttgtcaacagtgcacctacgtcatgcatcctgcataagggagcaggacataatcaggcactgtaaaaggattctgaattattgtttgtcaaacgcggcagatgattctgcaactggaaagatggctagtcattatcatgcaccttaccaaggaatagtagatgggatggcatgtaaaatagacgcgttaaagtggttggtgctttttgatgatgcaggggctaaagcaaccggttgattggtaaacgttctaaatcaccgggtggatgttgtacttgcggatacatggtttcttagctttgaaatatgctacttgaagagatttgcacaaggctgcgtgtgctgctctattaaaagatga

SEQ ID NO: 41424 - DNA, 258 bp, Triticum aestivum
  unsure (1)..(258): unsure at all n locations
  Clone ID: PAT_TA_41424
cggacgcgtgggattataccattttcttcttgaaacaaatcaacggggcattgggtgaacttgttactacagagatttccgtattcagtctatcccattactcatttgcttcataagttcctaccatattgtttatgtcgattcattctactcatattcataattcatgcgccgctgtcgccgccactttgaggccttagccaccaagcggcatccttccccggggggcttaattcantacatgctttttttgaattt

SEQ ID NO: 41425 - DNA, 391 bp, Triticum aestivum
  Clone ID: PAT_TA_41425
ggggcgcgttgaccgacctgtgtttgctgacatagccgcacatacttcagcttcgttggctggcgaaacatatgcaggaccctctgtatctgtgtctgactggtaccgaattgataatagacgaacctctactgtcgtgtaatattgtgtgctcggaagggtatctaccgctgttcatctatgcgtaacgttgtcgcacgatcgagctgtgacctagggttctgatctgctattggatagcagactgccgcgagccgataacataatatgtgactagctagccatatacagtatttgcttaatgtgtcgatgtgaagaataaaacttgcttaccggtctgctcactaatctgcataagtatttaattagtttttgggctaaaatgtaatta

SEQ ID NO: 41426 - DNA, 285 bp, Triticum aestivum
  Clone ID: PAT_TA_41426
acgcgtacgctttgacctacacgtgtgttctcgcacaaacgcacatactttatctacatgggctggttaaacatatgcaagaccctctctatctgtatctaactcgtaccgaattgctaatatacgaacctcttctatcatctactactgtatgctagacaactcatctacctctattctactaatacctaacgtagtaccacgttctatctcctaccatagcttctgatacgatattggatagcagactttccgcgaactgataaaataatatatgactattta

SEQ ID NO: 41427 - DNA, 112 bp, Triticum aestivum
  Clone ID: PAT_TA_41427
acgaaatcgcccttgattccatcctcctacaacaaataatctattcaatcaattgggttggggcaaatcctttggccctctgatctactttaccttcaattacttaaattca

SEQ ID NO: 41428 - DNA, 180 bp, Triticum aestivum
  Clone ID: PAT_TA_41428
ggaccttgttccccgatatatttggatagtgatgatgagctggatgactttgggtacaaagagccatcgggcaatttgattttaccctgtgaagagtccatgcgggaagaggagagaaacgactacacagaagaagggaagacaacgcaagaaaagaggggactaataaaggaagggaaa

SEQ ID NO: 41429 - DNA, 163 bp, Triticum aestivum
  Clone ID: PAT_TA_41429
aaacatacaggatctgaagtatcgacctctttaatattccttctaccggcagcagcacacttaggccggtgtgtcccgctcggcactatcataccaggcttccacctagtgtgtgccggtggaaaacctaagatgaagcggagcagcctggcgtgcgcgggca

SEQ ID NO: 41430 - DNA, 213 bp, Triticum aestivum
  Clone ID: PAT_TA_41430
cggacgcgtgggcttatctctccgcgctgccgtcccgaccccgtcttctgctcctccgtggacgcgacaccggccgcgggccgccggccggcctccctccaaatccgtacggccgagcggaccctccttcctttaagacctcctcccgtgccgcagacactgccccccgagatcccgtgcctacagataatttgactctgaaaaggtgacggc

SEQ ID NO: 41431 - DNA, 335 bp, Triticum aestivum
  Clone ID: PAT_TA_41431
cccacgcgtccgcccacgcgtacggagggctcaaacagcagtcgagaacacaatagatacaagaatgcaacacacgagtcttccattccactcctgatcttgtctttctcccacatcacaacatcacaagggtctttcttctcttctcttctcttgagacaagaacatcagcccgtcttcttaagtaggaattcagttcggcaatggtgctgcctccttggcctcttccttgatagatatagacagacgagtgaagtgagtgagcagtgcgtgagtggggatggatcagccggtgccctccatctgcgggctccacccgggcatcgacgtcgccg

SEQ ID NO: 41432 - DNA, 392 bp, Triticum aestivum
  Clone ID: PAT_TA_41432
cggacgcgtgggtttttttagtcaatcaacacacatatgatttatgcagtaagaataatgaggcggttgttgcttgtcaggttcatcagggaaaggaggacgaaaacatattgcatgaaggccaagttagatagcagtattcagcatgtgacttttgagatctgtcatcctggactagcatatgcaagatagacacttgtatttataattcaccacctcactcttatattactttttttcaaggacacattggtgcgcctcatctgtataaatattaaaagaacacggttcatttaagttaaaggtcttcggcgttaccataaacaaatcttgcatcaaaggaaatttatggagtagaaggcgtttgtccattgatgacacatgccatatgt

SEQ ID NO: 41433 - DNA, 243 bp, Triticum aestivum
  Clone ID: PAT_TA_41433
cccttccaaacaaggaacccaccgagaacaggtccatatctttatatttacatttagacccaaaaacactctcaccctttcactctctccacacctgaaatatacactatctacttggagcgaagtccagcacacttatatcccatatccaaagacaagacgcgcctggagcttgccatgacacccaatccagatcgggaggtgtcccaccgcgcagggagaggaggaaagattctgctgccg

SEQ ID NO: 41434 - DNA, 347 bp, Triticum aestivum
  unsure (1)..(347): unsure at all n locations
  Clone ID: PAT_TA_41434
agacaagacgccgaccacacacngccagattctgaatcttgacctggtgccaggagcggagttacaccttcagttactgccgacccaaaatatagactaactacttggaccgaagctcaaactactgcatcgacatacgaagacacgaagcgcctgcagcttgtaatggcagccaacagagatcggcaggtgcgccagcgggcagagagagggggaaagatactgctgacggagagagtcgacttggcggcgatgctactggcgactctgccgtgaacgagggtggccaccaactacacggtgagccacgagaatgggcccaaccagaacgtggactacacacgctg

SEQ ID NO: 41435 - DNA, 422 bp, Triticum aestivum
  Clone ID: PAT_TA_41435
gtgatgccccccccccccaaacatgggcccttgggcgtcgcccatgttcgcctagggccaaagccggccctgttttaacaccaatcagggatgggcaactaaaaatcaaatcttagggcttttgcagaactgcccaatctttcagctccagcaacatgaagtgtctgctattactgatgaaattagtcgcggtgctgttctcatcatacctgaaagcaatgtggatgaattactgatgacacttgaatacacctcatctggaaaaatattaaaagaacacggtccatttaagttaaaggtctccggcgttaccataaacaaattttgcatcaaaggaaatttatggagtagaaggcgttagaccattgatgacacatgccatatgtttgaatggcctgccaaaccagtgcgaaatgagacac

SEQ ID NO: 41436 - DNA, 145 bp, Triticum aestivum
  Clone ID: PAT_TA_41436
ccctcgcgttggtactctcagggtgttcgacgcataacccattccacgatgggcgcgacaaaatatctgagggggtgtcctgcctattctaaaaatacccaatataaatttctttaaccacgctggcaaaattggatcaaggact

SEQ ID NO: 41437 - DNA, 343 bp, Triticum aestivum
  Clone ID: PAT_TA_41437
ccgactccttggacgagttatgggtactgaccttacgagggtctgtacttacggagggtacccacggcaagagctgagattcactttgtcagagaactgctccagtggggagcaaactagaggtatggcaacctgtcttgccatgcgtacatcgggcaggggaacctgacggttagagcttcatgatttacagaagcgctgtgtgcgctccatgagggaagattttacatggacatatccattcactggcttactgaaaaagaggtggatcttacccgcaggagaataccacacctttcagttgacattaactatcttgtcaatatgctccggttcattatga

SEQ ID NO: 41438 - DNA, 403 bp, Triticum aestivum
  Clone ID: PAT_TA_41438
gtgaccgccgcggtgctgcccgggatgttgcggcggggcaggggcgccatcatcaacatgggatcggcgtcgtccgagggcatctccttacccctccacaccatgtattccgccaccaaacggtatgtcgctcagttctccaggagcctttacgttgagtacaaaagcacggggatagatatccaatgccaggtgccgttcttcgtggcgactacgatggcttccggcttcgccgcgacctggcggccgtcggcgttggtgcccacagccgacacgtacgcgcgcgcggccgtgggctggatcgggaagggcggcccgctctgcgtgcccaacctcaggcaccggctcctggggtggtatttcgccaccgtgccaggcggcgtgcaagactggttctgcctgc

SEQ ID NO: 41439 - DNA, 423 bp, Triticum aestivum
  unsure (1)..(423): unsure at all n locations
  Clone ID: PAT_TA_41439
gcgaatttgtagtccatcgaggagtacagacattaggaggttctgcaatgacagagcgtacccgcggcaagagctcacatgcactccgtcagagaactgctcaagtgcagcaacaaacgagagggaaggcagcaggtcttgacatgaggacaaaggtcaggagaaaatcacgggtggagcttcgtgatttccagaagcgctgggagcgcgccgcgagggaagataggacatgggttgatccattcactcgctcacggagaaagaggaggagcagaccagcagtagattagcacactnttcagctcacattttcttcctttttcatgtgctccgggcgattttgagacgccgaatactcggccgtccagttctgtgcaaaatcttgtgaaccccgtatgcttacaggtgatgttttcatgccta

SEQ ID NO: 41440 - DNA, 338 bp, Triticum aestivum
  Clone ID: PAT_TA_41440
ctcatgcgcatttctttgaattgtgcggacgctgaagtattacaaacccactcaaggggagtgtcttgctggccggcggggctcgctcaggacggcactaactctggactaatgggagttcatgcacaactgccgcattgagttcccagacacatctactactagaactaactgtggcagcagagcctgctcgtgagtcgaggtcccactccaaccaatgtatatcgactgcttccacaagctaagggcttggtacattcacaatcagagctggcatagcgcttactctgtctggactgggcaatacaaaccttgtccatcaagttgcgaacaaaatt

SEQ ID NO: 41441 - DNA, 385 bp, Triticum aestivum
  Clone ID: PAT_TA_41441
ggccccgaaatacccggggggccacacacgcccgtttatagaccgttctaggggttggcttttcttccctttccggttcggtttctggtggggggcgggttcctgagcggagagagtcccactggctagcatactctatggtctctgtagagaggaaggaagattcatgtgtgccactgcctgccacatctacgtcggaggaccaacgtctcgcaggattacatccacaatcgtcaacaaaccaccccagcccaatgatagagtcatgatccggaacctatggacttgctacatattgcaactagctgtttatagcctaggaattacgtgagattcggattaagatactttcccatccctatcttaacgcgcatttactttttta

SEQ ID NO: 41442 - DNA, 397 bp, Triticum aestivum
  Clone ID: PAT_TA_41442
cccacgcgtccgatctatgcgcccttcaagagcctcctgcccatggtaaacccagatgatcttgtgtttggtggctgggacattagcagcatgaacctggctgatgctatgaccagggccaaggtgctggacattgacctgcagaagcagctcaggccctacatggagtccatcgtgccgctccccggcatctatgacccggacttcatcgctgccaaccagggctcccgggctaacaatgtcatcaagggcacaaagaaagagcagatggagcagattatcaaagacataagggagttcaaggagaagaacaaggtcgacaaggtagtggtgctttggacggcaaacactgaaaggtacagcaacgtctctgttgggcttaatgacacgatggaga

SEQ ID NO: 41443 - DNA, 196 bp, Triticum aestivum
  Clone ID: PAT_TA_41443
cacgcgtgcttggtatggggaggctgaccgagactcccagtgtcattaaggacacggggatctgcaagatcgtggagaggaatatctacgctcgacgactgaactggtgtactcacagactagggttctgttcacgactgtgcctttctatacatcagatctgtactattaattgttagcgctacgagatttttgg

SEQ ID NO: 41444 - DNA, 359 bp, Triticum aestivum
  Clone ID: PAT_TA_41444
cggacgcgtgggctcatctcctcctcacgcacgcacgcgcacagagagcagcgacactccgctccgctccgatcaccccccaccccagctcacgcccgccgccccacccccacccaccccgccgccgctccccgtagatccgatctgccccgacccgaccgaccgcccgccgcccgatcggatccggcccgaagggttttggaggttggctcatggttcacgatggcgccgtgaaggaccagcagcagcagcagcaggagagttcgccggatatccccgcgccttctgcatctgcggaggcggggtcggcggtagcagaggcggtggtggtaagagcgccggaagcggtggcggggcgg

SEQ ID NO: 41445 - DNA, 187 bp, Triticum aestivum
  Clone ID: PAT_TA_41445
gctccgctcactgtgtgccgtttcgccccgacccgccccccacctgttcgacggaagtcgtgtccccgccggcgggcgacgatggacttcaagggccgcttattctcgtcgtggcacaagtcgttcgagtcctccaaccccgacggcagcaacagtccgcgcacgcccacctccgtgccgggggcag

SEQ ID NO: 41446 - DNA, 172 bp, Triticum aestivum
  Clone ID: PAT_TA_41446
cccacgcgtgcgttcatgtataccacagctcttggtacatttaatgttgtacggggagtagtttgcatgggtgttattcaaaacaaacatcctgttatggtgttctgcaacaccatcataagctctaacatgcttgcatatcgatgacgcaatagacacctagatgctctga

SEQ ID NO: 41447 - DNA, 384 bp, Triticum aestivum
  Clone ID: PAT_TA_41447
gctccgctcactgtgtgccgtctcgccccgccccgccccccacctgttcgacggaagtccgctccccgccggcgggcgacgatggtcttcaagggccgcttcttctcgtcgcggcacaagtcgtccgagtcctccagccccgacggcagcaacagcccgcgcacgcccacctccgcgccgggggcggcctccgcggcctcgccggcctcctcctccgcctcctccagatccgacaagaagaagcccaaatccgagacccccaagaagcgcgacaagctcttcggctccgccgccgtcgccgtgctctcccccagggcctccccggcctcctccacctccagccccttcgacgccaggaagcaccacctcagggattgccgcccc

SEQ ID NO: 41448 - DNA, 327 bp, Triticum aestivum
  Clone ID: PAT_TA_41448
cggacgcgtgggatcagcctgttgctaaagcaagttgaatgaagacgaaatgtatctcttgtttgatggagaagcaagacgatatcagttccattacagctctatgttatgtatgtctcttgaaatatatatccatctatgatctgccacctagaagttagtagtagtataactggatgatctgtgattgcattgtaggatatgtgtgatgttgctggcctgccatgttaccctttgagtctaaaacttgagcagtattataactggacgatctgtgatggcgttgtaagatatatgtgaattgctggtgtgttatgttgccctttc

SEQ ID NO: 41449 - DNA, 407 bp, Triticum aestivum
  Clone ID: PAT_TA_41449
acgatgggaaagtttaaggaggtcaaggaagtaccaaaaccttgtccgttggttcagacagcgtagctgtagactatgcactagaggaagttacatctgtttatgttggaaagcgagcaattggcaaatctcccgcaccatgcctgaaagaaaagatgcctggcttgaagaacacctcaggtcatgagatagatctcccaggtgcaaaagttggggaggtttgcgtacgttttgccccagagcctagcggatatctccacattggtcatgctaaggctgcactgttgaaccagtattttgcagatagatataaaggacgtctcttagttcgatttgatgacacaaatccttccaaagaaagcagcgaatttgttgagaacgttctgaaggatattgagacccttgga

SEQ ID NO: 41450 - DNA, 373 bp, Triticum aestivum
  Clone ID: PAT_TA_41450
agcgatcgtcggtcggttcgcacacaaatcacaaagcatacatcatcatccacgtttgtgacaaagctcaaatcaacaagttccacgtttcttcactctccccgccgacgccagggccgggggagagtggccttttattttcaaatcacaacaccaactacgaaagggagacacaaacttggtggccggccaccagggaaggaggccgctggattattgtggtcggtggtggtggtggcggcgatgatgccaaggggcagatggacggcgttggtgggatggtcctcagctgacgagcttcctttggaggagagccctctcgcccggcatctcataggtgcgccggaaggtgtcgttccgggcgtgccacgtg

SEQ ID NO: 41451 - DNA, 429 bp, Triticum aestivum
  Clone ID: PAT_TA_41451
cggacgcgtgggcggacgcgtggggtccatctgagagaacatttgtgagcatggatgttgcatttcgtgaatcggaacctttctagggtgaaaaaactgatctcggtgttatgtttgaaggccttgacccatctcaggttggtgaaattggtcaagagggggagagtaatagcacattagctcatgtgactcctttgacacaagcattgacctacaccggtgatgtgcaggtttgtgcaccgactcaaattgatagcgtgcctagaggtgtgccgaggtggacaacagagcaagaggagcacctaaaggtctattcacggaagcgaggtgatgatgttgtatcagctccgattggtagcgtgccgaggtggacaagatgatgttgcatctgctccgattggtagtgtgcttgaggggacaagatgatgt

SEQ ID NO: 41452 - DNA, 321 bp, Triticum aestivum
  Clone ID: PAT_TA_41452
gggccgccgtaagggtgatgacagtctcattaacccttccttcagcatcggtctggaagaatggaggctcatgtgagagcagacgatgattctattttctatataggcatgggctcatagcgggggctaggtctggctaccatgacgcgggacaacgttatgaggagccggacctgaaacgacgtccttgggtcaccgattagggagggagcagaccagaaatgcagcattcgtttctcaaaattataggtgaaaattattgatctatctgagagaaagaacacgttacgcgtgttgcgaggatgtgttgattcatgaaaa

SEQ ID NO: 41453 - DNA, 249 bp, Triticum aestivum
  Clone ID: PAT_TA_41453
accacgcgtacgtccactcgtgcggcaaagcgcaccggcgcatacacatttcgggtggtgtacaactcgccggagacgcagcatgcaagaagatggcctgtatgaaggtcggcgaccgtaataaggtggtgactcactccgagaaggccacgctccagttactggtctaccgtattgggctctacctcaagaagggcctatacacccagcgcgtcaggtccggcacccccgtctacctgaacgccgatc

SEQ ID NO: 41454 - DNA, 202 bp, Triticum aestivum
  unsure (1)..(202): unsure at all n locations
  Clone ID: PAT_TA_41454
atcctccctttccttccctttctttcaccttacgtnctcacccaaccacctgataggcgtgggttcggcggcttggcttcgnctgcgccagttggagtaaccctcgcggtctgtccgtgtttgaaggtaagggcctaaggttggccccgttctcgagccgagattgggccggggaaggtgcaacttaagcggatccagaaca

SEQ ID NO: 41455 - DNA, 428 bp, Triticum aestivum
  Clone ID: PAT_TA_41455
ccgcttcttcgcaatggcggcgagatctccgctccactgagcaagccaccggcctccgtacaggcgtgcgtctcccagttcggcagaaacctcggtggcaggcgcggccgaccggcaattgccctcccaacaggagatggcgcacgtttcgttcaaatccaaggaggtggacagcgtgccccggtggtcggaatacctgaccgccgaggagtcttctccctcagcgtcagcaagctggaggaccatgggcgtcgacgggcctcaaccctcgtcgagtggccagaggcaccttcagatggagccagtggttcagctctccaaggtcgcggaagggctgctggccaagatgtacaggctcaacagtatcctggactacccagatccaaacacgcacaccttctcggaggcattttggaaaactggtgtta

SEQ ID NO: 41456 - DNA, 100 bp, Triticum aestivum
  Clone ID: PAT_TA_41456
accatgcctctctttgcttattttcccctgcatcggctctctcttctcgatctctgagcggcagcttgtccatggaggaggccgcaccaacactacggcc

SEQ ID NO: 41457 - DNA, 241 bp, Triticum aestivum
  Clone ID: PAT_TA_41457
cccacgcgtccgccaagactgacttttagtgctacatacgagtaaggcttaaagataggttcaactattgatttggagatggcacttgaactggagtaggaaagctgttggcccatcagactttgaggctaaaccaataagactatgaccgcgtccagtatattaacgataatgatgtagcgaattttcgagactagccagtgagtaaaggtggaatgacataacattgtggagtgggatc

SEQ ID NO: 41458 - DNA, 275 bp, Triticum aestivum
  Clone ID: PAT_TA_41458
cggacgcgtgggcttgtttcggtttggagttggagacagtaacttgcaaccgaataggttgtaagtaatgcacttaggttttcagaaggtcaacatattcagtttcggcacagacgacacaagcaaagcttgaacagggtctgtattgcatcaaaggggggctgaatgatggttcttcaatacaagtccatgcatagcaagctatgcttgtgacatatcagaactgctttttctatgtttatcggtactcaacttatattaaaactacacttttg

SEQ ID NO: 41459 - DNA, 313 bp, Triticum aestivum
  unsure (1)..(313): unsure at all n locations
  Clone ID: PAT_TA_41459
cggacgcgtgggcggacgcgtgggcggacgcgtgggcaaaaattcctctcttgagcaacgctccctccctccctctcgaatctgattcatcacaagactatcaacagacaacatcctacctccagaatgtttggggcccctaggtatttgactgaatagcacgggctcgcgtgtgtatgtcaccatgacaatactgcacttcaagatttcataagtttaatctttagttctaacattatctnttgtgcagataaggatggcagtagaagagcttgacgacaatgaatgacaaccatatggacatttttttagt

SEQ ID NO: 41460 - DNA, 334 bp, Triticum aestivum
  Clone ID: PAT_TA_41460
cggacgcgtgggcggacgcgtggggctccgcgtcgagcaggggtcgctcaccggcgagaccaactccgtcaacaagaccgtccacgccgtgcccgccgaggacgccgacatccaggccaaggagtgcatggtgttcgcgggcaccaccgtcgtcaatggctccgccgtctgcctcgtcgtgcacaccgggatggccaccgagatcggcaagatccactcgcagatccacgaggcctcgcaggaggacgacgacacgccgctcaagaagaagctcaacgagttcggcgaggcgctcaccaagatcatcggcctcatatgcatccttgtctggctc

SEQ ID NO: 41461 - DNA, 181 bp, Triticum aestivum
  Clone ID: PAT_TA_41461
gcatggaaggcgagggcctaatctgccacgaccatgcccagctctaacacagcatccattatcgtgcgctgaaccaagaagcgaccacgggcgaacggattgcattacacgggcagctactctattaacaccaccgcatgttatgacatgaacggacgcacacggaacaagatctagaacg

SEQ ID NO: 41462 - DNA, 320 bp, Triticum aestivum
  Clone ID: PAT_TA_41462
cccacgcgtccgcccacgcgtccgcggacgcgtgggattcagctcaatcccagacgtgatacttaatggaaactcattcctgaatggacctgctcctacaccaccacctttgatgccaccaccccctagaaggccgcgcagtcgttctaaccgttctgggggaagtggaaatgctccaaaaggctctgagagctccactagtcaaggtggcaagaatggtctgcagacagcttctcttgtggggataattgttggctcaatacttgctgctttgtgtgtgcttcttcttttgggattatgcattcgcaaatctcgggaaa

SEQ ID NO: 41463 - DNA, 179 bp, Triticum aestivum
  Clone ID: PAT_TA_41463
gcgatccatggacgccgaggccggcgccgccgccgcccagcagcttccgtggaggcagcactacaggaatctactactgctagcataccagagcttcggtgttgtttatggggacctaaacacattaactttggattgggattaaaagtccattttaaggagggttccggcggtcccaa

SEQ ID NO: 41464 - DNA, 197 bp, Triticum aestivum
  Clone ID: PAT_TA_41464
cggacgcgtgggttttcttgcgttccggtccccagacttcgagttatttccctggtcaggcgcgcgcgcggcggaggcggcggcggaaggtacgagtcggcgctctcgcgagctagggtttcgggccgaggaggaggaggagcgagatggatgaggtgacggaggtggtcaagaacctggccgtcacggagccgcac

SEQ ID NO: 41465 - DNA, 372 bp, Triticum aestivum
  unsure (1)..(372): unsure at all n locations
  Clone ID: PAT_TA_41465
cggacgcgtgggcctcgagataaatttggacaccggcaagcccctctcagtaaagttacaccaagtctctcctttgtttgattttggttccagctttgatcgggagcaccaaccgcgagctgggagaaagcccaaagaactcgaggaagaagtgaagctcctcattttctgtgaagaagtaccttgagactgtccgtgaggaagacacgctgaatatcttgcttgattttgttccccgcccactgcacgccgctgtcgagaacacctctgctacctcctcccaatctccgccacaagattctccgtccagatcctgggcgaggaataaaaaaattagttcttgaagcttctncatcatgccggacggacaac

SEQ ID NO: 41466 - DNA, 328 bp, Triticum aestivum
  Clone ID: PAT_TA_41466
cggacgcgtgggcggacgcgtgggcggacgcgtgggttttttttaaacagaaaaaagaatggtattgtacacaagcagcagagtcagaaattacagtgagggggcactgtgataacacaaacaggtgaataccactattttacaagggctgacagacaggcccccatcaaataaagtttactcctcctttggccactccattactttgcaacatgttgggaaaaagaaactagacacagggaaagaatacctagtacaataacactatcatcccctttttgcccctccaatctggcgacaaaacaacatacaacccaactatttggcg

SEQ ID NO: 41467 - DNA, 153 bp, Triticum aestivum
  Clone ID: PAT_TA_41467
cccacgcgtccgctctaatagaactctgctatccagagcgctctcaatactgggccggattctaattgacaaatcttatgtgtaaaccatttatctcgtatccacgcacgatgtgtgaatttccctgaacctgccaccatgccgtttaccacc

SEQ ID NO: 41468 - DNA, 352 bp, Triticum aestivum
  Clone ID: PAT_TA_41468
cggacgcgtggggagttcttcacccgcaatgggcgctggaatattgcgaggaagaagctgattaggaccagctctgtcaagaggtggtccgtcgtcaatttctctgcacgctgtgatcttcgtggtcttgtccaagaccttaaaagggtcgcgactggaatgggactcgaatatgaggaccctcacactgtaattgaagagagcccgtcactgagacgagctccggtggcacgaagagtggaggagattttgcccagataaaggccaagctacctggagcacccttgttcctcttgtgcctcctccctgagaggaagaattgcgaagtttatggtccttggaagaaaaagtg

SEQ ID NO: 41469 - DNA, 361 bp, Triticum aestivum
  Clone ID: PAT_TA_41469
cggacgcgtgggtacttacacatgatttatgaagaatactgataaagttacattgggaaaggtggaaagatctgtctaggctgttaagactgcggttcatatgttagaaagtggtgcggatatagaagaggccacagatgtatgctcaccatatgaccttttccaacttgcaaaatggaagaacaaactgaatatatatcttgccccgtttcttcatggcacgcgctatacatcttatgggcggcattttacaaaactggacaagctcgagaagattgtagataagttacaatggtatgttcaaagtggtgatacggtcgttgacttctgctgtggttcaaatgattttagcacattattg

SEQ ID NO: 41470 - DNA, 361 bp, Triticum aestivum
  Clone ID: PAT_TA_41470
cggacgcgtggggagggcctactctcacctacatggaaactccaggtttttccttgttgattgtgtggctgccgatggtttaggttccaggatgcttttggtgactcttgtggctgcgtgctcaacatgaccacgtttcgtctcagctacgatcgtgagggaaatctgcaaatcaaagacaggaaaactacctcctgttgcgtgtctaagcaactctcgtccttctccccagtggccttctggatgtagctacagccaaggaaattgctcgtgctgttttttatttatttagcttgatgtcatgcatactagctatgttcatcgtcctatctgtaaattactccctccatttttctatata

SEQ ID NO: 41471 - DNA, 281 bp, Triticum aestivum
  Clone ID: PAT_TA_41471
cggacgcgtggggcagccgtcctttctcctggtcaccaaccccacggtcgtggtctcggggcgcgtcgccacaggaggtggaggcgccctggacgctccgatggccacgccggcgttccggctcttcatgagccggatctacgagtcggagcgccgctcgctgaactaccgcctcaattgggcgaagatgacctagtgttcggtcttttagcggccggactccctctccgacgccaccttccggctgcgccgtaaccttacctacttgcgcgtgaactaca

SEQ ID NO: 41472 - DNA, 340 bp, Triticum aestivum
  Clone ID: PAT_TA_41472
cttggactatggaacaggcaccggggtgttgggtattgcagctctgaagattggtgctgctctatccactggtatagacatagaccctcaagcagtgagctccgctcgtgagaacatgctgctgaatggtatggattctggcagaatgctggttcacttggtaccgacaggcgccgagccttcatgcttctcaagtagcatcgacaaatcagaagaggaaaagcccggcagtaaccttgagctgaagtcctcaaaggggacgtatgacattggtgctgcaaatatactgctgaaccccttgctggagctggtcgaggacatagtcggatttgcgaaaacc

SEQ ID NO: 41473 - DNA, 404 bp, Triticum aestivum
  Clone ID: PAT_TA_41473
cccacgcgtccgctctgctggatgtcgcctaagcagaggatgcggcagtctcggccacatttggttttcctaagctaatgtggggtttctttcccttgtattcttgcaagatgtggttctttgttggttcgttcgaccatgccgttaaccaacaaggttaggtctactcagattgccttgggttattacttcttgataatataggccgtgaactcctgcatttgtgcggctaggttgcctgtctatgtgtttcggggttcaccttattatgcttgtcgtgctttgtatgggttttccttcagatcttgttagaaaaaaatgtgttcttgaatacttatgcttggcctggtgggtttctttctgggtgattgtgtgcttatatgccattggtcgatattcatgtt

SEQ ID NO: 41474 - DNA, 185 bp, Triticum aestivum
  Clone ID: PAT_TA_41474
cggacacgtgggcagacgcgtgtgataacaaccaccagcgactctgatgctgggggtgagatgtatcaagtcactgccttattcagccacgctgaaaaagtcgataaggaaataaaagagaaccgtgcaccatcagaagctgacgatcaggctgataaatttgttgtccaagtgaaaggatatgc

SEQ ID NO: 41475 - DNA, 178 bp, Triticum aestivum
  Clone ID: PAT_TA_41475
cgcttgtgttgggcagtcagtctttgggttccggggcggttcggttccattcggttcggaaggggttagtagcggtgaagaggaatgcatggcgcacgtcgagtatcgttggtttgtgggcggactatgatgacctatcgactaccagacactatagaacgccttctacaagtacggc

SEQ ID NO: 41476 - DNA, 254 bp, Triticum aestivum
  Clone ID: PAT_TA_41476
ctcacgggcagtgatgaccggtccttgtttacatgcgagtgtggacaattgagtcacactttaatgtggtgcagccatttcttgcggttcattaacatacttcttctggaggagatcccggtgaatcttattgctatttgttggaccaaggagggacatacttctcttgtacctggttcaacattagaaggttatatccagtgaaattgtcattttacatgcttacactttaactcttacctgaatgctattcc

SEQ ID NO: 41477 - DNA, 151 bp, Triticum aestivum
  Clone ID: PAT_TA_41477
caagccctagccaatggtatcacgactgcgcgcgcgccgagcccgatagctgggggggcacggtaagggggtggtacatgccttttctgcttggtgtcactcgttagtcacggaatgtattcgtgtcctgttacgcatgcaccggagcctc

SEQ ID NO: 41478 - DNA, 310 bp, Triticum aestivum
  Clone ID: PAT_TA_41478
gccacgcgtgcggagaaaacctaaaccagatccagatgcgggtctgactccggcccccctcccggagcgagcacgcgccaccccctgccgtctatctatttggccgccgagcaagcccctcctcgccgtcggccttccagctcgcgcctcccgctcctgctccgtttgcgccttcccgacccctgacgcccaccttcggcggttgcgggtgacgccgacgacaacttctgcccaactctgcagtctttagcctgccgcaagaagatcgagataggagcctgaagtggtcaggacagaacagttggttact

SEQ ID NO: 41479 - DNA, 403 bp, Triticum aestivum
  Clone ID: PAT_TA_41479
cccacgcgtccgatggcgccccgcgcgcacctggccttctaccaggtgtgcttcgtgggcaagggctgcgaccgcgacgacatactcgcggcgatcgacgacgccctcgacgagggcatcgacgtgctctccatgtcgctcggcgctgatgacgccggagacttcgccgccgaccccattgcgctggggggattcagcggcgtcatgagaggcgtctttgtctgcacatcggctgggaaccaaggcccgtccccggccacagttgccaacgaggccccgtggctgctcaccgtggctgcggccacaactgaccggactttctctgcggacgtcaagtttggcaatgggcttgtgatcaacggcgaatcgcactaccagccgagcacctacgtgagcgtgcagc

SEQ ID NO: 41480 - DNA, 232 bp, Triticum aestivum
  Clone ID: PAT_TA_41480
gaaagcagtccgcgcggcgctcctctcagggttagggtgacacggacggagccctgaccggcgccgtcacagggagcatccaaggttgtatccactcaccgccgccggatgccaaagaccgtgcggaataccggccgggggtgccggcctgggctgtcatctggcatgggatatttgacctgccatgaccacaactgtgctgaaaactgttgtggcagcttgtgcatcagca

SEQ ID NO: 41481 - DNA, 352 bp, Triticum aestivum
  unsure (1)..(352): unsure at all n locations
  Clone ID: PAT_TA_41481
cggacgcgtgggggcaacactttacttgtgaagggagctgttgaaaccttgctggagaggagtagccatatccagctccaggatggttcagttgtgccattagatgagaaatcaagaaaagctattttggctagtctccatgaattgtcaacaaaagctctgcggtgcctcggatttgcatacaaggaggatcttggtgaattcgcaacatatgatggcgaataccaccctgctcacaagcttttgctggatccagccaattatgcggctattgaaactgacctgatatntgttggtcttgctggcctaagggatccctccagggaagaggtctttgatgctattgaggact

SEQ ID NO: 41482 - DNA, 232 bp, Triticum aestivum
  Clone ID: PAT_TA_41482
cgcgtccgggagcgttgatggaatcattagtcatgtgaagatggaaatcaagcaactagaggatgaaaaatttgtgaaagagagggtgtctgacctgaaacgacatgcagatgaagcattcaaaaagcaggattattctaaatgcatcagtgctctacacacaggcactgaagatggataacttcgacgccaagttgttgtcaaacaagagtctttgctggcttcgcatggg

SEQ ID NO: 41483 - DNA, 237 bp, Triticum aestivum
  Clone ID: PAT_TA_41483
cccacgcgtccgccgacgcgtgcgggcggaagcggatggggtatgggagcgacgacggtctaagagaaccaagcgtggacggccggagaagaagggagccattgcaaatgagacagagcaggttgctggcgaaaacaacaccatttttcttcagggccagcggaaaaattattaccttaatgagctcggatggcatgctgttcaaggtgtcggaggcggctgtactggtgtccgtgc

SEQ ID NO: 41484 - DNA, 345 bp, Triticum aestivum
  Clone ID: PAT_TA_41484
gaagaaaaaaccccaccaccactaccctgcctgctgctccggctatgcggcggctacctctgtggatcctgcgctccgcggcggccggatctctccggagccccgccccctcacgcggcggctgtcctgtccctcgagcgccacatctgccggcggaggcagccgccgcgccggccgagcttgcccgctggctaccgcggagagggtactcccggttcgcgagcggattcacccccctggagccgaagaagctgggatccatcctcgacgtcgagcgcgccaagggcctctcccccgaacacctcgtcgcggcatgggatgactaccacctgggaagaggtcaca

SEQ ID NO: 41485 - DNA, 169 bp, Triticum aestivum
  Clone ID: PAT_TA_41485
cggacgcgtgggatgcctggttactcactacggccggccatgtaggatacggtgcgccgctcttgctttcttgctagataagtctgcatgaaaaatctaccatgctccgtaaaggtttatacatcaattgcaacgtgttttaggaatgcattactacattgattatggt

SEQ ID NO: 41486 - DNA, 295 bp, Triticum aestivum
  unsure (1)..(295): unsure at all n locations
  Clone ID: PAT_TA_41486
cggacgcgtgggcggacgcgtggggggttctgccggggtccgacccancctcgcaggcgcaggtagggctgcaggctccccctcggtgccgcggcgccatccgccgacgcagccgtcgtcgccagctgcagctctccgcgcgcgacgtctaccacgggccgtctccgccccggacgctcgccggtcggtccgcaccctgcgccaaactacttctcgacctgtcacgttctttagaagaaaagaggaaaaatcatacatggatatcacgcagacaagtgattcttcacaatatgga

SEQ ID NO: 41487 - DNA, 196 bp, Triticum aestivum
  Clone ID: PAT_TA_41487
cggacgcgtggggactctaggaaggcgcggtggccccactcatcttgccatcttggctcagccaggggacacaattaatggaccactccttctcactgttcatggtgaagtcatcgagccaagcattatggaggaacactagtgcttcacggcgctccagcgcttcacagctgctactatagagcatgtgatgtgt

SEQ ID NO: 41488 - DNA, 134 bp, Triticum aestivum
  Clone ID: PAT_TA_41488
gcgcagacacgtgggtgcgcacactttactggtatatgatagggctatgccaaatatcacggtaggtgcgggaactgtggacgttcacctcactcctacagaaaacttcgccgacgtcccttcaactacggtgg

SEQ ID NO: 41489 - DNA, 319 bp, Triticum aestivum
  Clone ID: PAT_TA_41489
cgctgtccattcttctcggctcagtcaatgcggtctaccctcttgctgaagtcgctcctttctacaaatatggattgaagctgaatcgaagttcttgagtcctggcggagttggtctatttcttccatctggcggagcggatatggagcctagaaaatcgccaagatcaagaaaacaaatccagtctgaactttctagcgatgcatccagtgatgatgatgtttcttctagatccaaaagcactactaacagcaaaagaacttctccaaagaagattaagagggccaataggaaggatgtagttcatagatatcaaaga

SEQ ID NO: 41490 - DNA, 360 bp, Triticum aestivum
  unsure (1)..(360): unsure at all n locations
  Clone ID: PAT_TA_41490
tgagatcgttcgcttggagttcagtcactatgatataaaatcatccaagacaatatctgctaaggactttgcattatccatggttgcttctgctgacatgaatcatataaacaagctacttgacagagttgatgattttgatgaatctcctgatgtcaaggatctgcgcattacctttgaggagttcaaggcttttgctgatctgcggcgaagattggaaccatttgcaatggctatcttcagctatggaaaagtaaacggtttgttgacaaagcaggatctaaaacgtgctgcaactcatgtntgtggngtggacttgactgataaggtgggggatgtcattttcatgtgtttgatgca

SEQ ID NO: 41491 - DNA, 265 bp, Triticum aestivum
  unsure (1)..(265): unsure at all n locations
  Clone ID: PAT_TA_41491
ctatttcggcttcttcctctccaagctacagccccggccatggcggcgacgatccagtccgtgaaggcccgccagatcttcgacagccgcggcaaccccaccgtcgaggttgatgtgtgctgctcagatggaaccttcgccagggccgctgttcccagcggtgcatcaactggtgtttatgaagctttggaactgagagacggtggatctgactacttgggaaagggtgtttccaaggcttgntgacaatgtgaacttgattatc

SEQ ID NO: 41492 - DNA, 143 bp, Triticum aestivum
  Clone ID: PAT_TA_41492
cccacgcgtgcgttgacacgtttgactgctacaaggaaaatacatattatctcgtgctgagcctgccgcagcaagagatttttgttccactatgattatagttcatttgtgtgtcagggttattaatttggtcatgttttttt

SEQ ID NO: 41493 - DNA, 395 bp, Triticum aestivum
  unsure (1)..(395): unsure at all n locations
  Clone ID: PAT_TA_41493
cctcagtaccgtccgattcccgtcgaccacgctccgtgccatttcagatcattttccatgcncgacgaccagatcaaccaaagaggtcggacgtagaaaggctgaggaagattatttctcactgagtcctctcatatatactttcttctctttactaattattttttctttattttcttcttttttcttcttacttattttttcttttttttttttattttttctttgttttttatcttttttttgtcctatctttttcatttttatattttttattttaattattttatttttttcttatccttcttttattttctgttaagtgtttatcattttattttatttttttactatctattcattttatctcttatatctttttcatttatttttta

SEQ ID NO: 41494 - DNA, 167 bp, Triticum aestivum
  Clone ID: PAT_TA_41494
cgttccgatattccagtggcgacgccacgcgtccggtgagcttccgttatagaggatccaacctatcgttcccgaccatgccacatcattgggcggggatatttacaccgaagtgcaggacactgacctcctctttacatcgacgaggagtggaaagccctatactc

SEQ ID NO: 41495 - DNA, 288 bp, Triticum aestivum
  Clone ID: PAT_TA_41495
gcaccatatttatggtgcatttgatcttgagcttgaaaatgacaaggttggccatacgcaagctacggtccttcttattttgaagaataagaggagatgctccatttttatgggaatagggtgagacatgcatatgcatgatgcaagcgaatcttacttatcctggataatccttttaagttgaaatattgtacgaccagtacagatggctgaagagttctcttaacgaatgtcatcaagccatggatatcctacacagatcgaaaggcttgctgccatagggataag

SEQ ID NO: 41496 - DNA, 399 bp, Triticum aestivum
  Clone ID: PAT_TA_41496
taaaaaacttaaccttatttctgacgtttgcaaaaattggattaaaaaatattgcataatggcacgtggagcaggttatatttcattttttgcccggtgcaacgcacgggcatttgtactagttaagataaataggttagtggggatgaatctcttaggtatatatgattctaacgcaagttgtacaccggttgtttttagttgtagttctatagccttgaaatgataatcttgattaattttttcttatcgctgtttttgggtttaatttaaataattccaatccctacagtagatacggttggccaaaataattggtgtatccaccattaatttgcatggttttaatgctgaagatttcttttgcggtaggcttaaagtgttggcctcacaaatctt

SEQ ID NO: 41497 - DNA, 336 bp, Triticum aestivum
  Clone ID: PAT_TA_41497
cggacgcgtggggtggatccgccccgcccgacgtcaagcacgaaccaggtaagcaggctctttcactctcccgcgcatctgtgctcgccgccgccgccgccaggccgtctgcaacctgtaggtctctgccgtcaagtctgttgcttcaagcaccgctctccgtcgccgcatgtaagtatatcgttgtcttacaactggctccacaaatcacatatagatagtttgggcaaggccgaagcccgatggtggatcaagctccactcatctcttcgatttgaccatgacttattcaccaacagagtccctgcagtgtcataggaagagtatggctccatt

SEQ ID NO: 41498 - DNA, 434 bp, Triticum aestivum
  Clone ID: PAT_TA_41498
cggacgcgtgggtggacacttacatggtacaaacaattggatccttataggagttgtttgacccatgtgctagaaggatctgctgtagtttatttaattagtgctataccagtttacatctacttgggaagttttcatcagctgtacttttacagtctcacacgagctagtattattgtagcagacattacattctctaagatggatatgtggaattagctagcaatcaggtcttgtactatctggataaatatggagtgacatttgcgagcggtggcatggcctacactaacgttcacaaggctgatgtctcttttaaaaaaccatgcattcagttgttgttttctttgacctgatctgatagcaagtgttttttatgcatccttagagaacaagtatttgagtggctggctgttttgagcttgcggaagaac

SEQ ID NO: 41499 - DNA, 344 bp, Triticum aestivum
  Clone ID: PAT_TA_41499
cccacgcgtccgggtctgcacacccacccagtggcccgcccctcctctcttcgtcttcctctcgcagcttgcagcaatggccggagcaccgctgcttcttcttctcgcggcggtgtgcctcgcgtgcttcgcccccggcgccaatgcggcggggaggaagatggtcggcgtctacgagctcagcaagggagatttctctgccaaggtcaccaactggggcgccaccgtcacctccgtcgtctttccggattccaaagggaatttgggtgatgttggccttggctatgacaccatcggtgaatatgttaacggatccagttactttggagcgcttgttggacgag

SEQ ID NO: 41500 - DNA, 405 bp, Triticum aestivum
  Clone ID: PAT_TA_41500
gtcctgttgagagcggccacggggggaaaaatcacgcctttccgttccgttgcgtctccggcgccacactcctccggccggccgctataaagcgcgccgggtcacgggccccgcggacaatgggacccccgtccgccgccatcgacatcgacatcgacgacgatgctctgcctcacctcctcctcgccctcgctcctgccgcgcccttcccgtcccgctgctgaccggcccggtccggggatctcgggcggcgccaatgtgcggctgagcgcggtgcccgcgccgtctccgcttcgctggaaggccaagagcgatttctctgctcccgtgtctgcgccaagagactacaccatggcaacagctgaagatggcgtcggcgaccttccgatatacgatctggatccg

SEQ ID NO: 41501 - DNA, 335 bp, Triticum aestivum
  Clone ID: PAT_TA_41501
tgcggcaccggtcccggtctcggagattccgaggctacgacctcacgcgtccgcggacgcgtgggattgtgcgtacacaagggttcaacgtggacacagtagtgtatatgaacatcatcttcactgtttgggatgttggtggccaggacaaggtgaggtggtcgctcttttcttcttcttgggacactctttggctgcatttccttggtagccgcacatgaatcaaaagctaatccacctgtgtgctgctactaaagcgcttcattgacaaaagtctatttatgtaaagacaagctgatgatttatgtatgccatttccaaaacagatgatgact

SEQ ID NO: 41502 - DNA, 368 bp, Triticum aestivum
  Clone ID: PAT_TA_41502
cccacgcgtccgcgatctgcgccgcgccgctcccctctcctccccatccgcgccgcgccggcctccgctcccctcctgccgtcgggaccagcaatggtgctcatgagcgctgcggcgacggccgccgtgatttacgcgtacggcaagtcggtcgcctcggtcgggcttgctgcagggaccagcgccagggcgttctgggtggtcggcggtttcaccaaggtgctgtgtccgctctgccacgagcatgtcaggcagatgaagtacgagaggcacaccagagagcatacgttcgagtgcccctcgtgctacgaccaggtcccgttctccgagctcgagaaccatgcacagagccatgggtatcgatgctc

SEQ ID NO: 41503 - DNA, 321 bp, Triticum aestivum
  unsure (1)..(321): unsure at all n locations
  Clone ID: PAT_TA_41503
cggacgcgtgggcgcgaggagatagaggcgagctaccagtcccagatcagagtcagacaaggcgatagtcattgacttccacgcccagcccatcgtccacctccctcccaatgggatccacccacccacccgttctcacctcccttcatataatttttcttccgctgctaacaactgcctagtattacgacccccccttcctcggttgttgcaccagctgactacactccccgccgctcccctctgtntgcccgccggcggagggaggatcgcttgtttcccggcgagcttcctctggggcgtgtggggggactgtgactc

SEQ ID NO: 41504 - DNA, 126 bp, Triticum aestivum
  Clone ID: PAT_TA_41504
cggtcgcatgtgactgtgcgcacagacagcttccaagccaccaccgtcagtgttaagctaattaattgctgtgatcgcgttgccccaggtgtgaacaccatcggctgatcgaacattcctgactgg

SEQ ID NO: 41505 - DNA, 358 bp, Triticum aestivum
  Clone ID: PAT_TA_41505
gtcaccttatagttaaaagagcgctgaatgaatattttgtcttcaaatgtaggtgggtgcttcagttagattctgctggctcaatcttctactccacagctcccaaatgggtgaggcaatcaagtatcaaggatctaccacaatgcgtcgatgacacgaaggattggtgtgatcactggaagcactgtgtttggtttacacaaggaaggggtgctcctgttatgaacgagcaaactctttctctaagggctagtcataacctaactagcatctcttatcagctgctaaacccaaatgatgaagcatgcaatggaagcttgaaagctgacaatctaacattgttgccagaaaggatagc

SEQ ID NO: 41506 - DNA, 396 bp, Triticum aestivum
  unsure (1)..(396): unsure at all n locations
  Clone ID: PAT_TA_41506
gccgcatcccaccctctcctcctccctcttctgcttcctacctcctccccggatagggacaagtcttgttgattgggagacatggcaggacggctggcctctcgggctgggcactctgaaaccgggagccggagcggtcaggagcgtcgactcctcctcctccaccgcagccttcaccccgtcccactgcgtctcgtccgtcgcttcgtttgatctagacacagagtcggcatggtctttgccgcacgctggtggcggcggcggcatcacgctggcggccctgatcggcctggtggatgccatggagagccggtgcaacacgcgctggggcgagagggcgagcatgagcggcaagctgcgggcgctgctgctctcgctatgcctncggagccacct

SEQ ID NO: 41507 - DNA, 336 bp, Triticum aestivum
  Clone ID: PAT_TA_41507
cggacgcgtggggagggtttttggagaggatactcttgccattcctcgccggccgcatgtgggctcacctcggcggacgctccaatcaatgagagctgattaatcggcggcggatccgtcgatccatgagatccacgccaccaagagatggggtctcgtctggagtgcagatcatgacgagaagtcagagctatgtgacactgatatcgatgactatgctgagaaggcgtacacagaccttaagtctggcatgcttgtggagaagttcggcgcccacaggttcatatgcccgatctggcccgggaagaagaagcaggactaccgctacaatgagct

SEQ ID NO: 41508 - DNA, 123 bp, Triticum aestivum
  Clone ID: PAT_TA_41508
ccccttgcgatcgaatcgattcagtcaggatccccactgatcgccgtggtcaaagaggagagcgcggcgccatgtgggccgtgtccatcctggcgtccaactgcgccgactgcgcgtgcgagg

SEQ ID NO: 41509 - DNA, 227 bp, Triticum aestivum
  Clone ID: PAT_TA_41509
cggacgcgtgggttcagggcgactgttagctgtgtgaattccctgccatgatcttgttagattttaatctctggacatggcatgtgtattgttagttttgggtggtgatttaggggaaaaatgcatggtccgccttactaactaatttttttctttgcatattttttctgccggtgatggaacactctcagattcaaaatgaagaggggccatgtcagatagggatg

SEQ ID NO: 41510 - DNA, 301 bp, Triticum aestivum
  unsure (1)..(301): unsure at all n locations
  Clone ID: PAT_TA_41510
gtttcacatcatgagttcctatcgtcgcttgagtacattgagtttgcgggtgtcttcaacggcatggctgccaaggacgtctaagtttggtatatgaggatgttgtagagtttcgaaagcaggacaagtcttcaacatttcagtcaaccgcgagtttcaaggcgagatatgctgggaaggatgccttttcaattcaataatacaaactctgttagcttgagttgaaatgtgctactgctataaggttgtcttgaactagctctgggaggttgaattgagctatactatgatgttnnaaaaa

SEQ ID NO: 41511 - DNA, 343 bp, Triticum aestivum
  Clone ID: PAT_TA_41511
cccacgcgtgcgcccctcacccaatgcatccaacaccgtggcggcggcgcgcgcaagctgctcgactgaaggcctgctaggcgaagatgttcgtcgagaagcgggacgggcggacggagacggtgcactttgacaagatcacggcgcgcctcatgaagctcagctacgggctcatccaggagcactgggacccggtgctcgtcgcacacaaggtatgcgcggcggtatacaagggcttcaccacctgccagctctacgagctcgcctgcaagacctacgtcgcgctcaccgactaccaccgagactatgcctcactcgcggcgaggattgctgtttccaacct

SEQ ID NO: 41512 - DNA, 255 bp, Triticum aestivum
  Clone ID: PAT_TA_41512
tagactcagatccccatcacccaatccattcaacaccactaaaagcggcgcgcgcaggctgctcaactgtaggcctccgaagccaatatgttcttcgtgaagcgggacgggcggacggagacggtgcactttgacaagatcacggcgcgcctcaagaagctcagctacgggctcagtcaggagcactgcgacgccatgctcgtcgcacacaaagtctgcgcggtggtatacattggcgtcacctccagcctgctc

SEQ ID NO: 41513 - DNA, 259 bp, Triticum aestivum
  Clone ID: PAT_TA_41513
cggacgcgtgggccatacgcatcttgcttcttaactagaaccctcgcctttggccgtggcgagcccttggcggcagcaaaacttaacccccttgccatcacgggaaaaccttaacccggtcgacggcgtgtttgggtgtcaacccgctggacatacccgccttcaaggtgacaacttttcccggttggccggcccgtttgaaaccaaacccttcaaaggatggcggcccaacctacattatcaaaaagaaccccggccg

SEQ ID NO: 41514 - DNA, 439 bp, Triticum aestivum
  Clone ID: PAT_TA_41514
cggacgcgtgggccaggttgttcatgggggatctgcagttacagagaatggcgcattaagttcacttgagttgaagagatcggcgtcttttcaacaatgtgaagctgcagagccattggcaaagcatctgcgtgtggaccagttgctacctgaaaatgcgcttaggcaaagaagaattatgagcgatgctgcaggtcattctgctcaaatgtcgaaaagtcctgtgcgagctccccttgggatacccttttgttcaacaagtgtaggtggatcaaggaaattactaccgccagcagtttatgcaggggaagatcacttcagcagctgttatgagcaaggtcagctgttgaacacggaggttctgcgtaagcgcatggagaaaacagcagaaacactgggtctggcaggtgtcacaatggattgtgctgaacttctgaat

SEQ ID NO: 41515 - DNA, 352 bp, Triticum aestivum
  Clone ID: PAT_TA_41515
cggacgcgtgggcaccaccgtccgaccagccgtgtgtgtcaaccaaaagcagcacaggtccccacggtcggtctacatatactccccaccgactgcttctcctactaaaccactcgcgtacgtacgtaccaactgtgccgatcgaacaatgcaccggcagatggccgtcgcggcgtgggcactgctgctgctgctgtccgaggcggcgtcacagtgcgcggtgcaagcgctggtgccgggcgtgatgatcttcatcgactcggtggaggacgccggctacaacaacctgctggccacgctggtgcgcgccgacttcccgccctactgacgagacttaccggccacccacgcg

SEQ ID NO: 41516 - DNA, 392 bp, Triticum aestivum
  Clone ID: PAT_TA_41516
gccacacatcatgagtcgctatcgccgcttgattacattgagtttgctgatgtatgaaacgagactgctgccaaggacgtactaactctgcatataatgatgttgtagacatacaacagcatgacaagtcttcaacatttcagactaccgcaagttgtcactgcgatatatgcaacagaaggatgcccttctaattctattaatcaaaccacaccaaccttgaggtggaaccatctaactggtatcaggctaggctcgcactacattatgagaggccgaattgtgctccactatgttgttgaagtggaagaaccctctctatatgactctatcctggccagcaatataatcaacataagaatagcaacaagaggtgcaattcttaggcgacc

SEQ ID NO: 41517 - DNA, 374 bp, Triticum aestivum
  Clone ID: PAT_TA_41517
cggacgcgtgggcggacgcgtgggcgaccggcggtaaggcgccgaggaagcagctagcgaccaaggccgtccgcaagtcggccccggccaccggcggcgtgaagaagccccaccggttccgccccggcaccgtcgcgctccgtgagatccagacgtaccaaaagagcacggagctgttgatccgcaagctgccgttccagcggctggtgcgggagatcgcgcaagacttcaagatcgacctccgattgcagagcttcatcgtgtccgcactgcaggaggccggcgaggcgtacctcgtcgggctcttcgaggacaccaacctctgcgccatccacgccaagcgcgtgaacatcatgcccaaggacattcagctc

SEQ ID NO: 41518 - DNA, 408 bp, Triticum aestivum
  Clone ID: PAT_TA_41518
gcctctattatttctattaagaaggaagcatgcagggcgccactcagatctctccggccctggctcgcctcgtgcccggcaccgcgcctctcgtcaacgccgccccgcccgaggagaggaggaaggacgagcgatggcatcgccggccgcgcgcgcggcctcggcgctcctcctcctgctcgccctcgccgtcgccagcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctcggcgaggtcctcaatggggatcgggtgggggatgcgccctacaagcttga

SEQ ID NO: 41519 - DNA, 318 bp, Triticum aestivum
  Clone ID: PAT_TA_41519
cggacgcgtgggttcccacatccatcaagagctcgcactcccccaccccacgcgggggtctcctcccgagggcccgtactaatcatacggctaggaattccaccggcggctaggcgccgcggaagcagctggctaccaaagcggtgcgcatgtccgctccggccaccgtcggcgtgaagaagccccaccgcttttcgcctgtcacctttgcgcatcttgagatccgtaagtaccataagagctctgatctgctgatacgtatgctccccttccagcgcctgttgctggagatcgcgctggacttcaatgaccgacctt

SEQ ID NO: 41520 - DNA, 449 bp, Triticum aestivum
  Clone ID: PAT_TA_41520
cgcacacgccaagcgaccgaatcgccgccgcatccgcctagggcttcgccggcggggcagatccctacttgcggccgtctgctgcgggtcctccgtgttcgtggctgctgtgccggcgccgacagaaatttccctgccgtcagattttgtgagtgttcgagcttctgcaatgggtggaagcaactatgatgacgactgggtgttgcccagtgctgacatcactcttgttcttgttggaaaacttggctatggcaagagtgcaactggcaatagtatccttggacgggaagcatttgtatcagaatactctcatgccagtgtgacaaacacttgtcagatgggaagcaccatgctgacggatggccgcaccatcaatgttattgatacaccaggattatttgacatgaccgtaactcctgaggatgctggcaaagaaattgttaagtgca

SEQ ID NO: 41521 - DNA, 387 bp, Triticum aestivum
  Clone ID: PAT_TA_41521
cggacgcgtggggcgagagtggaggttgctcggactcgggggcaccgaagcttgtctttgtcattggaacacatgttgaagagggggcctacgcacggtctgagtttatgatcttgcagggaggaaaagagtgtccgtactatatgcgcattgggagctgcaaatttgccaccaactgcagatttcaccatccggatcctagtaatatcgccattctcatgctcccttccatgggaaggaggagaaggactaccagggacgatcgtggatcactccacccaaggatgccaaggcgaccaccgagcgctgttatattcccaagaggtgtgtacatgagtgggttggacacactaagggggtctcaacgatcagattttcccccaagta

SEQ ID NO: 41522 - DNA, 456 bp, Triticum aestivum
  Clone ID: PAT_TA_41522
cccacgcgtccgcctacggcggcccagcttcgccgtgtcgccttccctccagccggctgagcacgttccccggactgctccgcgccgcccgtgtgcggtgctcgtcgtccacctcgggcaggggcaggggcaggggcagcgtctcgcggttccagcgcagcaggatggccgcctcatgtactgagcatgcctacaacaatattttgaccagcctccctaagcctgagggtggtgaatacgggaaattgtacagccttcctgcacttaatgacccaaggattgataagctgccctactctatccgtattcttctggagtcagctatccgtaactgtgatggcttccaagctaccaagaatgatgtcgagaaaatcattgactgggagaacacatctccaaagctggctgagatacctttcaaaccatcacgagttctgctccaggactttactggag

SEQ ID NO: 41523 - DNA, 287 bp, Triticum aestivum
  Clone ID: PAT_TA_41523
gattgagtatccgtccatagggccatcgtagaaggttccttcagcaagtggtggcgcagttggtgttggaagagttggaagtgcatttggtgttggaaccttctacgatggccctattggggatccgtccatagatttcacaccagttgatgtaaccatgccacccactggaggtgggggtacggggctaaactttgcaaaacctgtttaaaatgaaatccagtgatgcaggattgggtacaccccgtgtggtacttgtttgatgttgtttggatgctcctgtggaa

SEQ ID NO: 41524 - DNA, 191 bp, Triticum aestivum
  Clone ID: PAT_TA_41524
catatgctctgtgtgaaatttctctagcgtgtacatctcacaccacgatctccgccagttcataaccgccggccacgccccagctccttccaatcacctcagcgtacagattgcagcttcaccatcgtctccttgcaagctctgacttggttcgattattcttgccgcctggtgagtccaggttcatgaga

SEQ ID NO: 41525 - DNA, 234 bp, Triticum aestivum
  Clone ID: PAT_TA_41525
gacgaacacccgccgcaaaaattccaaatcaccaaccaaatcccctcctctcccgcgttccgacgagcaccagccaccatacatggacgctttatccaccggagccggagcgaaggcaaaaaaaggcgcggtggggcgcaaggttggctgccccaagaagaagtctgttgacgcggtccgttaaggccgggctctattttcccgtttgccgcattgggcgcttccttaagaatg

SEQ ID NO: 41526 - DNA, 265 bp, Triticum aestivum
  Clone ID: PAT_TA_41526
tcgtcgttgtgctctgcaattgcagctcgagccccttgaggaaagaagcacaccaagcgatcgaagaacctcgtgtgcatccgaccagtgagcgacgccatggacgccggcaagacgcctcatccgttgcctttgagcggggcccaaaagcagatccgggatgatgtccaattggtttgcgcatgggcgctcgtaaacgccttcgccatcgccggcggccaagcatccttttacatggttggttacacccacctcaagggcatcc

SEQ ID NO: 41527 - DNA, 142 bp, Triticum aestivum
  Clone ID: PAT_TA_41527
gtgaaagctcgtgccattcatacccggagtacctcgacgagtccgtgatgtggacggagagcggcgacgtcggcaagggctttcgctgcattcgcatggtgaacaacattcgccttaacttcgacgcccttaacggtgacaa

SEQ ID NO: 41528 - DNA, 425 bp, Triticum aestivum
  Clone ID: PAT_TA_41528
cggacgcgtgggcttgcggagtgtgagaagtaagttactactggatccactttcttgtcactagccttgcttgacatgttcatttctcacgctacacttaccatcagaattatgtgattacatggagatatacatcagtgcttggcagttattaacattatggaagaaacttctaattatcttgattatcttgctgccactaactgtgttgtactgataacactgataggcttaactgatgtattcaggtatagctgtcaataacttttatctggacttctcagaaattgttccctagcaatcgaatgattatgtattgcatggtttgatttctcaaatcattctgtggtatggacggttcaaatttttcatttggacagcaaagctagcccatagtggtagtaaaaagtggagtactcttttta

SEQ ID NO: 41529 - DNA, 299 bp, Triticum aestivum
  Clone ID: PAT_TA_41529
cccacgcgtccgcggacgcgtgggtgaggacgaggatgcggggctggcgcagcagagcgtgatcgcgggcgggcgaatgcgcgcgtcggcggtgctgatgcagctcatctcctgcggctccatccccgcggcccccaagcgggacgccggcccgggcggcgcgaggtacacggcggagcgtaggctcccgcgcggccggtcggacctgagcagcagcacggcggcagacgggttctctggcagcattggcgtcggcgcaagcatggagcgggagtacttcagcggcagcctggtggaga

SEQ ID NO: 41530 - DNA, 304 bp, Triticum aestivum
  Clone ID: PAT_TA_41530
ggttttatgtccactcctgatggtgaaaactgtggacttgtgaaaaatctagctgttactgctattgttagctctagagtggcacagccattgattgacagatttgtttcttgtggaatgaataaactggatgaaattcctgctaagcagattcccaaaatggacaagatcttcctgaatggtgattgggtaggatcctgtgctgatccagcttcatttgtcatgcgtttaaggtgcatgagacgtggtggtctgatcgatccacaggttgaaatcaaaagggacaagcaccaatctcctggag

SEQ ID NO: 41531 - DNA, 126 bp, Triticum aestivum
  Clone ID: PAT_TA_41531
atcaagcgtaggtggtgtgcacgccgaacgtgtcgcaacctgtctgggacttcacgccggcgccgggccgatgcgtcgtgcttggccgagcagcactaggggacgcgtgctgctctcgtcagtcgg

SEQ ID NO: 41532 - DNA, 334 bp, Triticum aestivum
  Clone ID: PAT_TA_41532
caccaatcgccgatccgggccatggacgccaactggcggcccacccaagggccggaccccgccgccgccgtaggcgattggcgcgcccagctccagcccgaggcgcgcagcagggtcgtcaataagatattggagactctgaggaagatcctgccagtatcggtgccagacgaactgatcgaacttcaagaaatcgccaggcaattcgaagacaagatctacactgaagcaaccaatcagtctgattatgtgcggaagatttctcttgaaatggtctctatggagacgagcagacaactggcttcttgaaatgctcaagtgatttcaaataaaa

SEQ ID NO: 41533 - DNA, 246 bp, Triticum aestivum
  Clone ID: PAT_TA_41533
cggacgcgtgggtgccgttccggtagcctccctccgtccctgctcgccgccacgactcacaggccacaaaccctagccaagctcgccggagctaccgcgtgcgcgcacgcagcgatggaaggcggcggacgcaagaggggcacggccgacggcgccgccgtcggaggcaagcgcacgcgagaatcggagtcatttcaaaccggcgtaggaagcaaatcgaagccatgcaccaaatttttcagtacc

SEQ ID NO: 41534 - DNA, 370 bp, Triticum aestivum
  Clone ID: PAT_TA_41534
cccacgcgtccgccgccgtctcctgcgccgccgccatggacgccgccaccgcaagccgccttcgcgccttcgagagctggatgcgggagcacggcgtcgtctgcagcgacgcgctccgcctcgacgccagcgaggccggcggcgtctacgtgcgcgcgctcgccgcgctccgggagggcgacgtcgttgccaccatcccgcgccgcgcgtgcctgacgccgcgcacgttcggggccgcggcggccatcaaggacgcgcagctcggcggcaccctcgctctcgccggcgccgtcatgtacgagcgcgcgcggggcgccgactcgccgtggcacgactacctccgcctgatcccggactgcgagcccgtgcc

SEQ ID NO: 41535 - DNA, 375 bp, Triticum aestivum
  unsure (1)..(375): unsure at all n locations
  Clone ID: PAT_TA_41535
agcactcgtcgggtcacttgcacgcgaccctacttgcttaataaatacaacgtggcggtcgctgttcacagcaaaccccgaatactacctgactacttactcccctgcccgcgccgcctaccgagcccgacaaaccgtaggcgactcccatggactagcaggccgaccgccgcttcgagaacaagctcgtgcacaaccgactcaggcccgcgcccggcgccgactgtgcnggttactgtaccaaggtctgcatccattggcgcgctgggcgatgcaatcgctacccctgcccctgcctccacagcgagcttgctgaggcggccaccaccaagcgctcgaaccaacaggatggcccctgcgggcacgtttggcgca

SEQ ID NO: 41536 - DNA, 376 bp, Triticum aestivum
  Clone ID: PAT_TA_41536
cggacgcgtgggcggacgcatggttctcatccctgaccacctccctgaggtgggacggtgccctgaacgtggatgttactgagttccagaccaacctggtcccatacccgaggatccacttcatgctctcgtcctatgcgccggtcatctatgacgagaaggcgtaccacgagcagctgtcggtgtctgagatcaccaacagcgcgttcgagccgtcttccatgatggtcaagaacgagccgggccacgacaagtacatggtgtgctgcctcatgtaccgcggcgacgtggtgcccaaggacgtgaacgcggcggtggccaccatcaagaccaagcgcgccatccagttctgtggactggtgccccacggtgttca

SEQ ID NO: 41537 - DNA, 222 bp, Triticum aestivum
  Clone ID: PAT_TA_41537
cccacgcgtccgcggacgcgtgggccaaattccaatgtgcaacgagaaggaggtgtatcagcaatccattggagctgtctgcaacctggactggccgagatcgaatttcttggtgcaggtgctcgatgattctgacgatgctgcgacttcagctcttatcagagaggaggttgagaaatggcaacgggagggtgtccgggtattgtaccggcaccgggtgat

SEQ ID NO: 41538 - DNA, 320 bp, Triticum aestivum
  Clone ID: PAT_TA_41538
cggacgcgtgggcggacgcgtgggtaagaactgagcgaggactgggggggttgctaagagaagcgttgagatggggttcaaaccactggagtggtactgtcagccagtgaaggatggggcatggtctcatgccgtcgaaagcgcgtttggtgcatacacaccctgcggcattgacaccctggtggtgtgcatctcgtacctcacactttttggcgtttgcttctatcggacatggaggacgacgaaagactacaaggtgcagaggtacaagttacgctcgccgtactacaactatctgcttgggctgcttgttgtgcact

SEQ ID NO: 41539 - DNA, 193 bp, Triticum aestivum
  unsure (1)..(193): unsure at all n locations
  Clone ID: PAT_TA_41539
cggacgcgtgggcggacgcgtgggtctcatnctttgccaactttccttgaggtgggacgtggccctgaacgtggatgtgactgatttccaaaccaacctggtcccatacccgaggatccacttaatgttttgttctattggcccggtattttgggccaaaagggcttcaccacaagcagtttcggtgtctgag

SEQ ID NO: 41540 - DNA, 368 bp, Triticum aestivum
  Clone ID: PAT_TA_41540
cggggcgggccagacccacgcgtacgcctacgcgtccgcccacgcgttcgcggacgcgtgggcaacaacggcggtgcgctgagctgggcgctaagggcggccagggaggccgagtccgtggcggcggcgggatgctccggccacggccgtgtgttcctggatggcatcgtcggcgaggacgggcggccagggtgcgagtgcaacacctgcttagaagggccagactgcttcgtacggacgcccgactgcacctgttacgccgacagaggggacccgatggtccgggagcctctctggattcgccacgcggaggccagcgccgtggtggtattcgggtggcaccgcatgagctacagagccaccgacgg

SEQ ID NO: 41541 - DNA, 318 bp, Triticum aestivum
  Clone ID: PAT_TA_41541
ggggccaccccaaaagcctcaacaacacgccgaaccaaagaaaggcaggcgaggaatacatggcgggtcccggcggctgtgccgccagctgggttttgtacctttcgctcgccgccaaatgcggcggcgatcaccccggccgcctcgccggcctcctcgcggtctgcgccgccgccttcgcactcacctgccttctgcactggtgcttccccggcgggccggcctggggcaggtggtggctcacccgccgcctcaagggctccctcgtctcggggcccaggggcttgccgctgatcggcagcatgtggctcatgaccg

SEQ ID NO: 41542 - DNA, 383 bp, Triticum aestivum
  unsure (1)..(383): unsure at all n locations
  Clone ID: PAT_TA_41542
cggacgcgtgggcgcgaaccaaaccctaaccctacctcatcgctccaatggccggagacccgtcgccgtcgccgtcgccgcccggatcccccgccaagcaccgccgccgccgggagcgcgacgacgcggaccccgcccccgacgccttcccgaagcgccgtaggcaccaccaccgtcaccaccaccgttcccaccgncaccgccgtccggacgacgcccagcccccgccgccctctgcggccgacggagaagacgtcgaggagggggagatactagacgatgccggcgccggcgccggcggggctatggaagtcgatggcggcccccgcggngacgaccccgctctccgcgagccgacccggagctagtcgtgatcatgctgc

SEQ ID NO: 41543 - DNA, 436 bp, Triticum aestivum
  Clone ID: PAT_TA_41543
cccacgcgttcgcccacgcgtccgggtgaatttggctgcagcagcaaaattaggttggttaatgatttgctggagagcattcattttgttgcttctactgaagcaatgtttattggtgttcgagctgggattcatccatcaattatctacgacataatatcaaatgctgcaggaagctcaaggatttttgtggaggtggttccgaaaattttgagtgaagatccattgcttattgattttctgaagtcactaaagaaacatgctagctacgtgatggatacagctaaagcagcaacattccctctgccacttctagctgttgcctatcaacaattaatacatggttcttcagcagtaattggagatgaatccgcttcaccgttgaaggtttgggaacaactatttggagtaaacatcatagatgctgccagtcaac

SEQ ID NO: 41544 - DNA, 371 bp, Triticum aestivum
  Clone ID: PAT_TA_41544
cccacgcgtccggttagaagacaggattttcttctgttaacaaacaacgaaattggcaccgagttatcgcaacacactcaggtcattttcgattcagtgattcacacaataacaaacaaaatctaggccttggttcacggtcaatgaactatgtcatgatgagctatgtttctgatatacagaaatttagccacattttaggacagtaatactgagcagcttttcaaccatataacgccctgcgcgtttctggccattcattttcgtgacttgggcgcaaccttgaccgttagtctgttgtctactccggctttcaccgtacattctgattcctgagccaaatagtcctaaagggcttgcttttcagaaga

SEQ ID NO: 41545 - DNA, 407 bp, Triticum aestivum
  Clone ID: PAT_TA_41545
cccacgcgtccgcagaaatgactgacatttttgaaggaagcatcatacggctagttaggaggctggatgaatttctgaatcagctaaaagctgctgctgaagctgttggggaggtcaaccttgagagtttgccagctaaaagctgctgaagcttcttgtttccctttcatttgttaacttgcacagggcatgattgctctattgtctattgtctagaaaaactgatcgcctacctgggtggcatctgcatcgtgctttccagattatttgtgtggtcaaatgaaacggtgagtggtattaaaatgctcatgtagacagtgtttaagcattagaatggtgtagatagagttggccggcaactacagggtctgtgattttcgaatccagccgtaatatgtgttcattag

SEQ ID NO: 41546 - DNA, 445 bp, Triticum aestivum
  Clone ID: PAT_TA_41546
cccacgcgtccgcctctctcaacttgcacctcttcatgataacaagatggtttctggcaaacaattatcaggaacttcagctaggtatgaagcacaataaaggtggcaataagatgtgcgggcaattatctgtgttttcgtgaccatgctgatgtggagctgccattgaggcacattttgcctccgagatatcaaaccctccaacctccattttctttaggattgtcccgagcccatctcaccttggtcttctctcccccatggatttgattgtgtgcatggatgaggaaagagtcattacacgaggtgttggtggagacggaggttgagtggacgaccgacatacacagcttcatctataactgcctctatggcttcctcgacctcaatgttagcctccctgcttactactgcaaaagggtttgcagctttgtgtggtgatggc

SEQ ID NO: 41547 - DNA, 381 bp, Triticum aestivum
  Clone ID: PAT_TA_41547
cccacgcgtccgcccacgcgtccgcccacgcgtccggctttgtttacacctggggttttggtggatatggaaggttgggccacaatgaacagaaggatgagtggcaaccacgccttgttgaaatatttcaaaagagcaatatcctgggtcccaatgatatcatctcagccggttctgcaagttctgcctgcactgctggtggtcgcgggcagctgtatatgtggggaaaggtgaagaattcaggcgatgagtggatgtatccaaagccagttatggatttaagtggttggaacatccgctgcatggcttttggtaacatgcaccacactggtggcgcagatgattcttgcataagttggggcccttctgaatatggagagc

SEQ ID NO: 41548 - DNA, 439 bp, Triticum aestivum
  unsure (1)..(439): unsure at all n locations
  Clone ID: PAT_TA_41548
ggggtatagtaagttccattttcaatgttccagggaccacttccagtaagtttgcactcgacatcagcagtaatgtccactacctgtatcagcatggttatcgcagtagataatcagggcaaatatcataagcaaattacaactttagaatctctgaattctaatagatttctaatatccttcaaaagatgatgtgtgagcgctctttagatattccagtaagttcctttctacaggtgttcttacatctcctgaatggatgattctctttgcatttcggccgctcggcccacttccaatgatccactacatcatcactgtttggtaactggttagatactcttcaatctccttatagaaaggtccacanatgcacaatcaatagatacatatagaactatgtaagtctgaacatacatgtgggtcaaaacatggtgcg

SEQ ID NO: 41549 - DNA, 451 bp, Triticum aestivum
  Clone ID: PAT_TA_41549
cggacgcgtgggcaacgatgggccccaagaatgtctgttattggttttatctccacgaacaggggaatcagatgctccatcgttgctgatactatcagcagcacgtggtgagtcggcatttgttcccgatggttcattagtatgaacatcctttgccttcttttgatcatggtgatgataatgactccctatggaacttcggagataaggatggtgagaatggtgattcagatctattctttgggccaggaggtcttccccccataaggacagggggttctacatctgctagtgcttttggcaaggagcagaaaccgatgtttgattctgtcccaggcactccaatggagaagccattctttgattctgtcccaggcactccactacagaaatccgtctttgattattccgtcccaagtacgccgatgcagaattcatccttcgactactc

SEQ ID NO: 41550 - DNA, 414 bp, Triticum aestivum
  Clone ID: PAT_TA_41550
gcgttctacaagagatccctcgcctcctcccaccccactccagcacaagattccagcctcctcctcctcctcccaccagtgagagtgagacttagaccagccggtggcctcgcccgtgctccatggtgatcctgcgctctcacaggtaggcggccggtgcggcgaccggaagggagcaccaccggctcgatctgcttgctttgacgtgttgactttcggccgtcttcttggctgtttcaccggtctgattttccgagcacagggacacggagccggcggagatggcgcatggcagcccggacctggctggtttccagttctacaagctcatggctgccggaatgtcctgggagaagcttgtgctgcctgacaagttcgtgagcgagctcagcggccctgagctccggggcgtga

SEQ ID NO: 41551 - DNA, 285 bp, Triticum aestivum
  Clone ID: PAT_TA_41551
atcgtattaataccaaggctgatggatgatcagaaaacgttggaaaccatgatttgtttctccctgaccattgcttcgtagtagcacaaataggattcttatagcaaccatggatgatgagtctcatgactagtcgcgagactagtctagtagtctcaatttgattgtcaactagcttcttcgtgtagactagcttgttgaattgagcggtggagtgactagtcttcgactagtctacgtttttgagtcgatcgactcaatttgggtggatcaagtttttagggg

SEQ ID NO: 41552 - DNA, 359 bp, Triticum aestivum
  Clone ID: PAT_TA_41552
caatactcctacagaagtggtctgactatatttgctaagggtagttccagctgacagggtggttgttgactttggtgaacagatgctgagtgtccaattgaacttcccggtgaggaactataccattttagcctttttgttttcaaagatcgccctataagtgcagtatactgtgttttctcaaaggttgattgcgccttgaaaagctgttccagtaacttggacatgatttttttatacagttgttcgaaccgctcctcataagattaatgtacaagttgattcagcttataggccatcttatccataattaaaaatccaaaaaggtcttgtgatatgccttgaaagctaaattttaa

SEQ ID NO: 41553 - DNA, 386 bp, Triticum aestivum
  Clone ID: PAT_TA_41553
cggacgcgtgggcaagcattaacgaagaagttcctactgcaataattgcatctctggtgaaggatgttgttgatggcatcgagttcgcaaggggaggggtcaacactacatggggttcagttcgtgcggcaatgggacatcaacaaccttttaagcttgattatgtttcaatagggaatcaagaatgctggatgctctactacagagggaattaccaaaagttctattctgcgattaaagctgcataccctgacatcaacattatatcaagctgtgataagtcaactatttcggcatccaaccctgccgatctgtatgatgttcatgtctatgcatcttctgctaatatgttttccagaaccagtatgtttgacaacacaccacgc

SEQ ID NO: 41554 - DNA, 326 bp, Triticum aestivum
  Clone ID: PAT_TA_41554
ctatgatttctggggtggttttggctctgttcattacagcctcttgtccaagggtacgactcgagcccagtagctccagattaagaatggtggagaccatagcacatacgggtttcagctgttctacgatgtcccttatttttgtagacatttctacccgatcaaactttaactttggtatttgcggggcatgattcctctgcggtgccttgggggccagccaagcgccacaaagaaatcgctgcccatgttcacacgtgttggtggattccaacattgccctttttggatatggacctgaggatacttatttttgcacttgggct

SEQ ID NO: 41555 - DNA, 395 bp, Triticum aestivum
  Clone ID: PAT_TA_41555
caaggctacaactaccccatgcacgacagctcgagttgaattcacggcatgcactacatccgggagtacaacgggctaaaccttgagaggcagatcacttagcatctattggcctagctgcgcaagtccattgcttacaaggtgatctcgatgaggggaaacaagggtgaactatgaagtttcatgatccaggatgtgatcttctgaagatgatggatgtgctgcagtctggcgtttggcattttggcttggtctatgaagactacagatttctgtggaagatcaaaatacctcctaaaatcagaatgttcctttggttggtgctgagggaaaagcatttaattagaagactctgctggataggggtggaaaaatgtgaatcgggttggcttttc

SEQ ID NO: 41556 - DNA, 437 bp, Triticum aestivum
  Clone ID: PAT_TA_41556
acaaagcactcaaaactatttcatttccagtgagctgctttacaaacattgttcagttgaaaggagctctactgatgagccgctggtacatatttgagcaaactctacatgacacaaaaataagtcacatgtcgaggaactaggcaaagaataaaaaaatctgctaaatccactaccaattacccctcgaaacacaaattatggctcgacaaaaggagaaagatcaccttccactccttcattgatcaatatatcatacatcaagctcaaatttgcccttccatgtgctcagcagctatggcctccatttggtcagtagctatggcaatacgctcactttccaggaatgaaagatctaagaacttggcaacaaatgcccacatcttgtacacatcttcaaagttagtgaggaagccaagcgaaacaagcacaacttc

SEQ ID NO: 41557 - DNA, 251 bp, Triticum aestivum
  Clone ID: PAT_TA_41557
ccacgcgttcgctgaaactcgatgacatccaatggctagcatatctccgtcagtggtgcgaataatacactgaagctggctccaatgatattgcccagggatgtaacatgtgtatcatcggccccagttgtgaagagtgcacaattccattcatctatgatcgagtgtgaagtgacgaatactctggccaactaaagactaaatttatggatgaactgaagcccatctatttgcctcaatgccttgatgca

SEQ ID NO: 41558 - DNA, 410 bp, Triticum aestivum
  Clone ID: PAT_TA_41558
cccacgcgtccgctgaaactcgctgccatccaatggctagcatatccttgtagtgtagttaataatacacttaaacttgcttaaatgatatttcctagggatttaacatgtgtcttcttggccccagttatgaaaggagtgcttttcatttatttattttagtgtgtcaaggaatgaatacgctggccgactaaatactaaattcagttattaactgttgacctcatattttttcaattcattcatgcatgcatactttgttatgttgctatattgctctacaaattgtgaacactaaactaattattctctggttccttttttacccgtgaataatataagaagacatgtttgtccctgtgttctgtagcaatcccactctcagatgaccataaacctaacttaaagga

SEQ ID NO: 41559 - DNA, 204 bp, Triticum aestivum
  Clone ID: PAT_TA_41559
ctcacgcgtgctcgtacgcgaggtcccatcttttcattgtcggcaagctgttgtcggagtggttagactacaatgtggagcaaggcttccacatgctagtttaatacatataccacatagtataactaggcgctcatgactggaaacgcataacacgttcaaccccttttttgcgatacaaagctctaatatatgaacattcct

SEQ ID NO: 41560 - DNA, 314 bp, Triticum aestivum
  Clone ID: PAT_TA_41560
cgcaccgcggtgcaggtcgcggcgccagcgtacgtccgtccaaatacgtaggtccaatcaatccacacgctccgggtccgggagaggcaatccaaacagtggcgctactagctgttggcacccgctagctgctttcccaggccaaacgtgaccgcctggtggagacgagaggagcggataagaagccgccatgaagcatcctctgcctttcccacctccttgattaatccatcctgctcaacgaaccccacgcagctcctttccttcctctcctttccttttccctttcttcttcacccatccagatcatactt

SEQ ID NO: 41561 - DNA, 406 bp, Triticum aestivum
  Clone ID: PAT_TA_41561
agtttgaggacctttgatgcacttcactcttaatcaaatgtataacagcttccactccatatgcatggtgggaacgggaaggttgcctacattggcactgagggaacgttccggcctgaacgcattgtgccaattgctgagagatttgggatggatgccaatgctgttcttgacaatatcatatacgctcgtgcatacacctatgagcaccagtacaacttactcctgggccttgttgccaagatggctgaagagcctttcaggcttctgatcgtggattctgtgattgcgctattccgtgttgatttcagtggcaggggtgaacttgcagagcgtcagcaaaaactggcacaaatgctttcccgccttacaaagattgctgaggagttcaatgttgcagtgtaca

SEQ ID NO: 41562 - DNA, 413 bp, Triticum aestivum
  Clone ID: PAT_TA_41562
cccacgcgtccgccgacgcgaggccgaagctggacaaggacggcaagctgtcgccgtactactacgacgacacctctgatcaaggcagcagtgtctaggtaaggtaataaaccacagagcataacacgttggtcatgactcgacgagcataacacgttggcccccttccatgactcgccgagctctcggtaagaaagaacctaagtagaattacagtgctgattttgaccgctgaaccgcttgttgtcgacgcctccagcgccactgtgacctggagttgatgtgtgctccggtcggtcggcaatggaggacaagtgggagttagggcatagctagctagcggcggtgttcttggttggtctagctgtctgtgggccgtgccattgattccggtagggtagatggtctgtatg

SEQ ID NO: 41563 - DNA, 421 bp, Triticum aestivum
  Clone ID: PAT_TA_41563
cccacgcgtccgcggacgcgtgggcggggctgctgttggagctacttttggagggtcagctgcatacttaataaatgcagctatacctggtagtgctgctgttgcacagccacaagcttatgctcttgttgggatggctgcgacattggcttcagtctgctcagtcccgttgacttccgtattgcttctctttgagctgacaaaggattacaggattttgctacctctgatgggagcggttggactggcaatatgggttccttctgtggtaaaccaaccaaatgatggtgaatcttcagggtttagagcacccacgcgtggttattctttagtttcactacaagataaaaatagtagtgtctggacgcgaagtgattccgtagatgatcttgagcttactatctcacaaagtggccttcgt

SEQ ID NO: 41564 - DNA, 126 bp, Triticum aestivum
  unsure (1)..(126): unsure at all n locations
  Clone ID: PAT_TA_41564
cccactcgtncgctgacgctttttcttttctgctatagcatcaaaattttgatcgacagatgcttatttaaaataggcggctatactctctaacaactgctattgcacaatctctatcttatcctc

SEQ ID NO: 41565 - DNA, 321 bp, Triticum aestivum
  Clone ID: PAT_TA_41565
cccacgcgtccgcggacgcgtgggtgtaaaggaggatcagcccgaagacgaggaagggcttcctacatatccgtatgatcgcttgaggacatcttcaagcaatcctgtcacagacattgatagtaccaggcgtgagacgtatctatcttcggcagagttcagggagaagtttggcatgacaaaggaggcttttgcaaagctaccaaagtggaagcagaataggctcaagatcgcactccagctcttttaaagtcttctgctgtcaaatatgcagcaattaatgtctgcttggtgaaagtaaggacggcgagattgtttttc

SEQ ID NO: 41566 - DNA, 382 bp, Triticum aestivum
  Clone ID: PAT_TA_41566
cggacgcgtgggcggacgcgtgggcgccggggacgccgccaacatgacgctcggcgacatcctccagcacgacgcggtgctgcgccagtccgcgcacatccgcgcatccatggatgccacggggcaccgcatcgacaccctcgagcgcgagctcgccagtctccgctgccgcctgcgccgctccgagcaggccgcggctgctgtcacggcctcggccgcgatcgaccgcgtgtccgccaagtcggccagcttccgcatcccgcgcagccggctctggaacggcgaggacctctcgttcagcaccggcaccaccggccggtccgtcggcagggacaaccttagcctcaagtcacgtctggggcacgggttcaagagcctgttc

SEQ ID NO: 41567 - DNA, 117 bp, Triticum aestivum
  Clone ID: PAT_TA_41567
cccacgcgtgcgaaaacgcttagcgtatgcgcattctgacaaagatcctagcgtacgggctcgattgcgcagcctaattactctgcttatcaatccaccggctgtttttcgcggggc

SEQ ID NO: 41568 - DNA, 252 bp, Triticum aestivum
  Clone ID: PAT_TA_41568
atccccaggtcataaacccaagtcggactcgccttcctcctggccaactactgctgtggtctcctccgcgcatcgcacctggggtcactctgagatcacacacacaatggtgaatgctgtggctgcgctcaccggcagtgagggtgtcaagggcaccatcttcttcacccaggagggagagggccctgtcaccgtgtcgggaagtgtcaccggactcaaggaagggctccacggcttcatgttcacgctgtt

SEQ ID NO: 41569 - DNA, 258 bp, Triticum aestivum
  Clone ID: PAT_TA_41569
cggacgcgtggggtacaggggaatttgatccttcaactgcgagcatcaaaattacttaagtctgaggaggtgaagctccaacaacttgcaaaggatgtaccaaagggccacataccacgttctttaaccgctcatttgacaggagagctgacaagaatagcagcacctggagacgttgttgagatccctggtgttttcctgccacatgccttaatttgggttccccgccatgctagcaagattggttgctgataccta

SEQ ID NO: 41570 - DNA, 232 bp, Triticum aestivum
  Clone ID: PAT_TA_41570
cctacgtttctgccttggcgtccgcacatgcatccgcctatcctcgtggcttacacacgaaagctcgaggagatgatgggggcggacaacacaccatcctccggcgagatcgtgggcgcgcagcagccgcccttcccgccgcccatggtgggcagagaccatcatgccgccctgcttgatacagatgcatcagcgcctcccatctccatcacatatccagattccacgtcga

SEQ ID NO: 41571 - DNA, 155 bp, Triticum aestivum
  unsure (1)..(155): unsure at all n locations
  Clone ID: PAT_TA_41571
cccacgcgttcgggacgcgtgggcggacgcgtgggactgaatgtaanaaaggagaaggtgattctagtagagatgtgatcctaaacatttaagatagaaacaagacattacggggacaaggaaaagttatgataggggagttccctggatcttca

SEQ ID NO: 41572 - DNA, 335 bp, Triticum aestivum
  Clone ID: PAT_TA_41572
cggacgcgtgggattggacccaaagtttagactggactactgtaagctgtggaaagcattgatatcgctggatgtgcaaaaaattctggagttaggtgaacagtttggtgtcgggaaatatgcgaagtactttcctttaatattcactggaaggactatagacagcaaatcagctcttggaacacaaatatctggtgaagagaagacacgtataaagcaggacttgaactctcttggaatggatgatatatcttcatttatggaatccttgccgcctgattttctggtcatacttcgaacagaaatgctatttgtgatctcaattcagtggacta

SEQ ID NO: 41573 - DNA, 230 bp, Triticum aestivum
  Clone ID: PAT_TA_41573
ctgggactgggaagaagacacggccttctgcttaagcttgcatgactatgcctcccatcatgatggtgcgctgtttgctagcgtcggtattaaagtgtcgacccctgctacggctgggtcaaccattccggcggagcagagagttcacgatcccttttgctgatcattgcataaaggtggtctcgtgatcagtctggtttccgtgtgccagggccagggataggtcctgg

SEQ ID NO: 41574 - DNA, 403 bp, Triticum aestivum
  Clone ID: PAT_TA_41574
ctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaagtacaggtgtatgcggatccagcaacttggaaactaatgggtaaggagttaatgccaatattaccacttggaactgatatcatttcattattcacttagaccatatttagaaaaggatgcgttttgaatacgaccttatctggagaattctttaggcaaaaagcacgcccttctaatatccaatcatcgaaatgacattgattggctggttggatggattttaaca

SEQ ID NO: 41575 - DNA, 255 bp, Triticum aestivum
  Clone ID: PAT_TA_41575
acaagaatgggtggcaatgacgctctcctagatgccctcctcgtgcacaggagcgcacggacacgtggccaaggccgtgcgcaggtactgaggaacatcagcgcgcacaccgacgtgggcttcacggttcggactaccgtgttcctcccgagaagtcgacatgctcatccacgacgacaaggactccatcatcttcaacgtcggcacctacatgatgcccctccaggacatcgttcacccagtctgccaatattc

SEQ ID NO: 41576 - DNA, 158 bp, Triticum aestivum
  Clone ID: PAT_TA_41576
cggacgcgtgggcagacgcatatgaaacacaagtcggtccagccggataggcgtagactgatgaactaaagatcatactctatatcggtgaggctgatggtcaaactgcaggagttctttgactgaccaagtcacgggaggacttgatgcgcatagct

SEQ ID NO: 41577 - DNA, 386 bp, Triticum aestivum
  Clone ID: PAT_TA_41577
cccaaccaacggagcccaactccagcgccgatttcctctgccccagccactcggcctcgccggcgcggcggcctcctctcccccatccatgccgctgacctccctctccttctctcccatggcgccgaaaccctagccacggcgacctagcagcagcaggcaggacgagcccggctatggccatggcctcctcttcccctctgccctgccacggccgccgctccagcccctcctctcctctcctctcctctcctctcctcttcacttctctcccaagggaggggaggggaggggagggaagggaagccaaggccccagatcaagcggagcggcgcccaaatccgcccacagcggcaccggcgatctgatccgcgaccctcctcgag

SEQ ID NO: 41578 - DNA, 328 bp, Triticum aestivum
  Clone ID: PAT_TA_41578
cccaaccatcggagcccaacttcagcgccgatttcctctgccccatccactggggctcgccggcgcggcggcctcctctcccccatccatgccgttgacctccctcttcttctctcccatggcgccgtatccctatccacggcgacctatcttcatcatgcaggacgagccctgctatggccatggcctcctttttccctctgccctgccacggccgccgctccagcccctcctcttctttactattctctcctcttcttttcacttttctcccaagggagtggaggagaaggtgtgggaagggtagccaatgtcccatatcaagctg

SEQ ID NO: 41579 - DNA, 330 bp, Triticum aestivum
  Clone ID: PAT_TA_41579
cccacgcgtgcgctgtctcttggctcatgattgacaggggatgtagctaggagagagaggctgcgccgaagttaatgtagaacggccacactcgtatctcctaaataattaccaccaagcgctttgttgcggcgacattaagaacctacccttctatgagacgattaaatgcacgtggcacgtgacagacatctactcgcgcgccaatcaaagcggcggagatacaagacccaacacacggcgttgtttcaaatgatgccatcagcacgaatgaagggcgctttctatgacaatgctgatgctcaccgtcattgctttggcagattcaga

SEQ ID NO: 41580 - DNA, 153 bp, Triticum aestivum
  Clone ID: PAT_TA_41580
gcgcccacacgtaagcctacgcgtggcggtcgcagtcgtagacagcaatacgaggaggcgcggggtcacacacggaaggtttcaggtcttcttgcagacccttacgggcatatacattacccttgagggggggtgcttcaacacctatcgact

SEQ ID NO: 41581 - DNA, 134 bp, Triticum aestivum
  Clone ID: PAT_TA_41581
cccacgcgttcggtgcgtacgctcgccatgtatcctcctattcatcagtgctccaatggtcataccatttggtctggatgcaagccaagggctcataatcgctgtcccacttgcaggagtggattgggtttcat

SEQ ID NO: 41582 - DNA, 285 bp, Triticum aestivum
  Clone ID: PAT_TA_41582
acatgtaggggtggtgctataccgtttacaaacatcccgggtttcgtggcgggataagtgatgctcctaagaaagtaccctttgcccacatggatcctgagagcggatccatttatgcccacgggatattcacatcttaagaagacttgataatccaaatgttattaacctcgcaggtttggtgacattacgcatgtcttgtagctcgtttcttctgttccaatacatggagcatgatcttgccggacttgttggtacacctggggttaaaatttacatttaggg

SEQ ID NO: 41583 - DNA, 389 bp, Triticum aestivum
  unsure (1)..(389): unsure at all n locations
  Clone ID: PAT_TA_41583
cggacgcgtgggggaaaagcaaacttccaagcggctaggtctcccaaatccgtggccgcctgagctcggcagccatggcttcccacccgccgccgccgtcgtcgccggcgccgccggagtaccctatcccacccgctcccaccaccataagtgccctcgacgacgaccagctccgagagatcttcctccgcctcccggacctccccagtctcgcctccgccgacttcacctgccgcgcattcctcggcgccgtccgttcgtgccgcgcctttcgccgcagctttcgtgcgctccacgcgcccccgctccttgctctcttcctcacaccctacatgcgcacggtacctacctttcccgncttacgcccccncactgccgccagattcagt

SEQ ID NO: 41584 - DNA, 340 bp, Triticum aestivum
  Clone ID: PAT_TA_41584
ctgttttttaaaatactgctcacccagatagggtttagctggctgcgccgccgcctgccgacagcgatttccccccatggcgctgcctaaccagaacaccgtcgattaccccaacttcaagctcgtcatcgtcggcgatggcgggactggcaaaaccactttggtgaagaggcatcgttactggagagtttgagaagaaatatgagcccactattggtgtcgaaggtcacccatcggattgcaccactaactggggaaagatcctgttctactgccgggacactgctgggcaagagaagtttggtggccttagggatggttctatctccatggacagggt

SEQ ID NO: 41585 - DNA, 360 bp, Triticum aestivum
  Clone ID: PAT_TA_41585
ttcaattttagttcccgcaaaaaatatcaattttaatcggaatcttgtgtcataggtggcacatgtcatcttctgggtggagcgaacaccgaacacttctccgtggtgccttgggacgtgtctcctgccacgtctaaatatcgtcacagacgaggtgtgctccaaatcgatctgggccaagtccatggctcgtcgtgctgcggaggcactgctcgtcctcggcttcctcttcttacccctcacggcgtcgagctttctcgtcccagagagccggcgccggtccgacgaggtgctcggcattaccctcggcgcgacccactcgtgcattgccgccgtacaccgggacggctccatcgagat

SEQ ID NO: 41586 - DNA, 401 bp, Triticum aestivum
  Clone ID: PAT_TA_41586
cgcaattccgggattgccgggtgcgcccacgcgtccgcttctcagtcagaagaaagactgtgaagccaatgacacctgatgcttgagcgtcccttgattgcaacccttccactggaggcacgcggaaagattggtgatttcatcaaaggagtgtttgctgtcttccaagacttagatttctcatttattgagatgaacccattcaccatggtgaatggggagccatatccgctggacatgagaggagaattggatgacactgcatctttcaagaacttcaagaagtggggaaatttagaattccctctaccattcggcagagttctcagttctacagaaagttttatccatgagctggacgataagaccagcgcgtctttgaagttcacagttttgaaccc

SEQ ID NO: 41587 - DNA, 305 bp, Triticum aestivum
  Clone ID: PAT_TA_41587
cccacgcgttcgtataacccccgcagccgacgtcgctcctcgggctctcttagttcctggggcaaattttgcgggaaacacgacgccacccgaagaaacccttctcccgcacctcgtctgccaccctgacaaaacccttggccctcctcctccgacttctactacaatggccgcacaaacgcctaggcccgccgccggccccgactcggggccaggaccgaccccaacatctcaagtggtgaacaacgccttcgtgcattagtcctacaacatcctacactagacaccggttctaaaaatcccgc

SEQ ID NO: 41588 - DNA, 229 bp, Triticum aestivum
  Clone ID: PAT_TA_41588
cgcacgtgtgccggcgcctctgccattctccgagccaagttcttactctgaccattcatgtgtccacgccggtcgaggggagcatctacgggagcatatctccggcaatagctgccgcaggataaagcgggctatagtaggggagtcctaaggggagtgacagggggtgagaccgggcaatataaaccgctcaatatactgctccataacccctgctgatactgccgct

SEQ ID NO: 41589 - DNA, 315 bp, Triticum aestivum
  Clone ID: PAT_TA_41589
acgcactcgtttggccaactttatttttcgcgtgctctcacacttgctgccacgcgttcaggggctggtttgttcaacacccacagcccggatccagatcttctttctttttcgtcgggtcaccagggaaggacccggcctaccgccgggcgagccgattcttgtgagcgggtccctaatccggatagaacgctgcctggggcgattttgaattgtgggcccgctgccggcgcggcgcatggcggggcgaggtaagcggttgggttggcggccgttggcggcgacgcaggagggtcgaccaggccgtggcgtacc

SEQ ID NO: 41590 - DNA, 381 bp, Triticum aestivum
  Clone ID: PAT_TA_41590
ccaaaacaaggcatgcttattcatgttccttcttttgaaacaattgacgacacattagccaacatgtcacttaaatttatgcgaataatagttcagtattcatcatccttccatcatcataaaataagaatacagttcataaggtcaaaacaaaattagaagaactcttaacaaaagtaaccaacacttccaacaatgttaaatcaaggagttgaggtgttggaaatcagcttgtcctcactatatgattcttttttcctcttctcctcatccatctccattgaggagtaactaacacttccaacagcttcaatgttaaatcagcaacttgtgtcaaaccgtgagcactccgggtacagaatctttgcttgatgatcctcc

SEQ ID NO: 41591 - DNA, 288 bp, Triticum aestivum
  Clone ID: PAT_TA_41591
gtgatacgggagcatactaccttcaccgagcacgcccggcggaggaccggaaccggcatggacgaactatactcactcaaactcgcaaagacgctccctgtacagatgacggaggcttggccgtgccttatcagtcgaatccatctaggccaacaagattggattgagctaagccatggaatgatcatgggcgatgggctgaggcggaatggaatggccggatgatgatactggatgctgattttacacactacctgcatggaagtagacaataggagaacttggacc

SEQ ID NO: 41592 - DNA, 157 bp, Triticum aestivum
  Clone ID: PAT_TA_41592
ccaggccctagtcaaaataagaatgggagcgccctccttcttctcttacaggtggcttgggagctccctcgccccctgttggataattcaagtggttctcctcatcagcctgtgctacagatgttttctgcttcatccctgttgtgtatccactgtg

SEQ ID NO: 41593 - DNA, 371 bp, Triticum aestivum
  Clone ID: PAT_TA_41593
ccgaaacccaaaccccagactgagcgacagagagcagccagcagcctgctccgccgtcaccaatgtgtggatgagggttcccccgggggccactcccagaagcgccacaaccgtgctcgcgcacccggccaagtagtttgagtccggcgccaccgatctcagggccacggcgttggacggcctgggcgccatcgccggactggtggccgggcggctcttctaaacgggcgaggacagggtggaggcagtgcaacgctgtacgttaggttgcatgtagcccatcagctcatcgagtcacgcgcttctcgtttgttgaggaggccatctttcttttgacggaagggactggcttttgctgtgggttgcacacg

SEQ ID NO: 41594 - DNA, 195 bp, Triticum aestivum
  Clone ID: PAT_TA_41594
cccacgcgtccgcggactcgtgggtgacgacatggcctcgccggcgagcggcgattccaatcatgtactgtgtggaagcaaattgctctacacggacattggttttgaataggccaaagcatgttaaatgctctctcctctgcattggttacgggacttcttaaatgcttcactccttatgaggaagtaaacaca

SEQ ID NO: 41595 - DNA, 383 bp, Triticum aestivum
  Clone ID: PAT_TA_41595
cccacgcgtccgcggacgcgtgggctctctagacactaaacaaaagaggggggaagaaaagctcgcaccacccaacaccatatagttactcccccctcccccctccccaggagcttgctagctggagcagcaacagcagcagccagccaccgccgcaaatccaagaaatccgccgcatccgccgccgccgacgagcagcagcagcagcagatagagcagctagagcagaggaggcgctccgccatgggtgcgccggcgtacggcgccgtgctcctcttcgcgctcgcgctggccgtggccgcgggagctgctgagacggcgcggccggaggaacccacattgcccgccgtggccgccgctagatgtggtggcgagggggtggt

SEQ ID NO: 41596 - DNA, 351 bp, Triticum aestivum
  Clone ID: PAT_TA_41596
cccacgcgtccgctaaggttcaacctgcgaaaaagaaataggaatatgaataatctaaccgaacctcgctataataacctatcatatcatattccaaagatgccatatgacagtgccagccactgaggatgctcaaccacctgcttaagaaccctgttgaatccattgtattgcagttctatcctaatatacaagaccgctaattgcagaaatgaaactacagcttcagttaccagatcagacacaacttataacatgacctgcactcactgttacgctatagttgcagtctataccaaaggaataaacacgaatgaagattagaagcttcacctaacgaaatcaaaaccg

SEQ ID NO: 41597 - DNA, 212 bp, Triticum aestivum
  Clone ID: PAT_TA_41597
cggacgcgtgggcgtgatcacacactatggatgcatcgaccagatcacctgttcgccaggcgtctacctttcttattcaagtaaggctgcaattggtgactgtcttgacacggccatggttctcttggcctacacagaaaacatgagtgatccgacgttccaaagctagaacaatattatcctcatgagcagaactgacgatgctgtataca

SEQ ID NO: 41598 - DNA, 263 bp, Triticum aestivum
  Clone ID: PAT_TA_41598
ccaaaaaacaggcgcgccggcgccgcagacctcggcgtggtagtgaacccgcggacctacactccaagacgcgcgacaacacgatgtggcggctgcccgggctgctctcccaagccgccgcggccgggagggcggcagcgaggaccaccagctgccacgtaacgggttccaaggggttcttcagctgttgtaaaaggtccacgatagcgcggaggcagctgaaaacgctacggatcgaggagctgaaaagggagaaggaagct

SEQ ID NO: 41599 - DNA, 384 bp, Triticum aestivum
  Clone ID: PAT_TA_41599
cccacgcgtccgaccgaatcagaaatctcaagctcagcacagcaacaatggccgcgcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcctcgccactggacgcaagatcattggcgccaccaaccccctggcctgtgagccccgcaccatccgtggtgacttttccgtcgacatcagcagga

SEQ ID NO: 41600 - DNA, 231 bp, Triticum aestivum
  Clone ID: PAT_TA_41600
acgactcctggtcttgatcacgcactgtggatgtagaggatcagatacttagttcgccaggcatgctactattcttatactgtttaggctgcagttaatgccattcttcagacggtcatggacctcttcgcctacgcagaatacatgtctgaccgcaacttccaaagctagaacaatattatcctcatgagcagtaccgacgcttctataaacaggactcctagggccaag

SEQ ID NO: 41601 - DNA, 134 bp, Triticum aestivum
  Clone ID: PAT_TA_41601
cggacgcgtgggtgtgatcacagactatgaaggcatcgactcagatcacctgttcgccaggcgtcaaccattcttactcagttaaggctgcaattggtgcctctcttgagatggtcatggttcctttcgcctac

SEQ ID NO: 41602 - DNA, 227 bp, Triticum aestivum
  Clone ID: PAT_TA_41602
cgtgtatggctgcaagttgtgcattgtaccttccactacatgaggagagtgttgtttcttcaactcactctccacggactgttcgatcactgattcacaatctcgcctgatccaccagcaaacgttcatgcctattgctggaaaggagcccctcaagcacatataccatttgaccgaataacaactgaacggaggcggcttaataaggattaaacaggggaagagca

SEQ ID NO: 41603 - DNA, 104 bp, Triticum aestivum
  Clone ID: PAT_TA_41603
cttctgcgtcccattaatgtaaagctgagaacaccggttcgggtcgttagggtctatatgaggcgcactagaagaacgcctcattgggtgctcttaccgctgct

SEQ ID NO: 41604 - DNA, 314 bp, Triticum aestivum
  Clone ID: PAT_TA_41604
gttcctctggttttttgacgactaatatcattatgaaaaaacaattaagtatggggctatgtatatacggctgctaaactcgttgtattaattgcacgcttggctggtgaagttaaccgactattttcttcattagcaattgtgattttaggccctacttgttaaaacaaatatgcactatctaagctacaaaaatgtttaccccaattgctgtgcacttcttttattgcggggatatattagtctaatgtttgctaatgtttgtgtgttgccagacttgataccatatatgctctgttttttctgggttgcta

SEQ ID NO: 41605 - DNA, 169 bp, Triticum aestivum
  Clone ID: PAT_TA_41605
cggacgcgtgggcttccccttcccggagcagcagccagagaggaagcgagagagagagagagagagggcgatggatgggaaggaggaggacgtgcggctgggcgccaacaggtactcggagcggctgcccatcgggacggcggtgcttggcggctgcgactacaaggac

SEQ ID NO: 41606 - DNA, 381 bp, Triticum aestivum
  Clone ID: PAT_TA_41606
cttttgttgacacgaggttcactttgcaccagacaccgtgtgcaaggttgtcctcaggtgagttggatgctctagaaagctcaggtttgacgtcaatgcatgctactgataattctcattcacgctttcttcatggattccctaatggatctcaaacagcgaattcagatcgtggatctcatgtagagaaaatgaactcagggcgtgtctctacagattatggaacagctggctgtgtgcatggtaatgataaagttgctcctggaccccatatactgttgcctattgacccttttgaagcttttgcgccacaaagatcagtagcaaatggagcatcccctgtgtatcaaaatgaaaattacgaccagtttttggtgcaca

SEQ ID NO: 41607 - DNA, 195 bp, Triticum aestivum
  Clone ID: PAT_TA_41607
aaggcagtcgacaacttttttccttcatccccctcctaatcgaacttgtttcgggacggcggcggcgctgcctataaactgtttcggcggtatgtttacccatggcgcaagctaaacaggggcgtacccggagcttcggtgtggaccgctccaaaactggctctggagttttatgatatcatgagcgtggtgaat

SEQ ID NO: 41608 - DNA, 193 bp, Triticum aestivum
  Clone ID: PAT_TA_41608
cccacgcgtccgggcgcacgatacacgttgttaccctatataatagaacacgctggggtgagcaagcccgcgcgccggacttatgctagcgcaatcgtaccggaggccaaaggatgcgccatgcattgtttatcattcatccggcacgactacattactgagcatgatacatctgaatgaaaacgcagactgt

SEQ ID NO: 41609 - DNA, 303 bp, Triticum aestivum
  Clone ID: PAT_TA_41609
cacgcaagccccatcccaccaagctcagatcgaccatcacaccgtgcacggtgctgatcctgctcgcggggaggtacattgaaaagcgcgtgctgttcctcaagcagctcaagtccggccttatccacatcactggacctcgcaagagcacaggcgtagcgcaatcaccagattgagccaagcttacaacattgccacatccacaaaggtcgacatctgtacatgaaatgagcagaagtgggatgacaagatctttgctagggagaaaaagactagggcacagaagactgaaggcgaactatt

SEQ ID NO: 41610 - DNA, 171 bp, Triticum aestivum
  Clone ID: PAT_TA_41610
cttaagagggggtgtaagcttctcacccaacatatataacggtggcctgacggataaaacgaggtggcaatatctcttgctggagatcacaaggttaggaacgatacttgtaatctcacggtctttgttgatggtccggtgaagggagagcaggcaaagaagaaaacgaag

SEQ ID NO: 41611 - DNA, 114 bp, Triticum aestivum
  Clone ID: PAT_TA_41611
cggacgcgtgggcatagtgttcgttagatagagccatattcttgtggaggggtgcgacgaactacatcggcatgcacgtcttcctggctagtgcgcggctcgtccaccctacct

SEQ ID NO: 41612 - DNA, 386 bp, Triticum aestivum
  Clone ID: PAT_TA_41612
agaccggcgtcttcgtactcgcctctctcgcgcgcttccgagctttggcctgcgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttt

SEQ ID NO: 41613 - DNA, 394 bp, Triticum aestivum
  Clone ID: PAT_TA_41613
gaagcatcgggcatcccgcgcgcgggcctgtggctcacgttcggcctcgcgatcttctggacgatgccgttcccgtcgtgggaagcgctgatcaacatcgtgtcggccgcgctggtgctgagttacgcggtcgcgccggtatcggtcgccgcgctgcgccgcaccgcgcccgacctgccgcggccgttccgcgcaatcgcgttcggcatcaccggccccgcatcgttcgtgatcgccgcgctgatcgtctactggtcgggctggagcacggtgtcctggctgctcgggctgcagatcgtgatgttcgtcatctatctcgcgtgccgccgctgggtgccgaccgcgcacctgagcctcgccgaacaggtgcgctcgtccgcgtggctgatcgcgt

SEQ ID NO: 41614 - DNA, 384 bp, Triticum aestivum
  Clone ID: PAT_TA_41614
gcgtgctcgccggtcgctggcgccacgcgtggagatccatccgtcgcctgcacctcagccccgaggactggtgggacagaggcagccccgaacatctgaagaatttcttcgacgctctgctatcccccggcggccatgactcgattctggaggaggcccagctggacttcgatggattggtcgaagattgcgcgcacgccgaagtctggatccgacgaattttgtcgggccaagctcaggtgctcgatgtctccttcgccacactggaaaaccctcctctggtctcccgacacctgagaaaactggagctcactgaaatgattttagaaggagatgttcttgatttcgcgagctgcccagcattggaggatcttaagatggcag

SEQ ID NO: 41615 - DNA, 328 bp, Triticum aestivum
  Clone ID: PAT_TA_41615
ggctgcaggtgccagggtgtgcccccccatcctgatccatgactgggccgggagtcctccgcggtgcatgatcgccccaatgcaggatttgatcgttcactacagggacaaggcttttgatggcacctgcatgcttgaccactacaggatctgatatcgatccatcaaaggctacttgatagaataaatgctgtgatcacagcacagtagattagctgcaagcctgcaaggccatctactttgcgttgcatgcttccgtagaatatgaaacaagtctatgcatgtatgcttacaacattgagatcttttactaaaaaaattgatgccc

SEQ ID NO: 41616 - DNA, 381 bp, Triticum aestivum
  Clone ID: PAT_TA_41616
cggacgcgtgggcgcttgaagaaggacggtgcatgcatacttttgtgctccgtcatgggtacgagcaccacatccatgtgcggagctcagtggtggatatgtatgccaagtgtggtgccattgatgcagcccaaaggctcttcaacgtggcaccagtgaaggacgtaataatgtcgacctcaattttgtcaggactggcttcttgtgggaggattggtgatgcaaagcgagtgttcgacaggatgcaagagcgtaacttagtgtcctggaatgctatgttgactggttatatcaggtcctcggatctgactggtgctttgcatttgttccagcagatgaggaaggagacaaaggagcttgatgatgttacacttggttcgg

SEQ ID NO: 41617 - DNA, 255 bp, Triticum aestivum
  Clone ID: PAT_TA_41617
cccacgcgtccgggagcatgagggttctaagactgtttgctctcgccggggcggggctgatgttggacgtgatcaattcagggacagcgacagtgtcatacatgataagtcagcagtacacatgctacttcatgctgagggacggccaccacagctactggggatatagccgctgcctggattgcctcttctacacctacgactgattcatggaggcctgcagcacgttacgcgcatttggcactagtggctaac

SEQ ID NO: 41618 - DNA, 385 bp, Triticum aestivum
  Clone ID: PAT_TA_41618
agtaccacccccacccaccccacctcctccctcctctgctcctgctcgcggggcagagcggctaggcagccatggcgcgagcctcgagcctgtcgctgctgctcgcgctggtggtcgcggcggcgacgtcggcggcgggggccagggtgcccgtggacgcggccgggaacgcgacgctgagcgagctccgcgcgcggcgggggcggcgggaggcgctcgagaacggcctcggcaggacgccgcagatggggtggaacagctggaaccacttctactgcgggatcagcgaggagatcatcagggagacagctgatgcattgatcaacaccggtctggcccgattgggctataaatatgttaacatcgatgattgctgggcagaatt

SEQ ID NO: 41619 - DNA, 377 bp, Triticum aestivum
  Clone ID: PAT_TA_41619
cggacgcgtgggcggacgcgtggggaatcaggtagaggcttatgaagggagtaagaaacatatggattgtagtcctgcaaaattacctgaagaaaacgagctgcttaagaaatacttggcaactatcaacccagaacacattgatactgtgctgatagaacgcttgcttagaaaaatatgtactgactccaatgaaggagctatcttagtcttccttcctggttgggaagatataaatcaaacacgggagaggttacttgcttcttcctttcgggattcttcaaaatttcttgtactgtcacttcattccatgatcccatcttcagagcaaaaaaaggttttcaaacgtgcaccggcaggggtttgtaaaattattc

SEQ ID NO: 41620 - DNA, 372 bp, Triticum aestivum
  Clone ID: PAT_TA_41620
cccacgcgtccggtcaaagcagcgactgatgtcccttgcgtcgtcgccctctcttggtttgagcccccctcccagcagcaccaatgtgtctgctgctgaggatgctggagctggcaaagggaagcagccagtaacaccatctttggaggacaacaagctgcttaggcgattgagcatcgggccaaaggccttctttaggcgctctgtggagaaggacgaggaacaggataaggatgggttctttaagaggttgcttagagacagcaaggacaaggaggaggatgatggagacaaggaaggttttattaaaaggttgcttaaggatagcaaggagaaagagaatgatgaggaagaaggggataaagatggtct

SEQ ID NO: 41621 - DNA, 383 bp, Triticum aestivum
  Clone ID: PAT_TA_41621
agcgcctgtgctcccatcaccctcaagctcccacctccggatcgagcaggaggctcgatggcgagctcccgaagcccaccatgccaagcgcctcgtccagggactctgcaccattccccttctttctcccatgtgtctcttccctccctcctgtgctgatctaccttcccgtctctctcctctcgcagcaatcagtaggaacccaggccaccgagctttgcagcgccgccctcgaccaggagctccgcctgactccatggccgtcgtcccaaacctctccttcgcctgcgctgccgccatggattggatccggccggagctggtcatccgcctcacctcccattctggctgcaagctaccgccgtctggatccctcccgagct

SEQ ID NO: 41622 - DNA, 383 bp, Triticum aestivum
  Clone ID: PAT_TA_41622
cctcatattgtttcttgcacaggagacagcggcggctactggacgtgactcggcggcggcgactggacctggtggtggtactcaccggcggtggctacatccctgccaggagaccacaattcagatgagctaggtgttggagatggatgaaacggagaggggtgaccacgtcgttggagacggcttcgattttcctcttttgtttgttcccgagcagaggttaccaagatttctgtgaagcacaagtgctcctctaccggtaggataaaaaacagcatgacatctcaaggatgggtagcacagaggaccgtaccccttatacagagtgaccctacaattggatgcaaagagttgttggagaatttgcaagatacatatggcac

SEQ ID NO: 41623 - DNA, 364 bp, Triticum aestivum
  Clone ID: PAT_TA_41623
caatgtattgctgagacattgaggttgaataccaatatacgcacatacaggagaaatggttgatgacaacaacagtcttgtagcttcaagagtggaacatgaggcagcctgtgtattgtggtggtgaaagagcagaggaactgtgcatgctttaatggcgcgaacgccaatcctatttattgtgtatactgactgacaggtgccacatctacacttgtaacttaaagagcggagcatgcagcagggctcttagtcgttgaggatcatgtcgacaggctctggcttatggcttggaaggaacacaagaactgtgcatcgcgggttgtcgtaaccgcacatcatatcctttgtactgttgagagtc

SEQ ID NO: 41624 - DNA, 386 bp, Triticum aestivum
  Clone ID: PAT_TA_41624
gagctctctgggtcgtttcgtgctcatcatctggctgttcgtggtgctcatcatcaactcgagctacacggcgagcctgacgtccatcctgacggtgcagcagctgtcgacggggatccaggggctggacggtcttctcgccagcgccgaccccatcggctaccaggttgggtccttcgccaagagctacatgatgcaggagctcaacgtgccggagtcccggctcaaggaacttgccatcgacgactacgccgccagcctccagctcggcccgcgcaacggcggcgtcgctgcgatcgtggacgagctgccctacgtcgacctcttcctctccaccaactgccagttcaagaccgtgggacaagaattcaccaagagcggatggg

SEQ ID NO: 41625 - DNA, 173 bp, Triticum aestivum
  Clone ID: PAT_TA_41625
cggacgcttggggtggtattgatgtcaatctgttaccactcgaaccctaactccttgaaaaaagatgcacctccaggcatagtcgtctcccattgcgagaggaggagacttgagcgatatcaagttgacactggatggtcttggtggacaggcacacctgacgcttcatgaag

SEQ ID NO: 41626 - DNA, 362 bp, Triticum aestivum
  Clone ID: PAT_TA_41626
cggacgcgtgggcacggtcattgttgctcagaaaaaccatcataccaggtgtttccagacaaactcgccagaaaatgttcctcctggcactgtggtggataaacaagtgtgccatcccaagaactttgacttctacatgtgcgcgcatgctgggatgattggcacgtcgaggccaacgcattaccatgttctgcatgatgagatcggcttcagtggggatgagctccaggagtttgtgcactcgctctcctatgtgtaccagaggagcacgacggcgatatcagtagctgctccgatagcgtacgcgcatctggcggcggcgcaggtgggcaccttcatgaagtttgaggacatgtctgaca

SEQ ID NO: 41627 - DNA, 143 bp, Triticum aestivum
  Clone ID: PAT_TA_41627
aggaggtttttttagataaacttgcctcattctgttttttctgcactataatagtcagtctagcgttctcacccaagaacttgggtggtacttttccgagcctgcgtccatgttaatgaagaaatattcctgcgcacttccaa

SEQ ID NO: 41628 - DNA, 372 bp, Triticum aestivum
  Clone ID: PAT_TA_41628
tcctcccttcaagcgctagtacagccaggaccacctcacgaatcgcaccttcaaacggaggttactcacagcagctgccagccattccattcgcgaccacacacatccatgtgctgcaacagcttatccaacgcgacggccaagccaatgaattgggcttcacctgaaactggaggaagcctcgacctgtacctagaataggtctggaagtccaccacggccggctcgggcacaatcttctacaggttacaccacggcgccgacaacccattcggttcaaacatgtcacacaaggccgcagaagtcctgtcgcgcttcactcagaataccttgagcgaagattgaacacaaaatatcaatacattctttaca

SEQ ID NO: 41629 - DNA, 387 bp, Triticum aestivum
  Clone ID: PAT_TA_41629
caacaattcccaaaccaggagaaacttgatgatcccaaactgtatcactatgccttgttctcagataatatattggcaacagcagttgttgttaattcgacagtgttaaatgccaagcatccttctcgtcatgttttccacatagtaactgacagactaaattatgctccaatgagaatgtggttcctctctaatcctcctggaaaagcaacaattgaagtacaaaatattgacgaattcacatggctaaatgacagctcgagcctgttgctgaaacaactgggatctcaatctatgatcgattattactttacggcacaaagtgcaaattcagattcatatttgaagtacagaaacccaaagtatctttcaatgcttaatcatctg

SEQ ID NO: 41630 - DNA, 387 bp, Triticum aestivum
  Clone ID: PAT_TA_41630
tccaagactacttacgcgtagcctgcgacctcctaactcttctatcgtgagggggaaattcaattcagtggccgtcgctttacaatttttttactcacaaaccccggaggggtacccaactgaatagtctttcaagacataccactttcgtcaggtcgcgtaatatgctatgaagctcggaccaatctgacttcctaacagttggccaggctgaatggggaatgcgcccccccttgcatcgggccattgagcgctacgcgggtggtgttttcacgcaggtggagggctataattgtcatggccctatcatcctttttgttcccaagttgctcttcctttttttatacgtgggccagcttcccgaggttttttttaaagcttaatcat

SEQ ID NO: 41631 - DNA, 383 bp, Triticum aestivum
  Clone ID: PAT_TA_41631
ggggcccgacgcacccgacgaggacgctcacactcccatcatccaccgcgacatcaaggccaggaggatccttctcgacgaacgctgggtctccaagatcgccgacttcggcatggcccgcctcttcccggaggccgacgacggccactcccacgttcagacccgcgtcgtcggcaccaacggctacatgtcgcccgagtacctcatgcacggtcacctctctgacaaggccgacgttttcagcttcgacgttctcgtgctcgagatcctctccggtcgaaagaactacttctttattccagcgtcctgatccaacgccgacaatcttctcgattacgcctggaagctgtacaaggaggagcggggcctggatctgctggacc

SEQ ID NO: 41632 - DNA, 355 bp, Triticum aestivum
  Clone ID: PAT_TA_41632
ctggggaattactggggggaccaacccctcctccgacgatttctatccacagccgatgaccgccgtatttcgagaggttcgagctcgccggagagggacgagagatggtcattatggccctcccgaagaatatagtggggacccggtccaccaaggccgagctccagttcctcgtcgggcgcatcagacgctttcttaagaagggccgctacacgcagcgcgtaggtttcagagcccacgactacctcgtcgtagtgctcgagtaccttgtcgacgaggtgctggagcttgttcgtctcgccgccaaggacaacaagaaagacgcgtgtgtgccctatctcctatgctagttgat

SEQ ID NO: 41633 - DNA, 310 bp, Triticum aestivum
  Clone ID: PAT_TA_41633
aacctccactgccattgtctgctatggcagctcgtcctttcccacgagagggcctttgctcccagcctactacctctagatctctctccgtctgcgatcaaatgggatccatctctgcgctctatggcttcgccttccactaatccggctatacccatgctagtgaaggccaaatacatcacaaattgaatcaccccgtccagatctgcccggatccaacgcttcttatgctgttttcaacaccgtaaggccatcctgatatactggttcatactgcatcttaatccttgctgattcgtcgttttaaaac

SEQ ID NO: 41634 - DNA, 352 bp, Triticum aestivum
  unsure (1)..(352): unsure at all n locations
  Clone ID: PAT_TA_41634
agcatttctatccaccgccgacgcccgccgtattccgagaggttcgagctcgtcggagagggaggagagatggccaggatgggcagagagaggaagaaagcggtgacccggtccaccaaggccggcctccagttccccgtcggccgcatggggcgcttcctcaagaagggccgttactcgcagcgcgtaggctccggcgcccacgtctacctcgccgccagtctcgagtacctcgccgcctaggtgctgaagctcgccgtgctacgccgccaaggtcaacaagaagacccgcatagnnccncgccccctgctcctctgcattcncaactaccaggagctcggcnagctgctc

SEQ ID NO: 41635 - DNA, 234 bp, Triticum aestivum
  Clone ID: PAT_TA_41635
cccacgcgttcgaccagcagctgcacgacgagctcgacgccatccaaaagagccaagaaactagtggagaagtccttgaagcaacagcatatgttgcaacatatgctagctaacatgccaccggatatgcgtgcggctattgtggctactactttggaacaaagcttagatgtttccttagagctcaaattttaacacatctgtttcatcatatctggacattaatgttaagat

SEQ ID NO: 41636 - DNA, 307 bp, Triticum aestivum
  Clone ID: PAT_TA_41636
ggaattacagcgcgagcgacccacgcgtccactgacacgtggacctccacacgtgtctccctccacagaaaggctaaagagaaccgttatgcggagcgcccgcctcctacggctcagcttctgtcacgtcccttctcttctcttccaagggcccctgtccccctccccgagcccggacctggacctgggcctgagcgttgccagagtcgtgttggtccatctccgatgctcggcggccgatgccggctactgcaggtgtaagaaggtgtcatcgcgactagcattggcacagcatgtgatgcactac

SEQ ID NO: 41637 - DNA, 292 bp, Triticum aestivum
  Clone ID: PAT_TA_41637
cccactcctaaaccctacatcttaacgcagagctcaacgcctttcgaaaggggaatatattattgtacacgccttttaatccacaccataagctgctagatatactagcaatcatccatgctgacatccatgcagtttgagaacaactttgaatgtagtatatcttgcaatctcacaaatacttactttttaacatcaaatttgacaatcaaagaatactttcattacattataatctgagcttccatatctcattcctatgaacaacacctctatcggttgcactagaata

SEQ ID NO: 41638 - DNA, 238 bp, Triticum aestivum
  Clone ID: PAT_TA_41638
cgcacgcgtgggcggacgcttgagtcttctcaagctcaaacattggcggggacacagaagccgttatgtcagatcaaacgcttaataaaggctttgattcattagtttatatggttatgattcttgattaaattcaagaacggcctcgtagaatcttatcttgtccttgcttatgatacgcatgtcatattacaacaaatgacttacagatagttttaatgtacgcttccgttgatag

SEQ ID NO: 41639 - DNA, 333 bp, Triticum aestivum
  Clone ID: PAT_TA_41639
gcgattccccttcgcgcagccgtaccacgtgtctcccgtagcgcaccttttctaagcgggctccatggcggaccagctcaccgacgagcatatcgcctagttcaaggaggccttcagcctcttcgacaaggatggcgacggttgcatcaccaccaaggagcttggaaccgtgatgcggtccctagaacagaaccctacggaggcggagctgcaggacatgatcaacgaggttgactcggacggcaacggcgccatcgacttccgtgagttcctgaacctgatggcgaggaagatgaaggacactgcctcggaggaggagctcaaggaggcgtt

SEQ ID NO: 41640 - DNA, 265 bp, Triticum aestivum
  Clone ID: PAT_TA_41640
ctcactcgtgaccttaactcttatctaccgacacaccctctccaggagcgggtttttcacggcgcccgcctcctgctgctcacgaaaagccactttcgtgcattggaattgaccatggccacccccatccagcttgagaacaactctgaacttggcgttgactccaagcttacaaaggcctactcattgcctacactcggaggaccagacaatctccacagtgcatttgaatgtgtccttgcaactagcattcgtgcggtcaata

SEQ ID NO: 41641 - DNA, 182 bp, Triticum aestivum
  Clone ID: PAT_TA_41641
ctactcgtgggcctccacacttgtcttcctccacagaaaggctaatagagaaccgttttgcggagcgcccgcctcctactgctcagtttttgtcacgtcccttctcttctattccgagggcccttgtcctcctcccctagcccgtacctgggcctgggcctgagcgttatcagtttcggttt

SEQ ID NO: 41642 - DNA, 369 bp, Triticum aestivum
  Clone ID: PAT_TA_41642
ccgcggacgcgtgggggagagcgagaggggcagcgtggtggcccgcaaggggagcaccatcacgggagccgcgttctcccggtccacggccacgtcggggagatgccgcctaccttcgctggcgagcggcggctgtgagagtctggtgcggagggcggactcgatcatgaagtcgctctcgtggtccaaggcggtcccagtcacggagacggccatccgcgccgtcattggcgacaacgctgtaactagcaaggctgtgcgctggttgctgaaacataagagagggttgcgtcgtgcgggcactggtggccgcccggatccgtatgtgtacatggcacttcttgttctgcaatccacgagcagggagcg

SEQ ID NO: 41643 - DNA, 386 bp, Triticum aestivum
  Clone ID: PAT_TA_41643
caaatacttgaatctaacaagacctacaatgctagattactgcatatctgttggggcagttgcatatgatttttatgacccatgtatcaaaaagctacatgcaactgcccaaacaaatacttgaatctaacaagacctacaatgctagattactgcatatctgtttcattttccactactgaccaaatttttacagttggaattcgaagaagcattctccgacttaaaagtatatgttgttaaatcatgctggtgtttcactgaagttctgtagtaccttggtagtgggcacctcaaactcacagaagcatgtagtatttagtgtacatctcaaccaaagatcaacatcacaattgaaatggtaacttataaattctatatagatt

SEQ ID NO: 41644 - DNA, 228 bp, Triticum aestivum
  Clone ID: PAT_TA_41644
aaaaaaaaaaattcggttgttctatataatccaagcttacttaagaaaagatgcatactaagagatctcttatatagtcacctaaatacaattaactaaccgtccttttacaacgatctgactgaaaaaacaaacacggtacccaactaaattaactagcaatacatacatttttctttagctagcttaataaataataaagtatcactgatcgatcgtcactaacaa

SEQ ID NO: 41645 - DNA, 312 bp, Triticum aestivum
  Clone ID: PAT_TA_41645
tcgagttgttatatgtgctgctgaattctccattagggacttgatggatgggggttgctgacttcattgttgattgttgattgtcgagagaaaatccaggagagcggttgatgctagcgctggcgatgcgtcatctcccgtccacgcagcctccccactatgcctccacacccagattcgagtcctctcggtctcccttccccatctgtggtcggcaacgtcagtcacaatgatagcgaagtggtgcgaccaggggatggcgcacatacgttgttgccgtctgctggcctatgctctcgttcaagaatgatg

SEQ ID NO: 41646 - DNA, 198 bp, Triticum aestivum
  unsure (1)..(198): unsure at all n locations
  Clone ID: PAT_TA_41646
tcgcggattcgtggtaccacattcacaccaattttttccgtctgnctttctggtcggcggaggctttcgacgaaccctagcctttctaggaacgccaagatccccaaggccggcgacgatggccgcggttcggtgcgcggtgaggaggctcggtggttctctgctccagcgaacgcaggcggtggtcgcggaggaggg

SEQ ID NO: 41647 - DNA, 176 bp, Triticum aestivum
  Clone ID: PAT_TA_41647
catctttattattcctaaaaatctttatctacatcccatccgaggcgaagcggcgattcatatccaggtccgttgcgcctgccgctaggcggcttgcccggagtgggcggtggtggaggtgcatggcgtgctgtagtcgcagccctgtttctccggccgtatccagggtctccaca

SEQ ID NO: 41648 - DNA, 133 bp, Triticum aestivum
  Clone ID: PAT_TA_41648
gacagacgtgaaaattttcagatcatgtagagcgctctttttggtatcgggtaatacttgagcagaaggacttagcttgtgaggaattgtaatctatattattcaaaggaatggttatgaaatactatacgta

SEQ ID NO: 41649 - DNA, 351 bp, Triticum aestivum
  Clone ID: PAT_TA_41649
cggacgcgtggcctgaaaatggttatggttcttgatcgtatgtatgagcggatactgttctatgattactagatgaagctacaatggttaacttgctatatggtacaggttctaggtttgttatactgaaaatggctactgttcttgatcatatgatcttatatcatatacgtgcaaatcaggcctttaggccactggaatttcactatcgtttcatttaggaagagtagattgatccattatctggggcagcatagagaacacattgtctacctgcatagagatagtaccaaagtgaattatatgtgtttcatcacctttattaattctcccttctttttttagcttatt

SEQ ID NO: 41650 - DNA, 390 bp, Triticum aestivum
  Clone ID: PAT_TA_41650
cggacgcgtgggcggacgcgtggggtaaaattcaaacaaatattttaggagctcatggatatttaatttttgacatatgttttgatttaattaaaatactaaatcattttattaccttatgccaatttttgcaggagctaactatattattccagagctccttaataaatggcatagtttttggaccatattttatatatataacaatatatatccaaagcaaataattatcggattaatccaaatggccaaaattaaatatccatgagcttctaaaatatttggttgaattttaccttttgccaatatttttgcatgagtacatgcatatttcctttttctctttttcgatacaatttttatttagtttgatcatttagagattatttt

SEQ ID NO: 41651 - DNA, 391 bp, Triticum aestivum
  Clone ID: PAT_TA_41651
ataatttctataatttccaagaataggagtattgctggttaatcaattgatttacattaatatcttaaaaggggaccgcacgcatgtcctgatgctaaatctttttagaaaggaagggtttatgtaattttggtaggataaaaaatgtaaccttagtattacctagagctaggatatttgagtagattattttaatttttgtgctcatatgtgagatcatgataaaatttggaatatcatgttgctataacggaatcagtcgggatcgtgaagtctgcaccagaatgttgaccacccttttttgttttttaagttaaggaatgtacaacaagtctcttgcaaaaataactgtcctatccctttctacaatctctctatatctttgttagat

SEQ ID NO: 41652 - DNA, 342 bp, Triticum aestivum
  Clone ID: PAT_TA_41652
gcaagtggtctaaagtgggctcgggcagtatttatgctggccaacgagggggaggggtccaatcttgtgcggatccaactccataccatggtcgactgaagctacaacctggtgaaaacatcgggcgccaccatgggcgccccttttagtgaacggcttattagcgtgtgaacagttgtgataggagacgactaggtcacagcaagctatgacagggcatccacggcgttgtagcaagactgctagaccagcctagcacatgcgttgtttgatattcaccgaaatcatcccatggcttgcaagatgtgtttttatataaaaagttattccagagagcaccct

SEQ ID NO: 41653 - DNA, 388 bp, Triticum aestivum
  Clone ID: PAT_TA_41653
caacacctctccttcccacatctcctcctcctgcctcatcactcatctccatccaccgatccacgacccatccatccatcagcgccaccagctccagcaccacaccactgaacgcccccgcgctgttgctctttctttcttccttcccagctgctttctgctgctccttcttcacctacctcgctactgctcctccacctctcttcttctcccaagatctgctcatgctgctttctctaatctcccacgcctttgttgttcttcttgcccaaaccttgttgctgctccttctctgaacatactgctgctactacgctcagctgcttcttctctgaccctactgctgctcctctccagcggccccttgctgctcttctccagcgctccc

SEQ ID NO: 41654 - DNA, 242 bp, Triticum aestivum
  Clone ID: PAT_TA_41654
ggtgagccaccgtcgtcggcttcctcggctccgggttcggcaccgacggggagcgtagggcaggcgagcggcattttattgcccatgctcaacctcttcctcggcttagacaccaaggccgccgccgtgctgttcaaatgcatgatcatgggggcggctgcgtggtgggtctggtacaccctgctagtgtctgaccctaccaatgtggcgtcgttgcaagacttcatgctggtgctgttttt

SEQ ID NO: 41655 - DNA, 359 bp, Triticum aestivum
  Clone ID: PAT_TA_41655
cggacgcgtggggcctcaaccccccttgattattccctcgaaaccctagatccccaaacccacgcggccacctcctcatggatcatccatggcgcttcccagccggcgccggcaacgacctctgccccgtctgcaccgcgccccacttccccttttgcccgcctccgcctctcccgccccacccctttccctacgatctccacccaccgctccctcctcccccgccgcagtaccatgcccccttccacccgccgccgtcgtcgccgccgatgtgggctcctccggggccgcacccgtacgatcttctcgacacgggaggcccccacaagaggatgcgcgtgggggaggcgccttcggtt

SEQ ID NO: 41656 - DNA, 322 bp, Triticum aestivum
  Clone ID: PAT_TA_41656
atccggggcggaccacgcgtccgtccttttggaagaggggatcctcttaaattggttaggtgtcacttgagagccttcgatttggtgtggagttgaaccaagaagtttgtaagggcaaggagatcgcctacttcgtgaagatctacccgagtgaggcaagttcttcgtgggcgatggccatggtgggatagacaaggttgcttcttcgtggacccttcgtgggtggagcccttcgtagactcctgcaaccgttacctttcatgggtagaaatctccatcaacgtggacgtacgatagcaccacctatcggaaccacgccaaa

SEQ ID NO: 41657 - DNA, 391 bp, Triticum aestivum
  Clone ID: PAT_TA_41657
cggacgcgtggggctctatgaacatggctcggccgctgccatcactgtgaaccgcatgttgttcctcagatgcaacaagaatgacttcttgggttcactgtactttctaaatggttgtaacttttttgcttctgaagtgtcacaggataccaaaaatctcgatgatatattagtcacctgcagtccttgacaagaattgatccaaaggacgaagacttataaagtcctcaagctcataaactacaggaagttggaagcagagaaaatggattgggacaaggagccagacagaggatgaggaggggctcagcggaacaaatggccaaggagaaaaaaatagctatcgccacaagcatcaagatatgtgggcttcatgtaagagtgaacaaca

SEQ ID NO: 41658 - DNA, 288 bp, Triticum aestivum
  Clone ID: PAT_TA_41658
accacgcttgcgcggacgcgtggacgcttccaagcggagcctcaaggagctgaagggcctgcaaagaggatccccccacctgctgcagcgccagccctgtggcggaagatatgtttcactgatacacgacaatgatgggttcattgggaagcccatatgctggtggtgtatactcggatactattcacttgcccccagactacccattcaagccaccgaaagctgcatttaaaacacaagtttctcacccaaaaatccacagcaatgggagcatctgtcttgatatct

SEQ ID NO: 41659 - DNA, 369 bp, Triticum aestivum
  Clone ID: PAT_TA_41659
cggacgcgtgggcgcgaaggcgatgctagctcccgcgctgagcccccccaaaagatttggcgacgcgtcgcccaccccaaacgggaacctcccccccttactgaacccccttgcaatccgcaaatccacgatagccctagggcgtgcagcgctggaggagcggcactcgtaaccctacccgcctgccatggtgatcgctcgaggagggagctccgtgcaccaggacgagggggaggacggtgaccaccccatgcgctacctccctcgtagccgcgtttactttttcaccgaccgatgctcgccccccaagaagccccgtagcttcgtcttcgtcgtcgagggcgccaagccgtccgtgatcgtctacta

SEQ ID NO: 41660 - DNA, 285 bp, Triticum aestivum
  Clone ID: PAT_TA_41660
tcgcccacgcgtccgccaacgcgtccgcctaatccacctttttccccggccggccccaatccacttttttaaaccgtgggaacggcccaaccggaatccggcttcttcccgtcggcgccgagtggccacactcaggcctaagtgtcggctgcctgccgggccctccaagcgacccatggccacataaagcgttcggccactttcggctactcctcgtttgcacgggcggccggcaaggacgcgcttgactttgctgcatcgagcgagcactctcccgacgccagg

SEQ ID NO: 41661 - DNA, 396 bp, Triticum aestivum
  unsure (1)..(396): unsure at all n locations
  Clone ID: PAT_TA_41661
cggacgcgtgggcggacgcgtggggcgtggacactgattacttatttctcttggagggttactaaaatgcggtgtctaccttgtgttggaaaaacttgaactctaggtctaccggagattagttaagaaaatgtgagtgtaaacttgaaggtctccttgtcacaattttacagaatgaaccaatccttttcgatttgctttcttctgcatgcatatcatccagagggagaaggaaccatcgtctaaggtgcatcaaatcaagctagaggtttctgcatccattttagtcgagtagcagtcttgcgaaaggtgaccatggcaaacattntatcctgttacaagcacgttatttggatgaaatggtgtttattgttggtggcttatttgtatgcctaa

SEQ ID NO: 41662 - DNA, 148 bp, Triticum aestivum
  Clone ID: PAT_TA_41662
aggaaacgtatgcctacctgagaagagtattgcacaacaggcgcaataagttagagcctctatggaacgaggtggtgctttgtggtttgaaaatggatccaaaggtctattaaaaattgcttgaactggttaacatgattggtacaca

SEQ ID NO: 41663 - DNA, 404 bp, Triticum aestivum
  Clone ID: PAT_TA_41663
cagcacccgccgcccgtccacatcccttcacatcggtcgacccagatctcacaggccgcccaagccagccagcgacgatgaggccctcagtgatgagatccgccgcccagctcctccgccgccgcaactactcctccgcgtccgggcagcaggcgcggaaggtggccatcctcggcgcggccggcggcatcgggcagccgctgtctctcctcatgaagctgaaccccctcgtctcctccctctccctctacgatatcgcggccaccccgggcgtcgctgccgacgtttcccacatcaattcccctgccctggtgaagggcttcatggcggacgatcagctcgcggaggcgttggatggggccgacctggtgatcatcccggccggcgtcccgaggaagcccggc

SEQ ID NO: 41664 - DNA, 369 bp, Triticum aestivum
  Clone ID: PAT_TA_41664
ggatgctttgcccagactttgggtgttttgtttgcagaagcaaaatccctccgtgttattcttttgtctggtgcatcttataggtatgttgtggaggatgtgtttcgcagtcttccaagacttattcatcttcgttacctaaggataacgccttttgcaagactaaacagcaacatctcaagattttatcacctgagggttctagatgttgaacaatacagtgtccaactagattttccaagagatatgagcaaccttacaaaactgcgccattttcttgtccgagacattgacctgcagtatataaattctgacgttggaaaactggaattattacaagacttaagaagctttatggttaaaagggaa

SEQ ID NO: 41665 - DNA, 384 bp, Triticum aestivum
  Clone ID: PAT_TA_41665
cagacgcgtgggcttcaagaggccagaaccaaccacagagaaacatacattctcctggaataaaccggagcaggagcggtagataggcatgagagatcaggacaatagttcgtcaagagcaccctcgtgctaagaaccaagggatccgtccgtgttatcactgtcgctacctctcctgtaacctcggaatcctaaacatgaccaaattcaagtaggaagcagctgttcatcactgacgacatgtaggtgcagctggttgaccccgtagatttataatgtacctgttatatgcccatgctgttctgtagattgtgacttgaaacttaaaaaaccgtacccccatgtgtgagctgaaccttattttttgcttggtgaaaaataata

SEQ ID NO: 41666 - DNA, 194 bp, Triticum aestivum
  Clone ID: PAT_TA_41666
ctcacccgcacgagttcgtacgctcattctctcagtcggcgcccccatgccgtgggctttttcgctgacggggtaccccatccatccttttttttagccggcggcacgccctatcccgccggttacttgatcatcggcgcaccccattctgcgctcttttattctgtcggcgcgccctatcacgcggtcctttt

SEQ ID NO: 41667 - DNA, 250 bp, Triticum aestivum
  Clone ID: PAT_TA_41667
gcgaagcgtgctaactccactaatgccgcgcgtgctcaccctctcctactcgccggtgctgccgcccagggcccggttcaaggtctcggcctccgccgacgttggcgccaccggacgagccgccgccgcctccaacggtttactgctgttcctgcccagggcggtcgagcgcatcctagacaggagcctgccttcgcctagccaagctaatacagcgcagtacccttctcagaccgtcttctctaagagc

SEQ ID NO: 41668 - DNA, 393 bp, Triticum aestivum
  Clone ID: PAT_TA_41668
acaaatggtgccgtcttgtgaatcagctggagctgctctccttcttcctaatcgagctcagcctcgtcgactacaagatgctcaagttccagccgtcgatgctggcggcggcggccatctacaccgcgcaatgcacgctcaacgggtgcatgtcctggaacaagtgctgtgagctgcacacaaaatactctgaagaacagctcatgtatggaaacacaccactgtctttcattcagaccaaccaactttcagtgagtgatgtgatatgcctttgttactcacacggctgtttggctcacttgttttgcagggactgcagcacgatgttggtggagctgcaccagggcgcggcgcgcgggaagctcaccggggtgcaccgcaagtacagcacct

SEQ ID NO: 41669 - DNA, 392 bp, Triticum aestivum
  Clone ID: PAT_TA_41669
ggttcctgttaacatccacagaaacctgaattttctcctagaggcctgcttaccatctggtgatatcattgcacaaaaagtattgtcctttgaacccaaactttgcaacataagtcagggtagttgtgaacttaatggtattgagttggagatcactgttgcttggtcttgtcttgtttctgagaagcgggatatttcggtacaaggatgtgttggtgatgaggagcaggacggggacattgcatcaatggagcagcaggtgccgaagatagactccaaattgacatcggaggtggggcccgaggcggagacggagtcggcgatgagtctggataccagtgaattggcgaatgaatcgagtacctccatgttcatatcagacaagtcaatac

SEQ ID NO: 41670 - DNA, 277 bp, Triticum aestivum
  Clone ID: PAT_TA_41670
tcacgcgtccgttgtctcgttccagagcccgccgtcacacctgcatcgcgctcgatcccatcacccgctcgacctctttattcgtcctgatcgagaacagaagcgcctccgagccctcgtgcccatgaacgtactccgccggccgactctgttcaccgatgtccgtcaccgcggtaccttgcatcgcatagctgctgtgctcccatgccgggcgccacccaagccactcactgcttgcgccaccctacatcgtcgagctagggccggtctcagacat

SEQ ID NO: 41671 - DNA, 324 bp, Triticum aestivum
  Clone ID: PAT_TA_41671
gctttccctttctttacacccaagcaagctccctacctccctccccgagggccagcggcgagcccggacccgtagatcggctcgagctccctctctatccagaaccgcagcggaggccgcctcttactgaggcagcctcaaagcgaaccggagcttatcaggctccggagcagcgtgtcgaccgcaggcggatgatgatggacgccgtcgctgtcggcacgagcatcagctgatccggggcccatggggacgccgccaggcagaacaacaccaggatgctcaagtattccaagttcacgcattaagagctgccggactgcaaag

SEQ ID NO: 41672 - DNA, 326 bp, Triticum aestivum
  Clone ID: PAT_TA_41672
cggacgcgtgggtggccgaggacaagcccttgcccatgtacgatgagttgtccagcaaggacaatgttgaatatattgctggaggagccacccaaaactctatcagggttgcccaatggatgcttcaaactcctggtgcaacaagttacatgggttgcattggaaaggacaagtatggtgaggagatgaagagcgccgctaaagctgcaggagttactgctcattactatgaggatgaggctgctcctacaggcacatgtgctgtctgagttgtaggaggcaaaaagtcattgattgcaaacttatctgctgcgaactgctacaaa

SEQ ID NO: 41673 - DNA, 399 bp, Triticum aestivum
  Clone ID: PAT_TA_41673
cccacgcgtccgattttccttttccgcttctcgacttccccaagcggccaccccccaccccctccttccttcctggccagcgcggcggctatggcctccatgaccacacctcggctccccttcctccccgcccgaacccgctccgccgtcgccgcctcctcctcttcgtccccctcctccccgctaccacgcctctccatcaaatgcagcagctccgccaacgctaactcggcccccctcccttctacatcgcggcagccccgggcgcccgtggcggacggcgtagggtccgccgacctcaacggcctccgggccccgcctatacctgtcgccgacccccctctgcccgcgtaccgcgatccgcacgggctgcctcggcctctcactagtgcggatcta

SEQ ID NO: 41674 - DNA, 316 bp, Triticum aestivum
  Clone ID: PAT_TA_41674
gccttacacgatggccgcggcagtcactcgccgagccaactccctgggggtcgaggccccggacggcaactccgagagcgggcgcgccagcctagcagcagactcccccgtcgccaagcgggctgccgacgccaaggacgacgtgtgggtggccgcggacgagggagacacgtcgggagccatcgccggcgacggcaaccgaccgtcgctgttccggaccttcaaggtcaagggaagcatcctgcattcttacaggttcatgatcctcattcgtttgttcgccatcgggagtttcatcgcgtggcgcgtgaagcac

SEQ ID NO: 41675 - DNA, 400 bp, Triticum aestivum
  Clone ID: PAT_TA_41675
cccacgcgttcggttcccccctcctcgctcacaaccgagcgcggtcctgtccgtgccgccgtcgatcccgcggacaccgtgttccacgggcctcgcgagggtgtccagcaactgcgccaccgtcacctacatgatctgcgaggagcgattcatgctggagcgctctacatcacacccttcgtcatcgtcttcttcttcggcagccacgcgacgtcgccgttgattcgcagcacctagatcccctacgactgccccgagcccttcacgagcatacttactccgagaccgctgtcgatgtccgcgtgttcgactacattgaagatgacccctccttgccaaagcaaccagacgatggagttcacgagccagatgccatcgtcgacaatgactgctactacac

SEQ ID NO: 41676 - DNA, 405 bp, Triticum aestivum
  Clone ID: PAT_TA_41676
cggacgcgtgggcggacgcgtgggcggacgcgtggggccaactcaggtagcagcaactagagccgacatgatggcggaggcgtggatggacgtgctgccgccgccggcgccctacttcgccgggcagccgtgttgggccgtgcagcaggagcgtcgcggaggcggcgcctggacgctggaggagaacaaggtgttcgaggaggcgctcgcggcgatcgacctggacgcgccggaccggtgggagatggtcgcgctgatgttgcccaggaagacggtcgccgacgtggtgaaccactaccgggccctcgagaacgacgtcgggttcatcgaggccgggctggtcccgttccctcactacgacagctcgtccccttcgtccgggttcactctggactgggacggggg

SEQ ID NO: 41677 - DNA, 401 bp, Triticum aestivum
  Clone ID: PAT_TA_41677
tgttgatttcatacaccattgttccctcgaaaaggaaagaaccagccctacgaggattccaggataccgcaggtaccagctccgtttccgatccaagatataaaagaaaattcagcgaaagcaggagctgtgaagctaccctggcggaagaatcgactgaaagcggcagggtgaaggaaggatccactgccggggaaagatgcggccttactttgatcccgagtatgagaacttcaatcagcgcatcaaccctcctcgggtctgcatcgacaacaacacatgccgcgactgcaccctagtgaaggtggacagtatgaacaagaatggcattctgctggaggtggtgcaggtcctgagcgatcttgacctcaccatcttgaaagcttacatcacctcggatg

SEQ ID NO: 41678 - DNA, 138 bp, Triticum aestivum
  Clone ID: PAT_TA_41678
cccacgcgtccgcccacgcgtccgatttatctttcatgtgattgtcctcgttctccttctcataagctcaaaaactgagccttctgatacaaaagtggagataaacagaaggctcagttgtagagtttatgggaagga

SEQ ID NO: 41679 - DNA, 398 bp, Triticum aestivum
  Clone ID: PAT_TA_41679
cggacgcgtgggttttttttttatactaaatcacaccattccatttccacacggccagttcaccatagcagcagtacaaaaagttacacactggacactgcaatcgctaggtaaatatagtgacagtgacactactatagtagtatacggctcggtagttactactactggcgactgcgagaaacggccaactactactactgcgttaacgttgcaagctactccagcttgcttagctgcagatgggtcggtggcagagcacggcgcggcccccctctccgtccggccggttgctggggaggaaccgaatccacctacgtaccgcactctacaccgtggcgacacaagaaatcgactcaaaccaaaggccttccccctcgctacgtacgtacgtactc

SEQ ID NO: 41680 - DNA, 406 bp, Triticum aestivum
  Clone ID: PAT_TA_41680
cccacgcgtccgcggacgcgtgggttttttttatgtcaacatcaagtggaaaacaaaaattagaaatgatatagtatcataaggtaagggtaacccagatccacgtatgtcaacatcaagtggaaaacaaaaattagaaaggcatacttgcagaagttgcattttgaaccaaatggtatttatctatgtataaaacagggtgtgaaatccaactagaacttgaggtgaacaaaagacaagttttgatgtagatgccaaccacgctctacctaatccattagaaagctacagataacatgaacgatacatatcaaaggattgtcccccctgcgtaactgtgtccttcatggcaaacagtgaataacttcgctggcactcatgaagatgtttgcgggcaaaaatacca

SEQ ID NO: 41681 - DNA, 396 bp, Triticum aestivum
  Clone ID: PAT_TA_41681
cggacgcgtgggtcccatggctgtcctcctgcgcgggagcacaaccgcaacagcgaccgccatggatcccctgcttccaaccacgccaagttcgtcgtcgtcgcaccgagcccgtcgccggccgccgacattgcctctgcttcgcaccccatgcgccgctgtgcccggcttcctctccttctccgagtggtgcacctcaggaaccggccaaggattcccgggccgccatggttcctcctcaagctccaagtcctcgcatctccagccatctgtggcgttcccgcgccaagctgtcgtccccttccttgcctgaagtcgccgtgcccggttccagactctgcatcgagcagaggaggacgaacgcctcgcccgatccgttccaagtcaggcgcccgc

SEQ ID NO: 41682 - DNA, 378 bp, Triticum aestivum
  Clone ID: PAT_TA_41682
atcgtgaggctgtgcggcaacggcaacgtgcccttagcctttcacagtctcaggagcgacaactacagtgtcttcttgggggtggtcctgatggcttggtgccaactgacaagagaacttaggtcgcccgctgtattgttttccagcatccacctgtgcataacctagctcctatttcttgtgcaggggtaccaacaggagtgggagtgtgtggtcttcctatcctccaaccggttactagtctgcatgctccacaggtacgccgcctagccccaatggcgccgtagcgccgtcttgtactaggcacgacgccggatgctgtgggtgctgaaaaagatgagccaccctgacatcaccatgaggcacttcttcgcgctc

SEQ ID NO: 41683 - DNA, 396 bp, Triticum aestivum
  Clone ID: PAT_TA_41683
cccacgcgtgcggggacgcgtggggaaaagacgagtgtgttcggcacgggttcgctccttttgtccgtcctctaggcggcccttctcttcacgcgtcactgccctggccaccggccggactagctggtgggctaagccctgccagtgtgggggcggcggcggtgtgttcctccttaccccggccggaacgaccgtcgcgggatccaagatcgggcggcggctcagggctttcctcaagccgcgggagcagcagccggcggctgagactcgcgctgcggatggccgtgtgaatgctctgacgcatgctgctgcgcgatgggctaccgcagcgctgaccctgtcgatgtgcggctagatctggccccacgcgggccgggccggctgcggtcctagctg

SEQ ID NO: 41684 - DNA, 401 bp, Triticum aestivum
  Clone ID: PAT_TA_41684
cggacgcgtgggccaatattgcatggggttggactacaaaagacacactattctttttcaattggatatgattgatcatatatcatgtatttcttgtttatgtatgtactcactaacacttggacaggtaacttggttaaagctgtcatcccacgacctgaccccagcggcgctgctgttcctggagttggaaaggtgtttctggaatatgcagatatcgacggctcgaccaaggcgaaggtcgggatgcatggcaggaagtttggcgggaaccaggtggtggccgtgttctaccctgaaaacaagtttgctgatggagattatgatgattagatgaagtcctctgctcagttgtcacccgtgccatgcgtttgcttagttttcaaattgaatcctttttt

SEQ ID NO: 41685 - DNA, 305 bp, Triticum aestivum
  Clone ID: PAT_TA_41685
cggacgcgtgggttctcctccccaaacccagaaaatccccttatcccctctccccctgcttctcgaccgtccatggcgatggcctcctccgtcgccgcggcgtccctccgagcgctcgccggcgcctccccggccccgctcccgaagccgttcctcgtgctgctcttcccggcgcccccgcgccgccttggcctcggcctacgcgccggccgcccgagcggtccgttcgccccggtcggcttctttgacttctttttcgaaaccttcgcggccgtcaacgtcgccgagccggatgaccaggccct

SEQ ID NO: 41686 - DNA, 181 bp, Triticum aestivum
  Clone ID: PAT_TA_41686
cccacgcgtgggccgactcgttgttcctccccgtcagacgccaccacggggcggtgttcttggcggcagtagagattcatccgtccgttcaagccgatatcagtgcggagcatgtgtaggaaaccgtactgagggccagcagccatgatgttctctagccatgtcgacgccttttctccgt

SEQ ID NO: 41687 - DNA, 404 bp, Triticum aestivum
  Clone ID: PAT_TA_41687
tcggtgatactcagaagagcatgggtgccagagacaaaaggagcatattactgtcactttcagatagtgaagctgaggataatgataggactactatatctagaggctctcagaataaagaggtcccaaagagacgagggcgttccatttttaatgaagagcaagagaagcttatcagagatcttcatgagaaatataaggatgatcgtaaatgcagtcatctaattgctgaagctctagatcccagtggaaaggtatcgtcagctcaaatttctcgaaagcttacacagctaggtctcaggagtgtcactaggaggacaaaagttccagaggcatctctttcagccgaagatctggttacacaaccacaaaacaacgtgctggatgatccgaagccagaaagc

SEQ ID NO: 41688 - DNA, 368 bp, Triticum aestivum
  Clone ID: PAT_TA_41688
gccagcgccagcgccagcagcgccatcacttccccactcctccactagccactgcccctccctcccacacagacacgctctcttcccccatccatcctccctcctcccaaagagagcttgagcaacagcttggcaacggtggtggctcagcagagatgaccaaagatgaggacttcaagctggtcaagatccagacccatgtcctgagggtgaacatacactgcgacggctgcaagcacaaggtcaagaagctgctccagaggatcgaaagcgtctactcggtggccatcgatgtggacaaccacaaggtcacggtgaccggcagcgtcgactcggagacgctcatcaggaagctcaccagagggggc

SEQ ID NO: 41689 - DNA, 402 bp, Triticum aestivum
  Clone ID: PAT_TA_41689
cggacgcgtgggcaagaaaaggagatgaagactctacaagaagctgagctcagactgctggaagaaactgctgcaagagaagctgctcttgagaaacaaaggcaagaggaggaggaacagcgtaaaatgcaacttgagaaagaggagcttgagtccaatcttgccgccaaagaagcatcattgccattggagccaccttcagacaaagaaggtgttataacacttgtagttcgcatgcctgacggtagtcgacaggggcgtcgctttttaaaatctgataaattcaagtccctttttgatttcttagacgttggcaggacttgcaagccagaaacctacagactggtaaggacataccccaggcgtgcttttaccactgctgacggcgaccaatcatttact

SEQ ID NO: 41690 - DNA, 384 bp, Triticum aestivum
  Clone ID: PAT_TA_41690
gattagttgaccggctgtagtttgatgacagaagcattgtttgaggaaatgtttccgcagtcaagaatggttgatgtgccgaatagatagtaaagaaagagaatgtgattctttgtttattatacacggagcacgttccaactagggcatgcaaatcctaaagtatggcacatgcaagtatcgtttgaccataatgtagctctaatttataagcctcttaaggctttgttgaacaaaaaacaggtgaatgaagctagaggaaaggataaacataattagaatcaggaaccaagttcaacctttcactggaactggagtatggataggtcagtatattagcctcatatccttgggtaaaacttggattaactcccattcttttct

SEQ ID NO: 41691 - DNA, 407 bp, Triticum aestivum
  Clone ID: PAT_TA_41691
caacccccattgtcgcgcgccatgcgcaggccgacctccccccggcgctctgcccaactgccccaccttctccggcgcccccgccccgccctcgccgcctccccgcccgcgagcagcccgccttgcgacgcgctagccggaggggcactcgttccgcgccaacccaccagcgccgccatggtcccggccgccctcccgccccactcccgagcggcgcgtcctcgcggtggatatggacaaccaccacagcggcctcgcccgttcccctccttcccccgacgcccatggatccatggtggcacccccgcctcccgatgtgtgctggagcgaggtggccggcgagctgcctcctcccagcgtgggcaggctccatgggcaggggaagaacaatcgggggctgccgggct

SEQ ID NO: 41692 - DNA, 225 bp, Triticum aestivum
  Clone ID: PAT_TA_41692
aatacgctgaacaagtttggccttattttatcgcttgcatttactgtgggagggtgtatatcggggggcgtgtaaaattgttcaaatgacttagcttcgttcaactgctgtgtagactaaatctactgtgcctttaaacatacctgcttgcccgtgaccttgtaagctatgatgtcattctttcttgccttggaaggctgaaacctagacggcatccgttaactt

SEQ ID NO: 41693 - DNA, 226 bp, Triticum aestivum
  Clone ID: PAT_TA_41693
cgacaccctggcgtggccgttggactccaaggtgcatgaggcgttcgggggggtcgttgcgaggctggagatcatttacaagcacgcggtggccatgaacgggtacccgcggttcatgaaccgcaccgacccggccatgttcccctacattttattcttccctaactctttttaccacactttccaggccgtggtgctcacggtcatgtgcattcctaacagcatc

SEQ ID NO: 41694 - DNA, 289 bp, Triticum aestivum
  Clone ID: PAT_TA_41694
cggacgcgtgggacacgtatgtgatctgggcgaagacgcgcctactgacgacggcgacggatactactggctaacactacaataggaccaccgcctataccttgctgttgtggactgtgtccttactcagggcatgagaagtcgaacgacctccggtcgacgagaaggcaggcctataatgtacactggggcagaagctcttgggccgtcgatacattttacaagactaaggacaagcggaatgcgcaacataatcaagctacaagcatgctatgatggttacggagat

SEQ ID NO: 41695 - DNA, 399 bp, Triticum aestivum
  Clone ID: PAT_TA_41695
cagcggcccagctacacgagaggagcgcggtagtcctttcccggcgcgcagcggtgcactatggcgtccaccggagccgtcccctgctccgtcctcctgctcctcctcctctgcgcgtccccgctgtgccagggccaggccggacggcacaacatcacggagaccctcgccgccgccagcccggacttcgcccagttcagcgccgccctggccgccgcgaacctcagcgccgagatcgacgggcgcagccccgtcaccgtcctcgccgtcgacaacgccgccgtggcgcggctcggggagcggcgcctccagccggacgccctcgcgcgcgtgctctccctgcacgtcctcctcgactacctcggcgacgccaggctccgtaccctcgacggcgggttc

SEQ ID NO: 41696 - DNA, 385 bp, Triticum aestivum
  Clone ID: PAT_TA_41696
cggacgcgtggggagaaatttctttcctactttaaaccctgtattataccagaggaaggtggaattgcatctggtttcaggcacactgaaatcaatgaacgggagcatgtaacacgattatttgtctgcagaggaaagcatacagtccatgtcaaagaggttccttttgcaagatcatcactcaaccatgatgacatatttattttagatacaaagtccaagatattccaattcaatggatcgaattctagtattcaagagagggctaaagcccttgaggttgtgcaatatctcaaagacaccaaccatgaaggaaaatgtgatgtagctgcagttgaggatggaaagttgatggcagacgctgatgctggtgaattctggggtc

SEQ ID NO: 41697 - DNA, 387 bp, Triticum aestivum
  Clone ID: PAT_TA_41697
ggcctcacaattacctactccgccgccccccgacgccgacgaccctccgtcggccccgaactccgacgcccctccgtcgcctccacagctccaggtctccctcccaaacgatatcctggaggagatcctcctccgcctctccaccgcggccgacctcgcccgcgcctccacctcctgcacctcatttcgccacgtcgtcgctccccgctccttcgcgcgccgctaccgctccctccacaaggtccccgtgctcggcttcctccgtgctgacttctacgccgcccagtctccgcacccctccgccccggccgccaacgccctcgcgcaggctgccgacttcgccttcagcttcctccccaaccccgcctgctggagcccccgtgacgt

SEQ ID NO: 41698 - DNA, 283 bp, Triticum aestivum
  Clone ID: PAT_TA_41698
gtagggaaactgtacagctcttgcgtacatgtgctaagaatagtgttcttggctttgcagtgatcagcagatcgaggctatctcaacatatctcccacttggacaagtctgacctcaacacattcttcccaaagttcataaaaacactcacacttgcattccttattcctcagcatccaagcaaccattccctcttccagatcatacatttttttgcggttcttattcgcggtactgtttttttgcagggcatggcttgagcagaacgggggccggggttgat

SEQ ID NO: 41699 - DNA, 379 bp, Triticum aestivum
  Clone ID: PAT_TA_41699
cccacgcgtccgctcaccgtcctctcctctcccctgccgccgccgcgcccccgctttccccaccgcgccccgcaaaccctacccctcctcctcgctccccggcccgccgcccgccgcccgccgcgtcgccatgagtcgtcaacctgaggtgctctgggctcaacgtgcggaaaaggtttacctgactatctcagtcccagacgcagaagatgttgtgatcaagactgaacctcagggcatctttagcttctcagctgttgctcatggggaatcttttagcttggccttggagctattcgattccgtactgcctgagggaagcaaaacaaagacaaaggtgggttcgcgaaacataatctgttcgatccagaaagataag

SEQ ID NO: 41700 - DNA, 373 bp, Triticum aestivum
  Clone ID: PAT_TA_41700
cccatattttttagcttgaaggaggctttcttgatgccattcaccactgtatcttcaaaaatacattgccaaggattgcttcctctttatcctgttacatcgtccgatgccttgtcatcaaccagtactccagcatcaattgcgttctataaggtttatgttctctttggtgatttcttccaacaaactaatggtcctgatgtgaacatactcattgcttatttccatgtttttctttaacttattctgtacatgctttgcattgagtccgtgatctgtcacttttcagagtcctaactgattactcaaaatagcaggataaagattctcagcataatgcttcttcatatagctcgactgactacatatgctt

SEQ ID NO: 41701 - DNA, 372 bp, Triticum aestivum
  Clone ID: PAT_TA_41701
cggacgcgtgggcagatccacagagcggcagagagatcgccggagtatcaggccgaggaagaagtcttcagccagccggatctcaagtcagtcaccatggtggtcgcgctcggccccggcaggttctacggcggcggcctcccgcgcccgcgcgtcttccccggcgaccgcgtcgacccgccggcgcccgtcaccgacgcgctcctctgctgggcgcgcgacgcgcactggtccatgggcggcctcggcgccaagcgccttcgcctgcagggccgcatcgagggcaacctcgttaagctccgccgcaccgcgcgccgcgacgctcgggtctccgccaagtccgccaaggccaaggtccgcgctgcggggcac

SEQ ID NO: 41702 - DNA, 378 bp, Triticum aestivum
  Clone ID: PAT_TA_41702
cccacgcgtccggcaagactgatgtccatgtaaaaagctgcacgacaagtgtaccatccagaacaaaagttcagcaccgaaagaagaagaatgtggaattctctgccgtctatatggctcaagaaatccgggcgcacaacggtttaattagagtgatgaagtttagtccgtctggctggtatttagcaagtggtggtgaggactgtgttgtgagaatatggcagattacagaagtggatgcacattctaaaatgtatgggggagagaaccaccctcatgagcatgtagagaaaatcaaaatccttaagccgaagctagcagaggggcagagccgtgcacttgcagttatgccaagcaagggttttcacattacagaga

SEQ ID NO: 41703 - DNA, 207 bp, Triticum aestivum
  Clone ID: PAT_TA_41703
cggacgcgtgggctaatctatcctgatgaactagaactatacgttacttgtctctataactcaccccgtcacttttacttaatacttttccactgaacattacaccactaactctatacaacatgtcatcttcacactcactatttctttattatgctttcaccttgcttcttcccctttatctttataactacgcgctgcaccttc

SEQ ID NO: 41704 - DNA, 198 bp, Triticum aestivum
  Clone ID: PAT_TA_41704
gttgcagatggggaggcgtgcctttttttgttttttttggaccgaatcccgtcggcttataaaaaatcaatatagagtgcctgttttagtggtaacctgggaaaacgtttcttttttacaaagacccctttatatttgtaagaatacaacccgcgatcctttattttatcttatacagacgtcttctttccacccgcg

SEQ ID NO: 41705 - DNA, 143 bp, Triticum aestivum
  Clone ID: PAT_TA_41705
cagacgcgtgggcagactcgtggtctgtctcgtggtcatgacgccttgaatttatcccgagctccggtgggaagggagcttttaggcggaccaccttgggactttggccgtaccggcttagtcaatggttcgggcccttgggg

SEQ ID NO: 41706 - DNA, 217 bp, Triticum aestivum
  Clone ID: PAT_TA_41706
cggacgcgtgggctgacgcgtgcgccctccagtccgtccgcctcctcacgcgctcctggtggaatctagcaccgccgtctccattttctccatcgacaccaaccccttgctcgcatccacagactgaggtaggatgaggaacctcaagttccacgagaagaatctgctgaagaagaccaatttcctcctgtggaagcgtgagggcggccaccttgag

SEQ ID NO: 41707 - DNA, 349 bp, Triticum aestivum
  Clone ID: PAT_TA_41707
cccacgcgtccgcggacgcgtgggggtggtggtccgtcccaccccacgcccggcgggaccgccgatgtcgccccgttcctcggctgggtgcgctcgcgtgttccagccagccgtccgcgtcgagggttttgactgcctcgacggtggccgtagcggccgtggccatggcatcgccgccatggtctagatgcacatacaacatcgaataaccaggaaatcttctcccctcagtagtgcaaaagctttgggagggagagagatgagagtgaagagatgaatgagaggagccttatgtccaaaattaaccccctaaaacttttttatccattaattaaattccattagtttt

SEQ ID NO: 41708 - DNA, 375 bp, Triticum aestivum
  Clone ID: PAT_TA_41708
gcattttggtctgttggagaaaagtgtagactcaagtattttatgtggtgctactgatatttttggtgaatatgcaaaaatatcaaaaaacctgtcagacaagccccaaagctcctacacagtggacactgatcaagacaatggactgctgccgtctgttatcccgattggtgcaccatggcaacagatacacctattagccaggaaacagaagaaagtatatattgaattgtttgagttgactcctgtcaagttaactttcagttttactagcactccatggctcaataggaatgaaggtgtctcagaccccagcacaagcttcaacaacagtactgcaattcagagaggccttatggctctcattgacgttga

SEQ ID NO: 41709 - DNA, 333 bp, Triticum aestivum
  Clone ID: PAT_TA_41709
cggacgcgtggggttatacatggtgagcgaccctgactgaggggctatggatacggcagctctcaacctacttgttcttgacatttatgggttgaatctcaatgacgtgattatagtcatcgtagcaccgtccttgctgcagttactaaatagagctcttgataggcctggactcatagactgacaagggcatgcgctcttcccggaccttgctggcctccgacagatgctctaggtttacatgcgaaacgtgagttcttccttggatgcggtggcgaggaccatccaacggggggcgccggggttttcaggggctgcccatgctaacctagt

SEQ ID NO: 41710 - DNA, 379 bp, Triticum aestivum
  Clone ID: PAT_TA_41710
cgcatgcatacgggaactcgttcttgtcaggcttgtgtactgcaaacatgtctgcttgccgtgcagcctaatcaatagtgaggtagtgcacaaaaactaaaaaaagggcggtcactctagagtatccaaccttaccttcccgcgcatgcgacgtgatagctattctatagagtcacctagataaaattacctgccgcgagctttacaacgtcttgactgagaaaaccatggctgtacccatcttaatctcgttggagaacactcctcttatctcagctgtcagtagtagacaagagggccggactcatcgtccttacgaacatgtgcacaacctgaatgacgaatgccacgcaccctgcagcgcagcattatgctcggc

SEQ ID NO: 41711 - DNA, 355 bp, Triticum aestivum
  Clone ID: PAT_TA_41711
cggacgcgtgggtgaaattattctaacacgctacaaggaagcttttacggaactagcagttctttcaaagacagcaatatgctgtcgtgttacaccttcacagaaagcacagcttgtcaagcttctaaagtcatgtgactatcgaactttggcaattggcgatggtgggaatgatgtcaggatgatacagcaggctcacattggtgtagggattagtggtagagaaggtcttcaagcagcaagggctgctgactatagcatcggcaagttcaggttcttgaaaaggctcattcttgtccatggacgatactcatacaaccgtactgccttcctttcacagtattcgttctacaag

SEQ ID NO: 41712 - DNA, 170 bp, Triticum aestivum
  Clone ID: PAT_TA_41712
caagttcacctcatcctaggcttcatcgtcgtcgttttaacgaatcgatgatgatgttctgtatgtagttggcagtacgatgttacaatatttgtaaggattgtgctgcctgtgtgtttgaagaaatagtgatgttgctgtttgcaaaaaaaaaaataacacattaagga

SEQ ID NO: 41713 - DNA, 276 bp, Triticum aestivum
  Clone ID: PAT_TA_41713
gacaaacctccggacgaacctcaccgacaaggtgaccgacgagatgatggccgaaaccatcctcgacggcgatgtccacatcaactaccagatgaactacaaggtgatgatggcgaaattagcacccagctgcgcgctgcgctgcatgctgagaatcgtgcattgaatattacattaagtttcaacttttattgcatctattatcagatcaacatcctacctagcttgctatcttaaagcagatcgtacaacgcatttgctgactcaattcctgct

SEQ ID NO: 41714 - DNA, 381 bp, Triticum aestivum
  Clone ID: PAT_TA_41714
ggaaagaagcctgttatgtctcagcattttatcaataaagacaaagatggaactgccaacagccgctgtacttgtgttgcatgggttccagagcgtgaaggcatttttgttgtcagcaatgctgatgggaatctgtatgtgtatgacaaatccaaggatggaagtgctgactgggcatttccaactgtaagggatcaaaatcagctggtgatttcacatgcaaagtccaataagagcaatcctactgcaagatggcacatctgtcaaggtgcaatcaatgccatttcattttcgccggatggagcttacatggcaactgttgggcgagatggttatttaagagtatttgacttcgcgaaagaacaactaatatttggtggg

SEQ ID NO: 41715 - DNA, 372 bp, Triticum aestivum
  Clone ID: PAT_TA_41715
gaacctttctccttctgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgccttgccatcgtcaacaagccactggcctcgccgtcagcactcgctcgccagtcccacccggtgagctcgtgcattcaacccgagtacct

SEQ ID NO: 41716 - DNA, 182 bp, Triticum aestivum
  Clone ID: PAT_TA_41716
caagaagcaccagatcaaagtggcgctcctcccgctggtcctcgcggtcctcatcgtgttctgcgccgcgcagaatccaccggtgcaatcgtcgccaacgcccaacgcgccttctgccgtgaaccagtctggtgctcccaacgcgcctccggcaggcaaccctgctacagctcccacgcgac

SEQ ID NO: 41717 - DNA, 382 bp, Triticum aestivum
  Clone ID: PAT_TA_41717
cccacgcgtccgcggacgcgtgggaagcatagctataaagcacatgtttatgtaattggatattcgattgatgacttggagggtattatccctaccacctgcattgtctcttttgttgagagttctttcaggtttttgcttgtgcacgatccactacaggctgacaaggttcgaggtgacattccttgggaccctggtggactcagagcatggtgacgaggagaagcaaggggcacacacaaagaagagtgaacctggagcatccatgaggaagcaaaggtgaagagctgcagttggtgagatgatcgagctagtgctacatcatttgaagagcccggcgagctgtttcatgacccattctgaatatcataaatacatgctg

SEQ ID NO: 41718 - DNA, 294 bp, Triticum aestivum
  Clone ID: PAT_TA_41718
aacgtgagggcctaatccaagtgatcctgtaaaaccagcaagccgctcgtaactgagacctctaactcatgatatctgctctgcagttcgaatacccatcgtcgttcagatgtgagatctcaccaaggcccgcaatgtctcagcatgtgggactcaaaggagggatctcaagcgagggatgagcaacagctacagtcagctctgttcatgtattaacctgaagatgaaccttcagtaatggcataacaccacgaacagtcacttcaagacatgtgtggacctaaagatgatcct

SEQ ID NO: 41719 - DNA, 329 bp, Triticum aestivum
  Clone ID: PAT_TA_41719
cggacgcgtgggggccgctcgagaacgccgccgccgtcgtcgagggcggcgtcgccgccccggtggtgccggtggtgaccgcggcggcggcgggaggggggtcgtacgcgctgctgcagtgcggggaggactcggcgtacgtgcgggacgcgtacgggggctacttcgaggtgttccgcgcgctgctggccgaggacggcgagcgctggcaggtgtaccgcgccgtgcgcggcgagctgccttcggaggaggacgcggcggggctcgacgggttcgtcatctccggcagctgcagcgacgcccacggcgacgagccctggatcctcgcc

SEQ ID NO: 41720 - DNA, 381 bp, Triticum aestivum
  Clone ID: PAT_TA_41720
cggacgcgtgggccaacgcgtcgcagatccagcagatcacggcgcacctggcccactacggccgcatcgagggcaagaacgtcttctactggttccagaaccacaaggcccgggaccgccagaagctccgccgcaggctctgcatgagccaccacctcctctcctgcgcccactactacgccgccgccaacgccggccagtaccaccaccagcagcagctcctcggcgccggcgcggttccccctccgctgctgcagcaccagcagcagcagcagtactactccgcctcctgcgccggcggcagctacgaccagcacctgctcccgacgaccgtcccagcttccgcttatgctgctgctgctgctgggtacgcctacccct

SEQ ID NO: 41721 - DNA, 381 bp, Triticum aestivum
  Clone ID: PAT_TA_41721
cggacgcgtgggaaaagggatatgaaacacaggttggtcgagctggtttggcgttgactgatgaacagaagatcaaaatttctatcgctcgtgctgtgctttcgagtccatcaattctcttacttgacgaagttacggggggacttgattttgaagctgaaaaggctgtgcaaggagcattagatgttctcatgctgggaaggttgaccattataatagcttggcgccttagcctcattaaacatgctgtttacatagctgtaatggaggagggacatcttgttgaaatggggacacatgaagaattgctaaacttggatggcctttatgctgaccttttgagatgttgaggaagcaacaaaactttctaagaggatgcca

SEQ ID NO: 41722 - DNA, 187 bp, Triticum aestivum
  Clone ID: PAT_TA_41722
cggacgcgtgcgctaccggtatgccctacatgcgaaggaaatagcgaagatatttcatgcatccgcgaggtgtgccggtgctattattcaagccaaccggcactgcaagctccgacctaacggttctccaacagacgcctagtgtccttacatgaaggagtaccccgccaagcttacagggcacact

SEQ ID NO: 41723 - DNA, 386 bp, Triticum aestivum
  Clone ID: PAT_TA_41723
cggacgcgtgggcggacgcgtgggtctttttttggagggagcaacaaactaacaactggtctaagtaggaaacagaagacgtcggtcggattagatcacagcaaaatggtccgcggttgcatgcagcaacgcggatgctaccctgcttgcttgcttgctaggtgagtgagctaatactaactagctatctagctagctaactcctagctggagacgaggcggcgtaaggctgcgacggcggcgccacggacaggctcaggtcgtcgctctcgagcgccagccttgccttcgtcgcagggggcgtggacggcagctcctcctcgggggaaggcggtctcttgctccctgcgccgaccggggcggcgctgaggtgcacgccgaagagc

SEQ ID NO: 41724 - DNA, 387 bp, Triticum aestivum
  Clone ID: PAT_TA_41724
gtcactttgcagtgtggactaaataatgaacctaacatctgtttatcatgtcaccttgcaggtccagaacttgacagcggcccatgtcatgaaatgtgacgacgatacatttgtgagggtagatgtggttctcagacatatcaagatgaactcccttggcaaaccattatacatggggaaccttaacctcttgcatagaccactgagaactgggaaatgggcagttacggaggaggagtggcctgaagatatctatccgccttatgctaatggacccggttatgtaatttctggtggcatatcaaaattcgtcgtgtctcagcatgccaatcagagtttaaggctattcaagatggaggatgtaagtatggggctatgggttgaaaa

SEQ ID NO: 41725 - DNA, 173 bp, Triticum aestivum
  Clone ID: PAT_TA_41725
tcgcacgtccgtcttaatctatatggttgtcggagatgccacccacgcgccggcggacgcggaggcgcagtctttgttggagtctttctgcgccttcaccttttcaaccccctacgaggcggacttctttctttagggtcacaactgggccctcgaggccgtcgttcgctcct

SEQ ID NO: 41726 - DNA, 351 bp, Triticum aestivum
  Clone ID: PAT_TA_41726
gtagggccaataccggttgaacactaaggtaccccgtttaggatgaaaggaggcaccgtctgtgtgggttccaaagacattaacgcttttatcacccacagctaacctagaccaccttccgattgctaagcctacatagacaaggccagcatgacacatcgcataaactacaccctggccagatggtgcttgtggctgacaatgcatgcccagcaatatgttacatgaaaacgcaggaggcactggtgcttaatcggacagggaagacagggcatttacatactcatacgaggctgctgtacacatatgtgcaggcaacagagaacatactgaggtggtaaccaaacgacc

SEQ ID NO: 41727 - DNA, 392 bp, Triticum aestivum
  Clone ID: PAT_TA_41727
aaaggatattcctgtccttattgcttgccaaggtcccagtggccgtgtcacacgagctcaagttgctaataatagtagaagatgtggagtggctcaccctgcactggtacctgtgagaactgaacaaaaaccgacagcgaaagggaagatgaaacggggagctttggatgagaatacttgtgtaagtgctgtagctaaagctccgcaccctaaaaggagagcagtgctcaaggacgtgacaaacataagctgtgcaaactcatacagaaattgcactgctgtgactaagctacaatcgaggcctaccgaaaggggaggacgaaatcctagcaataacaagcaacgttcaaaggtccctaaaccacctttttctgctcttagtggaactacat

SEQ ID NO: 41728 - DNA, 177 bp, Triticum aestivum
  Clone ID: PAT_TA_41728
cacacacgccggccaccactagggttttaccgatccgcctcaccccacgccggccaccaccagatcccctgcgccctacgctcttaccgctgccgacgatggggggatacgggatccagcctatgctcaaggatgggcactagcatctatcgggcctcgacgagggcgtcctgtata

SEQ ID NO: 41729 - DNA, 129 bp, Triticum aestivum
  Clone ID: PAT_TA_41729
gggacgcgtggggaatcaaccattcgtatgtctgaggctcatgcgaagaggcatctgcgaagctatgaatctcatgaagatggcgacaaagtcattcctgtgctgattgactcatgtcatatgaaccca

SEQ ID NO: 41730 - DNA, 338 bp, Triticum aestivum
  Clone ID: PAT_TA_41730
cccacgcgtccgatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgctttcttaagaagggccgctacgcccagcgcgtcggctccggcgcccccgtctacctcggcggcgttcttgagtaccttgcaacccaagtgcttgagcttgcccggaaccccgcccaggacaacaagaaaaggcgcatcgtgcccaagcacct

SEQ ID NO: 41731 - DNA, 362 bp, Triticum aestivum
  Clone ID: PAT_TA_41731
ctcagttcagttcactacccgcggtggccgcgagaacccggatcgcccatcgacagatggacgcggtcatatgcggcgcccacgaagcgccgcccgctgtcgtgctcgtttccgccggcgccagccactccgtcgcccttctggcgggcaatgtgctgtgcacgtggggcaggggagaggacgggcagctcgggcacggggacgcccaggaccggctcgtgccgacggtgatcagcggcttcgacgcgccggggatcacgtccgtggtggggggggcggaccacaccaccgtctacttcgaggacgtgcaccacgtctacagctgggggtggggggatttccgttggttcgtgctcctccac

SEQ ID NO: 41732 - DNA, 377 bp, Triticum aestivum
  Clone ID: PAT_TA_41732
gagaaaagtagctgcacagcagaacctgagttagaaactaggcagaagagaagaagcttattcagttctgttggtccagatgttgaaaatgaacagcacatggaaatggatacttcaggaggaattaaagaggaagcaatgaatgatctgaatgcagcaaaagttgcagcaatgaaagctgctgaattagtgaataagaacattgtaggatttggagtcggaactgggcggctatccactgaccagaagaagaagctgctctggggtaacaaaaagagtaaccctccaaagacaagtacccactgggactcaaatctgttttctgatcgggagcgccaagagaaattcaacaaactcatgggtgtgaaaagcagtgc

SEQ ID NO: 41733 - DNA, 362 bp, Triticum aestivum
  unsure (1)..(362): unsure at all n locations
  Clone ID: PAT_TA_41733
gccacgcgaacgctatctcaaggggtggtcgatcgcgagcggatggcattttgtagatgttctgatgagtgcacccgatgcctacacacgtggcagaacaaaggcttattcccggggctggaacatataaaatcctgacaattggattttgctgggggaggaccacaaggtcatagagcttgggccacacagtgcctcatctaccataagagcactacccatggttaggagagggtgcccgcctaaagatcttgttggtccaaagctctcctgcaacaataatacatggcggctgctgtcgntgatatggaggatatgataatggtactggatgctttcctagctgccgggccatatatggg

SEQ ID NO: 41734 - DNA, 228 bp, Triticum aestivum
  Clone ID: PAT_TA_41734
cggacgcgtgggcacgcctcatccgtggcgagagggcctaagctgctctgcgcgcgtcgccgactgagccagatgtgttcagcgcttaaagtgttggtacgtgccatggtggatgtagagggcctgatatgatgtgatcatcttgctgtcatcagtagtttagatgaaattgtcgtctatctcgtgctactgctggcgttggtagttgtgctggggctggtgtggtgg

SEQ ID NO: 41735 - DNA, 346 bp, Triticum aestivum
  Clone ID: PAT_TA_41735
cccagcggtcgggcaagcgtgagaactacaaaaacttgctggccagtcaggacgagctggaggtgctactggaggtcatgcatcgccggcatggcacccacaagtgttctactaaatcagagcgagccgggccctctccctcgacaataggaccacggaatccatacaccacacactttgaatctatgcgggcctcagccactaatatacgggggtcctacgcactaacatggtcgatggagccccgacattgctcgccgccaccgctacctatgtcacaggctccgacggcttccccacccacagtgtgacgaacggatgcacgcgcggttcatgctatagctcc

SEQ ID NO: 41736 - DNA, 286 bp, Triticum aestivum
  Clone ID: PAT_TA_41736
cgcaaacccactcgcaccgggccaattacacaaagagcgcccacgcacaaagattccggtgatccctttaggcagctatgctactctgactagagcagtggaggttcatatcgccaacggcgcgagcccagccatcgtcctggacctctggaccacctactgcctcatgcttacatggtacaatgaccgggcattgatcatctgcgaacaccaggggcaccgcaccacgcttttcgacctcggcttctacgatacctaaggccttattggccacacctattagaac

SEQ ID NO: 41737 - DNA, 247 bp, Triticum aestivum
  Clone ID: PAT_TA_41737
acgcgtacgcggacgcataggacctctccatatcaagcaggagctggccaagatgtactggcagaaccgtcgcatgccctactgtatccacatgaggaccggcatcaccattcggtacagccgcgagcgcagccactgtcatcgaaccatgctccgattattaccccgtgattacggggatgactcacgttgctgccaacagaagaagggtctaggttacctacgctacattatgcgacgttggttt

SEQ ID NO: 41738 - DNA, 348 bp, Triticum aestivum
  unsure (1)..(348): unsure at all n locations
  Clone ID: PAT_TA_41738
aaaccctcgccgtcacctccctcccctgcccctccaccggcggccatggagacggacccgcgagagatcatcggcgcctccgggagcgtctctaggagcgatttgcgcgccgaccttgagcgccgcggccaggaccccgagtcgctggatctcggcaccaacatgatgctccacatcctgtacggctacctcccgaagccgcccgtcttccccaccgccaccatctcgcccgccggcgcttccagggtccccgacggcgtcgaccgcatcagccgcctccccgatgtggtcctcctcgacatcatctcccgcctccccgccaaggacgccgcgcgcacggncggcctc

SEQ ID NO: 41739 - DNA, 360 bp, Triticum aestivum
  Clone ID: PAT_TA_41739
aagggaggcatgggtctgggcatgggcggcgccaagcgccaccggaaggtcctccgggacaacatccaggggatcaccaagccggcgatccgtcgtctggcgcgtcgtggcggcgtgaagcgcattttggggctcatttacgaggagacccgcggagtgctcaagatcttcctcgagaacgttattcgcgacgccgtggcctacaccgagcacgcccgccgcaagaccgccaccgccatggacgtggtgtacgcactctagcgccagggtcgcaccctatacggattcggaggctaggccaccaccaccagattagagtgtctggggctcgtggtcgttgatgtgattgcagcatctcgc

SEQ ID NO: 41740 - DNA, 255 bp, Triticum aestivum
  Clone ID: PAT_TA_41740
cggacgcgtggggtgatccatgacgatagcgtcaccaccactcataccgctgtccatacttgcgcaataggatccgttaatactactatagatgacgacttgaccgtctgcgacttcggatgactactaccaccataactcgaaggaagcactgcgaggaaccttaaccaatgacgtctatggtagcatgcttttccggcctacacaggtgtagtactttgagccccgctaggaaggacctcgagttaagtaaag

SEQ ID NO: 41741 - DNA, 378 bp, Triticum aestivum
  Clone ID: PAT_TA_41741
ccgacgcgtagcggactcacttgctgaatctgttttttttttttaaccagagtaacaaacccttgaggagttcgtcgacggatctagacttttaggaaccctgtacggaacccagtggcaaactgactaaaacagggatgtacctgctaacgaactcaaggaccgacccaagtctggaaaatggtttcacgccttagggcaacacgctgggtgccattgttgtgcctgtgggtgcaccttcatcattggggttattatcctttggaatggggcttgcaccctcggtgttgccatttggaatagggttaaaagtgatgcctccatgggctgggctagcgcttgggcccctgccagtgttggaactttggcttggattgg

SEQ ID NO: 41742 - DNA, 375 bp, Triticum aestivum
  Clone ID: PAT_TA_41742
cggacgcgtgggctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcggcgtcaacgaccccttcatcaccaccgagtacatgacctacctgttcaagtacgacaccgtccacgggcactggaagcacattgacctcaagctcaaggaccacaagactctgctctttggcgagaagccagttaccgccttccgcgtcaggaacactgaggagatcccgtggggtgaggctggtgccgattaccctgtggagtgcaccggtgtgttcactga

SEQ ID NO: 41743 - DNA, 381 bp, Triticum aestivum
  Clone ID: PAT_TA_41743
cccacgcgtccgcccacgcgtccgcccacgcgtccgggagcgccgccactgccccccgccgccggctggccctccccgccgcccgcttccccgccgcccacttccccgcctccataccccgccctcacccgcagtcccgcttctctcgtcccctcgtggccgcaccaccccatcggcacggtcccgccaccccgccccacccacccaccgacccaatgttaaaccctagacttctccccctcaaaccctaggaaaggacacatgtattgtcggagccgccccgcctgagcgcggaggaagcggagccccggagcccctctgcggaggagaagaggtccaggaggccccgcgtggctagaagggagcgggcaaaatgaggat

SEQ ID NO: 41744 - DNA, 201 bp, Triticum aestivum
  Clone ID: PAT_TA_41744
aaccgcccggaagcccgggagacccacgcgtccggaggctggaccaccgcaaacctgggctcgcagctgcggcggcggcaccgaggggcccgggaactgctgctaccgagggtagtaggccggacatatataatatgaaggccgatctctgtccgattagaattaagcaacaagataataaaatgacccaatgagcgctct

SEQ ID NO: 41745 - DNA, 334 bp, Triticum aestivum
  Clone ID: PAT_TA_41745
cggacgcgtgggcgccgctgccgccgccgcctctccctcgcactcgtcgccagcgcctctccgtcgcccgtgttgccggcgcctctccgtcgcccgcgtcgttctgcctctccctcacgcgtcgtcgccgccactccattggccctctcgtcctcaccccttcaggaccccatttttactttccgataggtggatccgaagcgcggcggctcgaccggcaacggcggcagctgcggattcattgctcctgcgtgcaccgtgcgctccgcggcctcatgttcagcagcagcaacaaggccagcaacggcgggagggaggggcagggcaacttcat

SEQ ID NO: 41746 - DNA, 121 bp, Triticum aestivum
  Clone ID: PAT_TA_41746
cggacgcgtgggcagcggccaatctataagattacctcatacgtacactggcatgcgacccgttagcttttccatcgcggcacctatcctcagtcaagtagcggcggcgtcacaagcgcgt

SEQ ID NO: 41747 - DNA, 383 bp, Triticum aestivum
  Clone ID: PAT_TA_41747
ggaggaggggagaagaagaccttcggccagctgcgggaagccgccgggggcgtcctccgcggcatccaccggcgccggtggcgggcagaagcgcaagtgccatgaccacgcgcactccgagaacgtcgccggcagaaagtacggcgcctccggtggccgctgccactgctccatccctcctcatcgcgccgccaccatcccttctccttcggcctcgcctcttcctcccttccctaacctagggtttggtgggtgagcttagtgtcgtctgccaatggtggacaaggagaaccggcatgaaccacgcacagggaggagctcgacctctacttgctatgcatgcccccaggtgagctgattttcttattttaataagctttttt

SEQ ID NO: 41748 - DNA, 372 bp, Triticum aestivum
  Clone ID: PAT_TA_41748
cgctttcccaatccccctgccctctgtcaccgccctcccaatccctctgccctctgtcgccgccctctccctctcgtcgtcgccgcactcccactctcctcgtcgtcgcgctctcactcttctcgtcgccgcccactccctctccccgtcgccggacgagatgggctgctttggatgcttcgccccagcggcgcgccgaggggccggcgacctcaagccctgcaagctcacccaccactgcaccgacgacgactcatgtcatcttcttgactgatttctgcccgtcccctccccgccttgctgctggctggcgcaaagcactcttctttggtttgattctttcctaatccgggtggggtggtggggcttgga

SEQ ID NO: 41749 - DNA, 395 bp, Triticum aestivum
  Clone ID: PAT_TA_41749
gcgggaaggagacgagagagaaaccccacagaccgctccaaaccccggcacgcccctcccccacaactccgccgccgccggtcgccatggagaggaagcaggccgactacagcaacctggacgagaggtacaccatccagggggagaggtaccagggccagcagtacagccacatctactacacccgcctccaccacatgcgcaccctcctccacgccctcgtcccctcccggaagccgcacctccccgtcactacagtgcttggactcgaagaaggaaaagattgtgtgcttgttgggactttatacaagcacatgaaacctgagccttctattctcgaagaatactcaaaggagaggtcggcaattcctcttgttaagccacacaatttcatg

SEQ ID NO: 41750 - DNA, 284 bp, Triticum aestivum
  Clone ID: PAT_TA_41750
actgtatgtggtaatgtcgtatcacttcaggtcattcatccattaatcgatcagatgagagatcaccgcaacgaaatgatgcttgcgattacaaggatgctaaggcagtagcgaagaaatgagatacgtatgagacatgatcgctgctgttacaacaaggaacgcctcggtgtgcctgcctgcctgccactgagcagagctgaagctaacagagcagagcaatctatccggtggccattgtcatcgccatcgccatcgcgcacgaaggaaggtcacatgattag

SEQ ID NO: 41751 - DNA, 402 bp, Triticum aestivum
  Clone ID: PAT_TA_41751
cggacgcgtgggttcgaagttgatcagcccaaggacttgttcctctactgctagtacggggcgatgatatatattgggctgaagaagttccgtaaagcattggagcttcttcacaatgctgttactgccccaatgtcgtcattgaatgcaattactgtcgaggcttacaagaagtatgtcctagtttcactcattcagagtggacaggttccgtcattccccaagtacacatcttcgactgctcaaaggaatctgaaaaatcacactcagatttacgtcgatctgtctacatgctatggtactggtagctactctgatttggagacattcatccagtcaaatgcagaggccttccaaactgataacaactttggactagtgaagcaagttctttcttcaatg

SEQ ID NO: 41752 - DNA, 401 bp, Triticum aestivum
  unsure (1)..(401): unsure at all n locations
  Clone ID: PAT_TA_41752
gttatgattgatgtgggaactaacaatgagaaactcctcaaggatcctctttatcttggcctgcaagaacaccgtcttgagggagaagattatgttgaaattattgatgaattcatggaagctgttttttctcgttggcccaatgtgattgtacagtttgaagatttccaaagcaagtgggccttcaggttgttgcagcgttacaggaagacttatcgtatgtttaatgatgatgtgcagggaactgctggcgttgcaatagctggtcttcttggagctgtaagagcacaaggaaggccaatgatagactttccaaagcaaaagattgttgtagcangtgctggcagtgctgggattggtgttgtgaatgctgcaagcaggaccatggcaaggatgcttgg

SEQ ID NO: 41753 - DNA, 407 bp, Triticum aestivum
  Clone ID: PAT_TA_41753
cccacgcgtccgctccagtgatatggagacgcgtctccacctccatgcgttggcgatccttctggtcgtctcggcgcggcctccctccgtcgccggcgggctctgccgcgacagctgcggcgacgtcccggtgcgctacccgctgggcatcgacgacgggtgcggcagcccgtactaccgcaacatgctgacctgcgccgacaacaccacgctccgcctccgcaccccgtccggcacgtacccggtgtccggcgccgactacgcggacccgcacctggtggtgacggacccgtccatgtggacgtgcgcgcggcccttcacctacgtccacgccgcgcccttcagcctggacaccagcacccgcttctcgctgtccccgaggaacgaccacctgttcttcaactgcg

SEQ ID NO: 41754 - DNA, 356 bp, Triticum aestivum
  Clone ID: PAT_TA_41754
catcacatgcgtatagtaagtactacgtactagctatcttgatttgatggcgtttccttttcgtagacatggcttttcctttctcgtttcttaaagcaatcatcactcctcctttagtcttagtgcagcaaagtctttattggtccttaaggatgtctggcatatacttagaaactaagaatatgcaaagacaacgattacattctgtcgatcatgtaccaagtacaacattatcctggttaatgcaaaatccagtcatcctctaatccttcaggttaatggtatcttttttggattataggctttggcaggtgggccactggtgcaagctcgaaattttgcagtcatgactggtg

SEQ ID NO: 41755 - DNA, 404 bp, Triticum aestivum
  Clone ID: PAT_TA_41755
caaggcaatcgaccttccttggatggcagcgatgaggattcaatgcctctgccaaatccaatggttggatttaacctgcctggttacagtggaccatcagtgacccgaatgctttctaaactagataccggaccaccttttttctattacgaaaatgtggcccgagctccaaaaggtgaatgggcgaaaatttcaagaaatctgtttgacattcagccagagtttgtggattctcttcatctgtgtgcagctgcaaggaaaaggggttacatccacaatttgccaattgagaacagatcgcctcttcttcctctgcccccaaagacaatatttgaggcatttcctcattacaagaagtggtggccttcctgggacacgagaacacatctcaattgcttacaaac

SEQ ID NO: 41756 - DNA, 280 bp, Triticum aestivum
  Clone ID: PAT_TA_41756
agcggccgctcgtgatcaacaatagcggccctctacattatcagccggcctcaccaaccaccagcagtgctgtgctgtgctgtgctggtacgaaaaaccacaatacaccaacgaccagccggccagacagccagccgccgcaaaccatggagaatagttcggcggaggcgaagcatcatcccagcgcggcatgttctgcggcggaagaagaggaggagaggaggaggaggtggtgcacatcaaggacgccgcgaagatgctcgtcgagcaccacgtgaag

SEQ ID NO: 41757 - DNA, 268 bp, Triticum aestivum
  Clone ID: PAT_TA_41757
gagggcctcctcggcttctcgcctcctttaatcctctccccacgcgaaaccgtgggcgctctcgtctccctctgctcctcgctcctccgccccgtggcacccggccctccaaaaccctagccgtcgccgcctctcgatctaatgctgtgacctcccgacaccgtccccgcctcctcgcgtcgcgatggaaggccccgtccctgccccctcctactcctccgccgcacccgccgtcgctagggttccggccgccgcgccctacgctgcc

SEQ ID NO: 41758 - DNA, 199 bp, Triticum aestivum
  Clone ID: PAT_TA_41758
cggacgcgtgggtggagttatcctaagtgttcaattatacctagttggccgacttcccaattcaatagtacaaccaccactctaattacaacaaccactacttcaaccttaaccagaacaatgactactaagtctactattatttttttcccttcaacgcttactgaaatcaactagtggtatccaagctcagatttct

SEQ ID NO: 41759 - DNA, 244 bp, Triticum aestivum
  Clone ID: PAT_TA_41759
cccctagttcgcccacgcgtcctcggacgcgtgggatgcggcaacaacgtggcggaatggctatgaagcgtgaacgaaacgtttcttatgctctacaccgtgtagcccaatattgtggggcagtatcacgaggtggagatgcttaggattctacttgaacgtctactctgatcaagctcggagcctgaggctcagacgtgtaacaacaaaaaaaaacatatgctgacctaggagtagaacccga

SEQ ID NO: 41760 - DNA, 386 bp, Triticum aestivum
  Clone ID: PAT_TA_41760
cggacgcgtgggttccctcccccccgaaatctgaatccaaatctcggccgacgccgccgccccatgcctccctcgccgtcgcagccgccgccgccggccacggaggaggtcgaggtggaggacgtctcggacgacgagacggtggagggagaggcgccgccacttgccccggccccggctccggctcctgccccgccggccggcggaggtgccgaggcgagccgtgccgcgtcggggtcgggggaggcggcgggcggagaaggggccgacgaggaggaggaggacgaggatgaggacgaagaagacgactccgacgacgaagaggacgaggattccgaggatgaaggggacgaggacgaagacgaagactccgacgaggaggggga

SEQ ID NO: 41761 - DNA, 201 bp, Triticum aestivum
  Clone ID: PAT_TA_41761
cccacgcgtccggaaccggacatcgcagattattagattaggtcaggtgaagcgcttggcctatcatgagctatttaaacattttctatgacctgtagcctgtaggccaatactgtggtgcaccctcttgtcctgatctggattggaattagagttcaacgcttactgtgatcaactagtggtatccaagctcagatttct

SEQ ID NO: 41762 - DNA, 313 bp, Triticum aestivum
  Clone ID: PAT_TA_41762
gaagagtcgaaaatgcttcagccacacggtccgtcaactgacgccaagcgagagcagcgctgaacggctgcctctcctcccctgccgcccgccgccggcgacggcgagggcaggtgttcgacgaaatgtgcgcgcgggggccatccgccagggactggtccgagatgcccctggacgctctcacctgcgtcttcgccaagctcggagccgtcgagctcctcatgggcgcgggcctcgtgtgccgctcctggctccacgcctccaaggcgccagagctgtggcgggccgtggtgatgtcgcgcccgcccgacac

SEQ ID NO: 41763 - DNA, 282 bp, Triticum aestivum
  Clone ID: PAT_TA_41763
caaacgcctaaaatcccataaacacaccatacctcaacttacaccaaggtgaagcattactgaacggttgacacttctaccttgccgcccatcaacaccgacatacatggctaaaattcgacaaaatgtgctcgcggagtccattcatcaggtactgtaacaatatccccatcaacacctctcacctgcatattctccaagctctgatccgtcgacattctaatatgcacatgcctaaggtgccgttcctgacttcacgcctcaaaatccccatagatatga

SEQ ID NO: 41764 - DNA, 403 bp, Triticum aestivum
  Clone ID: PAT_TA_41764
cccccagccgccacaccctttcttctccatggctcggctcccctcccgcgtgcgtccctgcggcgcctgtgtatggatgaggaggtcgagggcacgagcaaggatcatgccgaacaggggcgcaatggggtggccggggagcgcgcggtgtctggagagacaaagatgctcctaagcagaggacggcgcagcgctggcttctcctctccccccgctgcctgcacacctcgccgatgtctgctcgtcatccgagacaactagcgatgataataccttggatgcgagtgatgatggattctttacttctggaagttcgagtgatgaagaggcagatggcgagcttaccgataaaagtacagcgttggcgatgaagcctgctggcctttttcttgaagcaattctt

SEQ ID NO: 41765 - DNA, 142 bp, Triticum aestivum
  Clone ID: PAT_TA_41765
cgcggacgctttggcttcgattgttcactcaccgagcaccgacaccaaccctgggggctttcaacagacagcgcagaacgccgacgctcatggcacacaaccctggggcacgctgtgcgcgtcctgaggccactcatactac

SEQ ID NO: 41766 - DNA, 298 bp, Triticum aestivum
  Clone ID: PAT_TA_41766
aagatgcaaaacatattccaagcacatcgcggaacaagagatgcatcatgccgataacacgcatcaccggtgtgtttccgccactgctcgtggcaaatgcataatactatctagcttgtgcttgcaaacagaatgtccgtgagcagatattgcttctcaaattattcctttttccagccgcagagcagtcacccagcacaggctaaaacagggctgctgcaatctattcttcttgtctcctaggatgaaaatcccaatctgacagatggcccaacaagcattaataaaacaaacaaac

SEQ ID NO: 41767 - DNA, 350 bp, Triticum aestivum
  Clone ID: PAT_TA_41767
cggacgcgtgggcggacgcgtgggctttgagatccaacatggtaatgaagagacattcagggagatgcttcgcatcaatcgtacagtggccgctagccgcagtcagactcatttcatccttccggagtacctgatgcaaagggaccagaggctaaacatggatgaggcggtcgacactctgacgcgtgccggtgtcccgcaggatgagatggccgccttagaaaggcagctagcttctggaccatccccggcgccagcagcggctccaagcaccagtacgactcctgcaaacagaatgatgaactttgttagtgccggagtagaggcacgggccgagagcagcacgcaac

SEQ ID NO: 41768 - DNA, 398 bp, Triticum aestivum
  Clone ID: PAT_TA_41768
ggagaaggggcatgttgaggctgtgcgtgaggtattgaagttttgtgatggtcagtcagctgggctgaaggcaaacaatagcttcgatgcattccatattgcagcgaaacatggccatctggatgttatgcaggagctattgcgggcatttcctcaggtacattatacatcaacttctctgaataccacagctttagacactgccataacttcgggccacattggcattgtcaaatttctactggataccgagccaagcctttcaaggattgcaaaaggtaatgggatgacagtcttgcattcagcagtatcaatgggaaatgtggaggtggtagcgttgttattgaataaagacccggggattgcttttagaacagacataaagggacaaacagcac

SEQ ID NO: 41769 - DNA, 364 bp, Triticum aestivum
  Clone ID: PAT_TA_41769
gtcggacacgtgggcgcgtgccctcctcctcctcctcccggccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctcgacttccagctgcaggagggcgggcgcaagctcaaggtggacgcctggttcggcacccgcaagaccatggccggcatccgcaccgtcatcttccacggtcagaacctcatcaccggggtcaccaagggcttccgctacaagatgcgct

SEQ ID NO: 41770 - DNA, 379 bp, Triticum aestivum
  Clone ID: PAT_TA_41770
tgcgattggagtgcgttcagaccattttctcttcccatctccatacatgcgccacgcctccacccagagttcccaattccacggcctccgggcctcctgccgccgaagcaagctcgccgcctccacggaattcttctgcccccttccaccgggccggcgtggagccgagatccgtccccgctgattcattcttctggtctggttagagattcgatcgctccatctacgaaacaaaggacacataaaagagcaaaggtgcctgtggggaaaaccccgcgttactttttgtaacttaggaggtgaaaggaagagaggactagagacgaggaaataataatgggaaagggagatgtggccactaagtccaaatcccagaaat

SEQ ID NO: 41771 - DNA, 365 bp, Triticum aestivum
  Clone ID: PAT_TA_41771
cggacgcgtggggcgaggttttttgaaagcgtcctctctctcctctccatcaacaactgcccccgacacccaacggcagccgtagcgcgagcgaggagaggggggataaaaagctctgctctttaacgcccgcccctagggtttcgagccaccgcgcgccctcgctccctccctcccttcccttcgcgccatctcccgccctccccccgatcggctcgccccctcccggattcgatcccccgccccgctcgatctggttctcctggtgatgagggggcggtagatgggggccatggcggaggaggcggaacacgagggctgcgtggagaaccggcagcccctcgcggcgtcgagcgagtcggtgt

SEQ ID NO: 41772 - DNA, 425 bp, Triticum aestivum
  Clone ID: PAT_TA_41772
cggacgcgtgggtgcacgcgcctccggcctccgctccgcctcagccatgggggccctccgcttccccgccgccaccttcgcccacctccccaccccgccgcctccccaccgtgccgccatcgccgccgcaattgccgccgccgcggctgcggcagccgcagccggcttcgccctgaccgccaaatctgccggtcggccgctcccgcgcccgtcacactctgcatccctctgggcctccctctcccttgccgacagcggcgcccccggcaacgtcgagccccgcaccggggccagattccccgccgagaccgccggcgggcgccgcctcctcggcgttggcctccgcaagaccaccatccttggcctcaagttcatcgacgtctacgcgttcggcggttatgccgatgacagcgaactgaagcagc

SEQ ID NO: 41773 - DNA, 406 bp, Triticum aestivum
  Clone ID: PAT_TA_41773
cccctcgcgccgccactttccaaatcccacatcgggatcctccctgatcccctcgtccaccttgttttccctgtcgctcaaatcagggcctcccctgccttcccaatccatcgatccatccaaccatcagccagccgcagcgcctccctgctcgatcgtgtgctcgaggcgcccgagcacctcgtgcttctcctcgtcggcggagacgagcaccaggaccaggccgtccccgcaccgcaccctgcctctacttctcttttgcttcttcccctacttcttctcttttcctcaccccggggtctttctctctttcttcaaggaggaccagagcttggccggcatgggcggcttattccggagcaaggttggtgggcttcttaaacaacccgggccaccaacgacaggt

SEQ ID NO: 41774 - DNA, 342 bp, Triticum aestivum
  Clone ID: PAT_TA_41774
cccacgcgtccgaagaaaagtaagaaaaagaagtccaaatctgaggctgatggtgacgccatggatcttgataagcctgccaacacggccgcagcagaggaagggacagagaaggcgctcttcagagctcttaaaacgcgtggaaacacaccgaagtatggcctcatattccactcatcttttattggtcgtgcatcgaccaagaacaagggaagaatggctagatacctggcaaacaaatgctcaattgcttcacgcattgactgttattcagatatgagtagctcgattttcggtgagaaactgcgtgaacaagtggaggagagattagacttttatgac

SEQ ID NO: 41775 - DNA, 308 bp, Triticum aestivum
  Clone ID: PAT_TA_41775
catacacccgtacaagctttacagattacttgataaattaatcatgctgaggtgctacctcgttccgagaaacaagatcgcatctgttgtaatatcatcacacataacgaggtaattgtcaggatgaacatacggaagaaacgtcctatgaggattattgaactgactagatatcagctgagcttacattaactttaacgacgttctttggatcaaataacgaccttacttgtatcataggatgaaaaggttcttattcttcatccattacgatttttttcttcgtggtcatctatcacgacactggt

SEQ ID NO: 41776 - DNA, 317 bp, Triticum aestivum
  Clone ID: PAT_TA_41776
ctgacacctaagataaagattgagatatctacatacgtgacactcttcggccgtcgggacggactcagtaatgatcgaacgctaactaagacagttactagattaggcacaacttttagcatgacagactcgaacagtcgtgcattcttaagatcgcatttctaaattgtcttcccgtcaccctctttagtttcagagagcgagtcaacaacgaagaaggtctttttggcgaggcactggatagaatagcatacttcttagtcatcaaacacgattagtttttaataggaagctaatacccaagcatattatgtaat

SEQ ID NO: 41777 - DNA, 186 bp, Triticum aestivum
  Clone ID: PAT_TA_41777
aatacacctgaaaaaaaagaatcagttgtcggacatactgaacatgagcggtagacgtcggtgagctcaccaggccgtaccgtattcgagaatccaccacgagcagatgagagaggggacacggaaccgctgatgtatccacctcccgctgcttcgcatgaacgaggtgcaaatagaggagggctg

SEQ ID NO: 41778 - DNA, 351 bp, Triticum aestivum
  Clone ID: PAT_TA_41778
cggacgcgtgggcaggggtgactctagatcgaatccatccattagctggggggcttacgccttcccaggccctagacgcccgacaaccgaactcccaggcccccgacgccgaacttccaggcccgggaaaaccccatcttaggctcccgacgccgtcctgcccggctcccgacgccgtcatgtcaggctcccgacgccgacctccccgggccctcgacggcagctgatgggacgcccgacgccgccctcccaggatccccactccatcctcacattaatctcggcgggagctgtggttacgcccaacgccacccttacaggagctcgagtcccagctccccgggccttcga

SEQ ID NO: 41779 - DNA, 416 bp, Triticum aestivum
  Clone ID: PAT_TA_41779
gcgcgcacaaaaaaagatggaaacctactccgacctcggcaccgacggcggcagccctgctccgacgaagccggcgatggaggaaccacgcgccgacgccactggaggtccctacatagttggccccgacgctgctcccgccccccagccgggtaccgccgccggcgcgaggaagcggaaggccccgacgacggcgacagcgaaggccgccaggaagcctcgcataccgcaggttgaagaaccgatccagatgcatgtgtactatggacttggagaaatgtttgacagcgttcagggcgatgatttagttgaagattcgttagacacttttgtagagaacaactgtgcacatgtcatcggcgagctaccgctgcagcccgaatcgatgtcattggtggatctacagctcttgatct

SEQ ID NO: 41780 - DNA, 295 bp, Triticum aestivum
  Clone ID: PAT_TA_41780
ccgcccccaaaaaaagaacgaaacctacttcgaccttggcaccgaaggcggcagccgggcttctactaaatccggcgaagagacaaccacgccgccatcgtcactgaaggtccctgtatagatggaccaaacactacaaccgcccactatactactacttatctagacaagaggaatcgtaaggccccgtctacggcgacagcgaataccgctaggaagccatgcatatcgcaggtggcataactcgacgacatgcttgcatactatggacttagactaatttttgatagcgatg

SEQ ID NO: 41781 - DNA, 420 bp, Triticum aestivum
  Clone ID: PAT_TA_41781
gaatctaattaaccctttattccaacgatgccctaggaaattcaacaggttacaaaattgcaccataccgcattaagcaagcaattcaggatgcgtccacacgacaacggccatccgttttaacgacataatacatctgaatcatatgacaatgactttcacggttcagctaacaactactacctccgatccataataagggtcgcagttttgaactgaccccagttcaaaaccgtgacacttattttggatcggggggagtagctagtaaccaactgatgctgcgtctgcttaaaactcaaccaggaagaagaatttgtcacgcagaatactacttctctggtggcgaggtcagctgccttaagttgaacttcgaaagctctttgtatctctccaccactccaatcatgcatatagtct

SEQ ID NO: 41782 - DNA, 436 bp, Triticum aestivum
  Clone ID: PAT_TA_41782
ccgacagccgggaaaccaaagatggccctatagttaataaaagcagctgcaatttacttgcacctgctgtaacccgatacttcgcctctgatttgatcgtctcgaggaggtcacttgaaggcaaaggtagagctgtgaaagataaatgcactcctttgcttccagatccaccaagcggtgagctggatgaaggagcaagtcccatgcctcggcctggacggggcgatccgatcacagccttacaccaggcggcgaacacagcactggcctcctcgggggggttgatccaaggcagtgcctcatcctgtaatggcggaaaagttacaaatatttcttgcatctgcagtttctatcctaacttcctgtttttttggtggtgaacatgatgagttgagatgtcaaaatgtgtatcacttgtcagcatacgtttttaata

SEQ ID NO: 41783 - DNA, 368 bp, Triticum aestivum
  Clone ID: PAT_TA_41783
cggacaggtgcgcttctgacttacatagggacgattggattctaagaggccatattcttgtgctgcttgtgctagctagctaggggctaccaattttcagccagggacttgtaaaccagtgctctgcaggaggtaccagatcccatggccggcaaggaaatctaccacaagatgaaagacatggtgaaagatgctcttacatcatcatgaccagaaacagggaaaggcaagacaaaattgttatgcaggcgtgtcaagcatggttaccatcttgtgaagggggaatcaaatcattcaatggtggactacttgttggcggaatatagtcaagttgaggagcatgattttggtttgtttgcaatttttga

SEQ ID NO: 41784 - DNA, 383 bp, Triticum aestivum
  Clone ID: PAT_TA_41784
cggacgcgtgcgttgtctcttagctgctttcaatacatcattctcataattaggtgatcaaatccaggattaactccatgaagctctcaacggagcatacacgtgcgcatgctccatcaagcgtgccttcaattgagcagacattcacatgcgcctacacatggtggcaaccttggctgaaactattgcgcacattttcgggctcattttgaggatggttacgacagtggtcacctcagcaaaattcgatactgatctggatactgtattggttagacactttggaagacacatgggtggctataaggttgtctccattgaagagtctattcatgacacataaatgcccacatacctgcgctcagtcctcacttaacatggca

SEQ ID NO: 41785 - DNA, 280 bp, Triticum aestivum
  Clone ID: PAT_TA_41785
ctcctaccgacgtcgccgtagtcgacgtctgactagagccgccgtcggcatggggagaagacctgcgaggcgctatcggcagatcaagaacaagccgtaccccatgtcaaggtactgccgtggtgtgcctgaccctaagatcacagatctatgatgtttgcatgaagaagaagggtgtagacgagttctctcactgagttcaccttgtctaatgggagaaggagaatgtgttcagtgaggctctagaggctgcccgtatcgcttgcactaagtacatgac

SEQ ID NO: 41786 - DNA, 367 bp, Triticum aestivum
  Clone ID: PAT_TA_41786
aaaatggctggtgttgctaggaaagggaggtccaagtgggacacacaggaaagttctcctgatattgttgagatcagtgaagatgactctcctcctaagaatacagatgatcgccgcaaagatgtgatccctactcaggatctcactaatgataatggaaagcgacttggtgaatcttctaacctaaaacctgatgccttcatgcaccaaggcagtactgaatacgagcaggaacgcactgatgggttaaataaagatgtcaaggaaaggcaatctaaagcgtcatctgaaaggtcgcatgctcctagaatggctgaagaggggcataaaaaatgatgactggggtaaagttagcttctttgggaaa

SEQ ID NO: 41787 - DNA, 436 bp, Triticum aestivum
  Clone ID: PAT_TA_41787
cccacgcgtccgcccacgcgtccggaattctggtggtgaagaaagagggaaacggaaggttatataagtcgtcgtggatcacagttggctttaaagcatctttgtgagaaatttggatcatcattattcgaaaaactccccaagttgtgggattgccttaccgagtttcttgaacctattaagatcgaagatgacattcacaaagatgatccaagtataacacatctaggcagatcttgtgaggataaggacccacagtccctcataaataacatccaggttgtgcgttcaattacaccttacctgcctgagcccttgaggcctcagctggtaaggctccttccctgtatttttgggtgcgcgcgtcattctcatgtggctgttaggttagctgctgccaggtgtatcacgtaaatggctaaatcactggctggta

SEQ ID NO: 41788 - DNA, 418 bp, Triticum aestivum
  Clone ID: PAT_TA_41788
cggacgcgtgggcggacgcgtgggggagaaggacgaggaacaggataaggatgggttctttaagaggttgcttagagacagcaaggacaaggaggaggatgatggagacaaggaaggttttattaaaaggttgcttaaggatagcaaggagaaagagaatgatgaggaaaaaggggataaagatggtctcttccgtaagttgcttaaggaccacaaggaccaagattttgaacttacacctaacttggatgggttggttaaaaaactttttcctgacaaaaaagacagaccgggccaccattaccagaaaggagggttttttcgcaagatattcaagggttagaatgaggagaggagagaaagcatgcatggaaggcttggggatgaggaaagagtatgtaagagtttggaggatgat

SEQ ID NO: 41789 - DNA, 330 bp, Triticum aestivum
  Clone ID: PAT_TA_41789
cccacgcgtccgcccacgcgtccggccggcaagcgctacgtcaagctcaggctctccaccaaggccctcaagaccatcgagaagcacggcctcgacgccgtcgccaagaaggcggggatcgacctcaacaagaaatgaaatgatcgatgagccatagttaaggtctcctagcaacaacatcttcttgatttcctcacatcaaccatttcaatgtaatgtaatgtaatgtagtatgcaaaatggatttatgttcagctttccttttctccccttttcttgatttgctattttccttgatgagttatataatgttaagcatcatactggatc

SEQ ID NO: 41790 - DNA, 441 bp, Triticum aestivum
  Clone ID: PAT_TA_41790
gttcatcaagttcatcgagggcagccgatacgtccccgtgaggcccgccccctgtgggttcatcctcctccgagacacgcagcccagcgaagcggaggagctcgtgctcaccgacgcccccgcgaccgtggccacgggcaccggcaacaacgcagcagccgctgccgcggggcaaggctcggccgccatggccgtcgacgacgagccacagccgccccaacctttcgagtactcggcgtaggctcctgtgataggatggagcgttgtctgtactcacccactagctatacgttgttgcttattcctttttcaagagtgcgagggaatttgttgtttgttggaaactgtgtagaatcatcatgagtagagaactcagactctgaacgggagttacaggatatgtgctcagccatgtttgcatcaaggaagaacgattgattt

SEQ ID NO: 41791 - DNA, 381 bp, Triticum aestivum
  unsure (1)..(381): unsure at all n locations
  Clone ID: PAT_TA_41791
cggacgcgtgggcggaccgtgggaccacgagccacttcctcccctccaactccaacaccaacaccaagctcgcgctggctcccgacggtcactgttcaccttttccccgtaacaggaacaagtagatctcagggggaagagagagaagagcgtcctctgtcattacttcactttcactcaagaagaaagaaacatcgcgagattggtagaagcaagacgcaggcggaggaggaattcatagtagatgcgtgcgcgtcgatgaggattcgggggctggcgatgagcggcggcagggaggtggccatctccgccgtcttcacggcgctcctcgtcgtctacatcctctntctcccctcggtcctgctcaccagcggcaggctc

SEQ ID NO: 41792 - DNA, 346 bp, Triticum aestivum
  Clone ID: PAT_TA_41792
cggacgcgtgggcggactcgtgggggaaaaagggcggacacgccaggaaagaagaacgagaaaggagtccaagaaacgaccagaccaggaggaaccaaatccctggaccctccctcgagaccttgagttgataaacaatccattttttcaagagctgggctgcagtccgcacgcacgcagggggacagtgcggagatgaagagccgaggtggtccgcggtccccatcctacggattaggacgggatccggccgcgccgccctggacatggacatcatctacagcatcaagtgcgtgtcgacgtccaacggggtcgaggacgacgaccccatgtactccaacctgcc

SEQ ID NO: 41793 - DNA, 439 bp, Triticum aestivum
  Clone ID: PAT_TA_41793
cggacgcgtgggggtctgtaccctcacttaaacactctcgcctacccgggctcgacccccctcctcccttcttctccctcgccaagaacaccgccgcagccaccgcgatcgatctgtttctctgtctcccgtgcgcgtctggagcggcggctggggtgggcgccatgatcctatgaaggagaaggagaaggagaaggagaaggagaaggaggaggaggaggagaggggatagataggtggctgcgtgacaaaggggccggatcgatgtacacgaaccagctgcaggagctggcgcagaggagctgcttcagcctgccgtcgtacgtgtgcacgcgggaggggcccgaccatgcgccccgcttcaaggccaccgtcaccttcaacggcgagaccttgcacgggcccacctgctgcaccacgctccgccaggccgagcacg

SEQ ID NO: 41794 - DNA, 435 bp, Triticum aestivum
  Clone ID: PAT_TA_41794
gggctagttcctactggagatcagttaaggttggttgggatgaatcaactgctggggaaaggccgcctagagtttctttatgggagattgaaccattgacaacctttcctatgtatccgtctttgtttccgctgagggttaaacatccctggtattctggtgtagcaggccttcaagatgacagcaatgctttgatgtggctgagaggagttgctggagatggaggttatcagtctatgaactttcagtcacctggtattggctcctggggacaacagaggctccatccttctttgatgagtaccgaccatgatcagtaccaagcagtagttgctgctgctgccgccgcctcccagtctggtggttacatgaaacaacaattcctaaaccttcagcagcctatgcagtcacctcaagaacactgtaacctcaacc

SEQ ID NO: 41795 - DNA, 243 bp, Triticum aestivum
  Clone ID: PAT_TA_41795
cggactctctgccgacccctcctcctttaagtttgaaaccatacacctgcgctgggggagctagattacgcgattccaactcaacttccgcaccttcttgactcgcaatcgacatcctacagcctgtacatccacactcacgaggctatacacctgccaaccatcagaacttcctgccacgatctattataagctacgcctccctgcctttacccttgacctggttttcctgacctctgattc

SEQ ID NO: 41796 - DNA, 406 bp, Triticum aestivum
  Clone ID: PAT_TA_41796
ctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctcttgaggctgcccgtattgcttgcaacaagtacatgaccaagcatgcaggaaaggatgccttccacctcaaggtcagggttcacccgttccatgtgctccgtatcaacaagatgctttcgtgcgccggggctgataggctccagactggtatgaggggtgcttttggg

SEQ ID NO: 41797 - DNA, 238 bp, Triticum aestivum
  Clone ID: PAT_TA_41797
ctgacgcgtgggcggacgcgtgcggccaaaaatatttgtagatatgcggatgcgtgatgcatatcagttgtgaactgtgttggatcaaacggaagttcgacgtttgcgattaccgtatacaatcaagtgctcataaccatagcgacacgcgtcagctatatgattttttaaaccagtggcaaacacactgaagtgatctgatgtgatgtgaagagcgagttcatacatgctctgtata

SEQ ID NO: 41798 - DNA, 369 bp, Triticum aestivum
  Clone ID: PAT_TA_41798
cggactccttggctagacccctatggaagggctcctgcactccaaacgggaggtttttaaacggcggggcacaccgaccccgtgttacatctatatgagaagacacagcgctttgttcgcacacacttcggggcgcgtatgcaaaataggagatatctcgccgctcacaaggaacactggagagatcaggaaaaactggccgacgagatactaatatacctattaccatcaaggatatacaacgtctgtgctgtgagacccacgttcatggacaaagcccttgagcggcactttattctttattgttgtgggcggtgcccacacagtggaacgaatataattctcagcgctataaccgcccattgtata

SEQ ID NO: 41799 - DNA, 279 bp, Triticum aestivum
  Clone ID: PAT_TA_41799
ggcacgcgttcgggccggggctgcggcgaaaactaaggcgaaaacaatagctacaacactagctacaacaccaactataacggacattataatggacttcgtcgtatcctcagtcgcatcggcagtcgccatggccgccgcctctggattgacctatatacttacctacatccgtatctacggcctagagctggccctagagctcggggagggtccaggcgagggacaacacgtcggaaaccactactaaatacagttctatggaaagcaaggttggaa

SEQ ID NO: 41800 - DNA, 382 bp, Triticum aestivum
  Clone ID: PAT_TA_41800
cggacgcgtgggtttttttttttttcacaagacaaaaaacgtatgattttcatgaatttacaagacaaaacaaccattaacaacaaaataatattccacattacatgatttttgacgagctaattttacatgacaagactcccactgttacaatctgcagagcagcggaaggaacagcacctagctagaaccatggacacaagacttaaccggccggagtcactgaccagtgaccgaccaccggagacgccgggcacaaaaacgccggcttatagtcatccgggacggactaaccaaaccctaccacaagagaacaaataatagatctacacaatgaacaaggattagagacttagagctaatccgctaaaagcccgtgcag

SEQ ID NO: 41801 - DNA, 291 bp, Triticum aestivum
  Clone ID: PAT_TA_41801
acactcgctccggcctgaggccggagggagatctcctgtgccgcaagagcttcttcttcctccccactcttccgctaaatactacaaaacctctccatccctttcccgcgaggcccaaaaatatcaaaaatcctcggcgcaaaccctagcgcccgcacctccctgcgtcgccgacgcggagccggagctcccctgctgcaaccggcggcggccatagaagcggtggtcgtcgacgcggagtccaagctgatgaaggccggcatcaagctgcccgaccaggccccggggctg

SEQ ID NO: 41802 - DNA, 211 bp, Triticum aestivum
  Clone ID: PAT_TA_41802
gctcagccttcgtctggggagcaagcaacatacttgatttcaccatgactggggcccatacgttcagaatgctcccccatatcttccagcgaggtttgctgctcaatacccagcctcatgctggaaattacaataccgccataactccaacgaagattgcccctggagaaacgctgtctgattcaaaggcgaagactagcagcatagatct

SEQ ID NO: 41803 - DNA, 391 bp, Triticum aestivum
  Clone ID: PAT_TA_41803
cccacgcgtccggtagtttctcttttacacgcaccagttcgcatgaaagcttgctaggtgaaactttattattctgtgactacatacatataaatttaaaaaattagacacatctctaaaatctgaagtgtgtatagttaaaaaatcaatcacctttttatctggcatgtgcttcttcattaattaggtatcatccatcaattcctgtgaaacatatgtaagatgaattagttaaggaattctaaagatggtacttcatatttaaaaaaaaaagttaaggcaactctacctcctcggtttatcgttcaagtagagcatctcaagcctattatcaggcacaaatgtatttttactgcatagttttgtgtgtcaaaggtaatattatatcatt

SEQ ID NO: 41804 - DNA, 390 bp, Triticum aestivum
  Clone ID: PAT_TA_41804
cccacgcgtccgctcgatttctcttgtattaattgcctttcgtgttcttgttacaaacttttacacgcagcagaattacagcagaacaagtgccccatgcattgtatatccgctgtgcactctactaaacatacataatgctcttatcatcttttgatctcccttgagatgtaaatgccactacttttagataatggcgttggtaggctgaaggttgtttgtttgggagcaaatgccttagtatccccgcttctgctaatttcaagcccacatattctacagagatcttccagctccaactcctcgatcatcaggatatctgacagatgtgtcaaaggatggtgctgaagtttgtagccgctatggttgaggtacattaatgctctagca

SEQ ID NO: 41805 - DNA, 341 bp, Triticum aestivum
  Clone ID: PAT_TA_41805
cggacgcgtgggcggacgcgtgggatcgccagcagctggggcaagggtttggggatttgctctgtccgaaggatcatcctcgcagcgtcttgttgggcttattaaagtctttattagtcgggcattgtcaccatcaggattgaattcagagcagactgatggtcttgttattgcttccgccaaactaataaaaagcttatctgacgagggctctaatttggttgctttgagagagtgctttgcaaatgctaaactgaagctgctctttaaaactgcagtttctgatggtgcccaggctgctcttctcagcatggtgccagtggtatcacctgatgatctat

SEQ ID NO: 41806 - DNA, 309 bp, Triticum aestivum
  Clone ID: PAT_TA_41806
cggacgcgtgggcggacacgtgggcccacactcacctcccctccgcgcgttagggttattccagttgggcagttcatctctacccaccaaccatgggtaaggagaagactcacatcaacatcggggtcattggccacgtgtactctggtaatgtgacaaccactggccagctcttctacaagcttggaggcatctgacaagcgtgtcatcacacaggttcgagacggacacctctgagatgaacaagaggtctttcaagtactcgtgggtgcttgacatgctcaaggccgatcgtgagtgaggtattac

SEQ ID NO: 41807 - DNA, 380 bp, Triticum aestivum
  Clone ID: PAT_TA_41807
aaattagcaaaccactgttgagaatattcgaaccaattctcaacagtggtttgctaatttggttctcacaacttggaacaatggctccacggggatgttgacctgtaagtccccttacatgggaacacaggatgaagatcatattagggacggcaaaagggttaatgtatttgcatgaggggcttgagccgaaggtggttcaccgggacgtcaaggcaagcaacatccttcttgataagcactggaatgctaagctctccgatttcggacttgcgaaactcttaggcccagagcggagttacgtaactacacgagttatgggaactttcgggtatgttgctccggagtatgcggggacttggatgttaaacgaaacaagc

SEQ ID NO: 41808 - DNA, 374 bp, Triticum aestivum
  Clone ID: PAT_TA_41808
aagaaatactccctccgtcccataatataagaacatttttcaaagcttgaagaatgttcttatattatcggacagagggagtagttcgattgcagcaccactcccatatctttttcagttgacattgttaggtactcgctccgtaacaaatgtaagacgttttttatgccctatgtaaaaccaaaacgtcttacattttggtacagaggttgtatttgctccacttcacattgaagctagcaacttaatttcttttcttttatcaggtatttgcctttgtgaccgctgagtatgaaaccgcgaagaatttcctgaaccaggtatgccaatatttgcatttaatcctggtctacgtttttctaccactatctata

SEQ ID NO: 41809 - DNA, 328 bp, Triticum aestivum
  Clone ID: PAT_TA_41809
cccacgcgtccgcaaatgcccagttggagcatgccaaggcatcagttgctgcctttgctgaacagcagggtatgctgaaatctacagtatctgacatggaacatatgattgaagatttgaaaggaaaggtttcaaaatctgaaaccagagccctaaatgctgaatcaaagtgtgcattattagcagacaccaatttagaacttagtgaagagctatcgtttctgagaggtcgagttgaacgcctagagagctcgttacatgaagctaaccatgtgaaagtagcaaccatcaaggacattagtctcagaactaaagttattaccggaat

SEQ ID NO: 41810 - DNA, 354 bp, Triticum aestivum
  Clone ID: PAT_TA_41810
cccactcgtacgcggacgcgtggggttagctcgtaccgtaaccacgtccacgcgctgtacatgggtgtcccttccagtccagtcattgccaagcttttctccaatgccaacaggtgctcccgtggacagggtggttccatgcacatgtgctctgaaccccacactctcctcggaggctttaacttgattgacgagggcatacctgtccgcactgtcaccaacttctccgctaagtaccgacattaggtgctcaagcagtgtagccctgtcggcctagatgtcactcttgaattctttggagacggtacctgtaacatcagtcagttctttgagagccttgacatggatcacctg

SEQ ID NO: 41811 - DNA, 251 bp, Triticum aestivum
  Clone ID: PAT_TA_41811
cggacgcgtggggtgagtggccacgggttccttgggcttgatgcagtgtatgacaggtgacagcacaagtggcaagcgatgtgctcatgtggatgtagtagatattctcaaaaaaaaaatgtggatgtagtagatgtggtggccatatggataatggaactggcagcagctcagaatgtatgtagagaacacacacacggcatgtatagtcgcaccccccatgatgtgaatgaaataataccttcgttggt

SEQ ID NO: 41812 - DNA, 148 bp, Triticum aestivum
  Clone ID: PAT_TA_41812
aagcatattccctcccttcatactataaccacagtgctcttagctaatataatgttcccatatcacccgcttgaataaatcattccatttcaataccactcccatctctttttcatataacattcttcgcaaattactccccaaccac

SEQ ID NO: 41813 - DNA, 160 bp, Triticum aestivum
  Clone ID: PAT_TA_41813
cccacgcgtccggactcgttttagatgacgcaccgcatccaccagctacatcagaatgaaagacaggtcgcaccccacccactagaagaagagagagaagctagtttacatcggggcgcgtgacgggaaactacctgctctgcaagggccaccccaagcg

SEQ ID NO: 41814 - DNA, 411 bp, Triticum aestivum
  Clone ID: PAT_TA_41814
taggccacttactcatgacatctttccccctaagctctcctgtggggggtactttaacgatcatttgcctcatccccataagccgtcagatttttaataatcatgataactactactttccaagaattctacttttttccacacttctttttaatcttttgcacctactactacatggtctacttaaatgacatactctcacatttgtttccactatttgatcctcaaggttcattttacgtctaatacttaatatgaaattttatcattcaatttctaatttctttattacaatctattttacttattcgtatatgtatattctttctaatacattaatatttcacttactataaaaaatatattcattttttcattattcctctatttaccatatatttatatacttat

SEQ ID NO: 41815 - DNA, 173 bp, Triticum aestivum
  Clone ID: PAT_TA_41815
ccggggggggggaggcacgcgtccgtccacgagttccacaaacagttaaccgcgcttaatgtttggccaggcgagaagacaaaaccgatgcagctgtttgtggtactcgtggaacagttcgttattgctggttctacaatatgtgttagtctttatattactatattcgctgc

SEQ ID NO: 41816 - DNA, 370 bp, Triticum aestivum
  Clone ID: PAT_TA_41816
ccgattattcccaaattcggccgctccgtcagccgcggccacactggggctgcggcgtccggggcttaaaagggagtgactggcggttctgctgcaggggaatcgcccatggagggctcccgggggcggaggaagtggggtgtcatacacaaatccatgctagcggtggcacgtgacaatgaatatgcagttgacgcagaatatgcgtggggcggtggcagtgcagatccttttaaaaacatttccttgcatgatgcctgggcgaaccatgacaagaaggaaggcgaatcgcatacaaatggcattaataatgcactgatctcaaggattttcgacagaatttggctcaaatgccctgtttttaagagac

SEQ ID NO: 41817 - DNA, 282 bp, Triticum aestivum
  Clone ID: PAT_TA_41817
ctcactctttcttttttgcaaaagccaatacaccaacctggggcggggctttatccgtggagaagacctcgtccggccgagagtacaaggtgaaggacctctcccaggacagcttgggttgactcgagcttgagctccgcgaggtcgagatgcccggcctcatggactgccgtaccgagttcagccccttgcagcccttgaaggtcgcccggatcttcgggtgactgcacatgaccattcagaccgccgaccttatggagacccttaccggactcggcaccg

SEQ ID NO: 41818 - DNA, 381 bp, Triticum aestivum
  Clone ID: PAT_TA_41818
cggacgcgtgggtgcctccaaaattaatagctcaagtctctcaacacgcggatggatgatgttgtggagagggccatcgagagggggtttgcattgccaaagttgaaggtggccatcgccttgacctgcctggacctcctgacctttcacaacgctcaaacaggaaacacatgttggaggaggagaccacaagctaattgatgatttggatgagtggatcagaggacgacatgagcaggaccatagcggaccattgcaatgcggcaaatcaaatttcaatactcaacactcttctatgtggattaacgaagggcatgatggatggcaccagcggaaaggtgagcgccggtggagataagcgagaaaaggagtagcgcgagg

SEQ ID NO: 41819 - DNA, 232 bp, Triticum aestivum
  Clone ID: PAT_TA_41819
cggacgcgtgggaaatgagataagaactcaaccattgaagccttcgctcttcatttattgaagcaccgtcgagtctgttacgctatggcatgtccatacaggtatctgcatcttgatttttgctggaggaggtggtcaccgtaatgaagtattgagtgttgacttccacccttctgatatctaccgaattgccagttgtggcatggataatactgttaaaatctggtcaatg

SEQ ID NO: 41820 - DNA, 195 bp, Triticum aestivum
  unsure (1)..(195): unsure at all n locations
  Clone ID: PAT_TA_41820
aaggccagcactcaccctcccatccctcctttccgggcggaacccccggcggcgtcgncatggtgaagtactcgagggatccgtccaacccgaccaagtcggccaaggcctgtggcagggttttaagggtccatttaaggaccccacccaggccaggtttggtttttggaaggatgctttgggccagggttaaaa

SEQ ID NO: 41821 - DNA, 206 bp, Triticum aestivum
  Clone ID: PAT_TA_41821
tcggtctattcacacacacacacacacacacttaatgttacctttttcattgatttggaccgcacgtgaaatctggatcttttaccaagtggatagtgcgctcaggatttggaccgcgcagttcgaagattacaacaatgtggtctccagatctgaggattggtgcaggaacataaagaggacaatggggtgccattaccggccag

SEQ ID NO: 41822 - DNA, 196 bp, Triticum aestivum
  Clone ID: PAT_TA_41822
cccacgcgtccgcccacgcgtccgagtgcgtccatcgacgctgtgcagagtgccgatttacccagcacaacaaccccggacactctgtggtgtctctaggaacacaaaccccccttgtgttttttctcgcagaaggaggatggtggttcaccactttgctgctaataataaaaaaccggcggtatgttctttcttt

SEQ ID NO: 41823 - DNA, 228 bp, Triticum aestivum
  Clone ID: PAT_TA_41823
atcacggagcagtttcccattctatcctacgccgacttttaccagggggggggagaggacgccgtcgtggttaccaagctaactggcgtccccttgaaagtataacataggacatgctctatcgtacttcaggacgcccaagtactactgcaacccaagtgattcccctcgtcaccggggactcaataagacagatgggtttcgagtcgccacaacatagctgctctt

SEQ ID NO: 41824 - DNA, 386 bp, Triticum aestivum
  Clone ID: PAT_TA_41824
aacgccggctctcccccgctccgcctccctccctcatcctcccccggtccgcgccctccgccgccagatcccttcgagccccccgcgcccccgcgtcgaagatgagggagtgcatctcgatccacatcgggcaggccggaatccaggtcggcaacgcgtgctgggaactttactgcctcgagcacggcatccagcctgacggccagacgaacggtgacaagaccatcggaggtggtgatgacgccttcaacaccttcttcagcgagaccggagccggcaagtacgtgccccgcgcggtcttcgtcgacctcgagcccaccgtgatcgacgaggtccgcaccagcgcctaccgccagctcttccaccccgagcagctcatcagcggg

SEQ ID NO: 41825 - DNA, 335 bp, Triticum aestivum
  Clone ID: PAT_TA_41825
ccgacgcgtaggagcacgtcttcctggacacattcgtgatcggtgagctccggtgtgcttcactccagcgcacaacaccataggtcactctcttgttactacgaacatcctggtacgttgcgccaaatggatcattcctgtacgacatgcggatagctagcattttcatggacgtggacccgtacctgttcatgttcatggcctcccggggatacaaccttatgctgaagtaccgtgaggactttttggtttctttctgatgcaatgctccgcagcggatcgtgtattctgtgcggtatatgacttattgttccaatgtatgagctactcacctg

SEQ ID NO: 41826 - DNA, 340 bp, Triticum aestivum
  Clone ID: PAT_TA_41826
cccacgcgttcgcggacgcgtggggttggcaatgatggactttttagtcacaaagaaattactgtactgtttgtgccaaacctgtcggaatgcgtaccatctatggatatatggagggacaactggatcgcataccgaaaatcaaagatagaaagggagcagctgattatgaagaaggaaaagagcccaggtgatccaaaggaacagaaacaagttgtagaggagccaagcgatgctaaaagtacgaatgatcaattgaaggagggtgatggtgcttctaaagatggaaaaattggatcctggtatgaaaataaagagggtggttgtgctgccaagaatg

SEQ ID NO: 41827 - DNA, 200 bp, Triticum aestivum
  Clone ID: PAT_TA_41827
ctccccatgcagcaccaaccatggggagtttgcgagaagatgattagctctgggtgcttccctgatggggagaaggccggtgagattgtgaccttcttttgcaaggggaagaaggtgacggaggcacattcagtatacctagcagcgtaggaatctgaaccttcttctgcttcgctgctaggtatactgaatgagcctcc

SEQ ID NO: 41828 - DNA, 211 bp, Triticum aestivum
  Clone ID: PAT_TA_41828
cggacgcgtgggcgcccttttttttttttttttaggaaatagctaagatgggccaggaatattttacaggacaacaaatgatccacagtaaaggacaagatagctcacatgatccgggcaatagcttattacaacttcccacaaatagcgttttaactaagcatgcgatgtttacctcttacatgttgccaatatactggacgtaatcgta

SEQ ID NO: 41829 - DNA, 367 bp, Triticum aestivum
  Clone ID: PAT_TA_41829
cttctcctcgctctctctcacacacacagcgcgccgcgctccaagaacaagaagaagaacccactccaagtcgtccaagggagcatggcggcaatggcggagggggcgggggagccggagctggtgtcgatccccgtgacgccgcggggtctgtccacgccggaggggatgtccacgccgccggttaggaggggaggggcagcgacgagcggcgccgggacgccggtgcgccgggtggtggagggcctgcgcggctacctggaggaggtgggccacctcacgcgcctcaacccgcaggacgcctggctccccatcaccgagagccgcagcggcaacgccagctacgctgcattccactccctcaacg

SEQ ID NO: 41830 - DNA, 372 bp, Triticum aestivum
  Clone ID: PAT_TA_41830
ggattacgtggctaaacatgttgcgccctacaagaaagtccgccgagtagccttcgtcaatgcaataaccaaatcacctgctggaaagatcttgcggcgggagcttgtgcagcaggccatgtccatgggcgcctccaagctttgagatgtaattcgctgtgcaaatgtagaagatctctttggctgtatataaactagatatggcactattcttcatcaaccattggtcaccctgtttccttgtgaacaccgggtgcccttcgcgaaacaaatatttttcagtgaagagggtccgagagaacaggctgatcaaacatgtcttctctaatgacggttaaaagtaatctgctattgatcaattcactcagcttg

SEQ ID NO: 41831 - DNA, 122 bp, Triticum aestivum
  Clone ID: PAT_TA_41831
agcacacgttgtctatcattacaatgcgctagagcagcttaatcaggggggggcttgccaaagttgtgagaacgcacaatctcactcttgggctcattgccctggccgacctggtgcgctac

SEQ ID NO: 41832 - DNA, 340 bp, Triticum aestivum
  Clone ID: PAT_TA_41832
gagaaaggctcaccgtggaaccaatggaatcgcacagaagcatcactggggggggctatggggatcggcgagcacttagagggcgtgaagcagtactgggcacgcaacttcttctgccttgactacttcaagaagggatacggacgttaccaggccctgcccaagtggtccgacgcccacgtcgaatagttcatcgcctccgaccccgtctactgaccgcagatcaaggccatgagggagtccaggaagtttgtgctcgggggggccatggccggcgccgcgcaccttggcggtgttgacttcaagtacttcaagagcccgtacggtgtcttgctggcga

SEQ ID NO: 41833 - DNA, 313 bp, Triticum aestivum
  Clone ID: PAT_TA_41833
ggagagagagggttcgagagtctttcagagagcggatccatacagagagtgcgtagggttttatctccgggcggcggctatgtacatggcagccgcaggccagggcggaggcgcgggccccattcagagcggcggcgcgctatgtacacaccaagctgtgcatctgcggcaaggagcataaagaggaggagagggccgcccagacgtctacatgaaaacaatggccaggagcaggagcagaagctcgtacgcaagcaagggcccagaactgcagagcaggctctgcacgccctaagcgcagtagcataatgac

SEQ ID NO: 41834 - DNA, 190 bp, Triticum aestivum
  Clone ID: PAT_TA_41834
acttaccaaaggggaaggcctgggaagaagcagctgaagtttattaaccagatctaaaatgcttgtactcgcaaaataaaccaaaatggtttgcctgtcaacgtcggccaaaggcctgaaacggggactcatagaggccacatagatactacctgcagcacatgttctgagctgcagcttttaagaggag

SEQ ID NO: 41835 - DNA, 333 bp, Triticum aestivum
  Clone ID: PAT_TA_41835
tcggaacctcgtgggttaacagtgcaaggagctgcctgccagaggaaggacaaaaatggggcttcctgatatggctgcttttcagttactgtggcctcgcctgtattgcatgcgtggctgttggaaagtggctaaaccgaaggcacgcactccgcctgagggcacagcaggggattccggtctctgaatacggggttttggttgacatgattcgtgtgcctgactgggcatttgaggcggtcggcttggaactgagaggaatgggccaggacactgcataccatcctggtctttatctgacagcagcccagagagaagctgtggaggctctta

SEQ ID NO: 41836 - DNA, 366 bp, Triticum aestivum
  Clone ID: PAT_TA_41836
atatgacatggagattctgttgttactaaaatgtcctgaacttagaggtcattactatagaattttgcaattgaaaagagaaaatggatgtgttctgatcttatcatcttaacacatcacctatttgcattctagtttgaagtagctgggtgtgggtgaagataagagggtgacgatctgacctggtaaattagtggaagcttcagctaccatttgccaatgtgggtttcagttctatatattgttcctaccatgtttgtaccaaatcgaagatatccatttgcagctggattgtgcaaaatcagcagagcatgctcttgttatttttgtccgctcactcggaaactggcaatcctttagctattc

SEQ ID NO: 41837 - DNA, 255 bp, Triticum aestivum
  Clone ID: PAT_TA_41837
ccacgcgtccgcgcaggagaaaggtattgtctccaccgtcgacgccttagagaggaggagctaccagcagtgccttcaacacgcattttatcaaagacccgggtatgcggtggtttaccactcgccggacgactgtcagcaggccccgtactacccttcgcaggatcaataaacatcgacacctgcgttgtaccaaggatactctagtcagggtcagccacagcagccaccgacctactactacccgccctcgac

SEQ ID NO: 41838 - DNA, 393 bp, Triticum aestivum
  Clone ID: PAT_TA_41838
gcgttggccgtctgcagttccttctaacctcctcctcgatggccgaatccccttctaacctagttctgtcccggccggccggccggccgttggtgtggtggatgcacgcggcacgcccacggctgacccctcctgctccttcgagcttggatccgcgctgcccgcacgcggctcgcccatgccggtagcgcacgccgtgcgcgcccgacgtcgtcgttcactcgtcctggacccttggttttgatcaggatgtctagtgcgccatgtcctatttttctgattagtgcaagcgcccatgttgactgactgaaattttcatgtacagccccagcagtgtcctgtccaccccatcgattaattgattcaagttttgatgcgttctgaattttgcat

SEQ ID NO: 41839 - DNA, 164 bp, Triticum aestivum
  Clone ID: PAT_TA_41839
tcgtggacgcgtgggccgcgccggaccggtgagatccagcccccgccgggcgatcccatggcccccgcggaggcgcggttcctcgtcctggtcctcgacaacgtcgtcgctacagggatcggggggtgcgtggacgccctctaaaatttagatggacgctgctg

SEQ ID NO: 41840 - DNA, 391 bp, Triticum aestivum
  Clone ID: PAT_TA_41840
cggacgcgtgggcggacgcgtgggcggacgcgtgggcggacgcgtgggcggacgcgtgggatcccaatgacccatcaattgattccagcaccactacgaccacaacaacttccctaagcatgggtgaccaaagtgtcgcgagcatcgactcggatgggctgacgccgagcgcggtgttctcacagatcatgaaccccaaggggcggtgaggtaaaaatctgggtctgcttttcagtcagtcaccgttggggcctgcctaatttattcattcagcatattttcatgcgtttgtgctcttgctgtctcgcaagttatgcattagaagtcaaaaaattgttccatattagatatttctgtcttgccttgtttttttttcttcttcctcttcttc

SEQ ID NO: 41841 - DNA, 361 bp, Triticum aestivum
  Clone ID: PAT_TA_41841
cacggtctaatccgattcaaacgcaccgctttctcgtgtccgaactaagccccaatcccgtcaccaccgccgctggtgctcggcgcgatggcgcaaaaggacgccgccaatggcaacggggccaccacgcgcccggcagccacttccttccccattcggttctccaagttctttcaggccaacatgcggatcctggtcaccggcggagctggcttcatcggctcgcacctcgtcgacaagctcatggagaacgagaagaacgaggtcattgttgctgacaactttttcactgggtcaaaagacaacctgaagaagtggatcggacaccctagatttgaactcattcgtcacgatgtcaccg

SEQ ID NO: 41842 - DNA, 399 bp, Triticum aestivum
  Clone ID: PAT_TA_41842
ccaacactccgttgctacaatccaagctaccccacctcaagaacttggaaattagactcaaagcagtcctccccaaaggcttccctccaagctatgacttcttttctttggtttcttttcttgatgcttctcctgccttggagtctttcaccctacacgtaaatgagtatgtcatgacacactatcctgttgttggagataatgacgaatgcccgaggcagaagctggacttgtcgcataaccgcctcagacacatgacgatcacgggattctgttcagccaagagcctggttgagctcacggttcacatccttgagagcacacactcgcttgagcgcttgacgctggacacaacctatgactacaataggtgtattcaagggcctggtaccattggca

SEQ ID NO: 41843 - DNA, 392 bp, Triticum aestivum
  Clone ID: PAT_TA_41843
cgccccacgacacaggtggtgtcgcggcgttgggcagtctcggttgcgcggcgtttttcgattacgtcgacgatgcagtgtcttggtttggtctactaggtgatgcccttcggccttgtcggtggcacacaggtgtcgtggtgtcgtctcggctcgtgtgtcctttcgattgcatcccacggcacaggtggtgtcgcggcgttgtgtactctcggatgcgcggcgccttttgattgcatcgatggtacagtgccctggcttagtctcggctgtccaatggcgttcgactactttggcggtgctcttgttgagttgtctgttcttttcctctttgtttctcccccgttttgtgtgttgtatgtgtgtgtcttttttctttatctcttctcctc

SEQ ID NO: 41844 - DNA, 377 bp, Triticum aestivum
  Clone ID: PAT_TA_41844
cggacgcgtggggtcggcgagtagggctcatcgcagttgaagcagaggccctgacggcggcgctcctgctgctcggccggggacaaccgacggaaggttcgggtggtggccgaagaggtggtcgccgaggctggagggggccggccaggtgatggtgcgggtcgactgggaaggtggccgccccggccggccggttgctgtagcgcctgagcccgctgctcgaaggcccgggcgtagtacatggccgtctggaggtcggggggatcccggagcttgacgtccacgcggatatggtctggtaatccgcccacaaataacttggcgcgctgagtcgcggagacgcccggcgcatggcatgccaaggcctggaagcgggc

SEQ ID NO: 41845 - DNA, 311 bp, Triticum aestivum
  Clone ID: PAT_TA_41845
cccttccgcgtcctgaggccgcgctggagcgccccgcgcaacccaacggagtatgtcatgcgcgtggtggagcccatacatccacccatctttcccaaagtttacttaggcaagtagcaccaccggtaggacatcgtgaccaacgtgcagatgggcggcggctgtttctcatcaacaacaccttgtactcccacaaggagaaagtccttcgtgagctcatttacaactcgtcagatgcgcttgacaagatccgcctcgtgagcctgactgacaagagcaagctcgactcccgccggagctttttattcatc

SEQ ID NO: 41846 - DNA, 396 bp, Triticum aestivum
  Clone ID: PAT_TA_41846
cggacgcgtgggtgctgctgcaggaatcacctcatctccatcagcaggcctgtcaagcttcacaccaacatcctccttgtagtcaccgtgaacctccatgagcttccccaggtcgaacttgggggccttcaggatcttcaccttgcggacgtacacgttctggagggggaagatgcctgaggtggccttctcaatctcctttccaatcacctcagggatgaatgtcctcacaaacttctggggcatagacttcaccactgacaagctcatgtttcttgcgaggaagtggcagacactcattgaggctcatgtggatgtgaagaccactgacaactacatgcttcggatgttcgtcattggcttcaccaagagactcccaaaccatgtgaagcgcac

SEQ ID NO: 41847 - DNA, 226 bp, Triticum aestivum
  Clone ID: PAT_TA_41847
cgcacgcgtagtcaggtcgtagttaagcactcgacgcataccgaagggggaggtttcaggcgagggggaacccatccatacacccatttttcccaaagtttcattcgacaagtaacatgtccgtccggacattgcgactaacttgcatatcggctgcggttttctctcagtaacaacacctgttactccatcaaggagatcttcctacgctagctcaatgtcaact

SEQ ID NO: 41848 - DNA, 400 bp, Triticum aestivum
  Clone ID: PAT_TA_41848
gaggaaaccctcgatctcttggtctcgcgaacgagaggcggcggcggcggcaagatccaagcacgacgcgccaccacactccgccctcctccggccaaagctccgcccgacaactggaagcgaagcaccgccacgctccggcctgtacctccacgctccgtccctccggcgggggcgacgacgaccgggctcgtcatccccttcttcccggatctcgtctctccctcaaagcatcactcatctccggcgaagacgacggccatagatcatcctcctctttctcatcaagatcaagggacctcctctccttgtttgaggtttgtaccctgaccccaagtgagcagctgtactgaagaacatcgaatgctttgaagtgctctatctatcctgacatcacaag

SEQ ID NO: 41849 - DNA, 287 bp, Triticum aestivum
  Clone ID: PAT_TA_41849
tcggaggcctttattttggcagtgcgggccccgggataccactgggatattttcattccggtcttggggagggggcaagaaacaggctaccggccgggcaaaacaagggcgcttggggcttgtttcgaaatttaccccatcgggttctttcttattcagggatcacaggggaggaaaaagggggacccctctccatgaaggcgctcattcttgtggggggctttgggaccccccttcgggcttttacactctagtttcccaagcccattgttgattttgcccacaag

SEQ ID NO: 41850 - DNA, 399 bp, Triticum aestivum
  Clone ID: PAT_TA_41850
cccacgcgtccgcggacgcgtgggcggcacccacgtcgccgccacggccgctggctcaccggtgcctggcgcaaacctcctgaacttttcgcgaggcgacgcgacgggcaccgcgccgaaagccaagatcgccatttataaggtctgctaccgctctcccgggggctgcccggactgggccatcgtggcggccgtcgacgccgcggtgagcgacggcgtggatatcatctccatgtcgctcggcgcaggcccgacgcccttctacgacgacgtggtggcggtcgccacgttcggcgcggtccgggcgggcgtgttcgtggtcctcgcgggcggtaacgccgggccgaacgcgttcactgtgtccaacgccgcgccgtggatgaccaccgtgggcgcggt

SEQ ID NO: 41851 - DNA, 395 bp, Triticum aestivum
  Clone ID: PAT_TA_41851
caccaccagaaccaaatcaggcgagctctcgttgccggatcgccgaccagcgtcagttccccaccgctacagtgccgccagccaccgctgctccattgccttgggtttggttgtggcgtgggctgggaggaaccgcacggtgttgtctgatgcgtgctccattgcactgggaagtttggtcggccgacgccaggtatgagcagctcctgagaaggatggatgcattcatgtgtcgtgtactaaaaccatgacacttagtttggaacagagggagtatgtatgtacggatatcatggtcatgttgcttgggggttcaacctcctttttggaaaaaaaagaggggtgatgccgatgatgatgactgtggctgaaataatcatgtcttgagcaatcaa

SEQ ID NO: 41852 - DNA, 296 bp, Triticum aestivum
  Clone ID: PAT_TA_41852
gggggtcaacccacgcgtccccgcaagtctgcacattttaccacaacctcgtcttctcttaagagagcctttccagatatgaacatgttaatatctattctgaatacacccaaccatcctctactgcaagaattacaccattcaactcttatttcacatgaccttctctaatgaagaatacaaacatatgttagctaccagacacacaaaagttcatcagtaatttctcgagatcatactacctgccgatttcttgatgaacacacccttgctcaataagggaacagttttgcatc

SEQ ID NO: 41853 - DNA, 375 bp, Triticum aestivum
  Clone ID: PAT_TA_41853
tccggtacggcagggtcggctcagacccacccgtgagattgcgcgtagggccacattcggatactacgactagtctgagagtgcttgtacaaagaggtatcatctagttattgctgacatgtcacaatttcatgtacagaaatgtatccaacagactatacttaacttgtgtacaggtttggtcggtgagttgacatactaggtgtgccttgtatgctgccatgagccacttcgccgccatgaagagccccagtagggggcgccctctacaggatccaagactacaaaagcctgctttcgtggtcaaagctgttctatagggtcacctaaactcaatgcacagcgcgtagtttataacacgcgggctgggaaaac

SEQ ID NO: 41854 - DNA, 400 bp, Triticum aestivum
  Clone ID: PAT_TA_41854
cccacgcgtccgcgcccatcacgcagcaagtagcttagccgccgctccttttcttatccccaacactcccgcgccaagccgtggccacaaacgtcggccggaccacccacacgtcggcgtcggccatgccatgaccgtgtcactccactcctcgcgtcgccattggcccaggtcaccagagaaagagcactggcaaaggccagctatatccgctccggatcggggccctggaaacctgtggagcagaagctccggccatggccatcccatcctcctacttagccgccatctcccccgcatcctgtcactaccagggatctcatcggatcgcgcaaaaagcttcgaaaagcaaaagcatggccctcccgtcgcccgccggcatcgccaagcccaggctcca

SEQ ID NO: 41855 - DNA, 343 bp, Triticum aestivum
  Clone ID: PAT_TA_41855
cggacgcgtggggcaccagtccaaccgcacccgcgccgcgcggggcaaaaacctccccccgcctctccccctccctccctccccacctacgccgcagcccaccatggaccccttcttcgccgccgacgacgccgcggacgagctgccgcgcaccgcctcccacccattcgacgacgccgaggacgacgagggcgccgtcgtggccggggccgacggcggtgccagaatccacaccgactgttgtgatcgccgggaccgacgtttttgctggcaacggcctgcaggaggacgtaggggacgaacagggggacctggcctgcgacggcggcgccgattcggtaca

SEQ ID NO: 41856 - DNA, 400 bp, Triticum aestivum
  Clone ID: PAT_TA_41856
cagacacagagaataggagcatgaatatgatgcaaacgggcaccagcctcaatgatgaatgtggttctgcatatggccgctttgagcagcataaaagaaatggtacgcatcatggtgtcggcgctgcatatataccttttagctcttgcgcttctgatggtccttcaactaaaagggtgtttggtgtgactttggatgaaccgcaagcttcacaattgtctaaagagaaaggtagccatgtcgtcaagttggccccagatttgcctcctgtaaaccttcctccttctgtccgtgtgatatctcagatggaatttcatcagaatgcggcgcaggatctgtttcctgtgccacctccaacctttacagaatgtgtttacacacagctaaatcttttccctca

SEQ ID NO: 41857 - DNA, 397 bp, Triticum aestivum
  Clone ID: PAT_TA_41857
cggacgcgtggggacattctgtgaaaaatatcatgtagagatgatgatacctgaagaattgagaaaagatcagaaaaaaaagtgcttacacttgtcacgctaagccacgaaatatcaatatatatcttctgtaaccgtcatacagattcaacttagctttttgtatatgtatttaaatggggaagcattagagaaaaatgtaagagggttatgcagtgacaaagtgtggttaatcatgtgatgttcaactgatctagtgttgtgattgatgatgattatgacactgtcaattggtagtggattagtagtgatgctgctggtagaaattgctaacaaataatctgtttgtgcagaaacggcgggtcggcaaaaaggccaagggcgcgaaaagcggaaa

SEQ ID NO: 41858 - DNA, 399 bp, Triticum aestivum
  Clone ID: PAT_TA_41858
gaagaatttgcagatgaatcacgctatcaggtttaggcgtgcacatggccactaataataataaaaattgatatttgatgaagccatcatcatgtcatgtaattacttgtagaacaactatattgttttttggggcggtaaagcggaaacgataggactctgcaactcatgtgagtgttgtttgattatttactttttcaagcgtgtggatgtcgttggcatgtttagtatacgcacgaagatatgcaaagtgtaaaaatggtttcctgggaacgtcatatttttttctcctgggaacgaatgaactgttcgtcagggagcgatcactccaccgaacgtttttgttcgatctgggggaggagctggagcgaacgattcaccccaggcccccatgcaaac

SEQ ID NO: 41859 - DNA, 260 bp, Triticum aestivum
  Clone ID: PAT_TA_41859
cggacgcgtgggtttgtccatccaagacctcctcgcgcttgtctactttggctcccttttttatgtcaagtcaccagacgagttcatcaccaccatggttgcacgcaagcacgagcggagcagctgcatcacctacggctatgtatgggatgataccgtggacctgcttacggagaacgaccttgatgcagtgtctgccgtggcggcccttgccacggctcgccctgcttttgggggtggcgtctcccaccatgacgcac

SEQ ID NO: 41860 - DNA, 194 bp, Triticum aestivum
  Clone ID: PAT_TA_41860
tatccgcagtccaagctagagataatctcttgcagatcgacaccagggggatcctattcttgggccgggaatctatccaaagcgagctggctactctaactgagacgcatcatagaggcaatgcagtatatatacgctctaaccgtagcgcttctgttggtcattcctataaaagactgttggacgcccatatc

SEQ ID NO: 41861 - DNA, 401 bp, Triticum aestivum
  Clone ID: PAT_TA_41861
tagagcagagcccggcagaaaagggggtggcgatggcggcggtgctgaaggtgtacgcggaccggctgtcgcagccgtcgcgcgccatcatcatcttgtgcaaggtcaaccggatcgacttccaggagctcaccgtggatctcgccaagggacaacaccgcgcaccagagttcgccaaaatcaaccccatggcgcaggtcccaacaatcgtcgatggaagattcaaactatttgaaagtcatgccattctgaggtatctcgccaccgtcttccccggggttccacatcactggtatccagccgacttatttaccagagcaaaactcgagtccgtattggattggcatcactctaatctgcgccgtggtgcagcaacctatgtactgcacaccgcgttgggt

SEQ ID NO: 41862 - DNA, 383 bp, Triticum aestivum
  Clone ID: PAT_TA_41862
cggagatcatcctttgcgttaacgcggacacgacgaggaatggagggattgaccgaacctgtcgactgtgctctttgacaatatggataggcaacttcttctctacgacgtgggcgagtacatccgcctacatgctgcatgcaaggagtggaagaactgcaccgatgatccacgcgcgggaggctgtctggactgtcgcttccacccctgacgctaagatcatgctagacaaccaaactcgaggcgactgccgtcgctttctcaacctctccaccggagccagtgcatgttttgatcgagaagagctactttgtcaccaactttagaccagaaggcgaggccttctgctcctagccggcaaggcaagccacgctgaacacttc

SEQ ID NO: 41863 - DNA, 247 bp, Triticum aestivum
  Clone ID: PAT_TA_41863
gtaagccgcggtgtggagtttaacaaatttgaggaagacgtcagcacaggacccgtcctcattctaatgctaagcggtatgaaaaacacatacgctcctaatcaactgcaggttcagcacgaaatggactagtcgtgtgtgggcatatagatagaattgcaacaggtttcttgaaaacgtgagggagatgttcactgaggtttcaaagactgtacctaggtaagcagtagaggtctcccgtggaaca

SEQ ID NO: 41864 - DNA, 390 bp, Triticum aestivum
  Clone ID: PAT_TA_41864
ccacaaatggttcatttactccaagctcacatgttgattttgacccttcaaaatcaaagcgactctcgtggcatccaagatgctcgcttctttttatatggacaaatcccaagtttcttaccttaatttagggtcttcttgtatgaaggttttctctctcacatggagtgtgaccacttagtatctatggcacatggtaagatagggtcatctgtacttgttaatgatggtgctacaaatatttcccagaacaatattgatgcaggcctcatatttagcctggctgatagcaaggtgagcatacatactgctttcatgatattttcatgactggctctttgctaaccatgcagaaatgtagacagagaaaaataaaatttaacaaacctt

SEQ ID NO: 41865 - DNA, 225 bp, Triticum aestivum
  Clone ID: PAT_TA_41865
cgtgtacagaatctaccactcggctctcatggcggcgaaagaaccgatgcgcgtgctcgtgaccggcgccgcaagacaaatcggatatgctcttgatcccatgatagccagaggagttatgcttggtgcagaccagcctggtattctgcatatgctggatatagaaattgctgctgcagctcttaaaggcgtcaagatggagttgatcgatgccgcattttcact

SEQ ID NO: 41866 - DNA, 323 bp, Triticum aestivum
  Clone ID: PAT_TA_41866
cccacgcgtccgtacggccgtcgccactccgcctctgccgccgacgagatgggtcgcgtgatccgcgctcagcgtaagggtgcgggctccgttttcaagtcccacacccaccaccgcaagggccccgcccggttcaggtcgctcgacttcggcgagcgcaacgggtaccttaagggcgtcgtcacagatgtcattcacgacccggggcgtggtgcgccgctggccaaggtgaccttcctccacccgttcaggtacaagcaccagaaggagctcttcgtcgccgtcgagggtatgtacaccggccagttcgtgtactgcggacg

SEQ ID NO: 41867 - DNA, 392 bp, Triticum aestivum
  Clone ID: PAT_TA_41867
cccacgcgtccggagatgtactaacttatactatgcatgtcaggataatgcgttgcttctcaaaaccatgcctagctacaacagcagctattggcgccacagcaccgcgtctggcaggagctcgactctgctggctacctaacaaaaaagtgcctcttcccatcatcatcccctctagaacgccaactcttcttcctcttgacctgctgtttgaggcaacgtgcctgcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagttcctccagaacgccttctccaagtac

SEQ ID NO: 41868 - DNA, 392 bp, Triticum aestivum
  Clone ID: PAT_TA_41868
cggacgcgtgggtgcccggcagcgcggctatgcaaggacaatacaacaccattgctccatcaggtgtgactcattctgaagggcaatattcatatggaggacctggcatcccaccatctcagccaccaccgcagcacaacatgcaaaggcagcagcttcctcctccaggccaaggctctttcgggccgcctccaggtaaggggggctatcctccgcagtatgcgccgcaggggcatccgcagggttacaacacatcgtatggcagctacccgccgactggtccttctgcagtccaggcagcacagatgcctccagggtcatcgcagcatcacatgatgcgcggccatccatatggagatatgatcgagaaggcaatcaccatgggatattca

SEQ ID NO: 41869 - DNA, 387 bp, Triticum aestivum
  Clone ID: PAT_TA_41869
cggacgcgtgggcggacgcgtgggcgaacgcgtgggatcgacggagtggtgcgcggcgggcctgcctactgagacgggtggatggagcgcatcatcgaggcgtacagcgcgggcggcttgccgctaacggtcgcggggtcgccgaggctccgcgtgtacgacacggactttgggttcgggcggccggcaaaggtggacgtcgtgtcggtggcgaggaccggcgcgatgtccgtgcagaggcgcgcggcggcggcggcggggtggaggtgggcatctttttgccggcgggtgccatggagcgtttcaacgagtgctttgccgatgccatcgcgtgccttttggcgtaggagtatgtgtaataacggcattgttcttttaagtgcatgc

SEQ ID NO: 41870 - DNA, 285 bp, Triticum aestivum
  Clone ID: PAT_TA_41870
acgtagagacttttatttcgcacacaacgcgcagggggttatccctgctttggccatcacacgggtacatgccacattcgcaccataagagcgaatataaacagcttttggcttgcagggtcgaattgcaatatctacagggacccaccttgtaaagacgccggccttatgagagggttctttggggacttcgtatacatgttggaaacgcctgccccagggccaatctggcttcaactctcaaaagcacgggggccattttcatctgggggtgaagaagaagat

SEQ ID NO: 41871 - DNA, 320 bp, Triticum aestivum
  unsure (1)..(320): unsure at all n locations
  Clone ID: PAT_TA_41871
cccacgcgtccgccatcgatcccatcgccgccccctcctccctcgatctcgccgccgtcgcgccatggcgaaggcgaagccgtcgtcgtcggcgaagaagcaggcggcgaagagccagggggctcagcagggcggcggggccgggcacgcggcgccgtccgggctcgcgcggtacctcgacccggaggcgccgtgggacaaggaccagctgctggacgcacggcactggatccgccacgccgtggcgctcgcctgcggcctcctctggggngcagnanaagatgaaggggaggattcatttccgaatgttgcgggcaacg

SEQ ID NO: 41872 - DNA, 277 bp, Triticum aestivum
  Clone ID: PAT_TA_41872
cggacgcgtgggctctgttgcaaggttcgtgaagcatctttgcgcggggaaaccgagaccgcttggctttgtttatttacctatgtgatgagagccatcaacttttgtgcatgtttaatggagaggagaggccgctccaattgcattttcttgaggaagatgcccaccatacaaagtgcttaacatcacatctatttattgcacgtcaaaaacgaaaatgactatctgataggcaaagcaaacatatcatagcttgttgagcatattcagaatgata

SEQ ID NO: 41873 - DNA, 314 bp, Triticum aestivum
  unsure (1)..(314): unsure at all n locations
  Clone ID: PAT_TA_41873
ctcaagggtagttgtaggtgttaaacaactacctagtatgaatgggggagggatgnngngaatatttagatggtataatgatctactttattattcaaagtgttgtttgttgcaaaaaataaaaaaaaatataaaaatactccacgnaaggaccagtacagatgggcggtcgttgtataggattcaagcttacattctcttggcttggaatggataacattagtttattgtcacttaaattcaattcattggccttttttttacaatttgttttaatgggaaaacccttggattactcaacataattagtttgc

SEQ ID NO: 41874 - DNA, 436 bp, Triticum aestivum
  unsure (1)..(436): unsure at all n locations
  Clone ID: PAT_TA_41874
nntccgcggacgccgnntgggtctacgaagtacatttagaggcaggcgtgttgaagggtgcgtggtgtttcgcatgatgagaaatcagtctctcattgtctcaacatgagccttaggagaacgagaatttggcccagtcagtcagcattttgtttgcctccacttctgatggnaatattggtggtgtgtcctcagtacctccacatccaagaatctcttttgagaagaagctcatccatgtcataagattgtcggctatgaaggacaaagtctgaatggnggaacctgagatatggttgggatctaatggatctgtcacgagaagatatttcttacttggattcaaagatgcaacgcaaagagggcttggcgttcacgtctatttgcatggcccaaggcgcccagctttcaaagggatctgcccccatcaatcttt

SEQ ID NO: 41875 - DNA, 352 bp, Triticum aestivum
  Clone ID: PAT_TA_41875
cgtacagctgcagcaacgcccgaggagagcgcagctcgtccccaagcaccggccatccccaagaacgcccgggcctcctcgtcgccggcgagctgtgccttatcgccggaaaaccacctgccgccgtgccctgctcctacccggcaacatcgccgtcgaagtccgtccccgtctcccagatgggatctggctgccgagctcctccacgcggacgggcttcttcgcccccggtcagatctgtcgccgtgtagcccgtttgcgacgggatccaccgaggtgaggtgctgcagccatggctccttctctggccgagcagcagcagcatgaggttaggatggaggatggcaggtgc

SEQ ID NO: 41876 - DNA, 246 bp, Triticum aestivum
  Clone ID: PAT_TA_41876
ccctgcgcttgctgccactcttcttcgttaacctcccactatccactcacatttcaagcaaacagcttcgacgtccatcgatctcttcgtgcatgagaaacggcatggcggctccgaggttcaggccgatcgaggagtgcgccacggaagggcggtcccggcagacggtcgccgccgacctcgacggcacgctgctcctgtcccggagcgcgttcccctactacctcctcatcgcgctcgaggccg

SEQ ID NO: 41877 - DNA, 224 bp, Triticum aestivum
  Clone ID: PAT_TA_41877
gcccacctcgggacgctgggcgggctgcggcagcatcacaggccggccagcggcaccggagaggcgttgctcgcatttctacagatcagaacgggggaggaccctgtgctgagcacaggcggcccgaaagaaggggggaagcctggcatggggtgctgccggaggaggcgggtgctatcatgcgctattttgtgggcgccttgtgatgacgcgggcggagctgc

SEQ ID NO: 41878 - DNA, 280 bp, Triticum aestivum
  Clone ID: PAT_TA_41878
gccacgcgtgcggccacacctacaactactcctccctcggggccgaggcatgttttcaaccgacggtcattattgaggacctccagaatcacattcccatgcgttaaaatcaactagctagcctttacggtatcgcgtctgatagaagtgcttctgggaagcattctgctcaagactagttttgttgagctgttcgacgatcacaacaacgacatgataaacaactaaatagcctacgttttcaaggataacctttttcacgaacagatgcacctccatt

SEQ ID NO: 41879 - DNA, 278 bp, Triticum aestivum
  unsure (1)..(278): unsure at all n locations
  Clone ID: PAT_TA_41879
cccacactcgcgccccctccctcgcctgccccgccccgctcgcccgcctttccccgcctcgacgactcgccagaccccaccccgacgtcccgcctcgaccgtcccgctcgccgtcttatctccccatcccagccgcgcgccccngccgatcgncgccgactcctactgcgatcgctcgtccctcctcctccacccaaccccaaaccctagcagctcccgctgtcgatgctgtctacttagaccaaactgccggaccgcctccgtacactttcccggcg

SEQ ID NO: 41880 - DNA, 385 bp, Triticum aestivum
  Clone ID: PAT_TA_41880
cccacgcgtccgcccacgcgtccgcccacgcgttcgcccgagcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgacgttaacgaccccttcatcaccaccgactacatgacctacatgttcaagtatgacactgtccacggacagtggaagcaccatgaagttaaggtgaaggactccaagacccttctcttttgtgagaaggaagttgcggtgtttggctgcaggaacccaaaggagatcccatgggctggtgctggtgctgagta

SEQ ID NO: 41881 - DNA, 236 bp, Triticum aestivum
  unsure (1)..(236): unsure at all n locations
  Clone ID: PAT_TA_41881
cttccgtgccgatgggccaagccttccttttacttggagggggccaaagggtctttaacttcttgataaagtaacccgaagaaaacaaggtggtacccctgatacaccttggctgggagaccgttgaagttggtgaaatcatatttgtgtgtgtcatgtgtatataaaatctttttctttgtttttatgtggntgtttgcttgtgtaaacttatattaaaaatgtgtcttttgatt

SEQ ID NO: 41882 - DNA, 375 bp, Triticum aestivum
  Clone ID: PAT_TA_41882
tgcatatatgccattttcagggagaaaatacaaagatgaaaaacacactgcattgcatttgttcaaggagtgccactacaacaagaagaaagggtacacagatatcgtacaactacaatctgccattttaagtcaaggttcgaggagtgataaccatataacagtgcttacttttttttaatagatccagtagtacaatagtcagtaatttataaagtcagcctaaagaaaggtagaagaataatttgactttgaaacaattgagcacatatcactttaatgaaatgactagattttttctgtactattctttgcttcttacatgaatatgaccacttgacaaccgttgaatgatttatgaaatcttcatatctt

SEQ ID NO: 41883 - DNA, 381 bp, Triticum aestivum
  unsure (1)..(381): unsure at all n locations
  Clone ID: PAT_TA_41883
ctcggccgttccctcgcctgatcgccccccgtctccgctaccgatggacgccgtcgccttctcccccgctccgaaccccaacgccgcgccattcccctccgcctccccgtcctcgcgcgcccgacgcttctccatccgcggcccgcggcggcggcgcccgctcccggccctccgatccagcgccttccccttcgcctcccaccacgacgtggtcgtcgtgggcgccgggatcgtcggcctctccatcgcccgccacctnctnctncacaccccgctctccgtcgccgtcgccgacgccgccgtcccctgctccggcgccaccggcgcagggcaggggtacgtggggatgtcgcaccggacgcccgggagcgacacgtggga

SEQ ID NO: 41884 - DNA, 367 bp, Triticum aestivum
  Clone ID: PAT_TA_41884
cccacgcgtccgggaagaagaagaagcagagggttttgctacgactacgatggaagaggagaaggcctttcccattgactcgtcaggtttcgagttcttcatcatcatgctctccaagtccttgaagaaactggtacgtacgtttctgggttctacaccgtgatgcttggtcattgggctctgggtttggtactttggtttggttggttcaacacttgttcaattccaactgctgcttgacccacgccacgtcgcagaggatgccagacaagttcgccaaggtgctcgccggacgtgagccccgggaagtgaagctgcgggaggccggcagcgggcgccccaacctgtgggacgtgaaggtggtgct

SEQ ID NO: 41885 - DNA, 277 bp, Triticum aestivum
  Clone ID: PAT_TA_41885
agaaagggaaccacagcgtgtgagtgagagaggagtgccggggttcgcggcaggcagcgcaccccatgggtagccgcgcgcaaccgcgggcagcatgggagtcagctgcgagtcctttgtgtggcgcctggggtaccgcacgtcgccgcgttagccgcgggggcgttggcagcgtcacgacgcagccgcgggaccatatcgggacccaacagcgtacctgctttttatgaacccccgcttgcgctcctgtggcatgtctatctatctgcgtcgcacg

SEQ ID NO: 41886 - DNA, 287 bp, Triticum aestivum
  Clone ID: PAT_TA_41886
aatatagtttctagaataatcttcaatgagaaataaacttggtagggtaaacaatgaatttatgatctttaagctttagccgacacatcagtctttacaaccttaaaatatactgatctaaaatattcatagcttgaaagagcaagtagatttccttcactaaactgctgctcaggttggtcacctcggatcacatcagtgcctacagcactttcaataacagacttgctaaaacttcttactactggcacgctttcctgcaaaggtggttcgatccaagagcctta

SEQ ID NO: 41887 - DNA, 166 bp, Triticum aestivum
  Clone ID: PAT_TA_41887
cggacgcgtgggcggacgcgtgggcggacgcgtgggtgcttgcatgatagcactgtagatatattcttgcatggtatttattgttgatgctagtggtcatgttatgttatgagtagtgttgcacttgtaatatttatgctcgtcattatgccatgttcagttggat

SEQ ID NO: 41888 - DNA, 254 bp, Triticum aestivum
  Clone ID: PAT_TA_41888
ggaacgcgctcgacttgatcagttcccaggggcatgcgacgtacgtcatggtcccaccgatagacacgcacaaccccacggtcactgaatatgcgtgtagtgagctcacacccgattaggttagttgagtgtatactgcggaggacataagcatctggcatctcaaaaacccctgtgatccaaacatgttcgctccatggataaatgctagctctaatgcttgaagtcgaatatctagcttaagcggtgatccc

SEQ ID NO: 41889 - DNA, 387 bp, Triticum aestivum
  Clone ID: PAT_TA_41889
cgccctttttctttttttttaactcaatcatccattcattcattcattcatttgcttgcttgcatagacaatagagttgtaagtcgatttctctctccaatatgtcatgtcaatgggatggctacattacaaagtccataggattacggtagagacagcctaaagttacttaacacacacagacagacaccaagtgaagtatatacaccacaccagcaacaccaacaggagtatatagagagaggagcctacgaacgaagaacgatgaggaagagtacaggagcagagcatatttgtatcgtttagtttataccggctggtagctcagggacctccagacaccaaccaagacaagcacaagcagagggggatgggcatcaccaggag

SEQ ID NO: 41890 - DNA, 149 bp, Triticum aestivum
  Clone ID: PAT_TA_41890
ctcataatttatgctcgagtgccgctctagaatatccaggcgtagcggctcacacgggacgagaacttcatcatctgcatctgatcaggaaattcaatttactggaccttatttcattacccaaattattaagcaaaaccattgtatta

SEQ ID NO: 41891 - DNA, 324 bp, Triticum aestivum
  Clone ID: PAT_TA_41891
cccacgcgtccgcggacgcgtgggcccagtggtgtgtgcagggaaggtttcctggattaattgtagatctgattccttccctgcccagtggtgtgtgcaacaggcgagcaagtaggagtgtctggttccaagagaaagcgtcggaagcattacgtttaccttgtttttgatgactggtcgtacggatatagcatccacaaggtaaacttggttccctgctctcgccgacgtaagcagactgcattctcagcaccagccgatgtgccgtgcctgcctacggcactcttccggttggaagcaacgcatgggtcgccagagtacatc

SEQ ID NO: 41892 - DNA, 380 bp, Triticum aestivum
  Clone ID: PAT_TA_41892
cccacgcgtccgcggacgcgtggggctcccgcccctccgcttcccgcctccgctgccgcttcctctccgcccttgcagcgggcgggacgcctccgccgccgcggtccggcctagtgtacgggttcggtgacaacagccacggggccgtgggccagcctgcgccggccgcggacgtctacgtccccacgcccgtgccctccctcccgtcgtccgtcgatgcggtcgcagccggacactaccactccctcgctgtatcctctgccggggaggtctgggcgtgggggcgcaacgaagagggccagctcggccgcgggctccaggccccgaggaatacttggagcaatccagaacaggtgagaggattggagaatgttcaagtt

SEQ ID NO: 41893 - DNA, 380 bp, Triticum aestivum
  Clone ID: PAT_TA_41893
cctagtactcaagcacctccttctggagcagcttccaaaacacctcaaaagaagccatctgctgggcagaagaaacctttggaagcaattggctcatctcctccaccatctggcaaaaagcagaagggatctggaggcttccatgatcaaagcattgaccagctgaatgatgttactgcagttagtggtgttaatctgagggaagaggaggagcaacttttctctgctcctaaggaagagagtcgagtttcagaagctgctcgtaaagttgtacaactagaagaagaaaggctcattctacagaaggggcctctgacaaagaaattagcagagatcatgagaaaatataatctgaagagcataggatgtgacgtagagcg

SEQ ID NO: 41894 - DNA, 360 bp, Triticum aestivum
  Clone ID: PAT_TA_41894
ggctacaatttccatgcctacagctgaaggagcgactgtagctgcagagaggcttcagagcatggtaacattgtttatgagaaaaatccacgacggactaataacctacttcttctaggaagtatctactgtaagtttatgacttggtgctagctgaagcttgcattttctaccaaaactgctattaacaaaagaactctagcgacccaggattttatctttaactgctattaaactcacaagagggagcattttaataacaaaagaactctatccatgttttctgatatactgtgtatatgcatgatgtactagcagttcctattttttaactattgcgtaccagaaaaacgaattggt

SEQ ID NO: 41895 - DNA, 388 bp, Triticum aestivum
  unsure (1)..(388): unsure at all n locations
  Clone ID: PAT_TA_41895
cgcggaccgcgtngggcggacgcgtggggngaaacgttcagntctcgtctctatcatcgtcatctaaaagtccacttacgacttcgatgattcaagatgatgtggatgatagtaataatgattttattgagcaatttgctatggtgtctggaagccattcttctacattggataggctacatgcatgggagagaaaattatatgatgaaatcaaggcaagtgaaaatgtcagaaagacttatgacgagaaatgtaaccttctccggcaccaatttacacgaggtctaaatgcagaactcattgataagactcgagctgttgtgaaggatctgcactccagggtttctgttgcaatccaggctgttgatgcaatctcaaaaagaattga

SEQ ID NO: 41896 - DNA, 344 bp, Triticum aestivum
  unsure (1)..(344): unsure at all n locations
  Clone ID: PAT_TA_41896
acgacacattcttaaatgcaggcaaggaggggtggcttcttctcctcctcctcctcctcctgcaacggtacaagagccagcgccagcaccatcacttccccactcctccactagccactgcccctcccttccacatacacacacacacacaccatctntttctccatccatcctcccctcctccccaaagagagcttgcacagcaacttggaaacggcggtgatctgcaaagatgaccaaagatgaggacttcaagctggtcaagatccagacccacgtcctgagggtgaacatacactgcgacggctgcaagcacaaggtcaagaagctgctccagaggatcg

SEQ ID NO: 41897 - DNA, 331 bp, Triticum aestivum
  Clone ID: PAT_TA_41897
cggacgcatgggttcgccttcctagaactgcacaacaaagggtcccttgtgcaacatcaacggcctgctcgtttgaaaccacgctgtatgtggcctgacgatttcgtctagaatttcgactcaagatcgactttgttcagtccccatgctgaatgctgaatgtggcttgacgatttcatctagaattctaactcgagctcgactttattcagctgggtacatagcttcgaaaatggtcttactgaaagacaactacaccaacatacactctgcgccagcactctctcgtggcaaccagggctggggaggtttttctttcgaaaatctcagc

SEQ ID NO: 41898 - DNA, 339 bp, Triticum aestivum
  Clone ID: PAT_TA_41898
ctcacgcgtgcgtggtctcgtccaccaaaccaccaaccacatatcggggctccgggtctaaactaccaattcaaaccaccatcctccccgaatttctggcagacggtcgtctggagattgatctatcgtgactgttagaagccacagacactgtatatgacgcagactgctgagctttcctgcgaggagaatgtttacatcagcaaactcgcatagcaagattagaggtactaggatatcgtggagttcatcgttaaggtgaacaagacagctgacttcgtgaagcccacactcaaagagcacacccttgtattagttgcttacaagaattttaatggt

SEQ ID NO: 41899 - DNA, 319 bp, Triticum aestivum
  Clone ID: PAT_TA_41899
cggacgcgtgggtgggctcttctagaactgcgcaaggggggttgtgtagtgcaacatcaacggcctgctcttttgaaaccacgctgcatgtggtctgacgattcaagagtacaatttctgctccagatctgactttgttcagcctctatgctgagtgctgaatgtggcttgaccacagcatctagtgttctaactcgagctcggctctatgcagctgcgtacatatgtttgaaaatggtcttactgaaagacaacgtctccaacgttcaccgttgcggctggccctttttgcttggcaaacaagtaatggggaggtttt

SEQ ID NO: 41900 - DNA, 257 bp, Triticum aestivum
  Clone ID: PAT_TA_41900
acgcggacgcgtggggcgagaccggaaggagtgctgatacagcgccggggggagcggcgagccctatattcctcgcctcctctttctatgggtcagagatggcggtccgtactaaccacccatctgatatgcagaacgatggtggtcagtacctccttggattcagattatctgaggtgttttgtgcttaaagcagttgtttttctgggccaagctatgagaggcgctgaagcataagctgttccatgactcaaaac

SEQ ID NO: 41901 - DNA, 380 bp, Triticum aestivum
  Clone ID: PAT_TA_41901
cccacgcgtccgcgaaggagataacctggacacgaggggaagaggtatcggtaaagcttcgccacaactcacattttgacaagcataacaagctttttactagttttgatactttgagttgcgtcgaatccataacgaaatcgcttctcaaagtcaataggttgctcttagtgttaacacattcgcagctaccatggttccaggtcatacggtgcatgtggtttttgagttgtcaatatacaaccatacaaattgaatgtactgtgtatgctaagataccttcaacttttattttatgaatacctacttttaggttcattgcttgttttttttttatgatctactgaaattatttgtttttttagtttaacatacctttt

SEQ ID NO: 41902 - DNA, 292 bp, Triticum aestivum
  unsure (1)..(292): unsure at all n locations
  Clone ID: PAT_TA_41902
cccacgcgtncgctgacgcctgttacgattcgctctcttcatcttgggcccctggcggacactcaaaaccctatgctccccctttcattaacttcatttaccatccatgtttcaacacatgccatagaaaaccagcaacaacaccaagtactattacgtgcttggtgtatccaatacaacaacccctgtttagtttaataaagcttaccctaaagctcctataaaaaaccattctgtttacggcggcaaccctgaaatgttttaataattgtcacaagcttattattatttt

SEQ ID NO: 41903 - DNA, 376 bp, Triticum aestivum
  Clone ID: PAT_TA_41903
gcattctctgccggcggaccaagaactgcgccgcgctcgtcggggaggcaggggtcggcaagacggccatcattgagggcctcacccagcgcattgccagcgggaaagtccctgcgagccttgccggagcgcgtgtggtagaggtcgacctcggagccatgctggccgggactagtctccgtggcatgtttgaggagcgcatcaaggacgtgataaagagcgcagaggacggggatggcaaggtgatcctcttcatcgacgagatgcacatgcttcttggtgccggcgacgatgtaagtggcacggacgccgccaacctgctgaagccggcgctggcccgtggactcattcgctgtgtcggcgccaccaccctcaa

SEQ ID NO: 41904 - DNA, 313 bp, Triticum aestivum
  Clone ID: PAT_TA_41904
cgcacgcgtcggcgaaggagatatcttggacacgaggggaatttgggggcgtagatgtacatatcatttattatattagcaaactacttgtgccttccacgtgctgtaggtacgccaagggtgagtccattgtatctccgaaagttgttatgcaactcgttattgaaattcttgaactacgacattgggagtaagcgcgattccaggtgctgcgacgaatttgtattgtggggttgtgttatacaaccagactataggtatgtcttgatgaagcatgggttcctacaggtcttattctaaaagtacctatttg

SEQ ID NO: 41905 - DNA, 380 bp, Triticum aestivum
  Clone ID: PAT_TA_41905
cccacgcgtccgcggacgcgtgggcaccgaaacatatgatgtgacgacaatcagggcaagcacgccaatgttcctgatgtcacgcaagatcaagtcacttggggtcaagatggtcatctctggtgagggttccgatgagattttcggagggtacctctacttccacaaggcacccaacaaagaggagctccaccgtgagacatgtcaaaagatcaaagctctgcatcagtacgattgcttgagggccaacaaggcaacatctgcatggggcctcgaagcacgtgtgccattcttggacaaggagtttatcaatgaggcaatgagcattgatcctgagtggaagatgatccggcctgatcttggaagaattgagaaatgga

SEQ ID NO: 41906 - DNA, 378 bp, Triticum aestivum
  Clone ID: PAT_TA_41906
cggacgcgtgggctcttcttctccctcggcggcgcctcgtctctgcccgcctccatccggctaccctccgcctcgcccgccgccgaccttgcctcctcccgcatgcgcgaggccgagctccacgccctctacctcctccgctcccagcgctccggcctcctcagcctcttcaaccgcactgctgcccctgagcccaccaacagctctaccgccgcccctgtctcgctgtctgatctccaggctgcgctcctcagccagatcaagatcaaccgcgagatccaggagtcgctcctctcaacgcaccactccgggaccggcaatgctacggaggatgctttggatcttgatctgccaggtcccgtgtgcaggaggagggaa

SEQ ID NO: 41907 - DNA, 278 bp, Triticum aestivum
  Clone ID: PAT_TA_41907
cggacgcgtgggccaaaccccagctccatggcgacggtggcgatggacatctcgaagcccccgccggccgcgtccggcgacgagtcggccaagggcgcgcgtggcggaggcgaggggctgcgccagtactacctgcagcacattcacgacctgcagcttcagatccgccagaagacgcacaacctcaatcgcctcgaggcccagcgcaacgacctcaactcccgagttagaatgcttagggaagagctacagttactccaagagcctggctcttatgt

SEQ ID NO: 41908 - DNA, 384 bp, Triticum aestivum
  Clone ID: PAT_TA_41908
cccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtaggttaggatttttatgc

SEQ ID NO: 41909 - DNA, 388 bp, Triticum aestivum
  Clone ID: PAT_TA_41909
cggacgcgtgggattagtcacagaatatttagctggcaagatacaaattttatgattcatccatctctccaattctgaccttacatatcaacctgtctccatgtacccttctatatctggtgctgctacttttttttccttacatggatatatgtatgagatttctttgtttaggtatatttgtgcctgaaagaagtttacatctattttcttgttagatgatcctgaatgagaatacttatgagatcgcatgaatgagatgttgacgccctgtatgctccaaaattgtatcattcttcccacacaatggttagaatcccaggtgttgaatcacaatagacaagaccatatttcccattttctatagtccaactaaaaatacatattg

SEQ ID NO: 41910 - DNA, 349 bp, Triticum aestivum
  Clone ID: PAT_TA_41910
gctaattgatccaacaatccagaatgcagttgcaggggctggaccttgctggttcaatgctatataaagtgtcggcgctaaattgaaagggggggcggctctattaaggtgttggctcgctatgtacaccaactgaaatatagcctagacactgcataccaattgatgtttgcgccacatctatgtgggactcaaacaaatgagctgcatcttatactaccttaccaggggcagcattatcctaataggcactgacttgaacgccaaaccgaactgctggcccatcgagacacatttattctaatgcccgacgcatgttatagtctactggttgattaccccgaaagag

SEQ ID NO: 41911 - DNA, 383 bp, Triticum aestivum
  Clone ID: PAT_TA_41911
ggcgggagctcattaaggacggctgcagcgtcactttcctctccggtgtggtggtggcggaggcctttctgctcaagctctgcctcaaggtgcagggtgtggctggggtgccacattctgagctgcagaaggagctaaggatctgggcggttagctctatctcggtcttccagaaccagcaattctttggagtcctgctgaacatgcttgtaaaccctccgctgcctgtttattcactactgagtgctgatgatgagatcttggtgagagaggtcctttatgatgctttgatcttggtggattattcattcctcaatggagctgaagttgatcaagctgatagttcccttttgcctatttttgtgtcaagattggttataact

SEQ ID NO: 41912 - DNA, 161 bp, Triticum aestivum
  Clone ID: PAT_TA_41912
cggacgcgtgggttttagcgtcctcttctcaagctctttgtggtgtgtgagttgaccaactttatatgttaatccagcatcccctcatcaactagggtggtgtagtaagttttacactcctttatcatgcatgaatgagtcataatgggcctttgagattt

SEQ ID NO: 41913 - DNA, 371 bp, Triticum aestivum
  unsure (1)..(371): unsure at all n locations
  Clone ID: PAT_TA_41913
cggacgcgtgggcggacgcgtgggtagagagagagacctcgcgacataagtcagttgtaccaccggcgatcgagccagtctctcccggctccggctccggcgcgccgctatccataccagaggtcctttccctgccgcccgcgggatacaacatacaaggatgaattccctctccaacctcctcgccccccgcgcgcgcccttccctcccgctcccgctcccgctccgcgccgccgncccggncaccagcagcgccagagcggcggcaccggccccgcgacggtggcggcagcgcgcgcggctgccctcgccggtctcggccgtggcggcggaggcgccctcggcagcgtcgctgattgatggcgaggaga

SEQ ID NO: 41914 - DNA, 394 bp, Triticum aestivum
  unsure (1)..(394): unsure at all n locations
  Clone ID: PAT_TA_41914
cccacgccgnntccgcggacgcccgtgggtggtctgctttgcttcgatgcatttatgctcttcacggtgggtgtgcgaagttcgtattttaacccagttgtgttctttcggttcggcccatgtggtttggtggaaataggttcaaagggctgtcaaaagcattacanannaggggcagcagtgaatggtggctacccaacaaaatnngctgttatgttcagatgaaattgatcagccccttgaaaggaaattttgctttgacnaacttnaacaagagctatgttacagaaaaaggtattattcattgtatttggatgaagcatgtgtgtgaaaagttgcccagagggattgggaagaatgaacggccctgcacacacttggtgttgtgaacact

SEQ ID NO: 41915 - DNA, 340 bp, Triticum aestivum
  Clone ID: PAT_TA_41915
ggcgtcttcacaaacgccggctcgctctcgctccgtctccctcccggctcccccgctccgcgccctacgccgacagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgagcggtctacgtcgatcttgagcccaccgtgattgacga

SEQ ID NO: 41916 - DNA, 178 bp, Triticum aestivum
  Clone ID: PAT_TA_41916
cgtccccatatcctcaaagtactcttacaagaccagtttacattcactagggcggctgtgctcattatcctccataccaaccatcatacatttatcatccagttcaaaacatcgcaaactttctatattatggatccccaaattatcccaactttttaaatgcctacccacattcatt

SEQ ID NO: 41917 - DNA, 349 bp, Triticum aestivum
  Clone ID: PAT_TA_41917
cgcggcgcccgatctcgtcgtacttggagccttggaggagactcgaaccctagggccctcccgccgcaggagagatcccgctcagcctcggctccaatccgcgactcgactcgactcgaagctccagctccgccgccgccccccgccgctgccgatggatccgaagctggtggaggtgacgcagctgatcgaccgcttcaaggcggccttcaaggccagcaatttcgacgtctgctcgaccctcctctcgcagctcaaggtcctcctcaccaagttccccagccttcccccggtgttccagcagacgcccaacgccgtggaggagctcaagcttgcgagggaaatttat

SEQ ID NO: 41918 - DNA, 121 bp, Triticum aestivum
  Clone ID: PAT_TA_41918
cccatcactacaaaccctatctccatctacctacatatctcacccgggttttccaatatgcaacctatgctcatactgcacaagtagcgcacccccacctcccataacataacacaccttg

SEQ ID NO: 41919 - DNA, 253 bp, Triticum aestivum
  Clone ID: PAT_TA_41919
tggacgcttttttcaagctcttggaaattccttaaatttaggaaccgggggatcgcggctccgcgcatatctacactcacccccccaagctatgcctatgacaattatccgtttttcccacaataaggcgagtgagttgtgttaatagagctgctggcttcgttgacggggtacttagcaaacatattctataaccctttggatgttggaaaaagtataatcatgtctcccgcgccggcgagataaaaaagat

SEQ ID NO: 41920 - DNA, 293 bp, Triticum aestivum
  Clone ID: PAT_TA_41920
ctttttcattttcattttttgcgggaagatcttgccctccctcacctaacatgtagtgaagcgccaaccacaagcttcttcagtaaaactccgaaaagatctttgcgatcccccctggatcgaggaatcggtgaatgggtccgggtgatcatgccggcgtccgttccgccgacgggcggctggaggccctgctctccggcggcggcggggcacggcgcatggcgttggccgcggcgcttgagctgcggctgctaacttcgctggccgcgccggccgtggtggtgtacatgctg

SEQ ID NO: 41921 - DNA, 385 bp, Triticum aestivum
  Clone ID: PAT_TA_41921
ttcttattcttctccgccgccggccggccgccgcctccgcctccgcctctgcgtgcgcgtgaggtccattgatttgatccattcagttcctgggagaggagaagggaagagaagaaaagatgctgccttggatcttcagccggaagggcgcgtcgggcttctcctgggcatccaccgccgaccaggtcaccgccggcatctccgccgcagggctcaccgcaatagtcaccggggcgtcgagcgggatcggcgcggagacggcgcgggtgctggcggctcgcggcgcccacgtcgtcatggccgtccgcaacctcgccgccgccgagaccgtgcgccaagccgttctcgccgagacccccggcgcgagcgtggaggtgatggagct

SEQ ID NO: 41922 - DNA, 284 bp, Triticum aestivum
  Clone ID: PAT_TA_41922
cgctccccccaccggccgatctccacgccaccgccggccaccttgtgtctccgcccgccagcaccacaccccgcccgaccgagccccccttttcccagacccgcgatgagctggtggtgggcgggcgcggtgggcgcggtcaaaaagctgcaggaccagcgggcggcggcggcggagcccacctttcagagcgtggggctcattctcggcttcacggggatcgtcggcaccttccttcttgacattcttccgcgcggcgacaccctgggcgggctctgggaggt

SEQ ID NO: 41923 - DNA, 253 bp, Triticum aestivum
  Clone ID: PAT_TA_41923
ctgacgcgtgcgattacacttgaggctacgtatcattgatcgggggattgtcatttttgataggaccgataacttaacgggagctttataggatgcacgcttaaaaagagtaaattgctatgggattgggtacgctggtccttactaggggcggttaactaggctgagactatggaccaggacagtgaagggtatgtccatgtattaaggttattgactctgtccgacaaggccggtttagccaattattatt

SEQ ID NO: 41924 - DNA, 294 bp, Triticum aestivum
  Clone ID: PAT_TA_41924
cgctccccccaccggtcgatcttcacgccaccgtcggacacctggggtgtttgtccggcagcgggataccccttctgaccgagcccccctttttccaaacccccgattagcttgtggtgggcgggcgcggtgggcgcggtcaaaaaacggtaggacgagcgggcggcggatgctgagcccaccttccagagcgtggcgctcgtacttgggattcactgggatggtcgggacctaccttcttgttattctttcgcgcgactacaccatcttctgtccctggatagtgttcttttt

SEQ ID NO: 41925 - DNA, 213 bp, Triticum aestivum
  Clone ID: PAT_TA_41925
acccacgcacgcgttttctgaactttttttatgtgatcccaatcccattgggtcaggcccttgccaatagcgaagggcaagacaaagcagctccatctctgaagcctataatagaaacgcctactatcaaatcgttcatccaaaggacccttactggaattgctctgtagatctatctaatactactaccacgcgtattaatggttatgtcta

SEQ ID NO: 41926 - DNA, 316 bp, Triticum aestivum
  Clone ID: PAT_TA_41926
cccacgcgtccgcggacgcgtgggtgtccatccggtggttggagcacggggcaacgctctggtcgcgatggggttgagctgcgcaggagggggaggaggctggcgacagggaaccgggccagggaggaggcaagcggcagttgcggatgtggtcggtggttgagggagggtctccgactagagcagcaggagcaaggagctcgaggaagttcaggtttatggcttctcacggattgtgattctggtcatgctacctgttatgaaggctgaggcgagcatcatggagatgagcaggcgagtggctgatacagagagc

SEQ ID NO: 41927 - DNA, 142 bp, Triticum aestivum
  Clone ID: PAT_TA_41927
ctgaaatccccatctcctcacccgaatccctcccctggggcctccgctctcttctccctaaggaacttacctatcctccccccgtcgtcatgattcatccaccaccgcctttcaaaccaaatccgctcatgggctccccaca

SEQ ID NO: 41928 - DNA, 368 bp, Triticum aestivum
  unsure (1)..(368): unsure at all n locations
  Clone ID: PAT_TA_41928
cccacgcgtncgggttggctgggatgaatcaactgcatctgagaggcgcactcgtgtttcgatatgggagattgaaccagttgccacacctttttatatttgtccaccaccatttttcaggccaaaactttctaagcagccaggaatgccagatgatgaaggcgaggttgatagtgctttcaaaagagccatgccatggcttggtgatgactttgccctaaaagatgtccaaagtcaattatttccaggcctgagcttagttcaatggatggctatgcagcaaaattctcagatgctaccagctggtgccccagctgtgcaggcgccgttcttgaactacaatgcaatggcttttcatgatgggatgg

SEQ ID NO: 41929 - DNA, 298 bp, Triticum aestivum
  Clone ID: PAT_TA_41929
cggacgcgtgggtgagaaccctggtcactaaatgctggtcgctcggtatctatagcgactagactatagccaccacgaagcgaccaagtagtgttggtaccaatagaccactagccaccaattttgtacctttatcaaccgatcaccttggtggctaaaactaatgtctctagtagtgataagagattaagtatgtattgaatgtctaatgattgcaactacaagtattatttcggtaacgctgtatttagaaatataaataaatatctaaggtgttgccctagcgagtagttcaact

SEQ ID NO: 41930 - DNA, 296 bp, Triticum aestivum
  Clone ID: PAT_TA_41930
acgttcagcgtgcgaggaagtgtgagaatgcccgttggcaaatccgctctacggggacccctactgttccttatcctggccttggagacccagcaaaccaacagtggagggtaccaactcgaaccgacgccgctaagcacatcccaaatgaagcgggaatagtatgggtcgggccaaacccctcgccatttgcaagaatgacctacacctgctagaccaacacaagcccaaaacacttccttccctcttgatcccactcatgccccatacattccaggagtttaagaacaaaaacc

SEQ ID NO: 41931 - DNA, 355 bp, Triticum aestivum
  Clone ID: PAT_TA_41931
cggacgcgtgggaagtggcagatcgagagatcaggcagcggccaggccactcctctccctcggccgcggagttgctcccgacgggccacccggacccatccgtcctcgagcgtctcctccgcctgctcgcctcccgtggcttcttctccgagcacacagctgatgacaatcggaggcggtacacgctgaccgccctgagcacttcgtgcgcgcccacgccggcgttcccgtccacgcctactacggccagtccacgccgacggcgatcagatgcaagcacaaccggctcccttttttccaccgggcgccccttccattccctttctccactcatccgacgacgtggactgggatt

SEQ ID NO: 41932 - DNA, 364 bp, Triticum aestivum
  Clone ID: PAT_TA_41932
cattccccagcctagctgaaggcggcggcagcaagcgattccaggtccggctccggcggccggctctccctcggtccctttcctccggccggccctctcggcctccggcactcccctccgcgcatccggccctctcggcttctcctccggccccccctgcaggcgcccagcgccctccgacaagtgtcaatcagtagtgggtggaagtggagtggagacagggaggctcggcgtttggaggcaaaaaaagctcaaccggccggcgaggcgaaatcatcgaaacgcccccaccaaccccccaccaaccggccgaggccatggcggcggcgcagaagccggccaagcggctcggcggcatggcggg

SEQ ID NO: 41933 - DNA, 293 bp, Triticum aestivum
  unsure (1)..(293): unsure at all n locations
  Clone ID: PAT_TA_41933
cccacgcgtccgggtgctgtcctggtcatggtcgaggagcttttgataaggaagatagatgacgaacccgagagctacaaggccaaggctgccaccgccctagccaacattgttgagtccggcattgatccagacaccaccgtggtgaacaaggaagggcacgtcctcacgtccaagtattgcatctataactttgtgtgcatgctcaagtgcttcgtacccgacgacttcaacctcagcatnatncgcctactactcgcgcttaccggatttcgcaagcccctggatgtcat

SEQ ID NO: 41934 - DNA, 361 bp, Triticum aestivum
  Clone ID: PAT_TA_41934
tatccagcgcagaagcggtgggcgacctgctggagaggggatgaagaccttatgcgtctaaacagacctgtccccagacgctcgctcacaggcagaattgaccagagaaagcagttttgttgatctaccgggtagaaaataaaattttgccccgccatctttgcttggcggggtgtacattcgatattcgagtcatctagcgatacttttgtcaacaggaaaagaaaatggcgacttacatgtaattcagctttagaaggagctcagctgtgtacaaagaaaaaaaacccatagctttatagacttacagatcagcgagatgcaagatagtgggtgctttttgttctttcgatcaacgatc

SEQ ID NO: 41935 - DNA, 300 bp, Triticum aestivum
  Clone ID: PAT_TA_41935
cggacgcgtgggccctgtgctcctcaatcaagtctacgggcctgccgttctagcccgccgccgcaccatctcctccccggcaccaccgcactactccctccccgcgccggggaccaaccccttcccgggccgccggaccatctttttccctggactaccacaccacctcactccccgtgccgtggcaacaccccctccccgcgccgacgtaccatcttctcccaagcaccaccgcaccacctcactctccgcgccgtggcaccaccaccttcccgcgccgtcacaccctcttcaaccacc

SEQ ID NO: 41936 - DNA, 269 bp, Triticum aestivum
  Clone ID: PAT_TA_41936
cccacgcgtccgattcgccgtccatcgccgctctgcccccccacccagcgcgcggcttcccgcgatggcgctgtccgcgtcggcggcgtcggcggggaggggcgcgcgggccgagaaggtgcgcaggatcttcgagcgcttcgacgccaacggggacggcgggctcgaccgggccgagatggccaagctcgtcgtcgccgtcaacccgcgggtcaagttcagcgacgaccagatctccgccatcctcgacgaggtcttccgcacctacg

SEQ ID NO: 41937 - DNA, 361 bp, Triticum aestivum
  Clone ID: PAT_TA_41937
cgccaaacccctcaatcatctcaattcgaccgcggaaccctagaggtccgccagagatccgtccatcaggccagccactgatcccctcctcgatcagcgagtaccaaatccgcccccttttggaggggaggcgctgcccccgatctacaaattccagcagacagagcatcgtcgatcttcgtcaaccgatcgagggccgcaatctgggtgaagaagaagctaggtccggcgacatggggaggcctctgatgtacgagatagtggagaagccggcgagcagcggcgtgatagccgtctgctccctcatctggttcctcatccagaagaggggcatcgggtacgcggacgtggggctgagcta

SEQ ID NO: 41938 - DNA, 342 bp, Triticum aestivum
  Clone ID: PAT_TA_41938
gtctcgccctcgccccccgtcccctcttcggcgcccgggctaagggaagatgagtcgtggccggagtgctcttggtggtcaaagttctctgggttacctgtttggagatggtgagcctgcaaagcccgctgcagcaccagctgccaagcccgcacctgctgagaaaccatcaccggccggtgctgatgtaaccaagcagattccagctggcattccaggtagccgggcgaacaactactaccgtgcagatggccagaacacgggcaactttcttactgaccgtccttcaaccaacgttcatgctgttgctggcggtggttcctccctgggctacttgtttgg

SEQ ID NO: 41939 - DNA, 363 bp, Triticum aestivum
  Clone ID: PAT_TA_41939
cggacgcgtggggcatcacagacaatttctccgaggagcgcatcattggccgtggtcggcatggactagtctacaagggagtgcaggacaatggggtatgcattgctgtgaagaagcttcacctcatgtcggggcttgacgacgaggaattcaaaaacgagtttaataatcttatgagggtccgacatcaaaataccataccgttggttggttactgcaatcatacagcacaggtgcttgttgagcacaatggaaagcatgtttctgctcgaatagaagaaagatatttatgctccaaatacttggagggaggaacccttgacaagcatctttctaatgaaccatgtgcgtttgtctggcaca

SEQ ID NO: 41940 - DNA, 158 bp, Triticum aestivum
  Clone ID: PAT_TA_41940
gcgaagtgagagatcagttttcgatttcgattccggttccgcttagagaaggccccagactagctagcgatatggcgaccggcgcgtgggtgatcaagtgcaaagccccggtgtcttggaaggcgggaaaccctttgtcaatgaagaaggtgaaggtg

SEQ ID NO: 41941 - DNA, 370 bp, Triticum aestivum
  Clone ID: PAT_TA_41941
aagcgagagtggacgttttttagaggatgcacccaactgattcatgggaggtggcaagagagcactcttttgtgccaggcacatctggagcgcgggcttcttcacatacccttatggaatacggtttctcacagggtcatgtttttctttgccatagcggttactgccttattggtgtcacaagcaaatgggtgaactgccctcattattgctactgttgtaactcataccacagaaatgtgttgttatactgtataaaacgatagcataactattgataaatatatgctctctgagcaagatcttttttgtgcagccacatttttacgactacacttggatatcttgccatagtgttagggtctgacta

SEQ ID NO: 41942 - DNA, 250 bp, Triticum aestivum
  Clone ID: PAT_TA_41942
cacgcgtcacggctagtgtgagtttagtcctgcttgccaagcttagaagggggcggggggattatggactggtcatctacaaatgattatacacattggtaaattcctcaaccctgaggtgtttgacctcaccgaggaagacctgagaaataaattatcttctggagtgtacatggttgcctcactgttcttggcgatctaagcgacacttatgtcagacttggttaacacaattctgaaaacatacaaa

SEQ ID NO: 41943 - DNA, 371 bp, Triticum aestivum
  Clone ID: PAT_TA_41943
gccgccgacacgcacgaccaccaacggagccggaggaagagaggaggggagaagccaacaggtaacgatcgtgttccgctccggtgtgtccgcgcgtcgcgtggtggcggatgcgcgccaccacatgctgggtcgtcttgcgtcgatcgtggtcaaggagctgctaaacggacatcgcgtggaggttgtacgattcgaggagatgtgtatttacgggcgacttgtacgtcacaagatgaatgtcctgcgctctctacgcaagcggatgaacaataagcaccttggaggtgatatacatttccgagcagactaaggtattttctggcgtaaacggcgccggatgatcccacacaagactccccgcggagagg

SEQ ID NO: 41944 - DNA, 317 bp, Triticum aestivum
  Clone ID: PAT_TA_41944
gcgggggcgggccacgcctacgcggacgcgtgggggggcatgcacatttacccttttctgattgtagcacgaaggagtacgaagaccgagcagtttaattggcgacaaacccggcaaaactccaagcactgggaaaaagaggttaaagaaggaagaagaagctggtgtctattggacactgctcgatgggttcggaaccttgatagggcgtacttcaagatgtggaacatttattgctctgggcgtcatccggagccgtttaaggtaaaagaagacgacagtgagttcccatatgacagatgaggagcatgaaataa

SEQ ID NO: 41945 - DNA, 314 bp, Triticum aestivum
  Clone ID: PAT_TA_41945
cccacgcgtccggtccccctctctctccctctctcacaaacaaacaaacaaaccgctcttgtctcccattccaatctcgccccgtcggtcgaattacaagttagaagaagaagaagaggaatcagaggaagaagaagatggtgtctgcggtgcttcggacgatcctggtgacggtcggcgcggggtacatcggcagccacacggtgctgcagctgctgctccagggcttccgcgtcctcgtcgtagacagcctagacaacgcctccgaggaggccatccgccgagtacggcaactcgccaacgccccgtaaaac

SEQ ID NO: 41946 - DNA, 383 bp, Triticum aestivum
  Clone ID: PAT_TA_41946
cggacgcgtgggcggacgcgtggggttgaatcgttgcatcaactcaagcacctgaggtatctggcactattaaacactgacatatctgttcttccagagaacattggcaagatgaagctattgcaatattttgaccttattggatgtaaaaatttggtgaatcttccaaatagcattgtgaagcttagccagctgaggttacttattcttcccacgtcaagtattgtacctagagggttcagcggtctgacaaatatgaggagactaagcgggtttcgagcccacatggatagcgattcatgcaacttggatgaggtggggcctctttcccaactcaaattttctaacttaacatgaatggaagaaggtgtcgcctgccctgt

SEQ ID NO: 41947 - DNA, 215 bp, Triticum aestivum
  Clone ID: PAT_TA_41947
cggacgcgtgggcggacgcgtgggcacagagttcgattctggcgggaccacaccacgcacacaccaacacgcggtcatgtaccgggcggcggcggcggacatttcgcggtcctcctactcggcgctgaggcggcagctcgcgcgcggaggcggcggggagctatttcagtggtcccccgggtaccctactcaagaggtgatgcttggtgttggcg

SEQ ID NO: 41948 - DNA, 370 bp, Triticum aestivum
  Clone ID: PAT_TA_41948
tggctgctatacgtgatggcgtgggattatcagacagagagctgggatgtgattctgcacgttcagcgacagcacataagcagcattttggcccaacaaataagatgcaaagtgcctcacaatgttcagatagctttgcggggcacatacaagaagagaccagcggggcaccccacgactcgccgcgacatgagcaccgtacgaacagcccgctaagaggagtaagttctgctcaatctggcgggggcaaggagacaagagcacaacatgtccgaagcggggtgatctgccaaaggcgccaaggaagtcaacttactgctccagatgcaacctgacaagtcccagaaagaacacctgcaccaacacgccc

SEQ ID NO: 41949 - DNA, 234 bp, Triticum aestivum
  Clone ID: PAT_TA_41949
aggcttcgtggcgcctgcatgcaacgtcataacttttatataggggcatttaaatgcaatccactgcccttttttcaacagcaagcagaatagcgacagcatggcgttacgcaactgaatccgctagaagcacattccactgacgccagcctgaatgataccgtagaggctctcgccgatcagctttcccagcaggtcctgccccttactgggcaatgggacgcgacctgtagt

SEQ ID NO: 41950 - DNA, 397 bp, Triticum aestivum
  Clone ID: PAT_TA_41950
cacctccataccgatctcacccccaatggtggccacgcccacactcgccccccagccctagatcccattcgtttgcgcatggcggagcacgccgcccgccacctccgccgccgcggccccgtcgccggctggtgctgctccttcgccggcgtcccgcccagccccgaccaccgcctcccccaccgcaccctctcccacgccgccgcgccgcaaggaccagcagcaggatctgtgtgcaccggcggcgagggcccgcggaagcagcagccgccgccgaaatccccctcctccttccacggctcgccctcctccaagctggcgggcctcatcgactacccgcgccggatcctctccccgggccgcgtctcccccatcgaccccggcgcccacccgccca

SEQ ID NO: 41951 - DNA, 343 bp, Triticum aestivum
  Clone ID: PAT_TA_41951
gtgtgtgtgtgtgtgtgtgtgtcgagctcaccaggaattccgcggcaggtagctggttgggtggaagatcgatcgacgggagagaaaacaggatcgagatgatgctcaaggatctcgcggcaattcataaataccaggaacataaaaactggccctggccgacgcaagaacatgtaaggcctaacacacgcctacactgaccaaaccagtgatgtctaataccctctaacgtcatgttccaagaagaagcacactctgccggtaaatccacaccctcacgcggactttatcacgctagatacgtgttcactcatcggaactaaccgatgcactatccagagct

SEQ ID NO: 41952 - DNA, 396 bp, Triticum aestivum
  Clone ID: PAT_TA_41952
cggacgcgtgggcaaaaacgcacgcctccgatccccacgccgagacggcagccttagacctagccaccacagccgccgtcggacagtgacctccgcggactccgcaggcacggggataagatcactcaaccccaggctgattgtggctgggaattatgtcatgaactaccttgcggcaagaggacctaaattgcagaacttcgtgactatttccctaattcagcttgcatgtcggataacaaaatttggatggtttgatgacgacagattcagagagatttttaaagaagcgacagatttcttagctctggcatctcaggatcactatttaataggattgaagatactaaattttctcgtaatggaaatgaaccaggcaaactctgcaatgccttt

SEQ ID NO: 41953 - DNA, 335 bp, Triticum aestivum
  Clone ID: PAT_TA_41953
gaccgacaaaagtaaactaattcccatacctcacgtaccgataaggaggacagagaccgcgcgcgcagagaggagaagctgccggctcgactccttctccgtaaactgactactctggcggctccatacatccaccgagaggagagggcaggcggaggacgtaccaccggcggacgccagaggccgcacctacctacctatatatctatctatctatctaagccgaccgaatggactcggagcactgcatctcgcgcctggccgccgcaagcgatactacgcggcgcagctggggcacgcacatcgggcgaggatggacgagctggacatggact

SEQ ID NO: 41954 - DNA, 391 bp, Triticum aestivum
  Clone ID: PAT_TA_41954
gtttactggaagtaagcttgactgacaatacacgtaattcaatgcttgttcttctaactaaaaattcagttcatgattctggtcctatacttactgaaatgattactatagaggtcacaaagctttcaaattcaagaataaggagagtattttctgttttctttccgccaatttcttttcatataaatatgacatttattgtttatagttaatgggcttgttttagctatgcagttttcaacctatatgatttctggttattggataataaactttcatgtagctctcgactgcccacacatgtagctgtacaatttaatctctagatacatcatacatgcaaattctttatctccctgtctccttctataggtacctaaaatacttgaca

SEQ ID NO: 41955 - DNA, 441 bp, Triticum aestivum
  Clone ID: PAT_TA_41955
gtgccggtcccgaatcggagtgtcggcctacacctacgcgtactacttaatgatcaagggctgatgtgtgtgcccacaagaagagggtggtgacccttcggcagtccctgttgaagcagacctcgcgggtggcccttcaggagatcaagctcaagtttatacacaccttattcaagttcggtcatggacgtgtacagaccactgacgagaggcagacgttctacggtaggctcaaggcttaggctgtgacagatcttataccatagtgctaccagctttttttattgctttgtggtagattgtctgcgaaccatttaatgcattgcgatcgcccctcaagacaacaatagtgttgacataaacaatgcgctccctacacttgcccacgcacaagaagcctctcatcttctcagacatggggctgccgttctagaggatcca

SEQ ID NO: 41956 - DNA, 228 bp, Triticum aestivum
  Clone ID: PAT_TA_41956
gattcggaattatgggaaggataccttggaatcggacgaacaagcacccatgactgagttatggccaaccctatcgatcagatacccgcgctgacggaaagaaacgaagttccattatagaggtgcgcgatcaaacagaacatcgagacctagtacggggcgctactgctgtcgacgacgttggtcaagatggaagccttgttggaggtggagttttaccacttatac

SEQ ID NO: 41957 - DNA, 394 bp, Triticum aestivum
  Clone ID: PAT_TA_41957
gccaaaccgaacgtattttattataacgcgctcgcacttaatcgtgagggctcagcagtcatggtcatcgccggtgacccctcatttgaagagctattgttcaagcatattccctctccacatggatccaaccacataatctactcacaacatcaaatgtagatcggagcatgttatatgcacagctactagcttatcacatgaatgcttaccacagtttttcacatatcttgacctatccactttaacgcggatttaatgctgtacttactggtcgaattttgattcactaacgtgagaatatctgttaagatgctgaggtatctgattgcactgtaccgatggttgactgttcaaggatcaacgagcttaataattcagagaagcctactgt

SEQ ID NO: 41958 - DNA, 285 bp, Triticum aestivum
  unsure (1)..(285): unsure at all n locations
  Clone ID: PAT_TA_41958
aggccgggggggacccacgcgtccggcacaacggatcttaatttattggtgcacgcacccacaatattcggcggggtcaataaatatggtgacgatcanttgaacattcggtataagaactgttgtacaagaagatgcccacgcccgatgtatgcaccaagatctttactaacgaaaccacttttggatctgagattgttattgtttcagctactggtttggcaattaaaaacaaaacgcagcttttcagttctctgaacagttacactgcaaccctgatttaat

SEQ ID NO: 41959 - DNA, 394 bp, Triticum aestivum
  Clone ID: PAT_TA_41959
gttatgtatgggcaagatacccgacgtccatacgccgtcaccaggaaaattaagtgcattggagaaggcattaataattatttttgaaagaaagtcagagtttgtggtcaagagttcaattctttggctgaagcttacgacttctataacctagtcaaaattctgttctatttgctgggcaaagggtcacctggcaaatggttgtccctctcgaggagatgcacaaaaaaaccaaggatagaaccaaagtgtagcaagtgctgacctggagggcacaaaaggaatgcgtgcacacggagtatcttcagcgtgttccttcaaagcaaacccgagaatttattcgcgtcatagatattatctcgtctatattttggatgggtggtatcttatcatt

SEQ ID NO: 41960 - DNA, 359 bp, Triticum aestivum
  Clone ID: PAT_TA_41960
cggacgcgtgggtccgcacagaaaatgaagaagggctggaagcgacgggattgcctgcaacagcaggctcgccaggagcgtttggagtccaacaggagcaggctttgtgaaaatgacattgatgaaatggctgtgaacatgaccgaagatgatatggaaaacaggccagtgatgaaagacattgttgaagaaagttcagcacaggatttgaaagaaacaagttctatatctgaagacctatcttgcataatcgattatgactcaaatgggcttataaaagatagtggcatgatgcttcaagaccaatatgacgatggaaaaactggaataaatatgagaaggtggtatgacaacaattt

SEQ ID NO: 41961 - DNA, 376 bp, Triticum aestivum
  Clone ID: PAT_TA_41961
acgcgcacgcgtacgcggacgcgtaggcggtcgcgttccatgccgagaatcataagacggcgggcttgcctgcggacgagcgaatcgtcatatgacatcgcaatccactgggggaaggacgcaccctagcgaataacaacatcctataagagtaacaccctacagcttgtccttcgtcttcgacgtggcatgcaaatgtttagcacaacgactcactggcaagactatcactttggaggtagcgacatatgacaccagacgacagcgtgaatgccactattcaagacaaggagggtattaacgcggaccagcagtgtagaaggttcgatggtaagcagcttgaggatggacgtaccttgtcagactacaacattca

SEQ ID NO: 41962 - DNA, 280 bp, Triticum aestivum
  Clone ID: PAT_TA_41962
cggacgcgtgggctatatcttaagcaacccaacattatcgggctgatgattttaaatgtgcgggtcttacacctaaacttctaaatgcaatcccttaacgacctgatcactcctgctaacagtgatgctttcataaagcaaccccatttttaaatgaataccactgtttgccgtactagcagccaatgacttaaaagcagtctacaattcttctgttttacgcaaaacaatgggccgaccctatagaaatccccatctaaagattgtttacacatacaac

SEQ ID NO: 41963 - DNA, 188 bp, Triticum aestivum
  Clone ID: PAT_TA_41963
gtgtggttttttatttgtgggggcgggaaaaaattaatgccgattcggaaaaactacaccgaagaaattcggggtagacccctcggttagacgcttttcggaaaacccagcatgtacctcaacaactttatcctctttcactcgattttcaagcctagaaacggccgacattacgagagcaccacgcg

SEQ ID NO: 41964 - DNA, 379 bp, Triticum aestivum
  Clone ID: PAT_TA_41964
cggacgcgtgggcgaactctctggcgccgtgccggcgatcctcgccgacctgaagctgagctacctgaacctgtcgaataaccggctcgacgggcccgtgccgccggggctcgccatctcggcgtacggcgagagcttccaggggaaccccggcctctgcgccaacaacggcgccggctttctccgccgatgcacgcccggagacggtggacattcggggagcaccgcgcgcacgctcgtcacctgccttctcgccggcatggcggggctgctcgccggcctaggcgtggcgattttcatcaagaagcgcccgcaggacgtggaggccgcggccatggccggcgccggcaagctgctgttcgcgaagaaggggtcctgg

SEQ ID NO: 41965 - DNA, 389 bp, Triticum aestivum
  Clone ID: PAT_TA_41965
tgcacactctaagcatttgatgcggtatggaagtgcaggcggtgtcaccagcaaagaatgaaacaggagcagcaggatagccatcatcaatcctggttcttggtgataacttgctaggcatcatacatggaagggcagtcagggaaaaccatgcagagtctaccggatacattgtcatccctcaaggggttcaacaagtacctcacacccagttggattgaatcagtgtcccacatcctcaaggagttgacaccaaccaaaccacagaaagtaatggaagaggaggctcaaaatgtatttgagtgtgatgacacacaattagacattaaaggtgcaaagattcaagatgaaatggtttcactgggtgcccaactaaagcagaaaacact

SEQ ID NO: 41966 - DNA, 333 bp, Triticum aestivum
  unsure (1)..(333): unsure at all n locations
  Clone ID: PAT_TA_41966
cggaccggaacggccggggcgacccacgccacccggcacgcgcaagcaagagaggaaagggacaanccccgagggacacgggggggggcccgaaaaccgagagacccaaaccgaacagacggccagggagacaacccacccnagggaccccaaggaaaggacaaggaagcccacgcacaagccaagnggaaagacaagggcaaaggacgggccgaacggaaagagacaagggagaagaagcacaggacccccaacaaacaagccaaaagcccacaaggcgagaangacaggacgccgaaaagagacgaggagcaaaaaaacacaaagaacaaa

SEQ ID NO: 41967 - DNA, 396 bp, Triticum aestivum
  Clone ID: PAT_TA_41967
cccacgcgtccggcccaatggagtttaaaaaaaactgaacagtcctcagacttagccaattttcaggaattccatagtattgtgagtaaaatgcaagcgcggtcctaattctttcccaaaagtgtcgactgggtcctaattctttcaaaatgcacatctgggtcctaaatctttctaagttgttcacccgaggtcctaatttcgactgtccgccgctgaccagctcgcgtggcgctttgaccgctgccacgtcgactcgagggcccacgagggataacgaccagccgtgcattttttcaaaagagccccccaaccctaatctctccacagccgtagtcctttcctctcctcttccccacctctctctgctctggcgaaacaggggagatcgacggc

SEQ ID NO: 41968 - DNA, 410 bp, Triticum aestivum
  unsure (1)..(410): unsure at all n locations
  Clone ID: PAT_TA_41968
attcccggctcgacgatccgagaaccctcaacaagatcctgtacatgaggccaccggcgaacattgtgtcccacaacgagctcatctcgatgtgggagaggaaagcgggcaggactttccagatcgtgcgcatcccggaggcgggtctcctcaagttgatcaaggaggcggctttccctctgaacatattgctgtccctcgcgctctccatcttcatcgggggcgtacaggccaactttgagattgaagcatcctttggcgtcgaggccaccgagctgtaccccgacctaaagtacaccactatcgacgagtatctcgagcaccttcactgacagcttttggctggctggaatggcaccatccacagtcggcatcaacaatcangatgatgaacaggtggatcctccaaa

SEQ ID NO: 41969 - DNA, 420 bp, Triticum aestivum
  Clone ID: PAT_TA_41969
aattcccggctcgacgcgtacagcatcacctggaatcctaggaaatctcccggtagatatgtttcagcactaagcttcactggttgcgacttcgacatgtacgtgctagagcatggcacgaacaagacggtgggtcagtgcactgctacatgccctgtcaaagatatcacggatacggtggcttggcagtattgcaacggtacaggatgttgcttcaccaacgtcgatgccgagtttgctacaggcatcgagataaagtttgtccgccacaagattggacagctgaagttccaagcgaacagcaaccgaagctctatatggcatacagttgatgtaaccgctgattccattattatgtggggtatcatcgttaatgaacatggccccttgcaaaacagcacagattatgcatgtctcagc

SEQ ID NO: 41970 - DNA, 437 bp, Triticum aestivum
  Clone ID: PAT_TA_41970
ggtacctatcaggaattcgcggctcgaccgagaagacaacagaagggcatcgagtagaccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagg

SEQ ID NO: 41971 - DNA, 430 bp, Triticum aestivum
  Clone ID: PAT_TA_41971
aattcccggctcgactttttcggtactcctgccttgctccggttgttcacaacaagggcccaagttagtgacctccaacggtatccagaacattggcaagaagctggtgaactccccggacggaccccttacctttgggcaaccaaagatgacaattgagaagctgccagagtacaggcacatgcttgtgcaagaacacggcaatgtcaaacccttttcaaccttctgacaccctacatgaaccaggcaactctgggtgatgccaaacaggatgcgatgaaaaacgggtcccttcaaggttagaacattctccatacacaaccaccatctcctgctgcataagatgaggtaaaagggcacaacaaggtactttgcctgtaccggcaagatgcaacgaccaaaatgccaagaaattctatccaaacagcgg

SEQ ID NO: 41972 - DNA, 469 bp, Triticum aestivum
  Clone ID: PAT_TA_41972
gggtggactgggactacatcaaggagaatgaggatcactatccaggtgtacatgatagtttcaaggcttgtggagtcgatgagtttgtggctcagaagctcacaaaatggaatgatgagctcatcatgcagttctactccacaactcatttctacctagatggaaggattgtctggatgtctgaaggtacgaggtaccagtccacggttgctgaatgggcgaagttgatcaatgccccaaaagagagtgaagatgacttggatgtctatgccaaccggaagaaggatcacaacacaatggcacacatgtacaaggagatcccacatgctgctcttgagacacataagtttggatctgtacattaccttctgtcaggcttgccaaccatcaactggatcctcaggcacactctctttcccaagtcaggtgatcacaagatgatcagaggccatgcaattaacttgcttca

SEQ ID NO: 41973 - DNA, 445 bp, Triticum aestivum
  Clone ID: PAT_TA_41973
gggtcgccactttcaaatggatatttgatgagtttgtgaagatgatgggagggaaaagaccaattaccattttaacagaccaagcgagggcgatggaagtcgctattgaggacgtatatccggatgcaacacagagatggtgcaagtggcacatcctgaagaaggccaaagagagcctggggtctaattacaccaagaaatctgatttcagggcagaattccacaaattggttcacgaaatgctgactatagaggagtttgaggacaggtgggcagcgttgcttgagaagtattcactgactaagaacacgcacctgacgcaaatttacgagacaaggcagaaatgggccaagccatactttgcaggaaaattctgcgcaaggcaaaacagcactgggaggagtgagagcgccaatcacatgttgagacagtatgtgccaacttc

SEQ ID NO: 41974 - DNA, 342 bp, Triticum aestivum
  Clone ID: PAT_TA_41974
gtggactatcgcaacacccaatatcatggggtcatcggcctcggcacgccgctgcaaaatttcacggtgagattcgagaccgggagctccaatttgtaggttcccactgcgaaatgctatttcactagggcatggtagttccatgccaaatagaaatcgagcacgtcaggcatgtaatagcatatggtgagatttgcgatacatatggggatctagaacttacactggacttttcagcattgagaaagtattggttggagacacagatgtcgtaaacattgggacattgatcacaacagtgaatatatgtccatttgcactctcgtgagtatgatgacacca

SEQ ID NO: 41975 - DNA, 425 bp, Triticum aestivum
  unsure (1)..(425): unsure at all n locations
  Clone ID: PAT_TA_41975
ggtccggaatatccgggtcgacctcaagagggtattcccagataaaaagatcggcaagataatcgaaacaagcctatcagcgaaccaagagcgcgccgccatggagaagaagaggctgaagtggaaggtggctgggcctcccccaaaagaaaatgtggtccgtggagggcccgtggacccctccaagctcgtcgtcgagctggcacccatggagatccgcacattcgtcatcaacttcgaccaccgactcgccgcacatccgatctaggcgccgacattgtaacttttttgtaattttgaaccagaatgttgtattgttgaagctgaactcgaatgagttgtgaatagcaataagaaataatgtggccaacggaggctggagcgtcatcaacttcttaaataagcttccgctagtgagatcaana

SEQ ID NO: 41976 - DNA, 464 bp, Triticum aestivum
  Clone ID: PAT_TA_41976
tccggatttcccgggtcgacgggcgtttgggctgaactctgtgtcttcaactccggcgccaacgactggagaatcatcaccgaggtgtttgctgatgagctccctgacctctggtggtccgatgatgtgtttgctttcgacggccgtttcctttgctgggtggactacttctgcggcgtcgtgctatgcgacttctccaaaaatgtggactcccaggtgctccacttcgtgccttttcctggaggaatcaaatacccttttgacgcacggttcccgaggtacttcccagggaggttccgaagtgcgtccatcagccaaggcatgatccgctatatccacattgacaatgactttcatgagactacccactccgactggcaagtgatgattcctcctaagagaagccaacggcggcagcagcagcttccccacaaaatcaccatttggacgttgaactccaagtt

SEQ ID NO: 41977 - DNA, 472 bp, Triticum aestivum
  unsure (1)..(472): unsure at all n locations
  Clone ID: PAT_TA_41977
cctgcccgtacagtccggaattcncgggtcgactcgtccgtggtcttcttcccgggccgtcgtcctcctcctccccttccccctccccctacatattccgtgttggcgcaggacatgtgataaagggacctgatgaagggatcttgtcgatgaaagttggaggattacgtcggttgtacatacccggtcaattagcattccctaagggccttacatcagctcccgggaggccaagagtggctccgagcagccccgtcgtatttgacgtcaacctattgttcgtacctggtcttgacgatgatgggtgaaagcatcatcttgcatctttacaggacgcaactgaagagagtgattttccttttgtgaattaccatgtgagtagagtgacaattgttttctgcagcataatatacaaaactatgatgatttgtattaagtgcatagcaacctttggttgtgaatgggataatgt

SEQ ID NO: 41978 - DNA, 290 bp, Triticum aestivum
  Clone ID: PAT_TA_41978
gggtcgacacgagaacttcaaaagcggcgtaatgaggtggcaattaacgggtggctgcaccagtatttcgagtcaggtgtttccatgtacgaagacaagtttgagttaactggtcgaagccgaagattatgccaggacacagcaagtaatccgccccaaaaaactaaatgggttacaaaagcaattccaaaaccctgcaacaacaactcccatgcttgacgtttgcaaatacccattttccctcccacttacaaggacaaaggagctaagagctctgactgggtggcggt

SEQ ID NO: 41979 - DNA, 352 bp, Triticum aestivum
  Clone ID: PAT_TA_41979
gtccacgacagctagaccgggcaaggttgatgcgccagtatagctctgaagatggactggtggcagttggcggcggcagcctctaagagtgcgccggatcggtggatgtcctattcccggcatgtggcttggttgatgcctcaggtcttaatgttaggtttgactgccaggtctgtttggtattaggccaggactatcaacatcccttcatcaactggataggagtatcgacagatactgcgtagacggtgacttcacacttaccgccgtatttttttttagaagtttttttagataattaatacagtggttgtatgcatcgcccatatgcaaaagccggggtcttcctctt

SEQ ID NO: 41980 - DNA, 427 bp, Triticum aestivum
  Clone ID: PAT_TA_41980
attctcgggtcgacgtggcatgttaaatcccgggattgttagctgtggactcgactgggccggcccatcaggcacgaagcgagttttttttcttttaacttgggacctggtatagtatagctcatcccgctagccactactacatacagctatgagtgacactataagtggcccggtatatttaagcagacaccgaagtgttgaactttgataaaaatttaggggtatacaaatattcaagacatatacacttttggaaatgtccggacattgtataaagtgtgagcactttttgagaattctgaatactttaagaagtcaactattttttgaagaagcaatcaagtttgaataatcgaagacttttacaaagctgaagaatgcgaacaccttttgaaaatttgtaaactgggaactaattttgaaa

SEQ ID NO: 41981 - DNA, 397 bp, Triticum aestivum
  Clone ID: PAT_TA_41981
tctagaattctagggtcgacgacttatccaacatgctcgacttcggctccaaagacatcgacggtatggacgagatgcaggagaagaacaggaaccattgcccacagggcgctggactgccacctcatcatatgatatatacatggtggacacccccaaagaaagcaatggcaataaggcaacggaggataatcccctcgagaagcaatctaagcaccgacgtcatcagcgccatagcaaaagtagcgataccggcacaagagacaataacactacggatagtgccgaagacaaagacaatgccctccagccagccttcgagcaggaggatgggcaagctagccctaagaaacaggcgacagatggagaatcagaagatgacagtcacatatccctc

SEQ ID NO: 41982 - DNA, 398 bp, Triticum aestivum
  Clone ID: PAT_TA_41982
tcgtagtacgtcgcaactccctaaactgagtcgtattaatcgtggccgtattgcttcagaggaaagcagaggaagctggatgctctgatccgtacattcgggctcggacatatctcggtcaactggagcccgaaacacggcagtctacacgtcagccggaccacaagaagcaggcgcttgtcttgcctttccaaattccaaccccgcacgccaactcccttcctcggtcaagaaccgacggcgacatgttggccaccggcgagctgcagcccctggcgacccagccggatttcctcgagctggccgagcttctccggcgcaaagtcgcgggagagccgttgcccatcttcatccacgaggttaacgcctaccctgcagtttggcaaatacacgttaat

SEQ ID NO: 41983 - DNA, 451 bp, Triticum aestivum
  unsure (1)..(451): unsure at all n locations
  Clone ID: PAT_TA_41983
acaggtccgaaactcgcgggtcgacctaccaccaacgtcggtgacgcaggagatggtcacaaccatgatgacatcctctagcactacaatttctttagtgtatggggcgaccttgatacgttcggcgtactagcaggcgatggcgatgtggccggatctgtcattgttagtcgaagattggaaacaaaacacaagaatagtgtccctttcaactactagaatgtggttgctaatcaaaagcaggagaatgtatctctggttcttaccaattcttactcaacatgtggtgaccggtaaccaatggtgtatattaccaccaaagattgggtanagtgcctggaaggtcatgccaaattgcacagtgaatccgtggagcttggtaggcataaatatggtagtaatgttagtcataatcaattcagagatggaagttgcacaaatggacaataac

SEQ ID NO: 41984 - DNA, 355 bp, Triticum aestivum
  Clone ID: PAT_TA_41984
gcgatgccctatatggagtcgtactattcctaagaatggggcagatatctgagccccgtgtcactcatggattactccttcccgtaggaaatggtaatgttgtagagggataaatgggaagagacgattataaatccaggaagtttagaatctaattctaactgttggctcctgagaaatgactccattgacgtggcagtcattttctttaaataagatgggttatatgaagaaacggtaccaaaggaggagaaaactgtattctaaggaggaaaaaattaataggaatctttctgagcttctgggataaagcttacagggtttgaagattagtacatttgtatgtggggagaaa

SEQ ID NO: 41985 - DNA, 435 bp, Triticum aestivum
  unsure (1)..(435): unsure at all n locations
  Clone ID: PAT_TA_41985
ttcgccggccgacgtcacactggaggtccaagcatgggtccatggcgataacagcggaccagcagtcaagatgtggaccgcttgctggctttgcacggatacgacgtccgctggcgactggtagaaggtagaacgcggtttggtgctagacaccgatgacgccttgtgaaatctggtaggggaagccgcactccttttacgcggtgcatcctttcatgcattcataatcacatcacatcctgattatctatgagaaacttccctatgagaacatgatatattgaatgatgaatgtcatactgccagacagatgggggtgtatgaacgaaccacggaacgacatancggcatgccatcactagcgcagactccattaatactgactatgccgatcacacattaatacgtcggtcatagacgtcatagctcttctaa

SEQ ID NO: 41986 - DNA, 259 bp, Triticum aestivum
  Clone ID: PAT_TA_41986
caccctataatgagtcgtattagcatttctgtacgtgcttcactcatagaaatgtgcaactactttatttgagaaacttatagttgggttgcaatgtacgtattttctagcttgagtttacctcagttgtagttttttttaaatacatgatacttgcacttttatagacatgtgtaactaccatttttagtacaggtgcaactgggttgcgacgtatgtagtttcaagcttgagtatccgtcggttgcgccttttgata

SEQ ID NO: 41987 - DNA, 390 bp, Triticum aestivum
  Clone ID: PAT_TA_41987
ctcgcgggtcgacgctacaccctatagtgagtcgtaatacagcattacagctctgaatatggattggtggcatgtggctgcggcagcctcatttacccggcaggcgtcctgtctgaagactgcgccggtccggtgggtgactcagacctgggatgtgtcctggatgggacctcaggttttaggagtcaagtttggttgcaaggtctgtgtggtatgatgctcagatattatcaattggataacagttacgacagatgtcagccaacactgtgacatgagacatactgttgtattactttgtactgtcgtgtgttcacagttaatcaactggcagcatgcatcgtccagccggcggtcgtcttcctttcgaaggctgtttagtcaaggatt

SEQ ID NO: 41988 - DNA, 383 bp, Triticum aestivum
  unsure (1)..(383): unsure at all n locations
  Clone ID: PAT_TA_41988
attccaggtcgacacgagcatccggcatcataatcctctggtctcgccaacccagaaacggttcattccagtgtcacctgtgaaccctccagagacgcgagatgttccccgccattggaacaatccgtagacagtgcacctgcccgacatccatccgtgaccaggaacctcctggtgcagcattcccggggccatggaggcatcacgatgggctggcaatngacatgtctccatttagcggtccaaggacctggtcattgtcaacgacacaccgtgtgcattgtgcaccctatgcttgggtccatactgaccggatgacataactctcatgatcaccactcgtagtagtggcctgatcatcatgatcctgaatcgtacagcag

SEQ ID NO: 41989 - DNA, 445 bp, Triticum aestivum
  unsure (1)..(445): unsure at all n locations
  Clone ID: PAT_TA_41989
tcgaaattccagggtcgacccacacatccagaatgtgggaacagcgacaagccttatggggtttctcatgaacgatgtcacaagatacacaagtaaacgaatctaccactttcacaagactgattttaactggactattgnaatgcagccagcgaagatggaaatagacaccgctgtcatggatgttgatcaccacatcgtcatgctaggtgacaaagtcgacgaattatgcgaccaactgatgtaccagatcaacgacgtcattgggatcgatagctgctctgaccctgatcaaagatctcgtaagctgaggcgccaatcacattggagtgtcaatcacacctgttgcagctgtagctgcaggctttctcgacagtcataaatttgatcacatacatgcaccgcatcatgtccttaagaatatgtaagcacttttttcagacag

SEQ ID NO: 41990 - DNA, 441 bp, Triticum aestivum
  Clone ID: PAT_TA_41990
tcgaaattccagggtcgaccgtgccgttgcacgaagtaattcacgacctcgacgtcgcttcgctgtacaccgctgagcatagcgtgcaccgctcgacgatgccttctgtcgtgcaaatccagatcgagctcgctaaaccaactgtgaaccaaggtgatgaacacgaagagcttcatcactccggtgaacgagctgaatccaacaatcctgcgactaccaattctactgacgcaccgactgagtacgcgaaagatcatcaccatcagcaacatcaccacacaagctcggagtcgtcgcagacgcctgatcacatcagcatctgattatcaagatccatctgttgcgataacatgcagacttcatctatcgtgcaagcctaagcctgactctagggtacgttgagtgatacacatgtatgggtacagtacatatccaaactgc

SEQ ID NO: 41991 - DNA, 431 bp, Triticum aestivum
  Clone ID: PAT_TA_41991
acgcctgtccgtaccgctccgagaattccaggtcgacgagccaatgcggaatctttgagcggaagagaactgtcatcaggtggctactggatggtgggctaagatgttgtggcgtcggatcgacattactgttctcacagatccggtgatggtcaaaacaaatggttgttttttcatcaccatgaattaatctctgtgagttgtattgaagcggtaacaactaatatggatcggagggagtaacaattttagatgagtatatactatatgatttttggtagcaacgaatacattcaatcagtttggctagcggaacagcgtaatagattatgtctacgggtcatctaatcttgcacgctgatgtgcggcgcttatgcgaacactgcatcatgggtcgctcacacgtcgccgtttcatgaatttgcccaact

SEQ ID NO: 41992 - DNA, 345 bp, Triticum aestivum
  Clone ID: PAT_TA_41992
ttcccgggtccacccaaacatctgaagcttctacgacaactagtctgtgaatcggcatatcgtcacttcttgacccatcatctcgtctcagctgttgccagtgtctgacgtgatcatggcagtgcgaattatggtgaaatcaacctaaaccgatcactcgccccttacaggccgggaagacatcttggttggctgtttatcactgtgcggtccctattagtcatcgaatatcgacgtggtagtgtggtatgcatggatgcaatggatcgtacttgtcacaacactcgagacagtatgtcgatgtgtatctacgatagcgtttgactgcagactagtgacgtgttg

SEQ ID NO: 41993 - DNA, 428 bp, Triticum aestivum
  Clone ID: PAT_TA_41993
gtgggtcgacgcgattccctagagtgagtcgtattattccaaggagcttgtaagcaagagagtgagaggtgtcttctccttcttcctcctcttcttcttcatggagagaaacataagaaaaccattagtctcatcatcttatggagctgagtattgtcccataactattgttgcatgatttagcatactataaatgttaatcaggccattaaatttgcattgcatggttccccttaaagaattgcattttttcagttattgcttattgttgttagcaggataaatatgtgtattttataacactgttgcaggactgatgagaatttggttggcttttttcttgcaccggcaacatcatctctacatctgatgtttaggttgtgttagtaatgagtaataagaaagtgtggcaaataatcgctgaacag

SEQ ID NO: 41994 - DNA, 316 bp, Triticum aestivum
  Clone ID: PAT_TA_41994
tcgtggtccgtcactactccctatactgagtcgtattaggcttcatgtatcaacgacgtggtgcgggaggccatcgaggtgggcacaatgtatcaaggcgcgccctgatgtgctgtgctccgcgtggggctcacctctggctagtccttggacctcaagatctctgctactccaaactttatcgcctaaagattttgctgcgtttggactccttttggtaatgatatgcaacgaagtttgctcaaaacgtaccactacatctggcactgggcactatatctctaggttagtcacaggtatgttgtaaagttggcta

SEQ ID NO: 41995 - DNA, 445 bp, Triticum aestivum
  Clone ID: PAT_TA_41995
tcactactaggactcgtagtccatcgctacaccctatactgagtcgtattattcaaaccaagacacttaattagtttgttcgttggcgtattcatatagtcaaggctgatcatagtggggagtaacttatactagtgtcagggtgaaatgcgcgacggaggagaagcggggtggaggccggttggaacgctggaggtgacggagacgtagagttctggcagggttgtggtgtggcgtccgggatgatggagcagcggcgaaggcaagagagaaataatgaaggagagagaatgatgaggatgaaggtgtggggtccggaaagggttttcgatgggccagggtgttggagttctacatgtatgttgtccaggcttccgcaaggccacacacgtttgtctgaagtttgctgaaaaaagtatgtctggaccactcggcggaccgatat

SEQ ID NO: 41996 - DNA, 99 bp, Triticum aestivum
  Clone ID: PAT_TA_41996
ctcgttgtctgtaactacaccctaaagtgagtcgtatataatgttttctagatagcagagattaaatatctgccaccgcaacaggttagatttaaaaca

SEQ ID NO: 41997 - DNA, 423 bp, Triticum aestivum
  Clone ID: PAT_TA_41997
gggtcgacgtgtgcgagcatgactgggtcccaacccacactgcaccgagcatttcggaacaacagcctcaggcactcctgcttgcggtagggcctgaccagtgaccagcacgctgcacgcagcaccatcccgaacagccggtgaggtcgccggcgccagcgacagcgaggtgctccttcatcatcccgtatgatacgacacgcttcccgtttcccctaggcacggtatcgatatggccaaccaagtaataccactccgccgtagcacgcagccgatgcaccaccgctccgccgtagcacgcagccgtcacaagaatgagatggcgctgtcagtcaattgactcagttccacctgcacgagtacagtccaagaatcatggtcacatgattgtcccgatggaggatggttcagacgttcagtccc

SEQ ID NO: 41998 - DNA, 365 bp, Triticum aestivum
  Clone ID: PAT_TA_41998
tccacgacggcaaacccagcacggcctgcgtcacgtacagctggcacaggcacaggacatcacaggttgctccgagcatcgatgctgggacgacttgggcggaacagttatggctgtccgtggacctgttcaaggcgcaaaagcaaatgttggtatcagcgtcggcgggaagcatttctctctctctccagtctgagctgtggtcacagctccgtgacaaaaggatatacacaggtagcacagtatcagtgtaagcatccctgctcaatcaagtaaagctcagtttactcgtgacaattcttttatgctcggtacccgtcaatcagcggcagcccaacacgatatatgcttacgtacgcgtgcat

SEQ ID NO: 41999 - DNA, 397 bp, Triticum aestivum
  Clone ID: PAT_TA_41999
cactaaagtctatagtgagtcgtattacaatcacttctctttttgaaaaaaaattaggcagaagaggcaagtaattttttttgtattttgcattcttcaaaaaaaaattgtttcacccaaaactagagaaaacaaaaacaatagggaaaaaatctacttagtgaagaaagcaaacaagcatacacaagaatatcaaccccacactattgctccccagcaacgacgccagaaaagagcttgataatccccaagtgcaaggaatcatcgtagatatttccaaaggtggaagtgataagtatggagtgtcgaacccacaaggagctaaaggtaagataaaaattctctcaaatccaatctgccattgagacaactctatgtaaaccgaaagtttgctttc

SEQ ID NO: 42000 - DNA, 417 bp, Triticum aestivum
  Clone ID: PAT_TA_42000
ggtgtagaattcacgggtagacttccacgacagcgatatccatcatctcatcgaaagacgggacacctttgcctctatcacaagctctgaggctccagcatgcatatatatagtagagagagtgtgaagagtgcaaaccctagaaaacaagcatcggggctgcagtgtatatagatggagtggttttatttttatctccataaaaatcgttttaaattgtgcaagaaatggaactctttatttaacgtagtgaagaaaaatgctaggggcaatgctaataagtgaagaaaatttaacgctctaaggagtcagctcgcaattaacagtgcacgcctcccggtcgcgcttactaatgttcacgtgtggtacacgaccctccgaagtgaacaacaattgaaacacacacggtcaaaatat

SEQ ID NO: 42001 - DNA, 454 bp, Triticum aestivum
  Clone ID: PAT_TA_42001
aggcacaggtctagaactcgcgggtcgacaagtcgagttacaagaaagcttcgtgaactccaactcatcctcctactacaagcaacttcaagccgagagctttatcatcatccacaccaaccgatgagaccgtcaagacaagttccttcaaatgcttcacatgcagaggccgaggccacgagtcctatgagtgcaccaacaagcggaccatgatactcaatgacgacggaacctacgactccatgagtgaaggagaaatggacggtcttgagcaagtcgccatgcactggcaagtgaactatgaagaggaacaagtcttttgtgatgaagattcaagtctcgctcttgttgtctccaaggtattgactctccaacataaccaagaagaagaccaaaaatgccacatattccacaccaaagccggcatcactgtaagatccgtcaaggtcatcat

SEQ ID NO: 42002 - DNA, 426 bp, Triticum aestivum
  Clone ID: PAT_TA_42002
tcgtggttcgacacaactccctatactgagtcgtattagtatttatatagcaaagaggcggtgcgggaggccactgatgtgggcacaaaccagatgggcgcgcctggttccccaggtcccccatgatgagttgtgcacaccactgggtccgtcttgaatactttcgtagatgcacaagtcatcgtccggtcaaaagtgtgtgtaagctagattactatactacttcatgcagtttcacatgtatatcattggagtgttatgtcattcattttgcatcgtatgatttcttgaactatgtgagaagtgtcctctttctttcctcatatatagtctccagctccaagcagctttactttcagatacattcatagatgaccatcaatacaacgtcatagctcttcgacattttcttataaaaaacgttca

SEQ ID NO: 42003 - DNA, 201 bp, Triticum aestivum
  Clone ID: PAT_TA_42003
caggtccaagactcgcgggtccacggtaatcgctataatgagtcgtattatcacagaaatctaccacaccgagcaaccgactgcatgtctccggaccaatgtgtttcagcagacccatcatacccgcagtgattcctcccagattcaagtcgggtactggagtcagcaagttcaatcgtcattctaaccccaatgttctgg

SEQ ID NO: 42004 - DNA, 250 bp, Triticum aestivum
  Clone ID: PAT_TA_42004
ctatagtgagtcatattatatctcgcatagacgcgtcctctggctgaacagcagtacccgtatgctccggcaagccaacaatggatcggccaaactaccacataagcaaccggagacgctagcttggcagatgaaggtgcatttctcaaatgagtggtgactcgcgagctgtgggtcactgtaactcgccggcatgaatcgacgtctccgttgacggccgccttttttttaaaatttgctgaaaatcttt

SEQ ID NO: 42005 - DNA, 453 bp, Triticum aestivum
  Clone ID: PAT_TA_42005
ctcgcgggtcgcacagtatgccctatattgagtcgtacaatccagtgaagaccacttacaccagtgctaagttggcaaagatatacatgaccaagatcgtatgtttgcatggagttccgaggaccattgtatccgacagaggaagccagctttacctcgaggttttggcagcagttacatgaaacattgggaaccacgctagaatttattacagcttttcacccacagacagatggacagagcgagagagtcaaccagattctggaggacatgttgagagcttgtgcactagattatggatctagttgggatgacaatttgccgtatgcggagttttcttataacatcagttatcaaaccagtttgaagatggcccctttcgaagctttgtacggaaggatgtgtagaacaccgttgttatgggacgaagttggagaccgtcagttgtttgga

SEQ ID NO: 42006 - DNA, 451 bp, Triticum aestivum
  Clone ID: PAT_TA_42006
tcccgggtcgacccatcgctgacaagaacacacataccaaacatcagcagcaaacacgcgcgcacacacgcacacatatcattagctagcgagctagccgcacgtcgcacggaaaagaaagatcctcgatcgatgccacaggagctgtagctccatcgatcatgaattcatgatcgctctttctttctttctttctttcagtgcaatgcagcaacaaaaagcacactgatccgtccgtcgatccatccaacaaatttttgattgcgccaaaagcctaaaggtagcaaaggctaataagctagccgggatcgatgaaaggtatatctatccggcgtatgagactgttaaatatgcgccgggtcgtcttcgtctaccgctcacccatgtgcatgtgccggagggaggaggttgccggtctggatgcgagtttcttaatgccatcggatgcaaa

SEQ ID NO: 42007 - DNA, 366 bp, Triticum aestivum
  Clone ID: PAT_TA_42007
ggtcgacgataaccactaatcgggttcctatgaaagagaaaggcccaatacagaatgacacaagaccaagaaacagtgtttgtatgtgcctataaaagagagacccactagtagagaatgcatctgttatccatgcaatgcacagagataatgctcctgctcacgcatgcattggtatgcataagaatgctcctccaatcaatgaacgcgatgcgattgaagtactgggaaaaaagacatcacacgtaattaagccaatctggggctaataataataaatcaggactcctccagtccgtggccctccggccattttaagatcctagtaattaaactaggggaattcacgtgctagatttgttgcaa

SEQ ID NO: 42008 - DNA, 309 bp, Triticum aestivum
  Clone ID: PAT_TA_42008
gggtcgaccatcaacaccagtctgatgtggagtaagtcggctccccgtgtgtccatcgacgctctttggactccacacgaggcatcgcggtcgcatgagaaattcgtcagagccatcatggtggagttgccgcccactgagatagcagcatcgcgtcacatgccagctcaatcgcaatcgcgatacgagtgttgcacatcccatccactacccttgtggttgttgtgcccatacgcactctctatacgatggaggcttacgtaggcgtgcagtcgacgtgatatctcttctaaagtgtcacgtaaattc

SEQ ID NO: 42009 - DNA, 351 bp, Triticum aestivum
  Clone ID: PAT_TA_42009
ctcgtgggtcgacaccactccctatactgagtcgtaataatcccgcgcgcactctaatgctgcgttcatcgccgagccccactacaccacgccaccgatacccgtggtcattgttctagtagatggaacactgttccacctcaggaccactccagccagcacctgctccagaatgatggccctataagggggaacaacatcgaagacatcgacatcgttttatccggggacccacatctacgtgacgagacaacaacgatcatgcctccacatcgaaacaatgtcagcgatttcgtttgataaatggaatatattaatattacacagataccacttagacccagcctctcc

SEQ ID NO: 42010 - DNA, 199 bp, Triticum aestivum
  Clone ID: PAT_TA_42010
tcacaactcactaaagtgagtcgtattaaacgtcagacaagagagccaaggataatggaaccaaacgagacacacaataaagaaaaggaaatagaaatgaaacataaaacccacgaatcgggttcagaaagaacaccatcaagagtgaaaacagaaccagaacctaagactaaaaatgaaaggaacagaagacattgaa

SEQ ID NO: 42011 - DNA, 264 bp, Triticum aestivum
  Clone ID: PAT_TA_42011
tcgtaggtcgtcgctacaccctatactgagtcgtagtagcaaaatggtaaagatcgacgcagagggaaaaatattactgctccgtacagtgcggtgtacggacgagagccgtggtgcaatgcaacagcagcggcgtgccgcctggctcttctttttgtcctggagatgtgcttattgctagactctgacagatgaattgcgtttctctccgcaagtaatttgagtccttcagcatgaaagtgatcgaggcaccgacttcggccg

SEQ ID NO: 42012 - DNA, 444 bp, Triticum aestivum
  Clone ID: PAT_TA_42012
gtctagaactcgcgggtcgaccggttcatatataatcatacgtgagaacaaatttatgcttgtttgtagaagtatatacactctttctgagattgtagcatactagcatgtgattatgggatgagagagagagtcttggacggtgataattgtattaatgaggtttatgttgcctattaaatcaccgacaacgcaagtcatatccggccagccgagaaacacatactatttccgtcgtgagatttttcccgtatatcatgcacgtctaaagctgggcagatcgaggctacaagttaaattgcttttttttcctcttttttctaattaccagtgcaaatacatgagtgttagtactctttccgtttcaaattgtaattcacgtattagattctgttgggtttttttactttaattggtttcaccttttttttttcactccagaca

SEQ ID NO: 42013 - DNA, 300 bp, Triticum aestivum
  Clone ID: PAT_TA_42013
tcgtaggtcgacgctacaccctacagtgagtcgtattacacttactacgtgcatgccgctgacgataaccagcagtactttaggaggatcccacacaagaagtctgcgactcgttcgatctgtcgcggacttagtgctaaccaactgaagacatcctgtccatcttggctccgtacataaatatggttgcatcctctgactcgattatatacgatcacttgtaatctaggtaccaggctacaggcttgtattaagaagctggattgacttacacggatatgaacattgtgttatgatatc

SEQ ID NO: 42014 - DNA, 402 bp, Triticum aestivum
  Clone ID: PAT_TA_42014
tcgtagtacgtcatgacaccctataatgagtcgtattaaacgtcggtttcccatgccattaattcctaaatagcaacatgcaatttttatttaatgcgccaaccaatgaaaatgttagcatgcaaaatgaaaattaatgatcatgaagatgaggaacttattccacgcatgatgacctatatatttggaatactatatttcgttagacgctctatgcatctggacggaaggagtactccaatacatgagtcgttcagagtcccttgaagtccgaaatggagccaacggtaatcgcacggcgcgcgcccatcatacccacccacgccacaacggctgcgtgtgcgccttggccctggcagtgggatgaagcttaacatttatgatggatcgctcgtgcgtcgc

SEQ ID NO: 42015 - DNA, 404 bp, Triticum aestivum
  Clone ID: PAT_TA_42015
gcctgcaggtataggtcctagaattccgggtcgaccatgtattcaaatattgttaatcttgtattttcaaaacgttatcaagcatttgaaaaaatgtcaaatgtgtatagaaaaaacgctaatcaaacatttgaaaagatgctaaatgtgtatataaaaaaattaatcatgtattaaaaaaaattaatttgctcttgaaaaagtgttgatcaagaatttaaaatatattaaatgtgcggagtaaaaatgttgaccatgtattcattaaatgttaatcatgtatttaaaaaaatgttaaacctgtattataaaaatgtattagatatataccaaaaatgtgtatagaaaacagtgaaaacccgagaaaaaacgaaataagactgatgaaggacaagaaaagaaac

SEQ ID NO: 42016 - DNA, 432 bp, Triticum aestivum
  Clone ID: PAT_TA_42016
ttcccgggtccacccgttgtactgaatcttcacttggtcgcttggagagggctcggtcgcttgggtttttgaagttggagagaatggatctgtcttttgggtggtgagtgggagaggaagagaggcaccccatttataggcctgtgggtgggagaggaagagagaagggatgagaatggtgcgtgtgtaaatccggacgtgtgtgtgtatccgttaagttttggacccttaaatttttgcacggaaacgatgcatggggcgcgtgcgtgcatttgaatcactgcatatggaagctctttgactgggcgcgtgcatctgactcgctgccgtgatcagaacgactaccgtaatctgaaacaatggcctaactctgaatcaatacgtgcagggccacctagctcgccgaactcgcgtcgctcgcatgcatgcacg

SEQ ID NO: 42017 - DNA, 285 bp, Triticum aestivum
  unsure (1)..(285): unsure at all n locations
  Clone ID: PAT_TA_42017
ccacgcnaccaactactccttctacaagaacatactcacaacttgtttttctatcaccgacancaaactacgcacgttttttatctacaacacgcgcctctccttataatacaacatcctcacacactatcacttcaagatcaacaaactgaccaataaatgtataatatcatttactgtctttcaaccaaacatcaaatctctaaaaaaaaacataaataccaaacaactgttaaaacaccaccatcacattaataccaaaatctcactaaaatagatacaatt

SEQ ID NO: 42018 - DNA, 321 bp, Triticum aestivum
  unsure (1)..(321): unsure at all n locations
  Clone ID: PAT_TA_42018
ggaactcgtgagcttatgaatgagtgattcttatttatctaattgggaactagcggagcatgcanagtaaggggtgtgtctgctcntatagattggttggtcgattgcttaatccatataccctaaacatcataactttttattgggggggcctggttgatgccctgtctgatgtgaatcttttgggatgcgcgggtatatacttccaccactatatacaaaaatgagtactgcctttaacatgggcatgatattaaatttgagtgaatctaagggcctactgcgtgcataatctggggctatatgatttttagatttttt

SEQ ID NO: 42019 - DNA, 446 bp, Triticum aestivum
  Clone ID: PAT_TA_42019
cccacgcgtccgcccacgcgtccgaaatctggaatgtctttcgagaactgttgatcagtgttgctataagtatttctcagagttttggttgcatggatgtacattagagtagcagaggttcttattttactttgtccagaagaggggcttttacttatttttgttcacaatttttatctaactttctatcagcaccaacgaccacaatgggatggatcaagcagccaagacttagagtgtggtcgggcagcgccatggggcagatctgtgcggcgcaaggggcggcagatgcgaaactgaagcttccctgaacttcggagcagtcaattgagaagatggacacgacgagtgaggattggtgctaccgcccctggtaggagcccaatgtcctaatcgaactactgtcatggagagggcaatacgtggatttgcttcaaatattggag

SEQ ID NO: 42020 - DNA, 354 bp, Triticum aestivum
  Clone ID: PAT_TA_42020
gatgactgaactcaatgcagctatatatagcagctagtttctgtcaggaatccatgaaacaaaaatgagtagaagaagaagaatcaaagatgcattcatggatgatgatgatggactggatggatgaagatggctacttcttgaggaactggaggccgttggcctgggagtagcgctccatgaagcgcatgaagcggtcccagtccctgggggtgcgcatcacgtacttggcctccacggccgccggcttgccgttgacgaacttggcgctgacgtccacggagctcagcgtgccctcctcgtcgatcatgtagaaccccgtgatgtcgcccagctccgccgacgagtcgaaca

SEQ ID NO: 42021 - DNA, 454 bp, Triticum aestivum
  Clone ID: PAT_TA_42021
ctcatactgctcgacctacacaatgcccattctgcaaaacccccaactatgctgtggagtatcgtggtgtaaagacaaaggaggaaaggagcatagagcaatttgaagaacagaaagtcattgaagcacagatgagggtgcggcagcaagcacttcaagacgaagaggataagatgaaaagaaaacagagtaggtgctcttctagcagaacaatcgctccaacaacagaagtggagtatcgagatatttgcagcacatcctattcagtgccatcgtaccaatgtacccagcaagaaactgaatgttgttcgtctgagccttcatgttctgctcaggctaacatgcggtctttccattctaggcatactcgtgatgataacatagacatgaacatagaggacatgatggttatggaagcgatttggcgttcaattcaggaggcaagaagtatagg

SEQ ID NO: 42022 - DNA, 348 bp, Triticum aestivum
  unsure (1)..(348): unsure at all n locations
  Clone ID: PAT_TA_42022
aaaacacagatgggacattcaacaacacatactttatacatgcgcgcatgatttatacccagtttaggtagagctgagggattacttggtctagaggagttttataaactaaacaatggccatatggagcaatcatggggggcgccataatatagcccctttacttatacgggggggctaaaaatggcgggagttttatttggatgcatgcatgtgggcatagaccgccacacgaacaccaataactttttgtttgctcgaaggggatacaactagaactagaactaggngccggttacgggcacggggttttttgcttcgccttcggcaccggttttgggggggggg

SEQ ID NO: 42023 - DNA, 340 bp, Triticum aestivum
  Clone ID: PAT_TA_42023
gaccacgcgtccgccgcgctgctgggctacctcggcgacgttttgttcgtcgaccgcgtccccgcgtggatgccgttcgtctactccctggcctccttcgtcctcgggtcgctgctggtggcggacgcgtcggtcagcgacgaggagtgggacgagtgggtcggtcggcggcagcgcggcggcgacctctcgttcctcgagtcggaggaggtgctgaggcgcacggcgcggaggaagcccgagggcgggctctctagatcatccaagcatacattcgcgtgcatgcgacagttataactgtcttatagtaggacgtaaattcaatgcacttgacctgtga

SEQ ID NO: 42024 - DNA, 342 bp, Triticum aestivum
  unsure (1)..(342): unsure at all n locations
  Clone ID: PAT_TA_42024
gacccacgcgtncgnacacgcgttaacaaatcccaaagcctttttttttagagctccaaaccctacgcggggggaggttcttcacagcggggggagagtccattcatcccaattcactctcgaaaagcgtacgtgcagcactactaccaaacgtacgactccaaccgtgctcagctggttaggctgtaccaatactaattcatgctcaccttctaggtctagaatttcgccagtcccgccatcatcacctgcaaactcgtatctctccccttccatcactgccagtacaaaaattaacacctttaactgccagtcctcgaagccccattgctaccgtcctct

SEQ ID NO: 42025 - DNA, 218 bp, Triticum aestivum
  Clone ID: PAT_TA_42025
ggccaggaggagtccgttacaacagattaatcaacgccccggccgaaaaagatttacactagccgccgcgggggggggcgtttaaaacgaggcaacggccggcgcgggggcgtcttaaatggcaacggggacggggtcttttttgcggcgcatttccagcactttgcggggggagttggagtgcaggttccccacaaacgtggggtttgcccccggcc

SEQ ID NO: 42026 - DNA, 316 bp, Triticum aestivum
  Clone ID: PAT_TA_42026
cccaggaggggtccgttacaacagactaatcaacgccccggccgaaaaagatgtccactacccgccgggggggggggcggttaaaacgaggcaacggccggcgcgggggcggccttaatggcaacggggacgggttcttttttgcggcgcatttccagcaccttggggggggagttggagtgcaggttccccacaaacgtggggttgcacgccggccggtactccggaaggagccgccccaatttgaagcggaccccgaaggcgttgcacagggttttggccccttccggccccgaacgccattggggcttttttt

SEQ ID NO: 42027 - DNA, 276 bp, Triticum aestivum
  Clone ID: PAT_TA_42027
aatgtatcccgatatcatgatcaagagtgagtctatgcgaagaggataccataccacacaactaccaccgctgattccaccacagacaagacggggccaccgacgaccagaacaataaaaacgccaaatcaaagtaccatgacaataccaattcatgcagcaacacggccaggattacagaacgtcgcacactatatacattggacagcaactagcctacacacgttctctgccaactcagcatgaaacagacattgaagaccacgcatgcctcac

SEQ ID NO: 42028 - DNA, 401 bp, Triticum aestivum
  Clone ID: PAT_TA_42028
gtcagtgaccaactcatcataacacacagagtaacacacatgtacacattctgaacttctccatgacacaacaacacggtgatctccctactgagtagtgactgatcagttcatcgatcagttcggcaattcagatggatcacgagttgatctacacaaacagtcagctagcagttaacaggttaggattcagcaatcgatgaaccgatcaggacgacaaggactgcgcgacggaggaagtggtgaggaggccggagaggaggccgacgatgagcgcgctgttgtacgtggtggcctcgttctgcatcacgttctgccgctcgtccacgaacgagtcgttcttgaaggggcccccgacgagcgcccccgtggccacgttcgggtggtgtcaggcgactcga

SEQ ID NO: 42029 - DNA, 211 bp, Triticum aestivum
  Clone ID: PAT_TA_42029
gacgccacgcgaccgagacgccggaaacaagatcgcgagcagccttcttttctaactatctagcgaaacagggagggcgtccacaagcggacggcaaccaaaacacacgaaaacacaaccaacgcacaattttttccagaaaaggaaaccctaacacgagccccccaaaaaccaaaccagcacacaactcaaatccactcagccaagacaa

SEQ ID NO: 42030 - DNA, 294 bp, Triticum aestivum
  Clone ID: PAT_TA_42030
gctacacctccatcctactcaatcggtcttcttttatcctaactacattctaaaggcggggtttctcaacgatggcgctgacttttcacacttgcctgacttcctacatcttcctgatcacatctcctcattgcgtcctactccacatcttgcagctgagatctaataccgcaacgctcactgcttaagagatccacacaattcactctgacaaagccataccccttgtcattgttgtttgctactacacactgcacctttaactacttttattacttgaacacagatccattc

SEQ ID NO: 42031 - DNA, 334 bp, Triticum aestivum
  Clone ID: PAT_TA_42031
acggatacatatatgtgtagggggggaacaatgtagcaaggagggagccctacgcttcatcacctgagcagccactcaacacttgaatggcccaggaggacaggttcgaaactgctacgcgcgcacggccagcgccattacatctgccagccatcctcacagaacgtgactccaggcctctaacctaggagaggaggatatatcagccaacgaatagaactgctttgctcaagttgacactacaatcgttggccagggaccaaagcccgaccatcccgggtgcacctcgaagttaggcgataaaacgagcagaagcagcagcagccgcggacgc

SEQ ID NO: 42032 - DNA, 434 bp, Triticum aestivum
  Clone ID: PAT_TA_42032
cccacgcgtccgttccagtgcacgccaatggccagcgtcgtcgtcctcgctgctgctgcttgctgctgcattctcctagcggcctcggtgtcgccggcgtcgtcggagcccgcggtgtacagcgtcggcgacgggagggggtgggcggtgcctgccggcaacggcaccgagacgtacaaccactgcgccaagaagaaccgcttccaagtgggcgacgtactggatgtcaagtacgcgggcaaggactcggtgctgctggtgaaccacgactactacaagatgtgcagcacggtgaccccactgacccggttcgcggacggcgacaccaagttgaagttcgaccggacgggcttcttcttattagacagcggcatgccggggcactgcgaggtggaccagccgatgatcgtcaacatcgcccggcactccacgct

SEQ ID NO: 42033 - DNA, 399 bp, Triticum aestivum
  Clone ID: PAT_TA_42033
gcacatctagccacatctcattcgttcccgagttggaaaattatttacagtgagctgcatatctaacaaagtatgtgactacacacacgcgcggagtactgcatggatgcgccagcagaccatgatcagtaactgcaataaaatgccaacagagctacaacaatgcggtggtggaacccgtgctccgattaaacacacatagagggagcaccgaagtgcacgcgtggggtggactctgtgtggccaccctcggctaggctggaggcagcagacccgcatagccagtcgtgtgaccatcgttctcctcttcaagaaaaaaataccactgatgagatgcacgcctggaggcgcaggggcgtgtccccttgacgcagaactgaactgcacgctcgtcgaatc

SEQ ID NO: 42034 - DNA, 447 bp, Triticum aestivum
  Clone ID: PAT_TA_42034
cccacgcgtccggtataatacatgtagttcactataagtaaaggatgaaatccatttgtatttttcgcaaaaaaataaatatataaatccgtgtgtacggccggagagaacacggacagttcagcagactgaaactcgaccggtcccaatattgtgactgcgacaatgtgttggagacaaattaccagactatatatgaccacatgctaaaaacgattatttatccttccaaccctgcggtctgaccaaggtgttaagagtaaagactcatctccaaataatgtctttatatgccatggacgtgacatttctaaacaaggcatactcgaattgttgcatattattttatacataaatccttccgattttaacctcttggacaggacgcatgagtttgctatgtttctcttatttcctaccgaaagaaacaaatagcattgctaacag

SEQ ID NO: 42035 - DNA, 335 bp, Triticum aestivum
  Clone ID: PAT_TA_42035
aactgcaaatcaaactgaaatggactttatttaggactgcagtatgtatgagtatctgcattaggatacactgtacagtgcgcgcttcatcaagagctaaacatagttactgacaacgttccggatatcgcatatcacgcctcatgtatcgatcggggtatcacgtgtggctagactcgtgtatcggcttcacatcttcgtgacaagctcggactgaagaagcgcatggtcaaacgaagagaaggactgggcaacgagtgtgacctgcatctggaccgggatgttgcgcaggtggctcgtcacaggcacgaccttaggcacgttactgaaagaat

SEQ ID NO: 42036 - DNA, 399 bp, Triticum aestivum
  Clone ID: PAT_TA_42036
cgacaaaagaacagcatgcgtagattttatcttctgcaagggaataaaattgaattgacaaaacaaaacatgattcatacaaaaagattgccacgaaagaaaaagaaagggcaacacgaaaaaaaggatcatctatggcgatcggacacccgccccgccaccacaattagtgataatcccatacatcgtcggcgcgcccttacttttattttgtttggtgatcatgataacataacacaatcacgacgaacaaatgtggatatatactacatgatttacaagcatcatcccccggacgacgattgatcctccgtattcgtcctactccgcctcgacccaccacatctgctaaaagctgctgaaggagacgaggattcatcctacgaaccacacactgta

SEQ ID NO: 42037 - DNA, 253 bp, Triticum aestivum
  Clone ID: PAT_TA_42037
atgctaagttcaaactctgcgatgtcatgtctttccagtttggccaaaaaggcatcccatacctcaacacctatgatggccgcaccatccgctacccaaacccactcatcaaagccaatgacaccatctatcttgacctggagaccaacaaaattgttgacttcatcaaatttgacgtctgcaacgttgtcattgtgactggtgggcgcaacacttggcgtttttgtttgatcaaaaacaaggagaagcataa

SEQ ID NO: 42038 - DNA, 325 bp, Triticum aestivum
  Clone ID: PAT_TA_42038
ggtcagcgcccatcttaaccactctagtctacactttttaaagtcccgggagacgcttgaactgatggaggagttggccgaaccagcaggactcaacaacacaatttgcatctccgcggtattcaatttggagaaaggtgttttaatgaactactcaataggggtttgatccaacctgggaaaatagatgtatatgacaacgtgaagaggtgtcgagttcatgatacaattcttgatttcatcatatccaagtctataaaaaagaactttgttactatacctggggttcctattctgacaattgggaaccaaaacaaaggtggtc

SEQ ID NO: 42039 - DNA, 285 bp, Triticum aestivum
  unsure (1)..(285): unsure at all n locations
  Clone ID: PAT_TA_42039
tctctcaaccctcaagataccctccaaatacatagagtaaacttcactcnannantnanttnacctcatttgatctaactaaccatctattaagtttgtaccatgcaccactactttactttctcttcaactctcacacaaatccataactatctccctactctccatactcatcaccaccctaacctactacttcctcatactactctcccaatactacaacgtctaacataactacaccttcattttcatcttcagcgactccctgaccgacaaccacaacct

SEQ ID NO: 42040 - DNA, 363 bp, Triticum aestivum
  unsure (1)..(363): unsure at all n locations
  Clone ID: PAT_TA_42040
gcgtgggctctcctttctttccnnctccncgtcttctctccggcctntgcttcccctgccctgtggctctccctttcntctgcncgcctcctgcttctcgtgcccgtcgcctttgccggggtttcctctgnggntgngccgctgcttctggttgtgctcttctnngggccttgtcctgttgcttgtcctctcgctgcctgcnngnggggtctcctccttctgggcgttggctgtcgtggtgtcgtccccgtgctcntgcctgtcgtcggngtccgtgcctggcctgctgtggtccctctgccctgtggcgtcgtccctggtgctcgccgcctgccctcgctgcttcttcttcgtcctgctccc

SEQ ID NO: 42041 - DNA, 444 bp, Triticum aestivum
  unsure (1)..(444): unsure at all n locations
  Clone ID: PAT_TA_42041
cgaacagntgtcacttcagcaagacccgaatggccgtttttctctagaaaaaggactcattcgttgtgatcgtataatttggctgggaggaggcatgcagatacgacaacgcatcatttgtactttccacgacatcctgatggaggggcactccgaatttccagtgacttatcatcgcatccggcgtttgtttgcgtggccaaagatgaagacgcacatcctccaatacgtgcgctgctgtcagatatgtcagcaggccaaaccagactgngctgcttctccgggtctactccagccactgcgtgtgcccagtcagccgtgggagatgatctctatggatttcgccgacggcctatctcagtccagcaaattcaattgccttctggtcatcgtcgacaagcgtaccaagtttgcctattttctgcctcttgctcacccttacac

SEQ ID NO: 42042 - DNA, 427 bp, Triticum aestivum
  Clone ID: PAT_TA_42042
gggcgtacattgtcatcatcaacaaccttagctggtcacctttatatactcggagttattcggacccatgtatgccttgcaagatcaacattcttactctcaacatagaggacatctgccatttttttattgcactaacgtatttttgctgaagcataaatttcgagacctttgcaagcctccttgacatgggcctctttttccgcttcgacataaatataattttttagatgatctaacgcaacaacagactttatctggagatctgtcctatcaatgaacttttgcattagacagattgctgtctccctctcatgcccaatcgcacatttcaccatccaaagctttggatctttcacagatggcaagagagcttgctgttcaacgtctgcagcttcctctccatactcaatatgagtagatcttg

SEQ ID NO: 42043 - DNA, 435 bp, Triticum aestivum
  unsure (1)..(435): unsure at all n locations
  Clone ID: PAT_TA_42043
cgctcctcctcccgacccaggtgctccgcctacctagggcatccgcatcctgcgctctagcccccgcgatcgggacaccccccgccggctagcgatgttgccccctccgcgccgcggcccggcgtacaagaccaagatgtgcgcgttgtggcagaacggcaactgcgaccgcgagctctgcagcttcgcccacggcacggccgagctccgccggcccccctcctcccggcccaccttcccgccccaccacgccgaattaggtggcattcttactggttgtcttttgatttaattgccatcacaaatttgttagactcgactgctgccagaggataacatggccttttccatagatttcttcgattggtattttgatgatttgtcgngaccactaaatgctcgggctgtatcagaaggtgaacctttgagggtatt

SEQ ID NO: 42044 - DNA, 237 bp, Triticum aestivum
  Clone ID: PAT_TA_42044
tccacccagcgtctgctcgcacgccaccttcccctacgctcgcgcctcgacgccggtccctcgcagcggccgcctctccccgcgcctcggatcgctgcaggcgggaaattgtgggtgcctgatgacgtgattgacgcacacatgccgcgctaggtaaatgacgaagcttggcctggagaaggggtggcaacatccgggcattccaaatcctaacgttcggtcattcgttccgtggtg

SEQ ID NO: 42045 - DNA, 377 bp, Triticum aestivum
  unsure (1)..(377): unsure at all n locations
  Clone ID: PAT_TA_42045
ccgagccgtcaaaatccaatctttgacggagttttcctcgccctcccctactgttctaggctcncttttgaattgttaggggctcctcaataattattattggcaggcagccccgggttggtgattactgctaatcaggctgccgctgcctaatccacgaatcctttcgtgattctcatcccagtatagtcggcttctttctttctttctttctttctttcttggaggttccttggattcatccgttcatcgggcgggcgtgcgggctcgatcagaatgggcggagactgctgcttctgggtagggctcgcatccaatttcccaccaccacaactagtacgcttgttttttattgttccaagagtgagatttgcctt

SEQ ID NO: 42046 - DNA, 199 bp, Triticum aestivum
  Clone ID: PAT_TA_42046
gcgcccacgcgttcgcggacgcgtgggctatagactattgtggttaagaatacagattcattatcttaggtagtgagcccataatggatggataattgccaccaccaagctttagggaaagcatgtaaccttaaaaagagtaaaccaagtaaagtagaacctccgtttattattttacagggaagagatttttattaag

SEQ ID NO: 42047 - DNA, 442 bp, Triticum aestivum
  Clone ID: PAT_TA_42047
gttttgaaatgccttactaaagctcctagagtgccagctatagactggggggttatagtacggcggtgcatgaaagttgaggcacaaattcctcagaagtcaaccaatcatcgagatcctacattattaagggaagaatgcttatatttttctctagctcatgccgatcatatcagtccccttctacagtttttggatgatctgacagatttacccaggttcaggagattagaaatgaacgtgcagtctgttttgctccaatatttgtcacacctaatgaagctcttctctgattcaagatctaagaaactgtacgaggatttagctgtgtacttctgttcccacttatcttcacacttggattactcttctgagcagagaagcatgttaagaatgtccttctggaaaggcatctgtaagtgcctgatggaggtggtctctg

SEQ ID NO: 42048 - DNA, 404 bp, Triticum aestivum
  unsure (1)..(404): unsure at all n locations
  Clone ID: PAT_TA_42048
agaagncncacaagaagggacacatttatgggctctaccataatccttgcaagagccctgacaataactcgtagagccactgctaatactatcggcattactagctgcagcaaactctcctacttactggcggagtacctcgcgcgtacggtcccacccctgatgatcgtcacggtgatcgtcacgttctaagaaccggacgtcataaacgacgtgatgatcgcattgctaatcgtataccggatcctctacacagacttagtttaaccctcagagcacctattcgggcacgtagtataataggcagcgcgttacgcggctctacccttcttcatagagttcctcgagaagaccatcgtgtcgtccactcagtgacacacgcatcgcctgctgaatctcgtgat

SEQ ID NO: 42049 - DNA, 307 bp, Triticum aestivum
  unsure (1)..(307): unsure at all n locations
  Clone ID: PAT_TA_42049
cgcgtncgcccacgcgttccgccacgcgttcggctggctgtattggcatcaccaattcaagctgggaggacggaagctggaataggaggagacgattgttcgtccattaggcatgaacgcaactccactgtactcccttttttttcgtaaccaattctttggagcagacatgtgggtacagttacatagcgtcaagattgtttgctttttttggttagtttagatttagatttctcagatattcactatttgatcaatcgatccatgtagatctcattgacatggtttatggaatgtacctttcagc

SEQ ID NO: 42050 - DNA, 213 bp, Triticum aestivum
  Clone ID: PAT_TA_42050
cccacgtgtccggccgccgcaccctcttctcacacgcctcagcgccctcccctgctccgtgtgccgccggccccattccttctccccgcgctagaacagagatgcgcctcagtagggcagcagcagcagtagcgtctccatggacgcgggggattgacggttccaaggaccggatcccttctttggcttcaatcttcaacttttcgggtggcc

SEQ ID NO: 42051 - DNA, 221 bp, Triticum aestivum
  Clone ID: PAT_TA_42051
cggacgcgtgggcgccacgccaaggtagaggagtatctcggaaagcaccgccagcgccggagccccccgcgaatccgggcccggatctcccggcccggcggcgatggcgctctccgacctctgccgcgactcgctccttcccagcttcctctactcctcgcgctccttcgtctgcgccgtcccaggcttgctctactccccgatgacctaccaggcgcccg

SEQ ID NO: 42052 - DNA, 306 bp, Triticum aestivum
  Clone ID: PAT_TA_42052
tcgctctatatatcagagagcaaactcaccctttcttcttatttttataacaatcacccatttttaaggaagagggcacacacatctttatctatacaacttctcttatatacattctaattaaatgtcactatttacaaaaactgcgactataaaacgcttatcagctctaacaataaacgcctctctcatcttaactttgctcacaaattaaacattatacctcgtacagtaactctatctcaaaacacttcattaaaactatctcaactacatatcaaaccctttgtccatcatattttaaca

SEQ ID NO: 42053 - DNA, 452 bp, Triticum aestivum
  Clone ID: PAT_TA_42053
cccacgcgtccggggctgggaaaatagacaatgtagtctcttgttccaccgaggaggagagcctcttggcaaagcaccagctggtcttctccttggttgcgtgtgtgtgtagagtttcatatgtgggtgtgtgtgttcttgtgagaagaagatagagagaaacaaccagagaaagatagagggagctgtgagaggcagcaccaaggtagaagaagaagcggcgctgcgagaggcggcgccaataattggcatcggagccttgttgatccgtggcggcgacgacggtgccggcggctatggtggccgctgtggtgctgggcggaggcaacggctgcgacggtggtgacgcggtggactccatgtgaggtggaggacgtcggtgcgaggtgatggctggcagcggtgcggtaccagtgatggccggtttcggtgcgatgcctcgaggtgattat

SEQ ID NO: 42054 - DNA, 463 bp, Triticum aestivum
  Clone ID: PAT_TA_42054
gcggcttgctccagctggctgccactggctcggtccctccggcgccccctccggcgccggtgctggagccccaggacatcctgcaacagcagctgccggtgtgccccaacgaccccatgttccggaccttccgctgccgcctggggcccaaggagacgccgacggggaaacctgagtacaacatcaatatggctagcctagatgactaggttccttgtggtggaaccagcccatccgggttcaagtcctaaacttgacatggatgctctcatagaaggtgtgtgctgccgacgggtgaagaaatgccaagacggacatcatcttgttgcaaataccccaccccactctttgcgagtttcgctaagttcgttgtgcattacatactggaattaatgcgttagttacctagttacgtggcactagaacaacatcgtgtactgagtattcggacaagtttgctttt

SEQ ID NO: 42055 - DNA, 421 bp, Triticum aestivum
  Clone ID: PAT_TA_42055
gctaaacaatctctaggtgcgggagcgctagttccttgtacaacattagtcaaatgaaccaataactacttgattaaaaaaaacaatcattaccatctgaggacaaaaatgacccccacatcaaaacactggaccagaactaatacctctagtcataactacttagatcgtcagaccaaaccaagataaaatttatggacagactaaacaaagagatatattcctctcatacaacacttttgacaaaagcatcatacaagcgcacagtcttgctatgccgctgcatattataagtgagcggcactcatctagctttcttaagaaatcttctgtgtctttcgtagtggaacctatgaagcagtaacattattacaacatagttgcacaacaagccatacgggtactttaatcgcggtcacaa

SEQ ID NO: 42056 - DNA, 457 bp, Triticum aestivum
  Clone ID: PAT_TA_42056
ctcctccctctaaaatccgcctcccccttcccccattccctttcctcctccccaagaaacaaccgaagctcgcacatcatctcacctcggcgcctcgccccctagcctctacgcacctcgactcccgcgccatctcgctgcattcgcgatgtaccgtgcggccgccagcctcgcctccaaggctcggcaagccgggagcagcgctcgccaggtgagaggattcgccctgctcgaatttctgtttgcggtcgcctggtgttctagcttggtagttctaggtcgagtagcgtcgctgggttcaagtggagattcggtcgcgttatttagtgggtttggtagcgcgtgcgagagcgagaccatgtggtggtctgtgcggggttcagtcgaatctaggcaagcttgaattgcttaggatccagcggattgggttcaatgacaagtaatggattaatgatct

SEQ ID NO: 42057 - DNA, 222 bp, Triticum aestivum
  Clone ID: PAT_TA_42057
ttctccttaaaatctccgatttaacatatcgtgaaaacattctataaactctataagagtcggaatttgactttaaaagacttaatctcctactaaaatttcatatactctcctcttaatgtcctccatttaacatattgtgctatacacttttcttattctatacatgtctaccccactggactatcttgttccacgtctcgcacattgaaattatctctt

SEQ ID NO: 42058 - DNA, 377 bp, Triticum aestivum
  Clone ID: PAT_TA_42058
ttccaatctaaaggctgctgcatccgaatttattgttccccactgaaactccctgaggagggtgaatcatccattttctatcaccatatagtttaagattcagtcctgtagtcgaacatctcaccgagaggcgatctggactaattacacttattcatgaagtagaccccatctatgtggactgattcaaaaatggaaaatcctgcaggtacgatgggaagatggcacatactgttatatccaaactacactatctccatactatatccagatatttgctggctcgccctctattgctcagtctctatcagcatacagttctaaaccaactacactgtgccctgagggcactgtgaacgctccaactctgtctggaa

SEQ ID NO: 42059 - DNA, 417 bp, Triticum aestivum
  Clone ID: PAT_TA_42059
gttaaatgggcagaaagattttcaataagtattaccacatagggcaagcttaaccaataccttattaaactagttcaaccactactttaacttgcattttttttttgttctatcatgccaacagaagaaatagagtagaacaggtcatgctgaaatttggcttacatcagtaaaagcctgacctatgaattttatttttcagtccagtcttccactttcacactccttttcttctgatattgattcttcctcatcagtttcagatgatagtacttccgatgatagttggacttccgcccgagctcaacaagcttgatagcctccttcaccctcgatgcatttaccaatgcattcactacatcctgcagcacaccacactcgactccacagcactttttactagcaaagatttcataa

SEQ ID NO: 42060 - DNA, 128 bp, Triticum aestivum
  Clone ID: PAT_TA_42060
ccgagtttatggatgaaaaggtgtgtaaagttgcattggttttaacctagtaagaaatatggagtaattgggattatcatctgtgttggcgacattcatgttctgctctataaaacatgcattggtac

SEQ ID NO: 42061 - DNA, 420 bp, Triticum aestivum
  Clone ID: PAT_TA_42061
cttttccccattctctccctcctcagtccagttctcctcccaaacagagcaagagcagacaaatagggcggctggaaaacacccaagaagaagaagaagaaggcaatggcggaagcgaactcgtacgaggagcagcgccggcggcagattgaggagaaccgccggaagctggacgagctgcgcctgcaccacctctccgccgccgtccgcgaggccgccgccaggcccaagcccaaccccaagcccaggccgaagcgcaaggccccggagcccggcgagctccggcggtccggccgcgtcgccggcctcccggaacagcccaaatacgtcgagggcgcagagcagcgcggctaccgtggagtgtacgaggcatacgctgtttggaaaggaccgaccgacgaggagagggccggcgccatc

SEQ ID NO: 42062 - DNA, 385 bp, Triticum aestivum
  Clone ID: PAT_TA_42062
gcggttagccatatgaactaccttctgactcgactcgtcttctcaccaccatctcgagcggacgacgacggcggccgccatgtggcagcgcgccagcttcctgctgctcggccgccggacggccctcacgatgcgaagcgcccccgggatatcgagatccaccgtgggcaccagcacgagctcgccctgcatattctctaccctcaaagcagagcaggcgaagacacccgtagaggaagtgaagcctatcgccacggtgcacgagcccgaagagatcgaagcccagcttgagagaacgaatcggtttgacatggacacacccgaaggtccatgcgggcccaaagaagatccagttctgtttcacgcacactgtcacaaaagggtt

SEQ ID NO: 42063 - DNA, 316 bp, Triticum aestivum
  Clone ID: PAT_TA_42063
catctactagaaaggaagagactaaatatctctatgcattcaaatacaaagcacactccaaaaagaactatatttatttattaagagcaaacattaaccagcacccgatatattaccaaaaaatattacgatgtaatcgagtcctcctattcgtgcgctgccctcgatagcgaactaatcccaagacatttccacttttttgatccatctataataaagccaattggagattttgcctagatgcgaaaacaattataaagccttagcccaacttgacaattttagcaagctgacgcatcaccttctactcaacata

SEQ ID NO: 42064 - DNA, 464 bp, Triticum aestivum
  Clone ID: PAT_TA_42064
cccacgcgtccggcagcgtggcagcgtatcaacatttgatttcaatgttgaggcaatgtgcatctgaaaatgaagccattcacagaagtgcgagatgggttgggtttggaagacaggttagcagacaatataaaggttccattaacgctgtgtgcaggtacggaaggtacacagattaccatccgcgatggtgactgcaactccgcaaacgaatctggaaatgtcctagcaaccttattgctgccagcaaagtgtgaccagccaaaaatgctccaaggcctgggatggtcgaattcagggaaacacagattcggaggcgtcagttaaccagggagatgatcgtgtccttgcgagaagtgggagctcagtggtttccttgctgtctctgcaggtaagcggtggtcacgatggcgaagcacatggattacaagaactacatggtgcacatgaggagcaagcttacg

SEQ ID NO: 42065 - DNA, 471 bp, Triticum aestivum
  Clone ID: PAT_TA_42065
caagttcgtcgaggacaagcacaaggcgcacctcccggccaacttccgcaagattctgtgggtgcagctcaagaagctggtcgcctccggcaagctgaccaaggtcaaggcctcgtacaagctgtcggccgccgcggccaagcccaagccggcggcgaagaagaagcccgcggcgaagaagaaggcgccagccaagaagaccgccaccaagaccaaggccaaggcgcccgccaagaaggccgccgcgaagcccaaggccaaggcgcccgccaagcccaaggccgccgcgaagcccaaggccgccgcgaagcccaaggccaaggccgccgcgaagcccaaggctgccgccaagcccaagggccgccccgccaaggctgccaagacctcggccaaggacgcgccagggaagaaggcccctgccgtcgcggcgcccaagaaggccgccgccaggaagccgcccaccaagagatc

SEQ ID NO: 42066 - DNA, 469 bp, Triticum aestivum
  Clone ID: PAT_TA_42066
cccacgcgtccgcccacgcgtccggctaggacctagagggtcgagttaacccaagaaccgcacacccgcaggatcgacgtaccaagcagctagcagcagacatgcgccgcctgtccctcctcctcctggccgcggccgccctcctcgccgccgcggtggcagtagtgcgcgccgggccggaaatgccccaagcggcgtcggtggcaggaatgggcgccgggccgggagtgccccaagcggcggcggcggcaggaatgggcgccgggacgcaagtgcccaaagcggcggcggcggcaggaatgggcgccgggacgcaagtgccccaagcggcggcggcaggagtgctcgccgggccgggagtgccccaggcggcggcggggggcccgccgggcaagctgtcgcccgatttctacagccagacgtgcccacgggcagagcggatcatcgcagaggtggtccagtcgaagca

SEQ ID NO: 42067 - DNA, 408 bp, Triticum aestivum
  Clone ID: PAT_TA_42067
ggggaggcaaattatttatgacaatccattaagcgaattacctatgataatctgaaccaatgaaattacaagtattgaccaggtgtactggatgcaaagcatctacactgtttagtctcaaaaggcaaaaatattgaacatactaacagaagtgtagcatttataaatctagttgaagcactacaaacttgaatcaactttcaaaatgatttgcacttcccacttgtgtggcaaacaaggccagccagccaggggacagaaacaataactgaaacaggggcttctattcattgctttgctttcaaggggatactacctttcgtgtagcacccgcgcaggtgacattggacggctcgacgaatgttcttcttccgccggcgaactcggcaacgacactggatgtgtcgt

SEQ ID NO: 42068 - DNA, 347 bp, Triticum aestivum
  Clone ID: PAT_TA_42068
accacgcgtccgcacacgcatacacataggacctatagggtctagttaacccaacaaccggacaggctcatgatcgacgtaccaaacagctatcatcatacatgcgctgtctgtccctcctactgctggccagagccaccctcctcgccgtcaaggtggcagtagtagcgcagccgggccctaaatgccccaagcggagtgcgtggcaagaatgggcgccaggccgagagtgccccaagcggctgcggcgactggaatgggctccccaacacaagtgcccaaagcgacggctgctgctggaatgggctccgggacgcaagtaccctaagctgctgtggcaggagtgc

SEQ ID NO: 42069 - DNA, 442 bp, Triticum aestivum
  Clone ID: PAT_TA_42069
accactcgtacacaacctaaaacacacaattactattacttatctctgcacacccaacaagaaaaactttatatataaatcctaactatatttttcatctatcacatgctttcaagcactattcccattcaaaaatataattccatcttactatacttccataattaatattttttatcttaaaaaggtctaatttttgctcaattctcactattatataaaatctattaatctacttaaacccttcaaacttataaaaactttcaaaaataataatctatagtaagttctcatacttcaaacctttagtcacccacggcacaaaaacatttactaaaacaggggcttttattcattgctccacttcaataaattcactaattcaaaaatgaaattatctattacttttaataaaatccaaaaatttttttttactttaaaa

SEQ ID NO: 42070 - DNA, 466 bp, Triticum aestivum
  Clone ID: PAT_TA_42070
atcgactgctacaccgaggcgatagcgctgtgccccggcgtcgcggtctactgggtgaaccggggcctctgccacttccgccgcaaggactgggccagggtcgaggaggacagcaggagggcgctcgcgctcgacgacgcctccgtcaaggggcactatctgctagggtgcgcgctgctcgagaaggaggactgcgctctcgccgtcaaggagttcgagaaggctttggatctcttgaagtcttcaaattcaagggacaaaatggcggaggacatttggcaggttcttgccaaggccaagtaccaagactgggaaaagcactccactcagcgggtttggaagatgcaaagtttaagggaagcttgtgaaaatgctctgcaggagcatcactttcttagcggtactctttcagaagactctgaggggacaaccaatgagtatccagagcaatgcaaattgttatccg

SEQ ID NO: 42071 - DNA, 432 bp, Triticum aestivum
  Clone ID: PAT_TA_42071
atcgcctgctacaccgaggcgattgcgctgtgccccggcgtcacggtctactgggggaagagggtcctctgccacttcctcctcaaggactggaccatggtcgaggaggacagcaagagggcgctcgcactcgacaacgcctccatcaaggggcactatctgctaatggacgcgctgctcgagaaggaggactgcgctctcaccgtcaaagagttcgaaaaggctttggatctgttgaagtcttcaaattcaaaggacataatggcggaggacatttggctagttcttgccaaggccaagttccaagactgggaaaagcactccactcagcggtttcggaagatgctaagtttcagggaagcttgtgaaaatgctctgcatgagcatcactttcttagcggcactctctcataatactttgatgggacaacc

SEQ ID NO: 42072 - DNA, 124 bp, Triticum aestivum
  Clone ID: PAT_TA_42072
ccaatcttacctactcttaaagaaagactttatatctcttctatccttccacctatattcaatttactgacccttaattttacaacgtctatactaccaaaactcctatcaaacccaacttaat

SEQ ID NO: 42073 - DNA, 392 bp, Triticum aestivum
  Clone ID: PAT_TA_42073
acttacatcaaacattatttgttgaaataagacttcaccaaagattctaacttattctattctgatactaaaccttccctaaaaagttaaatctacactatcatgatccaaactaaaagacattagttccacattgcaatcctacagcaacatccaaactcatattgtaaatctttccctccatttcaaataatatatctaaacattctcccaacaattacattctttaattaaaccattaaattcatcaactaataactactttttttcaacaataagatgtcctctctaaaacaaattatttctccaccattccttaaaaaacacatacaataatatcgatttaattttcatcattacaaagaatccctttaactctcttatttagctcc

SEQ ID NO: 42074 - DNA, 418 bp, Triticum aestivum
  Clone ID: PAT_TA_42074
cccacgcgtccgcaacctaggacacgagagttgccaacgtacaccgttgcgaaatcaggggggatctctggattgtctctgctgactgtattctggtttaacaacagaatgcgttggcatccatgaactccaggttccatggtgaaacctatacgctctttatatagccaagaatcggtcgctcggacaaaccaatcaagtgctcatagaacaacttaccaacactccggtgacacatctcataaggcagtatcatcccctattgccatatatcaaccaatgtcaatgcctggcatgccaaacgggttcacatgagccaaccttctagcatatcataggccgtttgcttagacccaggcggctgcaggtcacatagctgaccacaacggactggctggccaggtatacgggtggatac

SEQ ID NO: 42075 - DNA, 464 bp, Triticum aestivum
  Clone ID: PAT_TA_42075
ggccgagttgcagctcgtgacggtcggtggcgatggagaagctgctgctcttggcggtggcgtctcacgatcacgagacggtcctggggcggtgcccgttcctcctaccgcacggcgccacccgtgcccgtgtcgctgcaccgtcatcagacctctcgggcggccgtgacgaggtccgtcggaccgtgctccgcgccggcaaggtgttcggcttctttcaggtggtcaaccaccgtagtgccggagcggaccatgcgtgaactggggacggcgtgcggagagttcttccgccttcccgcggcggacaaggcggccttgtactcggagtcggaggacacggagcgaaccaaccggctcttctccagtaccatgtgcgtgtccggcggccagacctactggcgccactgtctccgcctcgcctgccaccccgtggagagcaccaagcccggctggcccgagaagcc

SEQ ID NO: 42076 - DNA, 340 bp, Triticum aestivum
  Clone ID: PAT_TA_42076
agcacatattcacaaccctgcacactaggttatataactgtcctacttacagtgagggagagagttcctacaaatgagaaccatcttatcaatatcctcaactcacaaatgaatccaattgcttccacacatacaacactcaatttcagccaccttctacggagaagagtttgagagcttactgtggttgctaaggctcaggcacccgatgacctacttgtgcaaaacccaccaccattgtcgttggctctcgcacaacaagactggcgacgctttgcaccttacaagcaaggctcatcctacgggcacttaatgatttcaacctattaataattcaaat

SEQ ID NO: 42077 - DNA, 355 bp, Triticum aestivum
  Clone ID: PAT_TA_42077
aaaaaaaaaaaaaaaataaaaaaaaaattttaaaaaaaaaaaaaaaaaaacataaaaggggggattattaaaaattaaatcacacaacttcactcaatggccgcccttttttctacttccccccttccttacgcgttctttcccagccttacttcttctatccgtccccttaatttcaattacctgccctcctttttccatcttcttgtctgagaaaaccatttctttccccaacttaattgtctttcattactttctttttttgtcagttggtttaatacttaattggccttatccattcctccctttcaaacaattattcactttttttggtgattcgttccctccctttttt

SEQ ID NO: 42078 - DNA, 265 bp, Triticum aestivum
  Clone ID: PAT_TA_42078
cggacgcgtgggcgcagccgcctctctcccgaccaaaagccctagctagctagacccacggcatagcgatgagcgaccatccccaccaccggctccgcctccctcctccggggctccgccagcctccatagggacgggaggtcaaccaggccgtcgtctagcggccaggccgttgacggggcgacacgcgcgctcgttgacggtcgtgcgcgcctccgtcaaggacatcggcttcgaccaggcgtcttagcttcgcccttcacgc

SEQ ID NO: 42079 - DNA, 401 bp, Triticum aestivum
  Clone ID: PAT_TA_42079
tttctgcggccaacatggggcgtatgtattgcaaagtaccatttataaaaagcatgaaagagtgctctaggaacataactagtgttgcttggaactgtggaaatttaaaacgggagtaaatatattgtcgcctagatggggatgcatgtttgtgtgatatacataccgaattctcaacagtttgttgatgattcagtgatctaatacacaattacaatacaaattctcacccaagagggaacaaaaaccaagttatgaacatatcaaataatactccggcagctggttattccgcgggcgggtggtactccagtagctgattcagatgattgataacctggcgaagcacgaaccacgatgatggatcctcgacccctagtgccaggatggcgcacctgcat

SEQ ID NO: 42080 - DNA, 148 bp, Triticum aestivum
  Clone ID: PAT_TA_42080
agcgcatattacaaatgctgcaaattggtaaaagtagtgtccaacctactgtgagggacaaagttcctcgatatgagaaacatattatcagtatcttgaactcacaaaggaagccagtgcaccacaatacaacacaattcagcactca

SEQ ID NO: 42081 - DNA, 156 bp, Triticum aestivum
  Clone ID: PAT_TA_42081
ctccacccatatcttactacctccgccttgctctatagaggcagctaaaaccctagcggagtcgttcttcccggcggatcgcgattgtcgtttatttccattactaggtcacgcaggctgcatacgtgaagctcgcgcttcacgctctcaatcacc

SEQ ID NO: 42082 - DNA, 251 bp, Triticum aestivum
  Clone ID: PAT_TA_42082
ctttattactcctcccaaccctctcaccataccttaatacaaccattgtaaacattctggaggagaacctaactctcactatgtcctcccacaactagaactagcattaaacacctcattgctcttaatatgtctaatcacacctaactcccgatcgtctactgcactataaatatctttcttatgtactccaaacatcttataaaacatttcagatatcaatatctgcaccactctaaaatacctctctc

SEQ ID NO: 42083 - DNA, 386 bp, Triticum aestivum
  Clone ID: PAT_TA_42083
gaaagactgatcaatagtaaccacaccaaatttcaggttcgcacaatgccttgtgaattaagaagcaggtcattgcctcctttatgcagattatatgccctataagctatataaccaaataaaatgtactgcttagaagacggtagaaatgaaatgggtttctgaaacattggcactgctagaactaggttgctaattttattccacgcggtttcgaaatttcctgtgcaaccaaaatgaccgtcttgaaccgtgccgcgcaaaacagcaagttcagtcaaattccaaaggtggatgttgtataaaatccagtgaatgatcgttgggagaaactgatgggccttgagctgcgctctgtagtagagcatcaaggaatttgatgaggc

SEQ ID NO: 42084 - DNA, 169 bp, Triticum aestivum
  Clone ID: PAT_TA_42084
gtccccctctctcgctcgcatcacaacaaacgcgctctcgcccagcttccggaacgctcggcccgtccccgtcgccaccggcatggcctccgccgtctccctcgccgccttctctcgcccttgcgcttgccgcactgcctgcgcggggcgggccacacctcgcgcggcg

SEQ ID NO: 42085 - DNA, 310 bp, Triticum aestivum
  Clone ID: PAT_TA_42085
gctcttttgttcatattgtcaaaaaggaaaaatacatacaaaaccaacgtcttccaggttgattaatacatgtcccttgtttccacgcaaaaagaaaatgctactagtatggtaccctttgcaaatcttgaccatgcattgcaccatcttatgatacaccgatttaccatgcttacactaacataaggaggaactttaggacaactctcgaagaaattcataatgtagattgtatccgctatcaagttggctgcattgatttacatctggaatcagagggatgtcgcagctggcaaaaattcaattgctg

SEQ ID NO: 42086 - DNA, 179 bp, Triticum aestivum
  Clone ID: PAT_TA_42086
ttctcccacacttcccattactcacaatatattctcttcatcatacttctttcttcctctttatctaattaccgacaagtttattatatctcttactctcccaaaattcaatttattcaaaactatcattaaaactaatttatactccatactacaaattactatttaatctaacacat

SEQ ID NO: 42087 - DNA, 355 bp, Triticum aestivum
  Clone ID: PAT_TA_42087
ggggagcgggcggggaggccgttgcgtttcccgctatttcctccttgcccaccgctccctgatacgtgctccgcggcggctgcgtcgccttccccccgccgccggcgccgacccctccacgcgccgcgccggcgccttcgtgcaggccggcggcgcctcgccctcctccgcgcccggccagaacaagccgccggccgccatcggccccgtgctcggccgccccatggaggacgtgcgcatcatctacaccgtcggcaaggagctcggccgaggccagttcggggtcaccagcctctgcacgcacaatgccacgggccagaagttcgcctgcaagaccatcgccaagcgcaagctg

SEQ ID NO: 42088 - DNA, 183 bp, Triticum aestivum
  Clone ID: PAT_TA_42088
cataatacccgtcccgacccacacttcctcttaccctactaccttaaccactacatttatacttccactctacttactaaatccaaagaaattttatcccccatactccccaaatcaaaccattcctcatcaatcaaataaatcacaacccaaaccacatccaacaacctcaactcaaccaat

SEQ ID NO: 42089 - DNA, 427 bp, Triticum aestivum
  Clone ID: PAT_TA_42089
gttgtttgtcatgtgagttggatctgtattatgttgggacatgaatgggtaaaaaacccgacaaatctgccatctgtctttaaacttatctataattgcttgttgttgatgacttgtttgcttgagcagtatttgtatggcagccatgtgcatccatcctcactttggatccagcattggctacctcttgctctcgagcaatcgagctgtacattttcggttacttgctgctgaggtgcaacaactgtgatttcctggtatggtttgctgttcttgttggctgtacgagggcaagttttgctacttgatttttcaaccggtaccatttgtaatattcattggcggtgcatttgccgagttacaaatgtgtcggtgacccgtttttactctgagaatttcacaacatatatcaaaaccatctgctagt

SEQ ID NO: 42090 - DNA, 394 bp, Triticum aestivum
  Clone ID: PAT_TA_42090
gaatggtagtcagagccgagtagtattattcttctcaaaatgtacaaagtttgctactactacttactcagaggccagcaatcggcatctcccttatgcccccacacaaacaaacaaaaagaaaacgaaatcttctaagcagcaccaagaaacaacaaaatcgtctaggaaacatcaaccaatcaaaactagaggaagaagaagaagaagaagaagaagaaaaaggaggaggaagaagatcgagcataaaaatggccggcgtagtatgtctatacgcacggctttgggtacatgtagccgacgtactttgccttggcgttctcgcacttggacgatgtggtgccggcgcccttgaacttgaggtcgaggtcctggagcacgacgccctggcacg

SEQ ID NO: 42091 - DNA, 319 bp, Triticum aestivum
  Clone ID: PAT_TA_42091
caactttgtcctctttagttagtttatttaacttggagggcaaagattggcttagttgtgtgtgtgtcttttcgggcgattgttacccagatagtactgtgccagcttagcttcttgtttatcctgggttaccatttaacgtgagtgccgaggagaccaactaaaagtttcatttggtcttcccatttggatattccatttcggggacattttcttggcaacaatcttccctggaaaaaatattctttgctcttaattggtttcctttggggtaatggtacctattggggggaggaaggccaatttttcattttcccac

SEQ ID NO: 42092 - DNA, 316 bp, Triticum aestivum
  Clone ID: PAT_TA_42092
aaaacaaaaaaaaaaagttttgattgattcattctgaccccacctatccctactcataattattatttttttacctaccgtattggcccttttcttcccacaaggccccaaactcaacttgtttacaggcagaccataccaaaccccacaacatggaaaaaaataaaccccccccccaacgggagtcaccaaacaaaatccacagggggggagggcccccttcccgtgcgttttccaaactttttgccttgaaagaaaaaaaaaaacttcttcaccaaccaaccggtgttgtaccacggcctattaatcaaatcca

SEQ ID NO: 42093 - DNA, 448 bp, Triticum aestivum
  Clone ID: PAT_TA_42093
cggacgcgtgggccagtgtcttctactgtcagttctaagcttacttcatagagtgccatagttaaaaccaaacacacgtattggagcacggactgcaggagcctaatcttcaagacatatagaaggcacacatatttgactgaagaataaggcatttgtctgattcagtactgacaggtgggacaggagcgctacggacgttagggtgccgtcgactgataggagcaaagccgtggctcaagacgtctccgcggtcctgatccgtggttcagaactgatgctttccgttaagttgcacaactaacgagtaatgccggtatgggtagatcggagcggctgtctcctacctaacgaacatggagctttcctttctgaagagcggtgatccggcggagcgaccatatctgaggaggcaacttcggcagcaggagaagatggagttcttgat

SEQ ID NO: 42094 - DNA, 189 bp, Triticum aestivum
  Clone ID: PAT_TA_42094
gaaacgaaaaagaccaccaaccctccataaaaaattttaaaaattacccaaaaaattctccaattcacaactgaaatccactaaaaattctctaaaggttttacaaaacctttttctatccctacttaatccaaaaatcccgacttttccatgaacctgatacctggtaccccaacctttgctttccct

SEQ ID NO: 42095 - DNA, 166 bp, Triticum aestivum
  unsure (1)..(166): unsure at all n locations
  Clone ID: PAT_TA_42095
cccactcttacncaaagcctctttcttccattttttgtgccttcttccaatattctggtagcatttttcatataaagcatctttcaccataaatgattcatcaaatgcaacatcctttctactaatgcatactaagtgactataccatcatctattaggatctctc

SEQ ID NO: 42096 - DNA, 458 bp, Triticum aestivum
  Clone ID: PAT_TA_42096
cccacgcgtccgcccacgcgtccgcaagactgaagcatttttctgcaatgaacaagctcaagaagatggcattgagggttattgctgaaagcctatctgaggaagagattggaggtctaagggagctgttcaaaatgattgatgccgacaatagtggaactataacatttgatgagctgaaagatggcttgaaaagggtgggctcagagctaaccgaacatgaaatccaggctttaatggatgcggcggacatcgacaacagcggaacgattgattatggtgaattcatcgcagctacattgcacatgaataaactagagagggaggagaacttggtgtcagcattctcgttttttgacaaggatggaagtggattcatcaccatcgatgagctatcacatgcatgccgcaaatttggtctggatgatgttcaccttgaggatatgatcaaagatgtc

SEQ ID NO: 42097 - DNA, 397 bp, Triticum aestivum
  Clone ID: PAT_TA_42097
gagtaatgatatactgaaaatttcctttctttgttgttttcgaatatacatcgaggcactcaggttgtactcatatccacaacccattgaacaaatggagattgctatatggtggactacctacagattactaactttacaaaatccctcgcatcctctcaatttctaatcctatggaaatcattgtcattaggcaccttttgaccattatatccagaatcgaacggtttggggtatgccagagggtttaagaatctcctgagaagcgccaaatgctttatttcactccagttttcatcatgaccatcaaatcctgatcatgcagtcaacaatgccatgcctttggtgcctttgttgcacaaaggcagaggatatgcatccctcagttatgtatgct

SEQ ID NO: 42098 - DNA, 262 bp, Triticum aestivum
  Clone ID: PAT_TA_42098
cctaattctaaacccccaaaccaaaggaaattcactccaatccaatccccacagagaggcggatttcaaaaccctatcccatcccatcccatcaagattaccaacccaagtttgttcttctacatgaccgtcttctgttctccatccggactcatctacatagatctttacaatgacgcgttgccgttgatcttatatatctttctcgctctcttcacctacttaatggtcttctgcaagaacatcaagcctctgcactaca

SEQ ID NO: 42099 - DNA, 293 bp, Triticum aestivum
  Clone ID: PAT_TA_42099
aaacatgaactttaacaacacactgattaaaatcttatttttactgctaaacacccttaaacttcattggccatttcttcaattcctcctgaaagcaccaaatttttttttttaaaaacaatgtgttttatactaaaaacattaagggcctttcccgggttgcttttaattttccccaccaccccttgggggccaaccaaaacaactttaaaatgggttttttttccccaaaatttatttttatttttaagcccacccaaatttttttttaaatgccctcgctcccctttttt

SEQ ID NO: 42100 - DNA, 139 bp, Triticum aestivum
  unsure (1)..(139): unsure at all n locations
  Clone ID: PAT_TA_42100
tcggctatttttatatcactagtcaccgctctttttttttgtttgggattaataatagggtagagttttcttttaagggttgntttctaatatacatcgaggcacatgatgttgtacttatatccacaacccattgaac

SEQ ID NO: 42101 - DNA, 293 bp, Triticum aestivum
  Clone ID: PAT_TA_42101
cttggtcgaggcaggccgcatcaataaatctaggtccggagtcgactccgtttccccccgttgggagtaccattccgaccggcgaacccattcaataacagccccgttcgtccgtcacattctgttctttcaccggtggtctgatcttgctctgagcatcgtccgtcccaagccccccgtcgtactctcgtgatccgacccatcccgttctcgtccacatgtccctcaacctgtcccaccataccggcgctgcggtcatcgctgccacccccgctccggtcgcccgcgctttt

SEQ ID NO: 42102 - DNA, 110 bp, Triticum aestivum
  Clone ID: PAT_TA_42102
cggacgcgtgggtatataaactatatatagactgctgagaccctactacttttgtatctgggggggatatctctagaatatgaggacctgtatatctgaaccttaagcta

SEQ ID NO: 42103 - DNA, 250 bp, Triticum aestivum
  Clone ID: PAT_TA_42103
ctagatgcgagcggccccccggtgttggatttgaagatgtttgacgccttgctagtttggcgttgcctccttagttctaggcttggtgggtttagttgtgtctttttcctgttcgggttgagcatcccttgtctctctgctctgggttccatgctcattccttcttgcgttcatgtcatgttttgtaaccctcctctgtactcaattctctttcttctatcaatgaaatgatacacaagctttgcgtatt

SEQ ID NO: 42104 - DNA, 142 bp, Triticum aestivum
  Clone ID: PAT_TA_42104
aatcataacaatctcacataagattcttattacaaataattaaatactaaaaaaaaaactcttttccccaacaatttcatctctttcattcccaaaatttataaatccttctccatacatcttatcttatcttctaacctac

SEQ ID NO: 42105 - DNA, 400 bp, Triticum aestivum
  Clone ID: PAT_TA_42105
cgaccgggctatggtgaacctcccctaccatgaccgctcgcgcttgtgtgcgcgtgatccacctggtgttcatcccgacgcactttccatttttagccccaagataaaccttaccccgcagccagggccagtcgtcaacgtggttgtgtccttcacccttgccaaggaccaactttccactctcaagcgcatatccggtggcgatggcgtgagcaccttcagtgccatgagcgcccacctgtggcaatgcatgtgtttagcccggcagctacccccggatgctacgacgcatcttatgttctcggccaacatccgccgcatcatgaggccacctctcccaggcggctacttcggcaacgccataataaaccctaatgtcggcgacaaagcgtatgccatc

SEQ ID NO: 42106 - DNA, 453 bp, Triticum aestivum
  Clone ID: PAT_TA_42106
aacactagagattgatccatccatgggttccctattctcttcccccgccggccgcgactgtctcccagtctccaaaaagtacattggccgctctattaggtcaaaagaagaggacgtcgccctccgaatttctactcttgtcgacatcgccatcgaacattacaactccaacaatccaggtgccgagtttgagtatcctgagtatcctccccagtcgaccacggagatgaaggctgcctgcatcggttttaggggaactttctggtaccacctttgcttttcggctcaccccatggatgccaccaccgagacgcagcactttttcgctgagctatattttgatagacagtaccttgaactagccgttgaaacatgcatcatcttagaaaagccgttgtgccgctttagcagctcgtgtgcattttgtccagacgaatccaatatcttgcaccc

SEQ ID NO: 42107 - DNA, 301 bp, Triticum aestivum
  Clone ID: PAT_TA_42107
gaagttgtgtgttgttacagtcgtgatcagtatgccaaggttagatgctatatcatagaccagtctctttgtgtaaacttaagtaatcatggttgtaggaactgtttttatatgatatcatgatgctctaggttggaggacttgtaccaaagcgctgtaggaatgacttccttaggttcaggaaacacaccgagcagaaaggaaccacgcaagacaatattgagaaagagaggctgaaacatatgatcctgattaggggtggagaacttgaacttacacattaagaatacaaatgtagctg

SEQ ID NO: 42108 - DNA, 314 bp, Triticum aestivum
  Clone ID: PAT_TA_42108
aaagctcaattcaaggagttgcactatatttatagaagctgctgaaaattcatccccaatcataatgccaatgttaatgcatctatcataaccactcacctttgcgtaaacccaagtacacatgctcgcatgaactatctttatatgctcacataaagccctagtaaataggatctgcaacaaaacgctaaatcaatgactcacttacgtacagacaacacaccaagcaggaagacccctccctcaacatattttagaaagctagcttccaataaattattgtttattagattcaagaactaatacctacacat

SEQ ID NO: 42109 - DNA, 435 bp, Triticum aestivum
  Clone ID: PAT_TA_42109
aatacattgatcgtaggtctatccatgcccgtgtaagctttaaccctgtgtgaatctgtagcctacattcctatttttctcaaggtaacccagatttactttttgcatgcccaatatgtttgtatccatgtccaataattgtcctttttagacgggtaaagtcaaatttataattgtaaccttgggtcataatctctaaccttcaccactatgaaacctttatgagctggtttttatgcaagcagctaaggtccattcaatggtatgaacatgaatgtttgtcagttgttagattttttttttgagttagaacatatgcgtcttatactgatctcttgcgaaaaatgagttctatgttgtactctctgttagatttatcctgctatcacatgccatttttatttgatttgaaaactcccatgtagaagctggaat

SEQ ID NO: 42110 - DNA, 393 bp, Triticum aestivum
  Clone ID: PAT_TA_42110
acaaattcgtcgatgtacctatcgtggagatgcgtatcggctacgaccgcctgcatcttcgccgcgcctgccacgaagctcctcctggcctcttcgtcaaccatgacggcccggacggcggtcgagacgccatggcggtcgaacgacccgtcgtcctcgttcctcgccacctgcagccccacctgcttcgcctccatctgccgcgcgttcggcccttggtcgccgtagatgggcagcatgaccagagggtgcccgaacaggaggctctcgatcagcgagttccgcccgcagtgcgtcaggaacccgcccacggccgcgtgcgccaggatgttcatctggggcacccaccccgtggtcaccaggccgcggccactggtgcggtcctggaaaccg

SEQ ID NO: 42111 - DNA, 327 bp, Triticum aestivum
  Clone ID: PAT_TA_42111
gtacgacacgcgagcgggcgcccttggtgaaaggtttagagtctctcatgttttggggggaggcgcatcaaactaagcagcctttgtatttcatttggctagcaattgcaaaaacaaaatgtaaagctgaataaggccgtcaaacctgaaataagaatactagatcattaacacaaagaccgcctcataaattctcatgtaccaaggttcgagacaggttttaaagaaaaacggcttatctctattcctcagctcgtcaatagggcaagaacggatgatccgttgttgcattctaactaaatagcgagtggccagttttagagaatt

SEQ ID NO: 42112 - DNA, 371 bp, Triticum aestivum
  Clone ID: PAT_TA_42112
gtagactaaattcagggctcacttattcataacctgcagaacgacataagtttcagatccaaccgataacactgcatcacagtactgtagaaacaaagacaccaacagcagaaccagacgagtccaccctccacctggagcttaggctccggggtggcatgcaaatcttcgtcaagaccctcactggcaagaccatcacactggaggttgagtcgtctgacaccattgacaatgtcaaggcgaagatccaggacaaggagggtatcccgccggaccagcagcgccttatctttgccggcaagcagcttgaggatggccgcacccttgcagactacaacatccagaaggagtccacccttcacttggtgctc

SEQ ID NO: 42113 - DNA, 437 bp, Triticum aestivum
  Clone ID: PAT_TA_42113
cccacgcgtccgcccacgcgtccggtccttcgtgtgggtgcggctgcggtatgtgccgagcccgagttcgtgctcaatgaaaaattaggctgttcgtgcggccgaggcgccgttcgtgcggcggagcgtatgtgcgccggaaatatttgtgtcctctccctttctcttgtttcttccttatctccggtgatcgccatggttcagtgagtaggctagacaacaacaagggccacaaatcagacttgaaaccagacttgtcaactgaatccggctcgtctctggagatcaactcgcacgccgtcttgaggttgggaacgatgcctgatatggtgggccggtccttcctggcaaacttcacgcagcatcgtgcaatctgcgccacatgcttcaatgcgtgcagctgtcatgacgttggctccggtacaggtcgtctatcc

SEQ ID NO: 42114 - DNA, 406 bp, Triticum aestivum
  Clone ID: PAT_TA_42114
gtagtagaacgtgagcagccgctgtagaagatgcaagatgactacctcctccatgctgcgacataattcttctataatagcaccaaaaaacaataaactactcgccgttgtacaacaacgtgactgctaaaacaacggcgtcaccaaacataataatcttgtagcacatcatccttttgtcagctggtgtcataacaaagaagagggcaccaatcgtcgttcttaacaacagctcagcctgcatgatgaatgatacgccccctgttgcagcgcatcaatcaccgcgggtgttgtggttactcccagcatgaccactactatagtcagcagcgtagtacccgctgcttccgctgctttccctcccttcctcgtcacgatggtcggctgttctcgtcaagcagtaaaa

SEQ ID NO: 42115 - DNA, 413 bp, Triticum aestivum
  Clone ID: PAT_TA_42115
ctagtagaacaccagcagccgctctagaagatgcaagctgactacctcctccttcctgcgacaaggttgttctataatagcacctacaaacaataatctgcccgccgttgtacaacatcgtgactgctaaaaccacgccgtcaccacactaaataatcttgtagcacatcatccttttttcagctggtgtaataataaagaggagggcaccaatcgtcgttcttaacagcagcgcagcctgcttggcgaatgatacgccccctgtagcagcgcatcattcaccgcggctgttgtggtgactcccagcatgacggctacactagtcagcagcttaccagcggctcctcccgataatttctcttctttcttagccaccacggtcggcttttctcgtcaagctgtttttagggggc

SEQ ID NO: 42116 - DNA, 324 bp, Triticum aestivum
  Clone ID: PAT_TA_42116
gcactaaaaacgagtattccacaaatatacaaactcattcacaccatggtacaggtacagttctcttacacacaaaacccccacaacctgcaagcacaacacacgtaccgaagatcgggtgatcatatatatacaaacgactatcgctaccatcatcaattggataatctcgagggtcgtggcttgtggtccactatacaatcgtgtgtatggcatctgaatcatcttcgcaatttccctcagccttcctcagtttcgccaccagggtccatatatttgcgagctcgccctccaggaacgcctccttctgcttcgactcctcga

SEQ ID NO: 42117 - DNA, 338 bp, Triticum aestivum
  Clone ID: PAT_TA_42117
gatgcggacgtgatcttcgtccccttcttcgtgtccctcagctacaaccgtcaggggaaggccgtgccgacggagaaggttagcatagacacgttcctacaggagaagctcgtcaggtatctggaggcgcaaccggagtggaagaggtccggagatgccaaccatgtgatcttcgctcaccaccataacagcttgttccacttccgatcagcgctgttcccagcagagatcgtgctgtctgactttgagaggttccaccctagggtcgtcagtttgtagaaggatcttattgtgccatacctacttaaggcgaagacagttctgaaagacacagccgg

SEQ ID NO: 42118 - DNA, 162 bp, Triticum aestivum
  Clone ID: PAT_TA_42118
ccagccccaaaccatccttctcggacatgctttaccttttcctccacataaatccttaagagaatttcatccagagagacaatacccactcgccaatcgatcgattaacccatatcggcatgagcttccacaacctgtatgccataaacgcgatccttccaa

SEQ ID NO: 42119 - DNA, 339 bp, Triticum aestivum
  unsure (1)..(339): unsure at all n locations
  Clone ID: PAT_TA_42119
natgcacacacaactcctttctattaatatttttcaaaaaattcaatcttctaaaggaagagatccatatacgcaatatactactcctccttcacacaacatctatacagaatcctacaaaaactcatcagaaaccatactctatacattgcaaacacttcaaacaaaaactttatatcctcacaacattactaaacacctacacaacccttacatccatttgtttcaataaccatatatccttacttactaaaaagatatgattcttctttaattttcaatacatccataagtactacctttcattataccacacttactgtttttaactttgtaact

SEQ ID NO: 42120 - DNA, 379 bp, Triticum aestivum
  Clone ID: PAT_TA_42120
aaatgtcgaaaaaaacctctatacattcaattcttttactattccgatcttaactattgctaagactccatttctcatcaagaacaactcaaaggattcttaccatgccagcagattttccacattttaccacataagacttgccaaactttacgaccgtcgcggattttttctatgatccttatgatagaatccatactactacaatcttttcattagacttcaatagagaccatgtattgccttatttaacaaatagattcaaatatttctgggttatattctgagagcagaagacactacgaacaagaaatggagacttaccactttacggcatccgagacattcgtagagagacttaagtctgtaataatcaata

SEQ ID NO: 42121 - DNA, 143 bp, Triticum aestivum
  Clone ID: PAT_TA_42121
cccacgcgtgcgcaatatcagcacgagcatgctgatgaggacagatgttacaaagggggggagcttttaccataatcgctgaaagctgcaactgcatcacaggaaatatatgcatctccagatgaaacttcaaagaaactaca

SEQ ID NO: 42122 - DNA, 443 bp, Triticum aestivum
  Clone ID: PAT_TA_42122
gcgaggtcgagggttccgccgtgctcgcggcggcgtcctggctctcccaccactcccttatcttcgctgccgtgttcacccccgttgccttgattctcgtcggcgccaccggagtgcgctccgcgtacaacaccaggaaggatatcaaagaccccccgaaaactcttcaccaggttgcgcagatgatgctcaaggatcctgtcattgttggagcgcttgttttgctggtcttcctcccgctcataagtcatgaagatttggtggtcggtctgttgcctgtgaaagaatctcagagggaacatgttcgttcagtattgacggatgtagggtcattgggtgtcagcgcagtattttgtttcatcatgttgcccactacggtgctgaggcagtggaggatgaagtagtagagggttatgttgatgtgctgttgaggtatatacctg

SEQ ID NO: 42123 - DNA, 382 bp, Triticum aestivum
  Clone ID: PAT_TA_42123
cccacgcgtccgaaaaattatagatcagacagcaacctaaacatccacaaaaattcgtagagggaattaattcacgtacagctagatgcagccgcctacctttctattcgtgccacgcaaaatgagcttacaggacctggatttccatcactgtgtccgcgaaacaccgtatgagaccgaccttactgttctagccagagacctctcaaagcacagctgcccttaaagcgaatagcccatcaccacatcgccccttccaacagcagcgcatctctgaataggctaatggcacccgccctctcgcggcacattaagcgcagcttatgtggtagttacccgcaccttgtccattacatttaccagacctctaacacccgatcct

SEQ ID NO: 42124 - DNA, 131 bp, Triticum aestivum
  Clone ID: PAT_TA_42124
tagactagttgtatatcatcatgcagcgagcaaggtatatgttttttgcgccattacaggaggagaggtgttcgataacggcccggacccattgaactcacaccgcctgcgcaactgtcgctgcgagccaa

SEQ ID NO: 42125 - DNA, 427 bp, Triticum aestivum
  Clone ID: PAT_TA_42125
gttgaacatcagataatggtggatcacagcactgggcgttcaagaggttttggttttgtcacttttgaaagtgaggattctgtcgaaagggtcatatctgagggaagaatgcgtgatcttggtgggaagcaggttgaaataaagaaggctgaaccaaagaaacatggaggtgatcacagtagcaatgggagatctagtcactctggtggtggtggttaccgtagttcttaccgtagtggtggagctgctggtggcggcggcagtagcagtggtggtggtggtggcggctatggctatggtgctggtcatcgatctgctgctgcaggaagttattatgatagcacgggatatggttatggtagaggaggctatggtgccgcagccgctgccgccgcctatggaggcaatgctggatatgggtctggtt

SEQ ID NO: 42126 - DNA, 410 bp, Triticum aestivum
  Clone ID: PAT_TA_42126
atctcacactatcccaataaaaagagagtagcgagcgagatagaccgctagagagagagagtgtgcggaggtgcttgtctttccatcggcgttcatggttattaacgccataccctctacgtcagctacatttcctgcaccatggctgcacggggagaaatgcgcagacactactttttccaagaaatgggcaaccgactcacacagagggtgtccgcgtgcgagaaatcgccttgctaggtgggagatctgtcgaaagcaatctcatcgcattgtttcatacgctcattacctcggtctttctcctaccctatcactgacatcactatagtcctaagcttctactacgtccccacccattacaggtgtctccttcctcagcctcttttttacttgacttggccactcta

SEQ ID NO: 42127 - DNA, 257 bp, Triticum aestivum
  Clone ID: PAT_TA_42127
tgggagggaagcgttgcgtgcgcctcacacgtgcggtaagacaccctggattcgtaacgctagactgccgcgttattctggcgtggaactgattaccgagccgttgggagctgatagctactcagtgcagctgagtgctcctctgtgctttccactcctccctttttctttctttgctacgagaaggataaatggaccctacttttccggtcacgaccaacaagctcttggggttgaggcgctccaatgggacatat

SEQ ID NO: 42128 - DNA, 320 bp, Triticum aestivum
  Clone ID: PAT_TA_42128
aattttaggagttaagtgaaggtcttgtctttccggaactgaccattctcttttaaccgagggcatttttactaccgagcgactgctgaattgaatctaggcaattaaacgttctggccgttcttcattattgtcaccgatacataactactgggcgatgaactacctcgtacgcttataccacctacgggattaaatgtctacgattttttgccggtaaacttcgacctgaggggccttacgctcttgccgatgctagaaaagttctagccaacgccctgtctgccggtgtaagccttttccgagtagacgccgctctt

SEQ ID NO: 42129 - DNA, 444 bp, Triticum aestivum
  Clone ID: PAT_TA_42129
gcggcctcgacgaccgcttccagcacgccgtgccacacatgaccagcgggcgccttcccaccttcatcaagctccgcgcctttcttcagctcgaggagcaacggctcgcccgtcaggcacgcgtcgccgcccgctccgcccttctggcgcaggcgcacgcgttctacgccgctcgccctccagcaccggccccctccttccacatggcggcgcccggtgttcaaccggcaggtgcggggccctccgctggttctccagggtcgcgcggtcgcaagaagcgcaagcacaactcgtcttcgggcgccggctcctcctccggcgggggcgtgcccgctctcggtcaccatggcgctggctcacgccctcctgctcccactactgttgccgggacgttccagggcatcctcggggcgcgacctcctgctcccgcgacccaccacgcgc

SEQ ID NO: 42130 - DNA, 434 bp, Triticum aestivum
  Clone ID: PAT_TA_42130
gtaccacgcccattggacatctcatcatctggtgcatggttgagagagttatgatgtacttgatccactgtacataaagaaatgtgcacaccctcctagcagggaacgcgatgaggccatcgcttggaagctccatggtgctctgttcaattgctcgacagaattctacgctggctggccaacaagcaatgaggagtctggatcttgtgtggttcatattgcctgccactgtgaccgcgacaaacttatgctgccccttacaaagatgtactcgccgtccaaagtgggaatctctacacgagtgcctgaagctcaagggaaacttctctttcggcaccatgcactatatatggaacattcttgcgccgttggactctgcgttcgacctctcatccattcctactaccgcaacatgtccggttgtcctgattcag

SEQ ID NO: 42131 - DNA, 457 bp, Triticum aestivum
  Clone ID: PAT_TA_42131
ccacgcgtccgggccgagaaaaatcgccgccccaagcccccaacactcctgccgcgataggggtctccggagtaggaagagctgcagcccgcggcggctcttctcccctgcaccccgagctccaatggcctcactctgggagccgaagcagtcaaggcgtggtggtctcaagcacagcgacgccgatcctgatagcgccctggccacgacgccgacggcacgccctcacgacggtcatgcacatgagcgataggagagggtggcaccaactatggctgcggcaccgatgagttcgcaagacgagccctgctgcatcgacgagccctgcgcggcatcggcaagaccggtataggttgccgcaccggcgagctctgtggtacatgcgaccatgccggcgcagttcctcaaaattggatgtgtgcactcttgcaggctggtgatgacaaccatcttggac

SEQ ID NO: 42132 - DNA, 446 bp, Triticum aestivum
  Clone ID: PAT_TA_42132
gtatcatgtgtttccccaggaaggaaatgctaggataactgaaaagaagcttgcactcagcatgattcaacagaaggtggagaacctcaagatttcgcttgaacatttttgcaacattaaaggtgatattagtgaagtcctcagggttgctgaagagcaattgaagatgagaaatcagtgtcgtatcatcaaccagcaagcatcgctctgggagttgaaagacattgttaaaagggaaaataagcgtgatgtcattctcaactatcgcaatttgctcttacaaaggatcatcttaaaccttagtgatatgtcaaccatatttgtgagtaactcactgatgggaaccaaaatagaaaaggcatttcccaatttgaaagcaactgtggcattcaatttcgttttcaaagctgaggagaatcaaagacttagtgacttacgatccttgc

SEQ ID NO: 42133 - DNA, 386 bp, Triticum aestivum
  Clone ID: PAT_TA_42133
ggggggtgatacaattgatggtggagaacctgattatttcggtagaacattttttcaacatttaaggtgatattagtgaagtgctcacggttgctgaagagcaattgaagatgagaaatcagtgttgtatcattaaccaggaagcatcgttcttggagttgaatgacattggtaaaagggaaaattagcgtgatgtcattttcaactattgcaatttgcttttacttaggatcatcttaaaccttagtgatgtggcaaccatattttggagtaacttactgattggaaccaaaataaaaaaggcttttcccaatttgaaagcaactgtggcatttattttgtgtgtaaagttggggatattaaaaatttattgactttacattctt

SEQ ID NO: 42134 - DNA, 323 bp, Triticum aestivum
  Clone ID: PAT_TA_42134
gggaagcacggggatcattttctccatacaatgtacagtaaatttttttaacactccatacaatgtgctggtgtctgcatacggagacacgaacttactagccttatttaaccgctttggtgctggtaaaccgtcgatcagtccttcagctgcaggctgggcatggtgtattcgccgcacttgtagccgatggggcggtcggccaggtcgcagcgcttggggatggtgatggccacctccggtttgaccccgacccggcgcacgatcttggagagcagcaccgcgcaaaggcacgcggggctcctttccccgatctccttcac

SEQ ID NO: 42135 - DNA, 261 bp, Triticum aestivum
  Clone ID: PAT_TA_42135
gtctcgtccagtgaccccttcttataaaaatgtaaacctgtttttcttattctttaaaccccttatatagattgtagtagttgttatacttgtacatataataacaaacaactgaaataatgagaaaccacgacgatatggttgtttcaaaaaaaaaagaggactccattatacacaaaaagcataaacgggccgtaggtgtagagaaggaagttttcttcacccgcgacggcgcctcaacccttttcatctgcggaaaac

SEQ ID NO: 42136 - DNA, 435 bp, Triticum aestivum
  unsure (1)..(435): unsure at all n locations
  Clone ID: PAT_TA_42136
gacccacgcgtccgcccatccgcgccgcccgccgccgcatcctgctgncgggaccagcganggcccctgccgggctcatgaccgcggcggcgacagctgcgangatatcgacctatgccaacaagatcaccgtggtcgcaggcgctgcaaccagcgccggcacgattggatggatggccgccgactatttcaggaaggtgccctgcccttcatgcaccaagatggtcagggtgcgggacttcatggatcacgcgaggggccacaccttccagtgcccctcgtgccaagagcatgtcaagttctctgatctggagaagcatgcgcaacaccatggtttccgctgcccagcctgctacgacgttgtcccgctcgccgactttgggccttacctggaacggcacaggcgccaggctgacgatgagagagcaaggcaag

SEQ ID NO: 42137 - DNA, 363 bp, Triticum aestivum
  Clone ID: PAT_TA_42137
actaaacatcctaatcaagatcatgatgaaggtgatcgtggtggaggccctcgtgttcgccacctatggaggcatctatggagggattctctagaggtttaatatcagctttataattgagtctgtagggagggcgctacttaatgtacatcttaaggtacatgttaaggagatgccccagatgagggccacattgtgttgtacatggtgttgcggatggatgtgcgcactcatgtaggaactagtctagtagctattatggtggctgcagaggtgggcgaatagggcagccattcgaacggtcatgactcaggtgtggacgaaagtgtatttggagtgataatgaggatgacgacgacgatg

SEQ ID NO: 42138 - DNA, 438 bp, Triticum aestivum
  Clone ID: PAT_TA_42138
gcgagccgaaacgtcttggaagcggggcggcgtgccatcggtgtcgatctccacttgcatggattcgaagcgcggcagcgtggttgtggacgaggggcgcgacgtccatggcgctcaagctttggcgaccatgctgataaaactggcccatcttcgtcccccacatagctgacttgtgctgcaaagactggattccctcaaaggaaaaaaaaaattgagactgatggtggcagaatgacgaagaagcttggtcatctctcttctgttactattgctggcattaggcctcgagcgtcaggatcatgagtagggtgtggaggctgtcgggctgcagtcccatggagttctatgcctccatatataggaagtggatatagttgaagcgccatatccaattcatcgacctcgccatgatgagggaggaaggtggtgaccaat

SEQ ID NO: 42139 - DNA, 441 bp, Triticum aestivum
  Clone ID: PAT_TA_42139
gaagatgtctggcgtttcctggttcaacttggtggacaggtgctgatcgtcgtcaggctgcgggggcgcgtcaaggttttcaagtacgacgacgccgagcccgtgcccgtcgagagcatcggcaggcatgccatcttcgtcgggcaccacaggtgcctcgccgtggacgccgacaggttcccgtccgtcgaggcagactgcgtctactacattgatcgacggggtttgtcagcccacatctgcgtgtacagcctcagggacgggaaagaggagagggtctctgctggggccgtcgatttcgtgaagccgcacaagctgttcgtcctcgtcgccgaccgccctttcaccgtcatccagcttctctgcagctacaccatcaacgcccgggattctcagctgcctttgaaagaagacgctggcaacgttgacaaaaaatggttt

SEQ ID NO: 42140 - DNA, 410 bp, Triticum aestivum
  Clone ID: PAT_TA_42140
gaggcgagcatggctgcacggagcagggccacctgccggcgaccgaccgccgtggccgggaggaggacgcccctccccattccgcgccgccattccccttctccgaagcagcgctcgagatgaagaagaagcagaagctggtgcagcagccctcgccggagatccccgacagtgcgctcgtcgagatcctgtcgcgggtgccctacaggtcgctctgccgcttcaagtgcgtgtccaagccatggctcgccctctgttccgacccggacatccgcaggaggtgcccgcagaccctgtccggcttcttctacaaccggagcggctgtggcctcagctttcgcaatctgtccgggagaggcccccctctggtcgacccttcgctcccgttcctacgagggcgctacgagcgc

SEQ ID NO: 42141 - DNA, 250 bp, Triticum aestivum
  Clone ID: PAT_TA_42141
cagggataaaaacatgtatttagtgctccggatcagggtggacgtcgacattgacacagaggtgttcgtgcacgcgtaatcggagatgagcacgctccgcatgttcagctatatgcggacgaggatcttgttgccctcttggacctgaacactgactaccttgtccatatgttacccggtcacgcccgcagattgtgcacgaggggtatgaagagcaagcccatggcgctcgaaaagaagctgcgcatgg

SEQ ID NO: 42142 - DNA, 344 bp, Triticum aestivum
  Clone ID: PAT_TA_42142
gaaatcataagcctgatcaggacagcgtgcctcctgtatatatttacaaggctcttggatggtacatggtggagctccagttggaaaggcaaagttctgtgacgaactttgttgacccaagcccttgtcttacaccagatcatttgtttccaacagctcagcgctgatcattgccaactgcattggctcgaaaacccttgctgtgaagtggacgtaccgtgtctgagtcgaacattactgtgatgtatgtattccagtgaaatctgaaaccattagggacataactacgctgtcacagaaatgcctgtcgtgaagtgacaatgtatcgaaggtaagcctgtctt

SEQ ID NO: 42143 - DNA, 307 bp, Triticum aestivum
  Clone ID: PAT_TA_42143
caataaagctctgaaagaatcaccatttgctttccaaccacataaggttcaaattgaacagccaatcttttcgtacacaggtaatacacctcacactccacattatgaccacactttgcttataataaacctgtaaaagctcggttgtgttactactagtaagtatgcgacggcgtgcgcgacacagactaacagcagaatgcatctaccaacacatacaaaccacgcacggtagaatatatattgtacaaacaaactcggcagtagaagctgtagttgtatgtttttccatgagaggaagataata

SEQ ID NO: 42144 - DNA, 369 bp, Triticum aestivum
  Clone ID: PAT_TA_42144
gccggtggccgttcggcggctgggcggaggtggtggtggcgccgagaggtgcaaggaggtcagggcggaggcgcgggcgatggggcgggtgcggcaccccaacgtggtgcggctgcgcgcttactactggtcaccggactgagaagctcgtcgtcaccgactttgtcggtaacggcaacctcgccaccgcgctgcgtggtaagtaaaagtaacaccggtcacttctttttttttaacaaacactcggcaacttgcttactgctctttcgtttagaacgagactttttactgcttttggtagcataacttgaagccaaactcggttagattagttaatcattttaataaagggtgtgtttaagttctttt

SEQ ID NO: 42145 - DNA, 438 bp, Triticum aestivum
  Clone ID: PAT_TA_42145
cggacgcgtgggtatttctcatctgatccgtccctcccgttcctctccgtcgtttcttccgcatgcgtctccatctgagcacgccgtcaacattgccgcctctaatccctgacttcttcacccagattgaacctgttgcaccacatgcttccttcccaccttgttgccggccacactatccactgcatggctcagatccaaatcgaaacacatgcgtgaccggctccatgatgcggccccgacgacctcgtcggcacggcatccctgcaggaggcggctccgcggctgtgcccaccacctctccaccgctgcatcaccaggttgcacggaggctgtagggtgtgcccaccatctccaccacccctcggctagtgaacgagcagttgtctttgatatgttctttctttttgttctttgatttgaatacaatttcacttg

SEQ ID NO: 42146 - DNA, 430 bp, Triticum aestivum
  Clone ID: PAT_TA_42146
ggcaccatcagcaacatggtgacgcaggcggcggtggtgcacatgctggccgagtgcgtggggctgagctggttcgaggactggggcaccaagacgctggccgagctgggcctccccctcatgaagaccagccggctcgtcaaggtctgcgaggacgacccggcgctcaaggcgttccggcagatgaggcggcgcggcgtcggcggcatcccggtggtggacggcgccggcaagcccgtgggcagcatcatgatcaaggacgtcaagcacctcctcacggcctccgagtccaccggacactacaggacgctgacggcgagggagttcatcgcgagcgcgcggcagagctcgggggagaagcagatgagcatcatcacgtgcaggagggaggacaacatgaaggagatcatcctgaagctggacgcggaga

SEQ ID NO: 42147 - DNA, 426 bp, Triticum aestivum
  Clone ID: PAT_TA_42147
cccacgcgtccagggatacgcttcattgcgcacaccccaggctagagtaatctcacactgaggtattgtaacgactcaattgaagaaaaagaattctcccaccaagaaaaaaaacctttaaaaacccaccctgtatcaccaaaccagaacgaaacatgctaaaggattcatgaatactgtctccgacgcatcagctcttatggtaaggtgcttgtttctgtttactggcagataaaatgctcccatttcttagatgttatttgtggatttttcttgtttcccacttgtcattcaagctgacagaacataaccaacctgcggtcatccactctttacattgttttttgagatgattataagctcgactctgtacattttgtcttgatcttgccccacttgttctttaagctttatgtaccacttttt

SEQ ID NO: 42148 - DNA, 272 bp, Triticum aestivum
  Clone ID: PAT_TA_42148
cggacgcgtggcttcctgcgccactgtcactttcggacttccgcccgccatggggcggggccccacgtatcagatcctggtgcgtcttctcgacgggcgcaccatatgtcttttattatccacgcccaccgtcttcggcgccgtgctcctccaaactgactcgtctatacttttcgtccccgaaatcgtcctttgcatagttaccggtcgcttctacttttcgtacataaacgtacttctctttaacttttgattttcagttccttttcgtc

SEQ ID NO: 42149 - DNA, 409 bp, Triticum aestivum
  Clone ID: PAT_TA_42149
tcggagagcgataaccctttatttatttttttttgattaacgtatacagttattaaagactggtgtaaagacttgatgaagaacacgacagatactctgctccttacagacacaccgccgcaaaaagaaccaaccatgtgctttaataacaaagcgggggaggactcatacatattggacaaagccaaggacctcaataagtagtttatggttacactagcagtccagcactgactgctactaatgaacaaggtaagctccatatacctgtgactctatacacttcttttgctgatgagccaaagaccacgagttcggcaacaacaacaccccgatggctgttatttggactagaatatcattctcgatgtgtataataactatatattgttctacaactactactatt

SEQ ID NO: 42150 - DNA, 191 bp, Triticum aestivum
  Clone ID: PAT_TA_42150
gagttatcctaaggaggcactcactgagaaggttcttttccagaactccgatcctgcttacattgaggtacatttagcgcgccagaataacaataaaacaccagtttacgattcagatacatagcacctagtcggcaaccaagaaaatctcagagaaggtcgtaaagacgtctcatatcatgataacagga

SEQ ID NO: 42151 - DNA, 154 bp, Triticum aestivum
  Clone ID: PAT_TA_42151
cttattataactctaaatatagagccgggagctatctttcatatgtataattataaaataaaaaagtgtactaatacttttacaattacaaacacattcaacttattcaataggcataatcatgggaatataaaaggaataatgatggtgtttc

SEQ ID NO: 42152 - DNA, 170 bp, Triticum aestivum
  Clone ID: PAT_TA_42152
cggcgggacccacgcgtccgaacctttgtttcatacgtttccctgtgcaagattaagagaattgcaagctattatcgggggtgtggtgtttattcggatggcttcatcacatacatcgacgtgtgctctcattccgtgcctgtatcatacaatggcgtcacctacactct

SEQ ID NO: 42153 - DNA, 438 bp, Triticum aestivum
  Clone ID: PAT_TA_42153
aagagatcttagtatgctttaaagaagcagcagcacatacattggttgttttcgacaaaatagttaagatgatgcaaaatattgaaattccagaaagaaacgagtcttactctgaagcagagaaatattcagatcctgacatagaggatgaagaggaagctaatatggaaacatcgtcttatgccattgtcaagatgaagaaccatatgtctctgcaactcgtaattgttcaggtacttcaaaccttgtgccagtttaattcgatgctgatcgatttgtatatcacgtcttcctttgtaaattttgttcaatactccgctttaattgcacacccaaataaaataggaattagaacaaataaaatacaacaagaattttgccttcatgttttgtgttctgacatgccaatagttatattaagatcacactcaccattct

SEQ ID NO: 42154 - DNA, 428 bp, Triticum aestivum
  Clone ID: PAT_TA_42154
gagtaatcctacaactggagagattgctgttccttacggcctggctgtttggggcactggaattggaacccgtcccataattatggatttcatgaagcaagttggtcaggcaaacaggcgtgtgctagcaactgatgagtggcttagggttcttggatgtgacaatgtatatgcacttggtgactgtgcaactataagtcaaagaaaagtgatggaggatgttgattcaatcttccgggtagcagacaaggataattctggcactctgtctgtaaagaacataaaaaatgttcttggcgacatctatcaaaggtacccacaggtggagttgtatcttaaaaccaaccaaatgaggggcttccatgacctactgaaagacaaggagacagaagaactgaacattgaaaaattcaagaaagcccttgctc

SEQ ID NO: 42155 - DNA, 271 bp, Triticum aestivum
  unsure (1)..(271): unsure at all n locations
  Clone ID: PAT_TA_42155
gannnannnnnaggacgaagcgcaaatgnaaaggaaacaaacacagcccngcagaagcagcacaacaaaaacaagcgccgcacaggagaccaacaggagggcagaacaacagaagacgcaggnggaaacagagagnaggagcaggacaacgaacnaagngccggcgagaccacagagcngcccgggccggccacgccggcgagcgaancacgggccnggcccagaaaaagcgcccgcacggcacgaggcggcagaccggcgcgccaccagg

SEQ ID NO: 42156 - DNA, 350 bp, Triticum aestivum
  Clone ID: PAT_TA_42156
caaaaaagcatttccccttcctctcgggtcgcacgcgcgtgcggctccggaggacctccgaaccctagaaaaaaggccccgatctccttccctcggccgctgccgccgccggcgccggcggtggcggccacgcccggccgtcgaaggcggcgggtgttggcggcgcgccccgacgggcccccttcgcgcggaggcgggacgtcacaggggctgcggtgatgtggccagaggcgcgagatcttggtggagctcggtggctcacggcgggagcgcggaggagcgccggtgcccggcggggtaggcatcatagaggaggagcagggtggtgtgtcttctcgagctagtggcgg

SEQ ID NO: 42157 - DNA, 437 bp, Triticum aestivum
  unsure (1)..(437): unsure at all n locations
  Clone ID: PAT_TA_42157
gactgttagggggcgctgtgtggattttaatctcatgttcagctcctaacttcgattttgagctggcaacctcgtgcattatattttccacaatttgcaacagcagaacagtgtgagaatgtggtaaaaactgcgaaggcacggcttaggccatcaacattggccttaaggaaaggagaaagcgaggagactacaaaaggaataaggacaagctcaggcacattccttagcgccgaagaagatccaactggagcccttgcagaaattgaaacgaagattgcaaaggctaccatgatgccgagaagtcatggagagccctttaatgtccttcggtatgagattggacagaagtatgcttcacactatgatngcattgacccggctcaatatggtccacagaaaagccaaagggtggcatctttcttgctctatctcac

SEQ ID NO: 42158 - DNA, 404 bp, Triticum aestivum
  Clone ID: PAT_TA_42158
ccaacgcgtaaaaaaaggcagcaactagtgcggagccaaaactcctgtgtgctcttcttctatcttgggtgcgtgagttcatgtggagtgggcgaggttcgacgcggcgcggctgccgcaaggcccttgtgtgtggaggtccggttctctgtcgaggtcaagctgcgtcacgatcgaaggaggacatgctgcccgataagttgtgccaccggcggcaaggagttcgccatccatgccggagtcgtcgacaaggtgtgtcgccggcaaccatgatgtggtgaaggcgttggaggtgcgcctcttattgaagccaacggcgaaggcggcaatcagcgtgacaagacggcatcggcggtcgtctacgtgttgcgccgacgacatcaacgaccattggcttcaagaga

SEQ ID NO: 42159 - DNA, 271 bp, Triticum aestivum
  Clone ID: PAT_TA_42159
cgcgtccggaaaagcagcagtccatgggactgcacatcctaagcgaaaccccgactccgtcgtgcgaggactctaccggcgcgtgcacggccacgaccagagtccccctccagaagcaccgtgcggaataccgtcctgagctcccgccctggctccagggcgaccgaggctaatgtggagtactgacacaccgcgatcgctgctgactgcgctgacgcgcatgtgatccgccgcgcgttcccgtacactctatgggcagcggctgtcgcat

SEQ ID NO: 42160 - DNA, 263 bp, Triticum aestivum
  Clone ID: PAT_TA_42160
gtagtacgaattcatactccgaattcatgacaaataatttcagataacctttttcaaacaggaaaaggagccacggaatccagcaaatttgctcttaaacgtgacatgagtagcaattagcaaagctacgtactgtgataattaattatacttatggtagaacaggttttgagcctggaactccgcaaaactatcagactactgcggcatggagaagcagagagtccatatatacgatgtgcaccaaacaaactggactgatt

SEQ ID NO: 42161 - DNA, 175 bp, Triticum aestivum
  Clone ID: PAT_TA_42161
caatgattcatagggatgtattttcttcttcgagagagaggactgtgcaatcagaagtacaatatgtgatcatcaagtgtaagagatggcaagaatatgtggtatgtatttcagtctgcgtattaatgaaatgtattgaccgttcatgctgctataataagctcgatgatttcct

SEQ ID NO: 42162 - DNA, 299 bp, Triticum aestivum
  Clone ID: PAT_TA_42162
aacaccatctcacatattatatattcaaacgtagtttcaatgaaagatgaccagaaaacaatcaggcccaccaaatgcatcggaccaaacatttagtcgttcgtttacctgactcattccagaaataaccaaaaactcaatggtgcaaccaccaggcttttccggaaagttaaaaaacaacgcctgacttttataccactcataaaacccactcggtggaaggggggtagggaatcgaacaattgcttttaactcgttgatttaaaattcggggttttgaacccattcaacaacgggtt

SEQ ID NO: 42163 - DNA, 202 bp, Triticum aestivum
  Clone ID: PAT_TA_42163
cctcatttccccttcaatagatactgtgttcctaaagctgccccgttcctcaaccacatgtccctctccggtgcttcaactataactaaccactattgaaaaactccatctactctacatctcacatttaaacactcactacttgctctttaccctttttttcaccaatatgcattccatgatgctctccttattgcacgac

SEQ ID NO: 42164 - DNA, 396 bp, Triticum aestivum
  Clone ID: PAT_TA_42164
agggggggttgccgtagcgaggttcagattctcctcttcattgttttctaagaaccatcggtgattaaccttgttccttttttttactactataaacaggttgatccagatcttaaccttgtgaaagggcggggtggagcccttctccgggagaagatggtcgaagctgcatcaggaaagtttgttgttgtcgttgatgagacgaaactagttactggcctaggagggagcggtcttgccatgcctgtggaagttgtgcagttctgctggaagtacaatcaagtaagactgcagggtctgttcaatgaaaaaggttgcgaggcaaagctgagatttgatgaggatgacaagccctattttactgacaactcggactacatcggagatttattactt

SEQ ID NO: 42165 - DNA, 401 bp, Triticum aestivum
  Clone ID: PAT_TA_42165
ttgggggttttttttttggaaatgagaatttttttcaaaattgatcaaattcatccgaataaaatgggaggcaggaactggggaaatccttgcggggggcttcttttttttttttaacaaaacggaattaaatgggcagctttttgtcgtaataataatggatccatggcgcccccccgtgcgggggtttccactttattaaaacttgacgtcctttaaaacctttcccacttgttccagggtaacaaaaaaaccaaagttaaaggccccttggccccaccccgggggattaaaccctttttggagggaattaccccttttaaccaaaccttttttgagcccccattaaaagggcccccgttttggaaggggccgcgcccccccccccctttttttttttt

SEQ ID NO: 42166 - DNA, 454 bp, Triticum aestivum
  Clone ID: PAT_TA_42166
cctgcatcgcgccgccgagagagacggtgtgcctcgagctgccccgttcctcggccgcaggtccccgtcccctcctccaactagaactcggtgctgttgtagaggtggatctatcctccagctcgcatttagtcctcgcctacgtgctcttccgcctcttcttgaccaagatgggttccagatgctctccttattgcacgacctcgagcggcggcgaccgccgccatggtcgtctcggcgctggccccgtgccagtttgtggagccatgtcgcgcctttgctgcgagaagcagctgcctgcgaccgtgcccctgccctctttctccccagcgtgctcctatttactcctatcccctgtcagccgcaagagtgttgcccatcaacaacaaagccgccagatcatctacgggttcttgtaggtgagtttccctctctccattgatacccgttcatt

SEQ ID NO: 42167 - DNA, 349 bp, Triticum aestivum
  Clone ID: PAT_TA_42167
ttgcggcaacatgtaagtcccatgccatgatcaaatcgccgccaccgatcgatgactttgcgtttcgggctttaatctctacgtggtcgatgatgcacgcgcaaaagatgtggactactctggcggggcaaaggcagagccacacgaggctcatcgagtggaccgtggaagccaaggcggcgaagcggctcaaggccaaggatgaggacattgagcggatcaggagcatgaactgggcgctcgaggagcgtcttcggaacctcctcatggaggctcatatgtggcgcgatgtcgcgcagtcccatgaggccacggtcaacgtgcttcgcggagacctacagcgggcgct

SEQ ID NO: 42168 - DNA, 321 bp, Triticum aestivum
  Clone ID: PAT_TA_42168
cccacgcgtccggtgggtttcccgcgggcgcgcgccctcccaccaccgtggccggcaccttccagggcatccttggagctcgcccgcccgctccggctgtgcctcatgctcatcacgccacgaccgcggccacgccctcaccacactgggaccaagccgccctcatcgctgcactcaaccagatggctctgcatcctccttccgcgcctggtggtgaatgggtcttcgacagcggcgcctcgtcccacatgagctccggttccggatctggccaccaagacggtgcttctccgatgtgactcccccggcgatctttacacc

SEQ ID NO: 42169 - DNA, 454 bp, Triticum aestivum
  Clone ID: PAT_TA_42169
agcagaggcagtgattttcatctagtgatttcgagaaagagagctagaaaagagaggaaaatgtcaatgtggaagagctttaatggggagcatgcatctgctgttactcatggtccaaatgaaaaatacactggccgctcttctaggcagatgattaaggaactcaacactaaggagtggtctcatagaccagatcaggttggtagcatacagcctcagcatggggttgcgttgaaacgctccatcaagaatttcatccataggaggagtaatgaagttccacttaagaactttgaaacaggagcaagtcacaaccattttacaagtccaaaggaaaacatcaatagcaaatcaaatggtgattttgacaaagagcagaacattgatttaaacaaaaagctacccaatgctgtgtactgcaatgagtcaagttcttgtgagatgttatcaaatt

SEQ ID NO: 42170 - DNA, 444 bp, Triticum aestivum
  Clone ID: PAT_TA_42170
gcggacccacagcgttacgcagaaacgctattcttctcccacgccgtcctaacttgtacggccagctagcttcctctcataccttgctgccgcgcggagaacgagccgaatgcgtgccttcccaccaccgtgcgacaagaagaacccacggcttgccctcgtctgctctgctctgacactgcctcgcatggtcgtggtatctgaccggcgaggaggcgatgaataccgcaggggcggcgaccgcgaaagaggcggcggcggtggggcaagtgaaggcagagctggacgacgcggtgaaggcggccgggcgcacggtggctgtggccgccgcgcctgcgctgagcccgctgagcgagacgctgtggcagaagaacgcggcggtggatttcctcggggacgtgtcgatgcggctggcgtggctggacctcacggtcaccgtcgcgc

SEQ ID NO: 42171 - DNA, 432 bp, Triticum aestivum
  Clone ID: PAT_TA_42171
cgcgcccgcaagtaccggtccgacctacccggtgtcgacgcacacacaggcaaaatcgctgggtcgactccatgaaacccaggcgtatattgagaacaagggaaagagcagattaccgcagtgtattcaggagaaggaaaacggcagttgtccaacttttctccagcctaatgctttgagcaaaaggaattggtactcactttggcaaacagagagaaaggaatatgtttttttgttgctattggagctccatcactcactgtcaagtattgcaagcaagcaactgaagcaactacagtggccaataatgcatatatgaagattgatttacaacaacagctccaacatttgtacataatcttgcatattgtgtctctcttcgaatccctgttagtgtgtttatatacattaatgtcatatcaagatgtgtcc

SEQ ID NO: 42172 - DNA, 409 bp, Triticum aestivum
  Clone ID: PAT_TA_42172
tcttaaacccgagcgcgcacgccctttccccattcccccctcccccgccgtctcgttccagcttgccctccataggttttagtctttctccatggcggccctcatcaagctcggaagacttcttaggcaaaccgctgtctttagcattgcctccaccgactagggtgctgccctcatcaacgctgcccacttgatgtgcgcctggaatcctgctgatggctccaagcttttcttcggtggccgcgcctgggctaccggggagaataattttttcgccacccccggggggtgggcggaggccaaaaataaccccctttttaaaataccacccccggccccttttttttttttttttggggcccaaacatgggtggccccccccttcaccgaaaaaattaacctcccccca

SEQ ID NO: 42173 - DNA, 321 bp, Triticum aestivum
  Clone ID: PAT_TA_42173
gattttatggtgctcttggacgacgtcaactggatagtggaagaaacaccggacaatggcgatgactacatgaacgagggtcttatttatcttgaaacactagtatcaacggcttcggagattttaccacttgaagctctgtacaaggttgtctctggtgcagtgggccacatcttggactcgataatgacaacccttttgagcgacggggtgaaaagggtaacgatgagtgccggtttaagcctcgacatggacctgaaaatgctgggggcatttgctgatgagaaattccacattaccgggctggcagatatggggaaa

SEQ ID NO: 42174 - DNA, 149 bp, Triticum aestivum
  Clone ID: PAT_TA_42174
accacgcgtccgcttgttgtacatgctaaggtgacctttaaaatctataacagaacaaggggtggctgcatgcgctggggtattaatgctctcaagacattactacttacaaagactgtatcatcatataaatcatgcgctagcaaaag

SEQ ID NO: 42175 - DNA, 296 bp, Triticum aestivum
  unsure (1)..(296): unsure at all n locations
  Clone ID: PAT_TA_42175
cccacgcgtccgatgatgtagcctctgggtgtgtatgtgcgctcacggtggggtggtgtgtgtggcaaagttcgagctcgccggaaatacaaggggctgttcgtgcggccggaggcgtttgtgcgccgggaaatctcgtgtcctctctctcctgttttttccttgtctccggtgatcgccgtggttcagtgagtaggctagacaacaacaattggtatcagagcttantgtcttgggcgtgcttgccatgccggaagcgtgggagcgatggcggcgctcgcaggaggctgcgcgtt

SEQ ID NO: 42176 - DNA, 390 bp, Triticum aestivum
  unsure (1)..(390): unsure at all n locations
  Clone ID: PAT_TA_42176
gcgaaccaagcctaaaagatcactacgcacagcagcagcaccagcaccgccaggaagtgcagtagtcgacgcagctgagccatggcccgccgcacggccctaatcctcgccgcgctcctcctcgtcgccctggccgtcgcgccgttggccaacgccaagaagggccgccaggacaaggaggagaaggcctncgacgccctctcggncgacgcgccggccgncgactcgcccgcggaggggccctccgatggaccggcggctgcccccgggcctgagggcatcgccggcctctcgcccgacaacgacgacaacgacgacaagtgacccgaggcatgcctctggaggatcgtcgtgctacaatcgccgatggtttagttcagcatatatact

SEQ ID NO: 42177 - DNA, 212 bp, Triticum aestivum
  Clone ID: PAT_TA_42177
tccgtgcgttcgcccactcgtcactaaaaaaaaatcccaatgccgagaagcgcgtaccgggaacggacggatgggccaacacgatgaagaagaaggccaacatgtgcgtgcagacgtacaagatctacatattagaggtgctaaatctcgtgcatgtggacatcggcatgtgctccaatgccatgtctatcatgaactcctgctttaacaat

SEQ ID NO: 42178 - DNA, 319 bp, Triticum aestivum
  Clone ID: PAT_TA_42178
ggccctcaaaccctaactttggatcgcagagcagttaaaagcattgtttataacccataaaacataaagaacgagagtgtagccaagctaaccaaggcagaatgcaccatatgaggtcagcccaggccagcttggtgggaacatacataactaagcacacaaaacgaatgctaaacttaaaacgaacacttactggaagaaacttctaaaaagaacaacaaatgagccaacacatgccgaaaaagaactcggtatggccaaaaattatttcttcacgttaagcccgaaaacttggatcagcaaaccaggctgtgctttt

SEQ ID NO: 42179 - DNA, 316 bp, Triticum aestivum
  Clone ID: PAT_TA_42179
catacggtgccgctctcggactacaccacatggatagttgaagaaacaccgtacaatgggcgagactccatgaacggcgctcctatttatctctaaacactagtatcaacggttgcggacattataccacttgcagatatccccaaggtggcctctgatgcatgttgcaaaatctcggactcgataataacaacgctagtgagcgacggagagaaaaggttaacgatgagggccggttgaggcctccttatgcacctgaaaatgctggacgcatgttctgatgagaaattacacatcaccgcgctggcagatatgg

SEQ ID NO: 42180 - DNA, 316 bp, Triticum aestivum
  Clone ID: PAT_TA_42180
cagaaggacccgcccacataatgcagtgcaggtcctgttgggaagaccttgttcattgggaagcaacaattattggaccccctgacagttcctatgccggcggtgttttcttagagaacattcatttcccttcggattaccccttcaagcgcaccaaaagtatcttttaaaacaaaagtgttccatcctaatatcaacagcaatgggagcatatgccttgatatttttaaagagcacaggagccctgctttgacaatatccaaaggcttgctctctatatgctccctgctgaccgatcccaacccggatgatcccc

SEQ ID NO: 42181 - DNA, 256 bp, Triticum aestivum
  Clone ID: PAT_TA_42181
ccttcattgaatgaccgtataacaattgcgactcttcttttttaccgtgacaagacatggggtggttttaatacaacctacaacttctcatggctaaaagataataatccaaatgccctcatatattcttatcatggaaaagagaaagcgcctgtaagaccggaaaatctacatctgctgttccaagtaaaatgaatagtatggttcttcaagaacatttactaaaagatggtgcctttgaggctgccccctgtcc

SEQ ID NO: 42182 - DNA, 177 bp, Triticum aestivum
  Clone ID: PAT_TA_42182
accacgcgtacgcttatacccctaccactaaaaagtttgcggcggctgcgctgctcataccatcaccgccggctgctgctaagctggaagccagattccggttgtggtgcagggcgcaaggccactggccaacagggggccgtcgcagcctaaccttacatacacatatgacaaatg

SEQ ID NO: 42183 - DNA, 395 bp, Triticum aestivum
  Clone ID: PAT_TA_42183
ccttcattgaatgaccgtataacaattgtgaggcaactttgggacctaacaagagatgttgtggttttgttagagcctggaactcctcaagggtcaaagattataagccaaatgcgctcatatatcctttggatggaaaagagaaagtgccgcaagagcggaaaatctacagctgctgctccaagtaaaatgaagagtatggttcttcaagaagatttgctgaaagatggtgcctttgtggttgccccctgtcctcatgatggtcggtgtccattggagaattcaaacaaatactgccactttgttcagagattggagaggacgtcatcacagcgtatctacaaaaggtcaaaaggtgtgcctttgcgtggtttgaggatgagaaattctgtatg

SEQ ID NO: 42184 - DNA, 324 bp, Triticum aestivum
  Clone ID: PAT_TA_42184
catggcacgtacccagggggacataatactagttttaagggggcgaccaattatatttatttttattcctgggggaggaaatggaactgcccttggcttcggcatttgaaaacggccggtgttggaagttgaaaccgggtaaaaaaggggtttttaaagcaacacgagcgacttcagccattgaaaatctgcgccgaggctttttcgcttttataaacaaaataagccagagcggtttgacaacctccaaattggccaaaattccccaagcaaacttggggggaaaaactttcttttttccccacccgcaaacacttttttttt

SEQ ID NO: 42185 - DNA, 197 bp, Triticum aestivum
  Clone ID: PAT_TA_42185
caaacctctctccccgctttcccggagacagatccagtcatgggcgccgcggataggagggggcccgagcaggagcaaagctgcaaggccacggatgacttctactccgacaagtcgtcgcccttccgaatcggcgacgtgcgctccgtcgtgcccgcccactgctggctcaagagcccacttcggaccctttccta

SEQ ID NO: 42186 - DNA, 384 bp, Triticum aestivum
  unsure (1)..(384): unsure at all n locations
  Clone ID: PAT_TA_42186
ctcatgcgaccgttacggcacggtacatgggaggagttggaggtagtgaagagagaaaaggaggggggtagcataggataggggtacgatagaaaggaatggagatccatgggagagacggagtacctggtgcgtgcttgagaaggccatacgctgatccgaccaaagacaaaaaggtgcaagaaggcgctttagncaaatacggcgagatcataaggcacctaatcatgaaaaagcagttagacggccaggccctgagggtaccgatctggaaaattgaggcctgaagaagggacgatactcgataatgcaacataattgggaagggacccaaaggtggatgactcttcctcgaacccaaagcaaagcttataaagtttttta

SEQ ID NO: 42187 - DNA, 458 bp, Triticum aestivum
  Clone ID: PAT_TA_42187
acactcccgtttcccgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaaacagggttatgtgatctaccgtatccgtgtgagacgtggtggcaggaagcgcccagtgcccaagggtattgtttatggcaagcccaagcaccagggtattacccaactcaagttccagaggaacaagaggtctgttgctgaggaaagagctgggcgcaggcttggtggtcttcgtgtcctcaactcctactgggtgaatgaggactccacctacaagtactttgaggtcatccttgttgatg

SEQ ID NO: 42188 - DNA, 185 bp, Triticum aestivum
  Clone ID: PAT_TA_42188
ggaatcttgcatcattcccataaaggcctaacttatatacaggaacatacaatttcgggggctatcaagattcacgatgtgatatctttaaaattcatttaagaaggtagaacttgatgcgagtaattgtactgaaaaagattgagggaaagatgaatggcgtttccggagctgagctaaaggct

SEQ ID NO: 42189 - DNA, 459 bp, Triticum aestivum
  Clone ID: PAT_TA_42189
ccccgccacctcaaatccggcagcgagtcggggaagtcaaaggccagatttcgatacaggagcccagcagcgcctccctcactccctcggccagccgctcccgcccagcaacgccgcggctcggtccacagccagtgagtaaaccatgagccacgccggcaagcgtaccagccagcacagggatcatgacagagaagacagggaccaaaagcgaaggccggcccacacccaggaaacctccagtaaggatgaattggttgtttaccggatactttgtccagacaaagcgattggtagtgtaattggcaagggtggcaaggtgataaattccatccggcaacaaacgaatgccaaagtcaaggttgtcgacccttaccctggtgctgacaaaagggttattttggtatattgttatgtcaagcatagagaacctaagcatagcgacatagatgctgatga

SEQ ID NO: 42190 - DNA, 446 bp, Triticum aestivum
  Clone ID: PAT_TA_42190
cccacgcgtccgcccacgcgtccgcaatgagcatcaaatcctccatcagagcgagcctaagatagttgcttcatgcgaactgtgacgagcgtgcgtgggtatgaccaagtacgatggagtcaaatctactacattgatttttgcccctcacgaggaggcaacttcaataaaatattatctcaattccgcccctcacaaggaggcgaggctacaaattatacaatggttttgtctctcacaaggagatgagattaataaactattactctgattccgctcctcactcacgaggaggcgacgtccatacaaccagacattgattttgctcctgcaatgaagcaaagatagatatatgttttattggcaagctcttccaatgcatctgtggtatattccacatcgacatcttggccgagtgtcgacgagacaaaaggctatgcacacca

SEQ ID NO: 42191 - DNA, 313 bp, Triticum aestivum
  Clone ID: PAT_TA_42191
cggacgcatgggcgtctacaagatgaacaagtttctactctactagagtgcacagaatgggggcaacggcaaattggagagatcgatcaagttctcttttctcaaggaatcagaaatgtggaaacaccgggtgttattcttgccaacttttttccatgacatgacactgctatgtttcgttagatgcttgggtcaggaagacataagttcagaatggggaaaatggtcctcaatttgaactaaatactaatatctttctttagcgcaatctttgtatatttcttgtaaagttcatgcttcataactaatcgca

SEQ ID NO: 42192 - DNA, 405 bp, Triticum aestivum
  Clone ID: PAT_TA_42192
ccactagacagagaccctaccttggggtggcgcctggctcggtccgggagaagaaggcctagatccactggcctaggtggaataattctgggagaagaagaagatggtgaccatgaagctgggttccaagccagacatcttcgtcctcgaaggcctcacatggagatgcatgaccgagctcgagagtgatgtcgttgtcgaagtaggagacatgtccttttatctccacaagttcccgctgctgagtcggagcggcgtgctgcagcgtctgatcagcgagtaccagccgccgtcggacggcagcggcggcggcggcatgtgcacgctgcagctggacgacataccgggcggcgccaaggcgttcgagctggcggcgcgcttttgctacacgtcaagatcgagctc

SEQ ID NO: 42193 - DNA, 287 bp, Triticum aestivum
  Clone ID: PAT_TA_42193
cccctttgtattttacatccctatgtctatcttcatgtctcaacctttcctctttgtacctttcatctctatgcagttcctcatctttatgcctatcgtctttgtgtttgttacttttatgcctgtcctgagctttggacctatcatctctatatttttcttctctatgtttttccacacctctaggcatgtcatctttcaatttctcatctgtgtgttgctgctcgtaacatccatcagttttggtacgagcatcccgaggcatggtttgccctcctttgctgctg

SEQ ID NO: 42194 - DNA, 173 bp, Triticum aestivum
  Clone ID: PAT_TA_42194
cgctaacaaaaatagagtaattaaccgggagatctggagctcagccagccttgcatgcatgcatgcgttgcgacgtacgtcgacggattgtcctgcatgcatacatgcaccggccaggccagtcaatccttaacctcttttgtctctggacgtacgctcctcgacatgaagct

SEQ ID NO: 42195 - DNA, 220 bp, Triticum aestivum
  Clone ID: PAT_TA_42195
gacacacatcccctatctatgagtcggaaatactattactccatcttattctcgacttacggggggcgctagcaaagtaacagcctgtaccatggccaggatccctctacaggcctaggtcgccaggctcgtgctcatagatggcttgttatgctgatcggcccctcggcgacggtgcccgtgctcattcttctggtgcctttccatttcttgtccgacc

SEQ ID NO: 42196 - DNA, 447 bp, Triticum aestivum
  Clone ID: PAT_TA_42196
cccacgcgtccgcggacgcgtgggcgccctctccactttcctgctgctggtgctgttaaccggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccagagggcaaggtgcctgtgtataacggtggtgatggcaaatggattgctgattctgatgtgatcactcaagtcattgaggagaagtacccaactccatcacttgtgacccctgctgaatatgcataagtgggatcaaagatcttctccacctttgtcacgttcttgaagagcaaggatgcccgcgatggttt

SEQ ID NO: 42197 - DNA, 386 bp, Triticum aestivum
  Clone ID: PAT_TA_42197
gaatttctaggtaactttatatttctttcatactactgacgacatgattggtgcagaagtacaaaactaaaaaataccactaaaaatgtaacagttctcccagccgaacgtttacaacaggggccaacagtaaaagacattctactgcatgaagaacgggattacaaagttatccatcttctcttttctctcaagttcggccttctcagcaatctgcttcagtgtagtccacccttttcttgcccgcttccttgaactgccagctggctgagtagaatcacctggtgcagactttttatttgatgctgacttgctataacttccaggggccttggcagcaactgaaccacaattcttcgctttattggtcaaggtacttctagtct

SEQ ID NO: 42198 - DNA, 429 bp, Triticum aestivum
  Clone ID: PAT_TA_42198
aatcttgctaccgagctgggccaatggcctcggctccatgggatccatctcggtgtcctacggcgaggacggcccggtgttctgcggcctcagctcggacggctcccacttggtcacctgctccggcgcggacgcatctgtcgtctacggtgctcccctcaggatccccttcctcggcctcaccgcgggggatgggttcgcgtgcggtctcttgcttgataccagtcagccttactgctgggggagcaactcatatgtcaagatcggggtgccgcaaccaatggtcgagggcgtggagtattccctgctcagtgccggggacaaccacctgtgtgcactgcgaatgcctgacaaggggattcctcacggtgttaaccctgatactttagtgatagaatgctggggtacaacatgactgccacacatgtt

SEQ ID NO: 42199 - DNA, 373 bp, Triticum aestivum
  Clone ID: PAT_TA_42199
aaaaaagaactgcaattgtttactaatatatccgaatcccgatttatgtttttatatttaaacagaagtccaaacttgcaagttctacaacagggctgtttcatacacatgtaattcgcaacatggtcatgggaaaaacaaaaaaatagtaactgcttttgcaaagttacaggtaaatttttcacggacagcgacggttgattttagcgaaactttttttctttcaaaggtgcacattttctttgcgctttggaattggaaaatacattttatgcgggaaacccaattttattttttttggttgccgggttcggactcttgttcaaaatttaacttttttcttggagcttggaaaaattccacctctttattt

SEQ ID NO: 42200 - DNA, 370 bp, Triticum aestivum
  Clone ID: PAT_TA_42200
cccacgcgtccgagatgagggagatcctgcacatccagggcggccaatgcggcaaccagatcggcgccaagttctgggaggtgatctgcggcgagcacggcgtcgaccccaccggccagtacaccggcacggcccccgagcagctcgagcgcatggacgtctacttcaacgaggccggcggcaaccgctacgtgccccgcgccgtcctcatggacctcgagcccggcaccatggactcgctccgctccggccccatcggcgccatcttccgccccgacaactttgtctacggccagtccggcgccggcaacaactgggccaagggccactacaccgagggcgccgagctcatcgactccgttctcgacgt

SEQ ID NO: 42201 - DNA, 438 bp, Triticum aestivum
  Clone ID: PAT_TA_42201
cttggtatatgcgtgcgttgtgtgtgtgtgagtgttcttgtgggaagccaccgacgagaagagtagcttgagagagatggagagttgtgtgaggcagctcaaggtagaagaagaagtggcgctgcgaggtgaggcggcgccaacaattggcatcagagccttgtcgatccgcggaagcgatggcggtgacgacgacacggcggactccatgtgacgtggaggacgtccgtgcgagatgaaggccattggcggcgcgatgccgccggtggccggttgcggtgcgatgccgcaagatgatgatggtgtggtgatgggcgctgtgacggcgtctaccacgacaagatggtgcatggtggtgtccggcgctgcgacggtgtcgaccacgacaagatggtgcacggtggtgtccggcgctgcgacggcgtcattcacaacaag

SEQ ID NO: 42202 - DNA, 271 bp, Triticum aestivum
  Clone ID: PAT_TA_42202
ggtggtttggaagtcaacccaaccctggcaactctctaagtcggcaggtacacacactggggctgtggatactaccgtcgtcgaatttcgggccgatcttatgcctgctgctcggtccaaatcgtacagcgcgtacaagaacctggtcgccctgtacgccggaggtcaacaccctggctccgataccattgcggagatgaaagcctatttcatctactacgcgagggatggttcgctgttcgtcatgccctctatagacttctacgacgac

SEQ ID NO: 42203 - DNA, 146 bp, Triticum aestivum
  Clone ID: PAT_TA_42203
cccacacgaacttaaaagcgacatgaggtcttatttataactggcgctatgtcataacagagggggtcatgctatagagagctaaactctatgccaatcctgttgaccgtatatatatgcagagactaaagatggttcttactctt

SEQ ID NO: 42204 - DNA, 242 bp, Triticum aestivum
  Clone ID: PAT_TA_42204
cgcatggttcatgtcaaccatactgatctgcaatcatatactgatgtgaatgtaaaaggcggggtctgtaataccacccaactttcaactgacttctccaaatacctttaaaaggataacagggatgacgtgggacatcattgagctaacttcattgaaatgcaagactccaatatgaagacctggtatctgttgactgaaggtgaacactatgccgatgcttcaaatcaaagatgttgctt

SEQ ID NO: 42205 - DNA, 389 bp, Triticum aestivum
  Clone ID: PAT_TA_42205
ctctctgcctcctccggtccctccccaaattcgtccgttcccagccccggccgcggctgcccgtgggctccccgcagccctcccgcgccgacggcggcggggcaccgcaggccagccccaccggcgctgcagcagcgcggatcggttacccccttcgtcggttaaggcacaacaatggcttcaactgctgcagtaccggccgcaaatacaaatgggaaccatgcactaagtgtggactcacattccagccaagatgttaggcggcgaacagttgttgttgcaaagaaaaaacctacacctgagcttcttactgaaggcggagttaatggcgtcccagatgataaggtttctagcaagaaagatattggtcaatcatacacgccggggag

SEQ ID NO: 42206 - DNA, 148 bp, Triticum aestivum
  Clone ID: PAT_TA_42206
atattgtttttttttatagcggggggttacacatacatcaacaccctaattgtaaatactacacgcacaacgcaggaaacaacattagtagctcaatgttctacccaaagaaacatctatcccccaccacacataagctacataagtc

SEQ ID NO: 42207 - DNA, 342 bp, Triticum aestivum
  unsure (1)..(342): unsure at all n locations
  Clone ID: PAT_TA_42207
tcatacttgtttttgttgtcggtgatggttagacttggagggttcatgatgacacgcaaatagtcaatccagttactgatgaaaaatctagttccatatctagtcacgccaatggtgtatcgcttggagagcccaatttaaaagaaccannnnaaccaaccagtactggagagtctgtgcagtcatatgtggctcaaccaaaacctgtaaagaaatgtagcttacgggcaaaggttccttttgagaagggatttagcccaatggactgtcttaagctgactcgtacacatgcagatctagctgggctcaaggcacagtcaaattggaggttaatttctttgg

SEQ ID NO: 42208 - DNA, 391 bp, Triticum aestivum
  Clone ID: PAT_TA_42208
aaccaattgtttatatactcgggcatggttaaactaggggggtatttgatgtcactcaaacaaacaatctatctacagacgaaaaatctaaatacaaatctagtcacgacaccatacaatagctatgagagcccaattgaaaagaaccagttcaaccaaccaccacgtgtgagcatggcatacaaacgtggctgaaccaaaacctaccctgaaatgaaactgacagccaaatgtgccttgtgatagggcttacacacaaacgtacggtgttaaactgactcgtactcacgcagatccacatgggctcaatgcacatgccaaatggatgctataacttttggcagaaggtaaacatcattaaactgacttttgattctcgacattttaaaaa

SEQ ID NO: 42209 - DNA, 316 bp, Triticum aestivum
  Clone ID: PAT_TA_42209
ccacgcgtccgcccacgcgtccgttagccgccgccgccgacgtggagcatagcagcagagcgacacgatgacgggggggaagatggcggcggctacggcggctaagtgggcggaggggtacccgtggaaggagaagctggccaagtacaagggggagctgagcaaggtggtgtgggggtactgggagctgggcgcgtggaaaccgctggggatcaacgggcggcaacgcgcgccgcttctcaaggaggtgcttcttgccggcgaagactgggcctaccaccccccccggggtgagattcgcaccaagcgcaagggc

SEQ ID NO: 42210 - DNA, 270 bp, Triticum aestivum
  Clone ID: PAT_TA_42210
aaaaaaaaacataggtcccccataaattccaactccaaccccttgtaaagagcttggctatattttgtcttattgaacttttaaaaggcgcccatgtaaggcccactcttacacttaaaacggggaaaggaaagggaaaaaggggcctggttacttaaatttacggcccagcggggggcccctacccccttattgttcttttttaaccacccaccacaaaaaaagaatttcctcaggtttttttttttaagtacccattcctttttttct

SEQ ID NO: 42211 - DNA, 391 bp, Triticum aestivum
  Clone ID: PAT_TA_42211
actggacagactctacgaatgcatgatagtttattattacagcacaatgacatttttaccggcataccagtaggccagcattatgcattatcaacatacagtcggatcatgaaccaggcgtttcagatcatgcaacaaatgcggactgatactgccttgttaaccaaagaagaaggtggttcacctatccgaaatcctccaactgctgctgaagatgcacgattagcatctcttatatctctagacaacatcttaaagcaagtcaaggaagtaataaaacaaagctctacaagaccattacgaaaatcaaaaaagaaagcattgctagaatcattagatgacctattggcacagatgccttctctttttgacattgatcatccatgtgctc

SEQ ID NO: 42212 - DNA, 183 bp, Triticum aestivum
  Clone ID: PAT_TA_42212
acatctaaccagatatatatatttaaattaaatcaataaataattataaacttaccgcgtgaaataagcatctaactatctcaaaaaacaatcaagaactctaaaaataacaataaactcgactccggcctgaacttgattccacctattattcattcaagcactcactatgttgaaaatcaa

SEQ ID NO: 42213 - DNA, 199 bp, Triticum aestivum
  unsure (1)..(199): unsure at all n locations
  Clone ID: PAT_TA_42213
cccacgcgtccggtttgaggatcaagtcattaaacatttggatttgtggaaaactactcatgggctaggactagagcaagtttttctttttcactgtgctgttgagacttttttgtttcttagctctctgaggactgagacctcattaaaaaataatgaattggaaggacaaagtaaagtctcgctggacaaaananaa

SEQ ID NO: 42214 - DNA, 198 bp, Triticum aestivum
  Clone ID: PAT_TA_42214
ggagaggaatatattctgaggtcaatctcattacacaatacgtacatacatagatcggacattcagtacacatgatctatagtatacccagcttagtttagagccgatggattacttcttatctttctttcttttttgcggggaaggattacttctttatctatagagcaaccttgtagagcaaccattatcacgagc

SEQ ID NO: 42215 - DNA, 440 bp, Triticum aestivum
  Clone ID: PAT_TA_42215
atctgtgtactccttcacccaaccccaaccgcaaacataaccctacccgcacccagcctcgggggcaccatgcaaaccgaaatacctaatcttcctacaccagaccacacacaaccccaatccaaatctagccaccttgtcccctaacctggttcttctataccggctaaatgagttcctcccctacccatacctgcggagattatgtggctatagaagaccacaaacccgtaatgccataaccatgatcgaacaactgatggaatacctgcacaccttcaaggccccatcagcaattcacgaaccgccaaaaccgttcttgctacacatactggagccgccgttatccgacccactgccggcgtcatacataggcctgaactcgctcctcatctacaccacggacaagaacctgttcacactctacgccgtctggtacc

SEQ ID NO: 42216 - DNA, 244 bp, Triticum aestivum
  Clone ID: PAT_TA_42216
gaacacccccccgacccacgcctccgaaacccaatctttcattcaaccctaacgcattctatcttctttcctttaaacaaatcagggatcaactatctgggaatctataacataactttcatctctcctaaatccataaatcaatcaaatctgtcaaaacatatatacaaatatccttataattaaaaacaaaacatagcaattttttaaacttaattcatgaacacaattacctccctttaac

SEQ ID NO: 42217 - DNA, 273 bp, Triticum aestivum
  Clone ID: PAT_TA_42217
aaaaaaaaagggggggccccttattttaattaaaagggggggcccaaggaaggacatttttggtcaaacacacccgaggggggcatacaaaattacggaacacgaacgggggttttattttattaagcgccccccccccaaagcccatgcgggggttgggaaaaaaaccctgggggggggaaaactgggggggagggggcttgtttgtttgccctcctaaacctggggctcccctttgccggccggccttttgggccccggttaatttgcaat

SEQ ID NO: 42218 - DNA, 427 bp, Triticum aestivum
  Clone ID: PAT_TA_42218
aatttgtataaatttttgtctttcatttttatccactacagccaagtggactgctccatccttttccacaaagcgaatagtcaggttctaaaagtactgcagacacacacgccgtactgcatggatgcgccggcaaaccgcacggagggaggctcgctgtccaaattacaggaactgcaaaaaatggcaacaaaactgcaacaatagctacggcggtggaactggtgctccgattaaccacacataggggagcaccaaactgcatgcatgggggtggactccaggtgcgggcgcgcctcgccgtgtggccacaacaccttggccggaggcagcagacctgcacaatcatagcttgtcgtgcggctatcgttgtcttctcaggcaaaaatcccagcgagtagcacggctggaggcgtggctccctgac

SEQ ID NO: 42219 - DNA, 361 bp, Triticum aestivum
  unsure (1)..(361): unsure at all n locations
  Clone ID: PAT_TA_42219
ccggccggaccgacgcgtccgacttgtacaagatgaccagccgccctaaaggattttatttggtgaccgttagacagattgggggacagcatgcggggagctttatgtgacttcaatggtggaaaaccaagagggcttcgttaacttcgaagacatgctgagggaaaccgctggcttaacntgggctagaggcgttcttgggatgaaaaaaccagccaagaaaatcttcccagaacagaatatgatgatgaacaagtgccaccttgctggcaagcatgggctctcagccacacaaaggctcacgcccatgaccatgtactgcacttcattgggcgctgcggctacttatgattcaaatgct

SEQ ID NO: 42220 - DNA, 338 bp, Triticum aestivum
  Clone ID: PAT_TA_42220
gggaattgaattttttttttttattttttttttttatgggaaaaaaatagttttcaagaaacaaaactcaaaaatgtttacaggtggggttaaggaaccccatttatataaaaaaatacaagccctaaaggtggaccttcttggttttataggtaacaagggggtgtttctggaacaacaacttttttttggccaccaaaaattttttttggaaaaacccattttaatttgccatgcaaaaggtgaaattattaaacgctttttaaggaaacaaaggattggttttttttaaaaacaggcgggaggaaacccccccttgggtttaacatggaaaaccc

SEQ ID NO: 42221 - DNA, 259 bp, Triticum aestivum
  Clone ID: PAT_TA_42221
tttttcttttaatatcgtttttttctttggggaatatatacatcccaacaaaacatatttcttcttcagaaccaattccttttcaaaaacacctatcccacattctttacaatccgtctctaagatcccccattactaatctccatcccctcctataatttctcccttcctgttcaatttacccaccgtgtcttttcctggaaacaccaactccttttccccccccaacaatttttttctaatcccccatcctcttttc

SEQ ID NO: 42222 - DNA, 449 bp, Triticum aestivum
  unsure (1)..(449): unsure at all n locations
  Clone ID: PAT_TA_42222
cccacgcgtccgctcaattcctaacacggattacagaagcgaaggcgacgatggccgtgagcaagcgatggacgcgggtgcgcacgcttggccgcggcgcgtcgggggccgaggtcttcctcgccgtggacgacgcctcgggcgagctcttcgcggtcaagtcggcgagcgcagcttgctcggcggcgctgaggagggagcagcgtctcatgtccggcctgcaatccccgcgcgtggtctactgcatcggcggccacggcgcccgtgatggttcctaccagctcttcctcgagttcgcccccggcggctcgctggcggaccgggtggcgatcgacgggggcctcgacgagcgcgccgtccgcagctacgcggccgacgtggcggccgggatcgcgtacctccacgccaccgggatggtgcacggngacgtcaaggcgcagaacattatg

SEQ ID NO: 42223 - DNA, 195 bp, Triticum aestivum
  Clone ID: PAT_TA_42223
tcgctcacgcgttcattcaatttctatcacggattactaaatccaatgcaatgatcgtcgtgatgcagcgatggaaatgggtacacacttctcgtcacccaactataatggctctaagcttattcgcctttgaccacctctcgtactagctaataggggccaacttatcgaccttaccatcatctgcgcagctta

SEQ ID NO: 42224 - DNA, 306 bp, Triticum aestivum
  Clone ID: PAT_TA_42224
aatattattaatttttattattatttttgttaaaccgagggaattaaatattttaaaccagcaaaatgaaaagttttcaaccaatacttcatatttaaaaaacaccacatcttaaaattaaagaaaatgtggctccaaaataaatggaacacaaaaatcaataattgaaaccaatggggtgtcaaaaaccagaagaagacgggcttcttcaaactctaaaagggggataaaaaagcaaccaaaacatcgatctaaattctccatgacttccccaaagcgccgccgtttgagaggataaaaatatac

SEQ ID NO: 42225 - DNA, 448 bp, Triticum aestivum
  Clone ID: PAT_TA_42225
cccacgcgtccgccctccgcgcccacgctgaatctgtcaacgccaccatccacgacggggaggtcatcgacgtcattgactccatgatgcagtcccgcgacagtggcctggttgatgggattccgagtgacttcccattccagatcctcaaagaggaggggcttaaagacatcactcttacaagaagtttgaatggggagcagattgaggtcatggtttccatgctcaaaccagatggggacgaggaggaatcctcggattctaggtatacgtcggatgaagacgaaggggacaatagcatacctctcagggtcacggtttccaaggccgatggatcaaaccttaaattcacctgcactgcctatcctgacaatgacaacatcttcatcgataccttgtccgtgagacacccaccatcacgggccaaagaacatgaggaagatatcct

SEQ ID NO: 42226 - DNA, 429 bp, Triticum aestivum
  Clone ID: PAT_TA_42226
ccacgcgtccgcccacccgttcgtcctcgctttcgtgacggctgatgctacccgccatcctctccgacagcagctgctactccagtgggcgccagaatcaattcaagatccaatccaagatcgcctcgttcatggcgtcattacaccagtcactacaccaacctagccgtgggcccaccggtggctgtgcgcgcaactgagcgcgtcaacaaagactgccacagacattggcggggacatgtggacgacgagctggaagaccgacaacctggccaacagggtggagccgcgggacgactggctgcaggactggcacccatacgtgaatggatacgtcaatggctccgactaccacttcgacctggagagggctgcggggaggcctgcgcctatgcccgcaccggcgcctgtatcgtagactgggtctag

SEQ ID NO: 42227 - DNA, 390 bp, Triticum aestivum
  Clone ID: PAT_TA_42227
cgaacgcgtgggctctgtagctcatgctatacaccaaccgcgccgccgtgctcggcgactacgaccaccgtgtttggacctaccacacctttttctatccaatgagcttctacacgctcacaattatcccagttctcaaagaggagatgcgaaaaggcctgctacccttggtcatgagccaagagcactaccagcgcgtccttcggacatataagcgccggtacttcctatacaattcatcctgaaaggagtatgaccaaaatctgggtctatatccctaacataataatgttcaacttgcacgacatgaatactatgatggagcctactaactgctatcttcccctggctagataaatttcactatatctaaataagatattgttgtat

SEQ ID NO: 42228 - DNA, 162 bp, Triticum aestivum
  Clone ID: PAT_TA_42228
acgcgtccgttatgttataagtatttattacatatgtaccattacttgttacacacatagcttcgcaagggtgggtttaaagagaaagctaattatacaatctgcatcctctttttgcagctatcgacatgctaataggtgacagatatactaaattatcat

SEQ ID NO: 42229 - DNA, 312 bp, Triticum aestivum
  Clone ID: PAT_TA_42229
cccactcgtacattaactcataaatttgcacagatagataaatttatatataatcatttgcgcggggcatttcatgggccatatattatcacacagttcttagataggctctcacaccttctcacacatcttctcgtccgtatgtaccaatgcattaattactgacgaaccatcacacgatccaacaaccctatagaccatgtatcactccatgttcctcacgccgtactatatacccgtgcaatcactcgtctattgtttggacttctacatgaactcgtagtatattttgtatctactcccattgctttt

SEQ ID NO: 42230 - DNA, 440 bp, Triticum aestivum
  Clone ID: PAT_TA_42230
cagggtcgacgccgcgcgtccggtcgatgactaccttaagagaagcaattactgtgttggtttaggaagcaactactatgggaggagcgacttcatgcctacgttttactcttatagcaaacaattgacaccctgacgatacgctaacgatctaataaggcgctacaggacccagctgaatgcattatacaactatggggctggaaagcttgcattgagtgcaattggagcaggtggttgtagacctaacgcgctcagaagacagccggacggtaggacttgcctagaccgcctcaactgagccaaccagagcttcaacaacaagctcagatctcttggtgatcagctcaacaacaatcaccctgatgcaaaggtcatctacatcaatgctgatggcattttccaggacatgaacacatattctggcagatttgggttta

SEQ ID NO: 42231 - DNA, 172 bp, Triticum aestivum
  Clone ID: PAT_TA_42231
gtgtaagtgttctatgctgagcctctccacccactgtagcgaaccactgaaccagggggggattttgaaagatcttagatttcttctactaccgacaggggcagaaacggtacagtcttatgacatactgatcaagcactatggacagcggatcttggcgttttatgaggac

SEQ ID NO: 42232 - DNA, 381 bp, Triticum aestivum
  Clone ID: PAT_TA_42232
gcaaccgatcatggggagacggtaatggccagcctctaactccccacccacgcgcccaggcgagtctctccttcttcccatcgccgccggcacgtctgcccgcccgcccgcgcgcgttgtgtcagtccgttcctcgaccgacgtcgcgcctaatcagttggcgacgcgtgcagttcccccggtggtcttaatcccttctgtttcgtcgatgcgaccgatcggccgtcccggagatcgatcggtaatttcgcggggtcgatcgggccgctgatccgcgggaggaactaggagccgtcgggcgcggccattcagcaatggcgagctgcgtgcggggctgctgctgcgtcctggtgctgctgctcgtcgcgctcggcatcacgg

SEQ ID NO: 42233 - DNA, 337 bp, Triticum aestivum
  Clone ID: PAT_TA_42233
aggaagccccttctaagggaggagctacttcatgccttccatttactcttatatcagacaattcacaccccaacaataccctaacgatctacatcaggcgttacaggacgcagctcaatgcattatacaactatggagcttgaaagtttgcattgaatggcattagaccagttggtagtagtcctaacgcgctcgcaagtagtccggacggtaggacttgcgctgaccggatcaacttagcaaaccagatctttaacaacaagctcagatctcttggtgatcagctcaacaacgaatagccctgatgcaaagtttatctacatcaatgcttatggga

SEQ ID NO: 42234 - DNA, 328 bp, Triticum aestivum
  Clone ID: PAT_TA_42234
agcgtccggtcgcgggaaagctcaggagatgtatttactttgttggtttaggaagccacgactatgggaggggggacttcatgcgtacgttttactcttctatcacacatttgacacccgaacaataccctaaggctctcatgaggcgtttcagcacccagctcaatgcatgatacaagtatgcgactctgagcgaggcattgaatggcagcggatcggggagtttctcatacaacgcgctggtaggcagtcccgacaggaggacttgcctagaccgtatcaactcagcaaaccagatctttagcatcaagcgatgaactcttgatga

SEQ ID NO: 42235 - DNA, 271 bp, Triticum aestivum
  Clone ID: PAT_TA_42235
gtctgactgcgccggacggagccgccccacccaccgaagcgatccaccggaccggctagcggctgtagaaggcgggagatggcttctaccgccgtcggggaggaaaccgggccggcctttgacattctgatcaagcacgaggggtcccggcgcaaggcgttcttgaaggacccggaagggcgggttattttcgtcaccacgcgcgccgacttcctcgagcgcctttgggaacttcggcccagattcttttcgggccggggctttttttttt

SEQ ID NO: 42236 - DNA, 455 bp, Triticum aestivum
  unsure (1)..(455): unsure at all n locations
  Clone ID: PAT_TA_42236
aaagacattgtgtaggttaatctttgctgtgttccatcttcagcctgaatagaagctgggatccattttgtttcctcttttgcacagacacagtacgacagacgaacccggcaacaccggctcacaacacccaccatcattgttcatcggtattactgtgtctgtgcaaaagaggaaataaaagacattgtgttggttaatctttgctgtgtttcatcttcagcctgaatagaagctttgatccattttgtttcctttgacgtactgtgtctgtgcaaaagaggaaataaaagacattgagtcggttaatctttgctgtgttccatcttcagcctgaatagaagctttgatccattttgtttggnanggantttctnaagcaaaactgataaacccacaggttgaactaaatcctggaattggtcttacttggttcagtagatgaaattgttttt

SEQ ID NO: 42237 - DNA, 395 bp, Triticum aestivum
  Clone ID: PAT_TA_42237
gacgaaattgcgtaagtccatcgctgctgttttccatgttcagcctgactcggagcaggaggcatttcggttcgtcttttgcacatacacattgctgcagacgagcccggcattaccggctaacaacacccagcttcatggatcaagggtgttacgtgttctgtgcacttgaggaactagggaacgttgagttggaaaatttttgctgcgattgatctcaagactcaatcgaatcttaaagccattgagttccactttgttgacattattctgtcacaaaaggaactagacgcatggcgacagttatctttcctgtgctccatcactaacctgaatagagccgtaggggcattttttttgttagagttttgctgaaacatatacttgtatactca

SEQ ID NO: 42238 - DNA, 500 bp, Triticum aestivum
  Clone ID: PAT_TA_42238
attacaggctagactgctctgcacactgtctgaaagtcttaagggcttataaagagaacagggggagtgatacttagagggggggatattctttggcacccatcgagattctctagggacaaacacacaaggagatttactcaaaccacaatttcactagccacatgggcatggctagagctgggccatgataccacccaagcccaagggtacaggacatagactacagtttagcatatgttcacaaaagcttgttatctcaagcagcataacatgcatagagaaaattaccatgagcaaatgttaaacactatcagtttcctttaaaaatgagccaaaaagtgagaaattacacccaaacaaaactggtgtaataaatgcaaatttgcttacgagcatatacgccttggttgtgcgggagttaatgtataacctcacaacttgcatttcagagtgagagtgagacacacatcacacatactacacccgccgggatcata

SEQ ID NO: 42239 - DNA, 409 bp, Triticum aestivum
  Clone ID: PAT_TA_42239
aacaattgtaaatcttcctatttgaagagccctgcatctgtttagccaaacctacatgtatgtgacatgaacaaatagccattaaatggcatgcaggcaattcctagaaatgtacatttgatcccagcaaagtcactaactaccctagattacaaattaagtaactcttagattacaatgataaaaaagagtggcagcagtacatatcacctatgacagaccaaaaaacaattacctgtatatgcggctctgtaaagcactgaatatgcactaatataaccaaccaattgtccaaaaatatgacacaaacaggaaaaaatatatatctttcaaagtctgctttcagataaagcaaatggtatagaagttatggttctccatgtgcttctaaatggtcctgactatggag

SEQ ID NO: 42240 - DNA, 202 bp, Triticum aestivum
  Clone ID: PAT_TA_42240
ttttatgttggtttttattattttgtttgtttttgttgtttttgccttgcggagaagcaacacccaaccttttcctttaattgaaataaaaggcgtccatcacaacctgggacgatttaaaaagggggcgcgctccctacctttaaccatacacatgggccccaccgccggggacacaaaagttattaaaagagaacacggg

SEQ ID NO: 42241 - DNA, 266 bp, Triticum aestivum
  Clone ID: PAT_TA_42241
atacctgctatttttttgggtgaaataattagatggcgtgcaaatctagttgtccctaaaaaaaaaaaaaacttagaatgggtggattaaggtatacacaacctacaactaaaacaaatataagaagtgcggggcggccgttccaaacctagaactacttcaagagggattatacctacaccgcgcttattaaactcaaaccccgtattttcaaaaatccattaagtctttctttatttatgcacatttactgtttatacgaaact

SEQ ID NO: 42242 - DNA, 181 bp, Triticum aestivum
  Clone ID: PAT_TA_42242
tcccggtcgactcacgcgtgcgtgtcagtgctcgagatcgttagcgagtcagaccatatgagtgttatgattttcttttgcgggggagtgcaggcaaagggtaaagaaaaatcccgcgtaaccgcatctcctaggaaataagtcttgtgctggcctggactagctggccataatttttgcg

SEQ ID NO: 42243 - DNA, 440 bp, Triticum aestivum
  Clone ID: PAT_TA_42243
cccacgcgtccgcggacgcgtggggacggagagcaacgaggagtacacggagtggaccaccgtgatccggcaggtcatcaccgagaactgccagcccaccgacgacggcgagatgcccttcgactacggcatgtactcgtcggccgtcacctcggacgtgaccacctccaaagacatgaccaccaagctcctcttctgcctctggtggggcctcgccaacttgagtacgctaggccaagggctcaagacaaccatctacaccggggagtcgctcttcgccattacgctcgccaccttcggccttatcctaatggccatgctcatcggaaacattcagacgtatctgcaatcgctgaccgtgcggctggaggagatgcgggtgaagcggctggactcggagcagtggatgcaccaccgcctgctgccgatggagctgcgcg

SEQ ID NO: 42244 - DNA, 393 bp, Triticum aestivum
  Clone ID: PAT_TA_42244
cccacgcgttcgaggacgcgtggggtcagtcagctacgaggagtgcactgcgtgggggagcgtgatccggcagggatcaccgaaaactgccagcctcacctgagacacgtagatgctctgtctagtacaacatgaactctgtggccaggacttcagacgtgactacctccaaagacatgaccacgaagctccttttataggtttgaaggtgacttcccaactcgagtacgctaggccatgggctcaagacaaccatatacaccggggaggggctgtgcgccaccacgctcgccaccttaagactcatcctaaaggccatgcttatcggaaacatttaatcgtatttgcaatagctgaccgaactgctggaagagatgcaggtgaagcggtggt

SEQ ID NO: 42245 - DNA, 355 bp, Triticum aestivum
  Clone ID: PAT_TA_42245
cggacgcgtgggcggacgcgtggtcggacgcgtgggttctaagcctgttgtcattgctgagggtggtcagatttcttagatctgactgagattgttgatgatgatgatgatgatcttgaggatccaatggtagctttatattgcttctctgtgatgtactctggcttatggtgctggattttgaagtttatcgctgttgtgaaactttgagtttggctcccattgaataacaagaacttaaagttaactttgatatcaaaaaaaaaaaaaatgggcggacggtttagaggattcaagcttacgtgcgcgagcatgcgacgttatagctcttctatagtaggacctaaattcaatt

SEQ ID NO: 42246 - DNA, 292 bp, Triticum aestivum
  Clone ID: PAT_TA_42246
gtttttaagccggcaaatataattgattgaggtataaattcgaaggcattatggagctaccaaaaagcttctaacttgctgtggccggccccaaggtggaaaaaatagaattgtccctcaattgcaaataaacaatgtggaaaaaacagaaccgtacatggtaaagaaaaggtttcttgttagcaaactatgaaacatattttctgcacggaacgcctttccccctccccttaggatccagggcacccggaacgtgggcctttttccgtacccaaatcccgggggaggggcc

SEQ ID NO: 42247 - DNA, 465 bp, Triticum aestivum
  Clone ID: PAT_TA_42247
ccagtttgtttggacagcaatgctcaagtcgacccaagggataactttcttattgcggaaaatgtggattcactgatgccggatgccctgttgtcaagagggatgggttccggaaaggatatttgcaatcttccttctgggcaaagggatcacagggaggttgataatgagctatcctctgctgcattcagttcccagtcatttggtgtgcctgacatatccttcaagcctggatgttcaggtgatattgctgttaatgatggtggaatgccaagccaaggattgtggaataatcaaacacagcggatgagaactttcacaaaggttcaaaagcgtggatctgtggggagatcaatcgacatcacacggtatacaaattatgatgaacttcggcatgatcttgcatgcatgtttggtattcaaggccagcttgaagatccgtacagaatggactggaagctagtc

SEQ ID NO: 42248 - DNA, 171 bp, Triticum aestivum
  Clone ID: PAT_TA_42248
tcagtttattttgacagcaatgctcaattcaacccaagggataactttcttatagggggaaatgtggatgcactgatgcctcattccctcttttcaataggtatggttttcgaaaaggatattcataatcttccttctggacaaagggatcacaggaatgctgaaaatgtt

SEQ ID NO: 42249 - DNA, 410 bp, Triticum aestivum
  Clone ID: PAT_TA_42249
ggggtgtttaatatttttgcctctaaactttgtcaaaatttacaaagcttgactttgatcaagctaatataagtcaagctaatatgcagagtaagtaaaagcaaagggagtacaatgcaactgtagcgactatcgggagcgaaatgcccgaaatgcctgtttttttttttgcgggctaaattgagagctttatttaataaaagcgttctaaattgagatgataaatcagagaaaagcaaacatagtagacatggctgatgccttgctgcaatctatggctcgtcttgcatcagacaccgcaacacaggatgtactgtgccttgttcgccgagtctactatgatccacacattgtcaagtctcgatggtcattgctcggcaattctgttgtaccatatgatctgaccaccc

SEQ ID NO: 42250 - DNA, 257 bp, Triticum aestivum
  Clone ID: PAT_TA_42250
gacacagatcggcagaggccgacggtacctattatggcctccaagatcaagaagggagggatccttggaacgggtgaatatatcctgagctatgtcaacacatactgcatgaccttccttaacaagatgggcaagaacgtgatctaggcttacaagatccagggctttgtgactgccttgacacttcataggaagcgcgctttaatagcctacaagagcacgagggtcgcatacaataagctctaggctgcagagta

SEQ ID NO: 42251 - DNA, 418 bp, Triticum aestivum
  Clone ID: PAT_TA_42251
cacctacctagagattaaatggatatctttgacagtcatcacaccttcattctctcttgggaggggtaatcgtatctgcagcacatcaatgctcatttctacagcattcagccgttgcttacaatcctaactgtcaaagtctaattttcagctagcacaaacagtctgcttacgaactaccctgtttgtatgacctacgcatagggacccgactacctgcttgtattggggcgggctgaatgcagagcttgatattctacctatactctaactagagagcgcgatttggaatcatcgatccttattagacgtcgctggtccggttcctctaatcacggcaatgattacaacatgcacgcaggccaaatgtctaatgtgcgctttttacctggtttactgccatccacacattaacctg

SEQ ID NO: 42252 - DNA, 400 bp, Triticum aestivum
  Clone ID: PAT_TA_42252
gttcagaactccacgtatatttctccaaattcgtgcatgcagttcttattacagtataaaagatgtagcgaccattagtttaagcttggtcggatcatattacggtggagattgatacgtcatccctcttagctcgagattcatacttcaccgatcataatctagtggatttcaccacccacccacaccacatacttctctggcatgtagtggcagatcggctcgccgcgggacccgttgagcgtcgcgaagtactcggcgtcccagccggaggtgtcctcgtggcagacggcgatcgccgtcgcgcccagcgtaaggtcgtcctgcccgaccagctccacgcgcaccgagcccacgttgtttggccggtggcagtacagcacgtccgccgggtacggca

SEQ ID NO: 42253 - DNA, 440 bp, Triticum aestivum
  Clone ID: PAT_TA_42253
cggacgcgtgggcggcgcatggccatggctgctggagctcagtcccaaggcaagctgggctgcagaggtgcggcaagagctgcaggctgagatggatcaactacctgaggccggacctcaagaggggaagcttctcgcaggaggaggaagccctcatcgtcgacctccacagggtgctagggaacaggtgggcccagatagccaagcacctgcctggcagaacggacaatgaggtgaagaacttctggaactccaccatcaagaagaagctcatatcgcaggccgtgggcagcctccactccgatttgtactataacattctggatggggcgggacaaggcatcgcagctgcggggtgcgcgtcgctcaacgggctggacaatgcggctcaagctgtggccacgcagccccctccgtcctccgcggcatggctcaatttc

SEQ ID NO: 42254 - DNA, 329 bp, Triticum aestivum
  Clone ID: PAT_TA_42254
cggacgcgtgcgctgcgcatggccatagttgttggagttcattcccttttcttggtggggtgggtacgtgcagcgcgacctgcaagatcatatggatgaattacctgcgggcgtacctaaagaggggaatcttgccgctcgaggtggtatcgatcatcgccgaccccgacaaggtgctagggaacaggtgtgcccagatagccaacctgctgcctggaccaacgggcaaggtggtagagaacttctgagactccatcatctagaagaagcttatatgacaggctgtggggcggcggcacttgggtgtggctataacactttggatgggg

SEQ ID NO: 42255 - DNA, 313 bp, Triticum aestivum
  Clone ID: PAT_TA_42255
ggaaagatactcaaatacggcagatgcaaacaatgtcgaaatcaaatcaaagacaaagacaaatacaaacatgtactgtagtactatgtttctgataaaaaaatgatggtgaaaaatggagacagataacaactaccggtagtagtactaagtaactaaagagtagcaggagacgggaacggtaaagctacgctcgcagttgcattatcagtcactcgtcgaccgtcggcacgcttgcggcgctgcgcctttggctgctgaaaggccctgtgacagtccggccgacaaacttgccggccttggtgatgctttt

SEQ ID NO: 42256 - DNA, 441 bp, Triticum aestivum
  Clone ID: PAT_TA_42256
cccacgcgtgcgatctcattgagggcaaggatggcatctacctcatttccttgggggggagcacgctagggctgtaggactagaactcctacctggagcgccgtcaggccgtgttgcactcagtcaccattcagggcctcaacacggggacgctggacctgaccagcatcgggtggtgacacattgcgagcctggacagcgagcgcaagcaggctttgacggccacgggcggcgaggtgcatggaatacccatggggttacagcaggcgctcacgtggtaccggcggcgcttcgacaggcgcaccgtggtgagccgcctgttgatcgacatgaacccgatggcagaggccttctgttcgtcactgttaatgagtggggcgctactggagctagtacattcccgcgctggggcggtcgcagactagctgtctcatgtgccgg

SEQ ID NO: 42257 - DNA, 382 bp, Triticum aestivum
  Clone ID: PAT_TA_42257
gaatcagtgacacaatgatacaatatgtaccaagtttcttgagacagttgaatacgaatttcaaatttgaataaacagagctctgcaggttctgttcctttattacaaacactgctctggtgatcatctagtgtcgagctacagcagtagagcaggtggtatgaacaacagaagacgtaggtaggagcagatagtagcagtagtacatcgatcttggttccggcgagacaacagagctggccgggacgctcacgccgtcgagcgcttcacgttcttggcccaaattatgtgcccgtacggcatgaggtggcagaccggcgtgccgccgggcttggtgccaaggagcttgaaggacacgtgctctgggttccacagggacgtg

SEQ ID NO: 42258 - DNA, 406 bp, Triticum aestivum
  Clone ID: PAT_TA_42258
cccacgcctccgatgatttatagtgattggcgtacacccttatattttctataaagagaggattgcctgggcagggctactaatatagatccaagagtttctcttgtttgcaagaaaaaaatggttacctcttgggatatgctatgcacattttgcccacctcctatcaaacaggttcttgagtctggcacatatatgaaatttgatgaagagccacattgcaccaaacttatgcttctctttgaaaggttgattgaatcacctgcattaaaggcccattaacttgttcggtcccttaaggaggggcaaaagcgtggaaggcttcttgctaatcatgaagaatatgatcagtgctaagaagaaagttaggattatggagcccatcattacagtggattttagttta

SEQ ID NO: 42259 - DNA, 249 bp, Triticum aestivum
  Clone ID: PAT_TA_42259
gtgtatagctcgatgttccaaaaatgctttggtgaaaatttgtctagcattgtatgtagcttgcgcagagtgcttgttaatctgatagcagctggtgattcttttgtcgactacaaataaaatgtgtcagtgtaatcctatatcctgggagagaaacagctagttagctgtttaaaaaaaaaaaaaaaaaattgaaaaataaaaaaataaaaaaataaaaaaaaaaaggcataatattataaataaaac

SEQ ID NO: 42260 - DNA, 388 bp, Triticum aestivum
  Clone ID: PAT_TA_42260
cccacgcgtgcggtgggtgccgcggcggcggcggttgtccctcttgagttatggtgcgaggagggaccctttcgcgcgacgccttaacttactctttccctgcacactaaggtcagggggaagcggggacgtctggcccgtgcataccgtccgtgttttacagcttcgtgtattcacacatcgaagaggtcagttgggggcaactagtgagcgccacaggcgacgacggctatgttgtgcatcatctctcgacccgtggatgagcaaacggcggctcacttactggagatcacacgtgaccactgaactacccggcatgccctcctttaattgttgaggacatgccttatctgcccaaatcacagtggtcaaaaagcatgcgactgca

SEQ ID NO: 42261 - DNA, 374 bp, Triticum aestivum
  Clone ID: PAT_TA_42261
gaagacccgcgagcccaaggaggagaacgtgacgctcggccccgccgtccgcgagggggagcacgtcttcggcgtcgcgcacatcttcgcctccttcaacgacaccttcatccatgtcacggatgaaggtgtcgttgaaggaggcgaagatatgcgcacatcttttcaagtgtccactgatacatgtcttctttttatccccaggcactcgaaaaatcaaaatatgaagaacaatggctggcgacagttcgtcgtttcattgtaatatctgaaaaggagctcggatttttctatcggtatgtggcacttgatggaaaaacacaatcccagaatgctgatctggttcatggtgggggcaagaaagcttctaaact

SEQ ID NO: 42262 - DNA, 463 bp, Triticum aestivum
  Clone ID: PAT_TA_42262
ctggatatcgaccgcgagcggccgaccgaaaagtttaagccgagagagacaatgtcatcagcagtcacgagctcaagcagttgttcttaccccaacaacattccttggccagactaaagactaaagctttaacccccttcgtgatgtatgtctttctacggatctccgaagtacactatgggaaatgatctttggtatggacctgacagagtgaagtacttaggacccttttccgttcaaactccgtcttacctcaccggagaattccctggcgattatggctggcacaccgtcagtttatccgcagaccctgaatgctttgacaaaaacagagctgttgaggtgatccatgggagatgggcactgttgggagcttatggatgcataacccctgaagttcttcaaaagtgggtgcgctgggacttcaaagaaccagtcttggttaaagccggatcacaaatct

SEQ ID NO: 42263 - DNA, 396 bp, Triticum aestivum
  Clone ID: PAT_TA_42263
gtaaaatacaaagttctagtgagatgtccttgtctgacatgcttgaccccttgatatcttcttaatgccaggggttaatgacagatcaattgccaaatgaactcaaatctggcattcagtattggtctctagaaaggaaagcttgtcaagcattatcaagaaatgataagatatctatcggagatgttattggaagcaattcattttaaatcatttgactattcggttcttaatctgatgatgtatcggcttactgggcagcagggtaatgacttgcacatggagttcttgtctgcctcagaatttttagttgagatatgtgatgacccgtatgattatgaggatgatgtgggttacaattacttttaacaatcctcgcatgtttgctgcgatata

SEQ ID NO: 42264 - DNA, 166 bp, Triticum aestivum
  Clone ID: PAT_TA_42264
gtaaaatacacggggggggggagatgtccttgcctgacatgctttactcccttgataatttcctacaatgcctccgggtaaatgacagatcaattgctaaatgaactcaaatatggcttctagctttggtctttagagagtaagttcttcatactatataagaaat

SEQ ID NO: 42265 - DNA, 445 bp, Triticum aestivum
  Clone ID: PAT_TA_42265
gacggatgttctgttgggcaagaggcccaaggaggtcctgccggccggggcaccggagaagaggatgaaggtggtcaggagaaggctgccgcagtcgctcgtcgagcatatcgtggcaaaacccctaccagatggccgtagtccccgccgacgcgctggccagggaaaccaactactaccgcgagtcgtacgccgaacgcaggcgcacagccgacaggatcgccgcctaccagcagggcatcatcgaccagttcaagtcctttggctacgcggaggaggataccgaggtcaccgacgacgatgacgatgacgacgaccactagatcgatggtggagaagtggcgcagcaatcagaggggcttgagcctcagagcctgcatgtgtgcaagactcagctgcttttaagatgtgtgtactctcgtgtgcgtttgccgtccatctacct

SEQ ID NO: 42266 - DNA, 452 bp, Triticum aestivum
  Clone ID: PAT_TA_42266
cttagatactctagatgttcatgatcctttatgtttatgtttcagtgtgtttgtaagggtcaacttctttgtactgattcatgatatgaataaaaaaattctcaaaaaaaaaaaaaaaaaaaaaaaaaaaaaaaaaaaaaaaaaaaaaaaaaaaaaaaaaaaaaaaaaaaaaaatatatattaaaaaaaaaaaaaaaaaaaaaaaaaaaaaaaaaaaaaaaaataaattaaaaaaaaaaagggggcccccttttaaaagaaccaaacattatccccccattttccaaacataatatttttttaaaggggcaccataaaaaaaattcatgtgccaagataataaaatatttggaagggaaaaaccggggcgttcccaaaaataaaggcctggaaacaaaacctcattacccccgctggaaaaaaaggaaaaaggccccaaactaaatttactt

SEQ ID NO: 42267 - DNA, 287 bp, Triticum aestivum
  Clone ID: PAT_TA_42267
ggaaacgaggcaaaaaatttgccattttaattgattaaaaaaaaaagagttgcccgtttaattaaaggaaaaccaggcgaaaacttagatacaaaccctacagggggaacacgcggacaatctggttacaacaacgccaaacagttcaccgcaaatttaaggacatggcatctccgatttttgctgagagcttaaaaaaaaaaaatttgaagccttcacccgaccttattttagccaaatttcagaaaggccccgctgcttaaaaacctccttatggaattattttt

SEQ ID NO: 42268 - DNA, 244 bp, Triticum aestivum
  Clone ID: PAT_TA_42268
gaaccaaatggtttttatctattttaaaacagggggtgaaattcaactttaacttgaggggagcaaaaaacaagttttgatgtggatgccaacaaagctctacctaatacattagaaagctccagataacataaacgatacatatcaaaggagtgtcccccctgcgcaactgtgcccttgatggcgaaccgcgaataacttccctggcactcaagaaaatgtttgcgggcaaaaaaaccaggga

SEQ ID NO: 42269 - DNA, 286 bp, Triticum aestivum
  Clone ID: PAT_TA_42269
acgagcggtaagccactgcactacaagggcagctcgttccaccgtgtgatccccgacttcatgtgggagggcggctacttcaccaagggcaacggtaccggcggctattctatctacggcgagaagttctccgacgagaagttcgtgcacaagcacacctagcccgggatcctctttatggccaacgcggtccccaacaccaacggctcccagttgtatatctgcaccgtcccctgcaattggctggacggcaagcacgtggtcttcggcgaggtcgtcaagggca

SEQ ID NO: 42270 - DNA, 303 bp, Triticum aestivum
  Clone ID: PAT_TA_42270
ccaagtgcgacccccgccacgggaagtacatggcctgctgtctcatgtacgcgtgtggggttgtgcgggaggacgtcaactctactttgtccaccatcaataccaagcgctctatttagtttgttgattggttctccactggcttaaagtgtggtatcaactaccatcctccaggagttgttccaggcgtttaccttgttaaggatcatttggtctgtgtcatgatcttcatctcctcctgtgttgtctgggtcttcttctgcattgaccactattttgactctatgtactccaagtgtgcct

SEQ ID NO: 42271 - DNA, 403 bp, Triticum aestivum
  Clone ID: PAT_TA_42271
cccacgcgtccgtgtcatccgtggcaagaagggagcctgaggcatcaccatcaaaaagggggggggggctctggtggttggcgcctacaaagagcccatcacccctgggcagtgcaacattgtggtggaaaggctcggctactacctagctgaacaaggcatgtatgtcaccccatcaatataacggctgacacgatgatgattagatcacacaattttaaagtatctctttttaatatttactgaaatatatgtggaccttttgtattcctcttcaagcgggtttggcatacatcggttattatgaccagagtgtcttatcaagtttcattttttatgccttaacttcttttccttcttcttcagcgaggaccttaatttttagttgtgtgttatgaattgc

SEQ ID NO: 42272 - DNA, 382 bp, Triticum aestivum
  Clone ID: PAT_TA_42272
ccgacgcgtgggcggacgcatgagactcggtgcttccatgtattccgatcgcactaagggaacggcggctttataacgaggcataagatatgaaggacttccttgtattgttaaaccaaacaataagcacgcttaattcttcatcaagtgtcatactggaggatgtctttcctactattgcaagtcaaatgtctgagatattgaaacaagatgccttttttgactgatcctgcacgcattaccgaggaaatgcgagaactgtaagagctgtatagaacattatacacattcctccatggaatggagacacatgatttgtttgcagttctgcgtgctcctacctgtaggtaggtttttgaaaccataatgttatttacttttg

SEQ ID NO: 42273 - DNA, 406 bp, Triticum aestivum
  Clone ID: PAT_TA_42273
cccacgcgtccggcgaaccacagaacccgacgcgaggcgtggctcgccgcgagatggtggcacttttacattagcgatgctagtttgtgtcttgttatcttttgaaaatggtgaagctgacaatgatagcccgtataactgacggccttccattggcggaggggttagatgatggttgagatctgaaggatgctgacttctacaagcagcaagcaaaactgttgttcaaaaacttatctaaaggccagcacgaatcatcaaggctgtcaattcagactggacctacaccactgtgtgcagtggcggagtgtgacaagaaaggaaggaggggccgagagagaacggaaaatgatctagactagtggagaattttttgggacaagaagaaccgtcggatttttttaac

SEQ ID NO: 42274 - DNA, 281 bp, Triticum aestivum
  Clone ID: PAT_TA_42274
ctcaaaggcgagccgtcacgacgactgccttatgtactgctacatatgctggggcgagggcaactgcgtgccgtcgcataccactcactacaaggacgattgcccagttctacctcatacatgaccaccggtctttgagcgcgcacgaggctcaagtgcccattatccatgcaccacccatggtagctacatgtggtatatacctaactcaactggaagatgccctatcatgtacttttcttatttccatgttcgtggtacacttctatattacatgcttg

SEQ ID NO: 42275 - DNA, 208 bp, Triticum aestivum
  Clone ID: PAT_TA_42275
cgctatcgagcactgaccataagaaggggcttaagcactgtattcataaacggtggccggcgcacagaacgtgagcattactcatttatcattgttttcaccgttattttatgcggatgtgtatgctctcctagtctagcctagcgtaagatgatataagcctttcattctgtgttataagataataggatggatgctgcatgttatt

SEQ ID NO: 42276 - DNA, 136 bp, Triticum aestivum
  Clone ID: PAT_TA_42276
tcgttcttccataatctaacaatatatgtgcatgactcactgacgttacacaacttcttgatcttaataactcatgtgttaaccaacttaatcttcttgcatcacattttcctttcgacagctgtcattatatcta

SEQ ID NO: 42277 - DNA, 438 bp, Triticum aestivum
  Clone ID: PAT_TA_42277
ggacgacaacattagactgataagtgcttggttgaataactccatagactccattgatggaaacaacaaaaagggagaggtgtattggaagaatgtcacggaggactacaataaaaacagtccacccacccggaggagaaacagtaaaaactgcaaggaccattggggtaaaactaataggaaagttgtagcttttcatggagtttactgcaggctaaaagatgcctatgcaagtgggcaatgcgacttacagcttgtccagaaagccttggccatgtacaagaaggagaagaatcaaaacttcacactattgtactggtgggagaaggttagggtccaccagaagtggagtaggcactccgaggagggtaaaggcaaaggtaatggtacaatacaaacccagatggaaaaagaaactcgccccgatggaaccaaact

SEQ ID NO: 42278 - DNA, 369 bp, Triticum aestivum
  Clone ID: PAT_TA_42278
gggttcttctgaagcaacacactgtacttatacctgtagaagaacaacattagtgatgaaagctcttagtttccccaggcacactcggatatgtattgctataggtgaaatctatgatggtaaaaagattaactgcatcgaatacaaagttccctaacatagcgtatgtgcacaaggatgcctttatctgatggtgaactacaccttttccaaaaaatactcaacccaaatggaagccctggactatcttgtttctggcataggtgaaggttttattccctgttctgaaggaaacatggctaaagttggtcaaggacaccacatgcctgtctatttatgaccttcctgatatgaaaatcggtttttttt

SEQ ID NO: 42279 - DNA, 109 bp, Triticum aestivum
  Clone ID: PAT_TA_42279
aaacattagaagtccccactgttttctccatgtactccgtggccgtcagtccactacctggggtaggcatacacgtttggcgccccactccaaacctttgaactccatt

SEQ ID NO: 42280 - DNA, 271 bp, Triticum aestivum
  Clone ID: PAT_TA_42280
aaaaaaactctgttcttcttcaaatatacaaacatttttcagaaggaataaattggcatggcaatagcaggaacacggtggatacatagatagaagctactcacgaaaacaataacagtcgttgattttgttggatcaatgttgaagcagcacaaacgcatacagtgcttaattaggcgctcacacggtcacgtctcctttccgttcgtacgcacgtatcgatgattgccgtacgtgcgcgagatcgacgaggcagcagaggcgggcatac

SEQ ID NO: 42281 - DNA, 253 bp, Triticum aestivum
  Clone ID: PAT_TA_42281
ccaaaaaaaagcctcctaaaaaataaaaaacatgttttttttaaaggggggaaaaaattccaacaagtgtacgttgttggtaataataaaaaagcccgtttaaattcattctctcttcctatatctcacgtgtctttgaaaaaaatataattttttttgggggggggagagacaagaaaaatcaatatgttctcctcccatctctctgaattactcaattccaacaattgccataggtcaataattttttttt

SEQ ID NO: 42282 - DNA, 335 bp, Triticum aestivum
  Clone ID: PAT_TA_42282
ttttggatgggaggacctccactgaatattaatgatttcaaaagagtatcatgaatactaattgacgacgatcataccgatctccagcttattattacatctgcgaattcaataactgcaagacacgtcattccaatttaactatcctctcgattcacgatctagaaacaaaagctaagctcctagcatgccggagacggatgtacttctgatctagttgggggcgaagaagatctcggagtcgagcctcttggagcggaacagcttctccatctccggggtggtgttgaacgccgtctctagcactgccggggaaattgccttccacaccgacg

SEQ ID NO: 42283 - DNA, 131 bp, Triticum aestivum
  Clone ID: PAT_TA_42283
acgtctcctataaccactgagcttactggctctcccccttcgccctcaccggggtcggggttatcctataccacatccccttcatcatccaacctccccacaagcatctccccaccaacgactactacaaa

SEQ ID NO: 42284 - DNA, 136 bp, Triticum aestivum
  unsure (1)..(136): unsure at all n locations
  Clone ID: PAT_TA_42284
cccacgcgaccggaagaaggccngnaagggcagcgagcncaccgcngacancaagcacagggggccggacggggagaaganccggcgccncgancgccagnccaaangccnccaggacaagaggaccgccaaggag

SEQ ID NO: 42285 - DNA, 328 bp, Triticum aestivum
  unsure (1)..(328): unsure at all n locations
  Clone ID: PAT_TA_42285
cccacgcgnccgcggacgcgggggaggagcccgcancccnncggcgcaccncgcggagaccggcancgncgccncccccaaggccaccggcgcngananncaaaccanggnccnnnnaagaggagaggcgnngaggagaaggcagacgccgncgcccaggcgcggancgncacggccgccaacgcccagcaccgccncccncgccgnagagcaacgacgacaccaagcgaggcacngncgacaccccgccgnccccccccggagacaacnnccgccaccaccgcgcagaaaccaancggcaacacgcccggaagcaagggacgcccag

SEQ ID NO: 42286 - DNA, 413 bp, Triticum aestivum
  unsure (1)..(413): unsure at all n locations
  Clone ID: PAT_TA_42286
aacaccgaagaagagaggagacgagaaaggggancgccgccgccgccgccgccgncgcccaggangacgncnangcngnccgcgnncncgncgnggnncgngaacccgcgccgcaacccgcnggcccgcanccacaggcccaccancgccaaccgccncaagaaccacggccggaggnacgacgaccngnangaccccnacnncgancgggacancaaggaggcgcncngcaggcggccccgggagggggncgacgcccgccaccagcgncncaagcgcgccanggaccnnnncaggaagcaccagaaccgccccgacgacgnccgggcaccacagacaccanncaaaagcnnagggagcgacaggcnggcncnggagaaaaaggaggcagcagagccgaaagcaccgggagc

SEQ ID NO: 42287 - DNA, 280 bp, Triticum aestivum
  unsure (1)..(280): unsure at all n locations
  Clone ID: PAT_TA_42287
ggagaccaagctcttccaaaacttaggatgagcacaattgcaatgatattaagagcgcaagtccatcctggaggaattacaatgccaagtactactattacatttgatgttcgctgagatatcaaggcacgagtgatctgtaatgcatgaacataagtactgacccgtacttnancatcgaatatgctatgtataatcttaggggcactgtcaacttaccaaaatgcaaacaattttcagcccaagttttgaagtatcaaagatcaatttttcatgatgt

SEQ ID NO: 42288 - DNA, 208 bp, Triticum aestivum
  Clone ID: PAT_TA_42288
gacaaaatcgataggtcaaagggttttggaatccttgcatagagtaaagtaggcaatctatcagatatctaactctcattaccaacaggaactctgtatagaatcataggagtttatgatgtaaaatccatgtccagctagcaataatcagaaccaaagaatagtgtatactgcatcagaaattcagaatagctctttgtttttcatg

SEQ ID NO: 42289 - DNA, 249 bp, Triticum aestivum
  unsure (1)..(249): unsure at all n locations
  Clone ID: PAT_TA_42289
gaaaaccaaaagaggctgggttcttacagttgaaaaatgcaggcctaacatcgcggatacagacgttacaaaacagtttacaaatcggctgagcatctgaatcattttcatggtctaagtctaaaggaagggcaaaactaacacctatatgaacctaaagcaaagtgacagtcactagacgcagcanacagagacatgcagattgtacagctacagcatgccggcgctgatcattaagtacttgataag

SEQ ID NO: 42290 - DNA, 354 bp, Triticum aestivum
  unsure (1)..(354): unsure at all n locations
  Clone ID: PAT_TA_42290
cccacgcgtccgtacggaagtgctgcgcgagagccgactggccggggaacagaagggctccgaggcaataatggaggcggcgtcggcggagacggcgacgatggtgttcgtgtacggcaccctgaagcgcgggtttcccaatcacccccgcctggccgtcttcgactgccccttcgccggcgcggccaccaccgccgccccagcctccctcgtcatcgggccctactccgttcccttcctcctacctgccccgactccgtcctccggccgtctggtctccggcgagctctactccgcgtctcccancnccctcgccgacctctacttgctagagggcactcacctcggcgtcta

SEQ ID NO: 42291 - DNA, 325 bp, Triticum aestivum
  Clone ID: PAT_TA_42291
cttcctcaggttgagggaatacagggaattatgtcagcttataccagtgcgctacgcaatgtgtcattggctggtcctacactctttggtcctctacttagcaccgttacagcaatagcaggccattcctttacaagcaaccaacaaaaatacttaatttggtaataaggaccggtggtgtaatgactgattttcaagagactattggtgccatcattaaggcattccaattttctttggccataaatggtggtggaggtggtggggctgactctaaaggaatggagattctggatccaaataaagggggaagattggaaagctc

SEQ ID NO: 42292 - DNA, 469 bp, Triticum aestivum
  unsure (1)..(469): unsure at all n locations
  Clone ID: PAT_TA_42292
aaaatcttcacgtaaagctggatctggaaaaatcattagagacagaaggggtcgcgggcaacgttgatggctgatgggattaggagcatggatgtatgttccaacgtattcatccagaggacccaatctttaatatttctcctagtcgatttataatatagtcagattttttatcatcatggattaggaccatgttccaaggcgttcatctagccgatacatcaaccatgcatctanaaaaacacatccgtcgtgtaagattgcgatgcgcaacgaccaccaatataagattgttatggtgcnnngacggtgacaacgatttacggctgcacacgccgacgagcgactactctatgaggtagcagagacgactacatactactgcacatctcggatggctcaccggcgaagcgagcggcggctgcgtcacaatactgtttatggccgacatgtgactgctccagcacgg

SEQ ID NO: 42293 - DNA, 342 bp, Triticum aestivum
  unsure (1)..(342): unsure at all n locations
  Clone ID: PAT_TA_42293
cggacgcgtgggcccacgcgtccggttggttgctccagcagttacagatgctgttgtcagaggaaaaaggcaggctgatcagttggttactccagtcattacagatgctgttgtcagaggaaaaaggcaagctaatcagttggttactccagtcattacagaagctattggcaatagaagaacacggcagaccagtcagccggttgccccantcattacagaagctattggcaacanggcaacccaagtcaatcagtttgttgctccagtcgttacattgccaagacaacaattacaaaacaatnnncaacagaagcttagcatgataactctgcccacaag

SEQ ID NO: 42294 - DNA, 456 bp, Triticum aestivum
  Clone ID: PAT_TA_42294
cccacgcgtccgcccacgcgtccgcccacgcgtccgcgcaactgcacaacagaccgaagaaacgcacagccgcaaagagaccagacccaaccgcatcggcccggcggcgcaggggtttccttccttccacgatccacggtcgcggcgaggcgatggacgccgaccacgccggcggctaccgcgacttctcctcccgcttcgccgccccgcccgcctccgccaagtcctccatggacctcggcggccgcgacgcgccgccgctcttccacccgccgcccgccgacggggccccacgggcctgaccgctcctccgccccctcggatcgcgccacaggaaaaggaaaggtatcgctcgacggtggtggtcaaacttcaaagcgtggcaaaaagacggtggccttttctcggatggttcggctccataggacgggatgcggattgggatcgtttctttct

SEQ ID NO: 42295 - DNA, 464 bp, Triticum aestivum
  unsure (1)..(464): unsure at all n locations
  Clone ID: PAT_TA_42295
caaccttggaagatgaaaaggcaacaccatacaaatctgagaagctacagtaactctccttcttcccaaggctttattaccatcaaataaatcttgcaaagccttttatttcattgctgttgagaatcattaagaactctgcaacattgccaccagcccatagagttcattctattcttttgcatgtcatagttgaattatgacccacaaggtctatccagtctaccaagtaggctngacatgcgagtgctagatccctcctatccccttggtcatggtttttcatgggtttgattgggtgaaaataattgctatttggcagaaatgactcgacagttattgacatgggccctcctgctgattgggtgaagataaatgttaggagaactaaagattgctatgaagtctatgcattggttcctggccttcttcgtgaagaggtacatgttcagtcagatcccgct

SEQ ID NO: 42296 - DNA, 471 bp, Triticum aestivum
  unsure (1)..(471): unsure at all n locations
  Clone ID: PAT_TA_42296
ctcctccaatccttcaccgtgcaattttcaggccatttggggccttcatatggggccctttgtctcctccctacctcctagcgcggcacgcttataactaaaaatctatcgcgtcgccctctccatctcctctaagaaatgaagtcgtatagtcttcagcgtagggctccaccggcggaagacggcgcgccagtgctccggcggagcgcgagcgcgaagcaggcgtcctccccgtcgccgctcagcgtctcctcctcctcctcccagtaccagtcggcgcgcgcctcgacgtccacggccaacgcgcctgccttcgcgcgccacaaggcgccgtccatcaactgcatggcggccagctccaccgacacgccgncggccacccccaggggcaccaagcagcagaagcccaagtcggcgtcgtactcggtcgtgttctccccgaggaagctcatgcagcgggcctcccgcgcc

SEQ ID NO: 42297 - DNA, 466 bp, Triticum aestivum
  Clone ID: PAT_TA_42297
cccacgcgtccgacagtttcttccattatatcaattaaatagcacgctgcctctgtaataggattaagtactattcctagccttacttatagaactttgtgtaactataggtattttctgttttcctctaaaatagatttatatttcaaggaagcagattcataagtaaaatcatagtattacaggcagaacatgttcttgcaaaacatcaacatgaaagaggtttgctgatggttctaggtctgatgctcttagggaccatgagtatgtccttacctatgaagacaaggatgctgactggatgctcgttggcgatcttcctccggattcaacaagttgtgtctcaatcttgtaagttctgtcacaaggatgagattgttagaatggtacaaaacttttacgtgatagcagttgttccagtcaactaggatgtctacatgatgtttcttgggttcatagcaacaaa

SEQ ID NO: 42298 - DNA, 445 bp, Triticum aestivum
  unsure (1)..(445): unsure at all n locations
  Clone ID: PAT_TA_42298
tctgcttctccgacgacgagcgacggcggcgcgggcgacacaccagcgagcggagcggcggggactccgcgcggaccgcgaccagattcgtcgacgccatgtcgtcgttcgccggcgtcgatctgtgccccccttgcgccgggtcggcctgcgaaaccagcgcggactgcgggtaccacctgctcgtggtccaggactactcgcgcgccaaggagaaggcgcctaccgggnagagcatcatctcccggcccttcagggtcggatgccacacgtggcagatcgagctcttccccaacggcaacaacccgagctgcgccgacttcgtctctctctacgtctgccgtctcgacgactatctcaacaatgccgtggatgccaagttcagtctcagtttcgtcgaccaggccgagaagcagaagccggtgtacattcttgggaccgagac

SEQ ID NO: 42299 - DNA, 278 bp, Triticum aestivum
  unsure (1)..(278): unsure at all n locations
  Clone ID: PAT_TA_42299
agggggcctccgtctaatcgtcctccctgtcgatttgctccccccccacacacgcggaacagagagaaaaaccatacccaccaccccctagcgcgcctcgccgcgccagtcaatcaaccatccagccagccaaccaatcacccccatccccctccccatctcgcgtggattaatggatctccgccccgccccgctcttcctctaactnctgcttctgctgctcgctactccgcagaccgccacgccgactcgcggagccgcgccgacggacatggggc

SEQ ID NO: 42300 - DNA, 284 bp, Triticum aestivum
  unsure (1)..(284): unsure at all n locations
  Clone ID: PAT_TA_42300
atgaaaagtnaccgacttcagggagtgccagcacagccaaatcaccggtacgagcaacagcggcaccatttgccggttctgcggctccaagctacagtagtagccgccgggccaccaagaagcagatggagctgcagcatgagccgctctgcggccaanctgcagcgtcagccaccaagatggagcccaaagtgtcgccgtccgcctacaccanntgggttctcacttatgtacgagtgnannggggaaaggaacgggatgaggactatgaactgatggtggat

SEQ ID NO: 42301 - DNA, 315 bp, Triticum aestivum
  unsure (1)..(315): unsure at all n locations
  Clone ID: PAT_TA_42301
atgcagcagccaaccagtgatgacaattggttctgcaaggacgatcatcatcaaatttgtttattcgtctattttctgcagaaaatgttgatcaacctatctccactatactgcatcaacgcactgtttacattcttcagatcatctccacgcgaccaaactgtacccgnccctgagaaccagctagagcgtgatgtactcattgggatcaagggatcccacgaggcatttctccaagaggaactctgcgttcacccaggcatggtatgtatatgacaaagcagtgcagattttttccagcacccttcataagca

SEQ ID NO: 42302 - DNA, 658 bp, Triticum aestivum
  unsure (1)..(658): unsure at all n locations
  Clone ID: PAT_TA_42302
cgnntccgctttgctttaagaagnngataaagnngcgccacttctggtattctccttaatgtgcanngcattcnaaaaaattgtggagtgccattctaancnagaggagaaggcgctgnnttgcgagnanngaagttaccacgatcnnaaagannaataaaccatannggggaagggcgttgtatcnncctcgacctaattcnnaatgttcncnntggtgatacggcncnntgtaagaacgaaccctaagnncagaagtatttctgaccganggtganntcgtacctcncnaagaaaggacnnctgtattttcagggaagccaaaccatgcctccannnatttcgannaatggnngataaaccacccatacttgnnngtcgagacatntnnctgaacgataananngcagatctttcaagaagaacgatgananntctgataattctccaagaaactgtnntgtggataaacannatcgcaggtgcacaagttcttaacaatgatnngttgttttgaccgaacggtgaaggcctctttactgcaagnnggagaccccannacttcaatcattaaaatttccaagacnccatgttcttgaacccagaagagcacantgccaagtgaatcaacccaatttaccgaagaggccaaataatg

SEQ ID NO: 42303 - DNA, 444 bp, Triticum aestivum
  Clone ID: PAT_TA_42303
gcgtccgctcccaagcagttcgtcacctcaaccccgagtcctctatccccacccgccagccatgatgggccgtactaagcaggggggggggcagtccaccggttgcaaggcgccgcggaagcagctcgcgaccaaggcggcgcgcaagtccgtcccggccaccggcggcgtgaagaagccgcaccgcttccgccccggcaccgtcgcgctccgggagatccgcaagtaccagaagagcaccgagctgctcatcctcaagctgccttttcagcgcctggtgctggagatcgcgcaggacttcaagaccgacctccgctttcagagctccgccgtctccgcgcttcaggaggccgccgaggcctaccttctggggctgttcaaagacaccaacctctacgccatccactccaagctctttaccatcatgcccaaggacatccatct

SEQ ID NO: 42304 - DNA, 452 bp, Triticum aestivum
  Clone ID: PAT_TA_42304
cggacacgttttctaaaatcacaagccactttctgtcggctcaacctcctccaccgggcgtcatattaccggggtatcgggccgtcaataaactcatttcttcccccgacccgccctccctaccccaccaacagagccccaaaccgggttcccctctacttctactcctccccccaccccacccagcccaccttcgtagaaccacaagcgcatacagattctaaccggataactctatctgataacataagctttcttatctcggcctaatggccgatgaaaacgtgactcttcacacgattacgacctccttccgtggaccacaatctccgcgccatatctacactgtggctcaccgttatctcagaatccatcgtctacaacttgtccacacccttcattaataccaccgcaatcttatccacaccagactttatcctcagtccctaacc

SEQ ID NO: 42305 - DNA, 613 bp, Triticum aestivum
  unsure (1)..(613): unsure at all n locations
  Clone ID: PAT_TA_42305
cactggaagaaaaaggagctctgaagaaaatgtctgtgctgaacattcattgcctgagaaaagagcaaagggacctagaagcccagtaacatcacgaaaacaacttccttgtgtatcattgtcttctcgtatggcagaagaaagtcagagtgaggctcatgatagtgcacaatcattaagtgatgattggaacaaggtagtattcagcgtatctgattccatgaagcaaatgcatatacgcccagaatctattagtaagcttaacctacaacagcttgatatgttaggagatatgctggggaaggttcatgtggctagaacatataagaggcttcctgctgctgtgaggatgcaagatcccagactagctgaggcaatgactctccatggcaagctttcatatgaaaaggcaaaactgcaaataaatcgtgttaaacttgataaactgcgaaacaaagcacaactatgtcaagttggaattcaagaatgccgctatttgaaatccaagatttcacagcttcgtcgtcctacaatgggtgctgcacagatgaagggaggtcctctntatacagaaaacttgattaatacctgtgacagactggaaggaaatgct

SEQ ID NO: 42306 - DNA, 432 bp, Triticum aestivum
  Clone ID: PAT_TA_42306
cggacgcgtgggcccaaatctcctcagcctttttcgcatctcctccgacatggcccggagcaagcagacggcgagggagtgcaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatacgaaagctccccttccagtgcctagtccgcgagatcgcccaggacttcaagaccgacctgcgattacagtccttcggcgtgttcgccctgcaagaggccgccatggcctacctggtgggcctgtacgaggacaccaacctctgaggcatacacacacagcgcgggaccatgatgcccatggtcatgcagatcgc

SEQ ID NO: 42307 - DNA, 476 bp, Triticum aestivum
  Clone ID: PAT_TA_42307
cggacgcgtgggcggacgcgtaggctcccttatgcctatcctcttcctcgccacccgccgatcccaccgggcacggggtgcccgctaccgcctccgcctccgcctccgcatcccccacgtcgccaccgccgccggcgctgccaccgctccgggaaacagcttcgccgtcgaggactacctcgtcgccaactgccacctcacccagccgcaggccgtcaaggcctccaagaacctcgcccacctcaagtccacctccaaccccgacgccgtcctcgcattcctcgacggcctcggcttctcccccaaggaggtcgccgccgacgtcgcctccaacccgcgcatcctctgcgcccgcatcgagcgctccctcacgcccatctccgcggagctccgcgccctcagcctctccacctcccaagtcgcccacctcgccaagatcgccgacccctacttcctctaccacaacttcctctcca

SEQ ID NO: 42308 - DNA, 557 bp, Triticum aestivum
  unsure (1)..(557): unsure at all n locations
  Clone ID: PAT_TA_42308
cggacgcgtgggcgcgacttcctcaccctccctctcggcggcggcggcggcggcgacggagcctaagaaccggcggcggcgacggcgactcctctcgtcccaacggaatacttcgatttgccgaggcgagctgttcttgtcttctcacggcgtgggtgaactgcggaggcccctctcgagtctcgaagcaaacgcgcggggagaggcgccgagatgtttgcgacggcggcgcggtgggcggcgaagaaggggaagcccaagatggcgccgatcgagctgacgacggcgccggagcaggcgcagtccatcacccgcaccatcttcgacgtcgtcaaggagcacggccccctcaccatctncgacgtctgggagcatgtcaaggacgtagggctgaggggtttgacaagcaagaggcagatgaagatcatgctgcggtggatgagggagaagcagaagctcaggcttatctgcgaccatgacggaccacacaaacagttcctctacacgacatggttcaccaaccccaagaacgccccgcaaaggcccaagagggagct

SEQ ID NO: 42309 - DNA, 216 bp, Triticum aestivum
  unsure (1)..(216): unsure at all n locations
  Clone ID: PAT_TA_42309
cggactcgtgtgctaaaaccacgagccactgttcnttcggcgcagcctcctccacccgccatctcttaccgcggtatcgggccttcaataaactcatttcttcccccgccccgcccgcccgcccccaccaacatatccccaaaccggcttcccctctacttctactcctccccccacccaacccagcccacccttccataaccacaatctcacaca

SEQ ID NO: 42310 - DNA, 548 bp, Triticum aestivum
  Clone ID: PAT_TA_42310
cggacgcgtgggtctgaattgatttcctttgtgtttatgttactaatagtggtgagggcgagattcccacctgcgcaggcgggtggaaacatgggttcctcgcaagaatccacattttcatctgcctcaaccgccgcacaagtgaatgctttgggcttactacctgtctatgccaaggagcttattgctggtggtgcagctggtgcattcgcaaagactgccgtcgcgccacttgagagggtaaagatcttattgcagacaagaacccaagggtttcaatcccttgggattgtccaatccttgaggaagctgtggcaatacgagggaattcgaggtttctacaaaggaaatggtgcgagtgtgcttcggattgttccatatgcagcattgcattacatgacatatgagcagtataggtgctggatactgaataatgcgccatcagtgggtacaggacctgtggttgatctgttcgctggctcaactgctggcggaactgcagttctgtgtacctaccctttagacttggctaggaccaaacttgcata

SEQ ID NO: 42311 - DNA, 532 bp, Triticum aestivum
  Clone ID: PAT_TA_42311
agaatttatgacctggaggctcataataaaagggaaacatttctttgttccaaagctaaggcaggacgatcaattcaaattaagttagatacagagagtagagttagacaacaaaatcaagccagagcgccagtgagagataaggaacctatacagttcaactaaagcatactatttgataacttcacttgactgtcttgtcgttcaacttctcacatggcacgtcacatgaacctgctgtgagtttttagtttaaccaatcaagccatagaaaaaaatcatggataatacgattatgttcttttaattgaccgcttgttgatagtgagcgatggtttgccccatagtttgcagcatattggtcctatgcgtaagagtggagtttaacatgcgaagaacaatctcttattacggtcctctcacaaagacatggttcgctacatggagctcggccccttgtctttttggcacgttggcgtttatggcggcgcttacctccggagcgaaccaatgtactcttccctggattgct

SEQ ID NO: 42312 - DNA, 611 bp, Triticum aestivum
  Clone ID: PAT_TA_42312
cggacgcgtgggttcagctgtccaaggacctttttcaagaaaaacaatgcaggctcggtgtgttaaatataatttccagagcatggactacagaaatcatctgtcctgcagcatatgactactattatccagccagtactggaaaagggtattgttgagtattccatagtacacatggtcatatcggagtacttaacaattgcggataagctttggatgtgattcgtcagttaatcccccatcttatccaagggtcatctgtcctagatgaagatgtgattggtcaattaatcccccatcttacaccaacgaaatcaaaagcgcagaagaaaagatcaaaagcgaagaagaaaagatcttcagaactacttctcattcggatcatgcagacgaaggaaggattaaaattagggcttgcttgcctcaagcatggccttgagaaggataggaagaggattatcaaaagcttgaaggggcatattaggaagcttgctctcaatgattatggatgccttttcgttatttgtcgtctctccattgttgataacacagaacttattactgaggttgtagttgatgagctgacaaagcacttaaaggaactcatattt

SEQ ID NO: 42313 - DNA, 543 bp, Triticum aestivum
  Clone ID: PAT_TA_42313
cggacgcgtgggtttttgcgcaaaatagctttctatcgctcgatttatcattacaatcggggcatcatcgtctccaagggggaatagccatcagtgcgcagcatcactgttttaattcttaggggcggaaacaaaaatgtatgccaacttttgatttgtttgtgaattctagttaacactacgcagtatacgatattgccaccaatatgaaatcctcacttccagctttcccccagaaaacaagtcttcactttcagctttcctcaaaggaaaaattttccccttcaagcctccttcggtcaaaaggccgtccgcagcagcgatgatgaacttgccaggctgaacccaccatggctgttggttgatgtatgctgaaccttgcaatgttggtttagtttcattcagaagcagggacatgtcttctaacttatagttgtccgcaccgaatccgatcggtccggactgctgtgcgccgcggcctgttggctgcactcctcgacaaccctcgtcggtgtcctagccttgagcatcatctcggcatac

SEQ ID NO: 42314 - DNA, 629 bp, Triticum aestivum
  Clone ID: PAT_TA_42314
ttctccagagtacttaacagttaaacataatgtccaaattagtaggttaaggacgggtggataatcctcaatttgaaatgtagaacgttggactgaaaataataatatctacggttgttccatttatcgtcacaatacacattcattcagtgaaaagttgatggacagtgagctctttttataattgtgaagattatacaattaccaattcctataacaaatgtattgtattataatttaccagttctagacacacccttctgagttctgaccgttagttcgagatatggatggagccattaggaaacccaattcatgagcatacattatataatatatatgtgtgcattggtgaaaagaagagaaaaaacaaattagccaatgtaacatatgggcaagtagaatctaatcacaatagtaagggacagaaagttgtacaacctgaaatacctgtctgagtggcacatatagtaagcctagatttctttttcttctccttattctactgtatgcggatgtcaatgggtacagtacatccatagtactactagtgctactgtaatatatataaggtgggtaggaataagaatagaatgccaaagaatatgatatggtttttacttattttt

SEQ ID NO: 42315 - DNA, 534 bp, Triticum aestivum
  Clone ID: PAT_TA_42315
ggggaacaaaagtactggcgataactttgattttgttcccaacatagatcatacccgggcatttgtaaggaaggatagggagtgaatggctgatctggcttcgggaaaccattggttttcaagatttccgctttgatttcacaaaaggttatgcttcgaagtttgtgaaagaatacattgaggaatcaaagcctctttttgcagtgggggaatactgggacagctgtgaatatgccccccctgacaaccgtctgagctacaatcaggataaacacaggcagagaattatcaattggatagatagcactggaggactttgcgctgcgtttgatttcacaacgaagggtattcttcaggaggctgtgaaaggagagttgtggcgtttgcgcgaccctgaagaaaagccgcctggtgtgatggggtggtggccttcaagatcagttacatttattgaaaatcatgacacaaggtcaactcaaggccattggccatttccatctgaccatgtcatggagggatatgcttatatactca

SEQ ID NO: 42316 - DNA, 614 bp, Triticum aestivum
  unsure (1)..(614): unsure at all n locations
  Clone ID: PAT_TA_42316
cccacgcgtccgggtttaccgagctttactttttgtcaacccaagcccatacatgggggagtgttcatgcgaggggttgggtcctggtancatctagtcctgaaattcttacaaaagtcgagaagggaaaggttattaaccggccacttgctgggactacacgaaggggcaagacagagcatgaagataaattgcaagaggaacaactattaagtgatcaaaagcaatgtgccgaacacattatgcttgtagacttgggaaggaatgatgttggcaaggtatccaaatctgggtctgtaaaggtggagaagttgatgaacatcaagcggtactcccatgtcatgcacatcagctccacggtcagtggaaagttagataatcgcctttaaagctgggatgcactgcgagcaacattgcctgttgaaacattcaagggggccccaaaagtaaaagccatggagctaatatatcagttttaagtcacaagacgaggaccatacattggtggcttaagagggatattattgtatggtgacatgcttatcggtctttctcttcggaccatttgattcttaacaacttccaaccacaatacaatttacctcatacaaaaa

SEQ ID NO: 42317 - DNA, 611 bp, Triticum aestivum
  unsure (1)..(611): unsure at all n locations
  Clone ID: PAT_TA_42317
ctgtaaactgcaatgctcgcttgcaaaaacaatgtataaatacataaatacgcaatggtggggagatcataacttattgcggtggtttgactgcagctgattgttgctgtggggtcaatattaatttaactcggtgtttttgccggccattgtttggattagcagtacataaccattgtgaattacaaaaactgttctgaatttactcttccactgacctggctctgatgggaggcctcttgaccctctgctaccaggggcgaggtgtgagtgacgtanggagaagtaggtagtacggagctgcaaggtactgttactctgatcacatagctgattacttatcagtgtttatagtttataacgcaattgttcctccagttaagacttaagagtaaggaagctggtatccttggtatgtggtaagatttcttggtttgagtaaggcgtgacaataatttttatttcctttcatttctagtagctaagtaagtccacatgataatggtaggcagggaaccccagntaggtatgtattcatttcttttgacaagttgcttataagtaccaaagtacgacaatgatcatagcatagaatgattttatcagcaatg

SEQ ID NO: 42318 - DNA, 337 bp, Triticum aestivum
  unsure (1)..(337): unsure at all n locations
  Clone ID: PAT_TA_42318
cctcccctgccccgggaaccggccgtcgtgctcttaccggtcccaaatccggtcgccgaggcgctctctccccgggatgcggctgccgcgccnccaccgcccccggatccggccgctgcgccacccccgtccatgaatccgaccggcgcgccgccttttcccccggatccaatctcgccgcctgtctccctgcgcgtcgtcggcgttgaccagctgagcgctgcctccacgccaagatccatgctcgaggtccaccacctgttcgcgtctgatctcccttgctcctccccccgaattcttctctgtcctctatcgccgaaagccacccactttgagc

SEQ ID NO: 42319 - DNA, 554 bp, Triticum aestivum
  unsure (1)..(554): unsure at all n locations
  Clone ID: PAT_TA_42319
cggcgncacgcaagcggacggagaaggcnagtttttcctctaatcccccaacccatacgggggcgcctgcgggggagccggcgggatctctcaaattcctaccgccagccgcccgtaccgacctcgatctctcctccgaggtacttagggcctaataattgggaagttggtgcaggcaatctcttgcagaacctatggacagttctaaatctccccaaccattgaagaagagccgtactagtttgtctggtacggatggccaccaatttgagaatgacgagcttcaggctgaaactgcatcagataaaacacctggtttgaagtttgaaacaggagataaagcgcaagatgaatttggagaagacagtgccccattgcagcaatcagctgcttccaatgtggcataccggggatcggcatgtattggggcatgcactatccaatgtgctaggtgcttgaaatggagactcattccaacgaaagagaagtataaagaaatacgcgagcatatgatacaggaaccttttgaactgcaaaaagcccgtgaatggaaa

SEQ ID NO: 42320 - DNA, 560 bp, Triticum aestivum
  unsure (1)..(560): unsure at all n locations
  Clone ID: PAT_TA_42320
ccacgcgtccgggaattgctgaaagcagagttcgggccttttttttaactccaggaagtacatacaaacgaggataatgataggggcagcgggggttcctcaaanacctnattcatctgtcaaaccatctactccagtacgacgtatgaagcccgtcgatagtccttccacaaatttaaaaacagcagaacgcagtttcggacagcgggacatccaattattatctcgtacagggatggctattaattcttcgatcactaaaaaagctccgcctacagagtcggtagctgtaaaagatatttacactacatcacaggctgtttctgtgcctgttgttgttcctagagacattttggaggacaaatcagcaggcagtattcatagaggaattggaggcagaactgcattcccagatgatttttacagtccagtgcacttgagaaaacgtttacctagtggcggtactagtgatagtgtcagctcaataaaatccatgctcacttaacctgatgtttgctcagacggtttatctggattaaagttctcctttgaaactaact

SEQ ID NO: 42321 - DNA, 590 bp, Triticum aestivum
  unsure (1)..(590): unsure at all n locations
  Clone ID: PAT_TA_42321
accggnccgaattcccggtcgcgggcgcgtccgcggacgcgtgggcgccgagtgcctcctcgtccttttccccggccacgcatccggttccggggcgatggacgccgacgacggggccgccacgtcctccgaaccgcccacctccgaagccgacttcttcgacgtcccagatgccctccccactccccctccccctccctcaccccacaccccgtcctcctccaccctccggcgccggccgcgccgggccaaaatcctgatgcagcccgacgaccccgtctccccctcggcttccggcgcatccatcgtcaccggggtcgatgagcccgacaaggacaaggacagggccaaggccaagcctgattccgattcctccggcaccggcaccgtcaccgcgggcgatgagcccgacaagggcaaggccaagcccgattccgattccgattccgattcctgcgagggcaccagcgcgccccgttccccccctcccctcgaggaggaggtggaccataaggatgcggagccggcggcccccgaggcgaatgtggactagaaggattctgagccggcggccccccaggcgaatgtgg

SEQ ID NO: 42322 - DNA, 207 bp, Triticum aestivum
  Clone ID: PAT_TA_42322
gaaaagaaacgcagccaaggggggtttttggcacgacgacggcaaaaaagggggggatcgaggggggcgggggggcatcccctacctctccggccgaggcggcggcgaggcagcgcacgtctgcacgcaccgggtggggcgggccgcgctccacacggaggaggtggagccccgccgctgcgaccgcaagtgcgagaaaaccgagca

SEQ ID NO: 42323 - DNA, 567 bp, Triticum aestivum
  unsure (1)..(567): unsure at all n locations
  Clone ID: PAT_TA_42323
cggacgcgtgggctgcggcccagacttggtggtcgagcagcagcgacctcgacgcggcgcgtgcgtggtagctgatgcacgacacagcgaccgcgaccaggacgcggtggcgggagaacgacnacggctgacaagacctggcgtgacggccatgaagatatcgactccgacgactcgcctccgttcaacagcgccctgcttttccgcatcgcctccggcaagcatcaccttcttttccgcgcgcacagcacctcggtcactagtaaaccgctgtatctctgtactctggtggcgggctggatttaggagctctgggatttggagaatgcacgggctggagctggggaatagctcgggcttccttcaaaagacgataggtcgtgtttggattttttttcgaagaattaatttgatttggatgagactaatcagtacgtcatgtgggcctccaatcgaaatttgtggtgggaactttccttccattcatcttctaatcagattttgatatttgtgccattgatttgagtgctgatgaagagctttttatggacagagagtcaaacatgc

SEQ ID NO: 42324 - DNA, 264 bp, Triticum aestivum
  unsure (1)..(264): unsure at all n locations
  Clone ID: PAT_TA_42324
cccacgcgtncgagcacacctcccaaccccaccctaatcattttttttctagcagcccttctacatcccgcgctattaattgagagggggagcctacgaccgacaccctcaccatattcccattttccatagtccacatctcaccaatttccacataaactaccaccgtttcatttgcatctaccgacatgcacatggtgacaactccacctcttcattccagctagccacccaatgcaaaggccgaaatctcaaattttttca

SEQ ID NO: 42325 - DNA, 311 bp, Triticum aestivum
  unsure (1)..(311): unsure at all n locations
  Clone ID: PAT_TA_42325
cggaaaacccgggggcgggccacgcgnncgcccacgcgnccgcggacgcgnggaccggattttttctacaaaccaagcgagaaagggggggggaatgagggagggaggggggggcaaaagccgnaacaaccnccnnagctaacnccaaagacanataaagagaagcaggcactggcggggcgacagaaggacaaacaagctgtcatgcgagggcaaagacctgatggagaaactctacagggggaattcgcgccaacggaggccactgaagcactatatgagtatagcggcggaagcataaaagcaaacag

SEQ ID NO: 42326 - DNA, 329 bp, Triticum aestivum
  Clone ID: PAT_TA_42326
ccacgcgtccgcccccgcttcacttaaaaacacccgagctttttcttcgatctcccataccattcccccgccacttttcgcgatggccggggcgaagtatactgtccgcaagtccaccggcggcaatgccccgttgaagcagctgacaaccaaggcggcgcgcaagtcagcccctgctaccggcggtgtgaaaaaacctcaccgcttccgcccgatcaccgtggcgctgctctagatccgcaagtaccagaagagcacggagctgctcatcctcaagctgcccttccaccgcctggtcctctagatctctcatgacttcaagaccgacc

SEQ ID NO: 42327 - DNA, 608 bp, Triticum aestivum
  Clone ID: PAT_TA_42327
gcagcggcggccgtctccaggatcaagaactttaaattttttcccctcctcttttctgggcgccggttcttgtgtgcgcggggccgctcacccgagaagaagggagggctcttgctgccgcttcgtccttgcatttgtgtgagagcgcttgtgagcgggggaggccatggcggatccggacgccgacgagagcccggacttgtggcagctcttctgccactacgaccggctctacttccgcggcgagctcgacgccgccgccttcgccgtcgagtgggcctacccgcgcatgaggacgaccacttgtttcggatcctgttcctttggagaccttaacaaaataatactctatgagccaatgctgcaatggcgcacaaatgctgatatgaagaatgccctgctgcatctgatgattcatgcaatcatatttgtaaagcatggtatgaagaacctcggccatggtcctgttttccgtgattggatggatgctatcaacacttgcactgctgaggatctcatgagaccgacgggtggctaaccgatcaccactacccatgatttcagtgaggaaaaatcctccacatccacgggattccatggaagtgtga

SEQ ID NO: 42328 - DNA, 179 bp, Triticum aestivum
  Clone ID: PAT_TA_42328
cgcaggccgaggctgctgccgcaacgggccattcggcgatcccggcgtcgagcaaggggggccgtttccccgtccgccgaggcaaggccagcgccggcaccaggtgcctggtcaaggccaaccatttaatcgcccagttgccggacaaggacctcaaccactaccatgtgtccatcacc

SEQ ID NO: 42329 - DNA, 458 bp, Triticum aestivum
  Clone ID: PAT_TA_42329
gtcttcttcttcgcctgatctcctcccgatccttctccaaatcagagacgtgatctcgagttccaccgctaaatcggcgatcaggtggcccgtgagagttgatacttctctcttgctctgctgtgttgcaggtagcgggtcgaaggcttcatcaactgaaacaaatggtctggaggaactcccagaggtttcggcgttcctggagaagctattccagcctcatactcagtgagcgtacacttggtttggacagaaaaactgaggaatggaaaacccatctcattgacaaagttgacaaaattcttacaaaccattatcacaatggggtgaaggtgaagacacttaaacttgatattggcccttgcagagatatcaaagcctcctacctcgacaggtggctccgaatcattaaacctgggatccaagaatttaacttgctgttgcctttagtcgtcaat

SEQ ID NO: 42330 - DNA, 299 bp, Triticum aestivum
  Clone ID: PAT_TA_42330
gaacggcctggtgatcgcattgaactcacatttcactgttgtttggaaggcagcggttggtgctcctatttttggtggtgcatgtatttcatatgcccttccttctcaggtcctgataccttcccgtgatggaagtttatactcctttgatattacatctggtgatcttctttggtcatatgacgtcggcaacccaattcctgcatctgcttttgttgatgaagtgttagcatcaaggccatctggagcatcaaatagatttgcttgtatctgcacaagttctgggaaggtccgtatcc

SEQ ID NO: 42331 - DNA, 414 bp, Triticum aestivum
  Clone ID: PAT_TA_42331
gctcgctcgcgttccgagaataaacttcgccaataaacaagcgcgcccattctctggcccttgggcgtctggatccgagagccggccgccaacagcaatggcgtccctcctggagatcttcgtgggatcctgttcctcctcggcgccgccggtggactgggaggcggaggcctacccggagtacgccgactacgccgtcctccccctgctcctcgccttcttccccgccctgcgccttctactcaaccagttcctcttcgaggtgttagcaagacgacttatatttggaaagggatatgacaagcttgttgaaacagatgaaaggagaaagaaaatcaataaatttaaaggaatcggcatgggaaattgtttattatctttctgcagaactcttttcactatctgtaacataca

SEQ ID NO: 42332 - DNA, 458 bp, Triticum aestivum
  Clone ID: PAT_TA_42332
ctcgccgtctcgccgccgtcaccaccgtagcttgataagagaaaaaaagagagaggggaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttcttctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtc

SEQ ID NO: 42333 - DNA, 353 bp, Triticum aestivum
  Clone ID: PAT_TA_42333
tcctcctcccactcccactccgcttccccttcttcttccgccgtccggcggactggtcctgtccgtctcgtgttggggcatgagatccggctctgactgcgacctgattctccttcttattctccccccctataaatctaaacaaataccctgtgtgaaagatccagatccaccatgtcgctcaaaggctaccacgaagcctcactgcatccgccggctgcgtatgatgcggcggcggcggcgactgtgtgggactggggggaagccctcctcgacaagttcgcctacatggtccacatgaaagaccaccaaataaaccatactttcgcccgctgtacattcaagaggtattt

SEQ ID NO: 42334 - DNA, 461 bp, Triticum aestivum
  Clone ID: PAT_TA_42334
cggacgcgtgggctctcccccgatccactcccgttgccgccgtcgccccatgccaggcgggggaacgaagagacagggcccggcgtggctgtcttgctcgccggcgcgcgcgtgcgtgcttcgatgcacggcgctccatcctgccgattccccatcgtctcccactgccgccaaccacatcttcgcctttgttctcccatagcacgccgccgagcttcccgctcccctcctcgcagctccacaactgccagatctgccgctctccgacccctacgtcctcgaggtcgactagatccgcccctcccgctatctgaagctcgccgcgaccccttgctcgtggctagggtttcggctgcggtgctgcgtccatcgacggtgcgtctcaggcggcacctttccgtcgcccaccccgggctccgcgcaagttcatccgctccggtacctcgaggagttcgcgcggg

SEQ ID NO: 42335 - DNA, 384 bp, Triticum aestivum
  Clone ID: PAT_TA_42335
cccactcgtacgcccacgcgtccgatttgcttctggcagtttgacatgcttgatgggctgattgctggcgagtcagggggctggtgtgctgatggttgcactgcaattgtcgactcaaggacctcactgctcgctggcccaacgaccatagtggctcaagtcaatcatgcaattggggctgaggggattatcagtacagaatgcaaggaagtagtgagagagtatggagagatgatccttgagttgcttgtagcacagacaaggccacagaaagtgtgcagtcagattggtctctgtgtattcgatggtcgttactctgtcagtaaccaaattgaatctgttgttgattagaaaagagaaacgagggttctgatcttcttttgc

SEQ ID NO: 42336 - DNA, 460 bp, Triticum aestivum
  Clone ID: PAT_TA_42336
gaaacttgctaagtcttccaaagactacgatgttgccattgagactttccagaaggctctgactgagcatagaaacccagatgccctgaaaagactaaatgatgctgaacgagcaaagaaggagctcgagcaacaagagtactatgatccaaaactagctgacgaggagcgagagaaaggtaatgagttctttaagcagcaaaaatacccagaagcagtgaagcattacactgaagcgctcaggagaaacccgaaggatccgaaggtttacagcaacagggctgcctgttacaccaagctgggtgccatgcctgaaggtctcaaggatgccgagaagtgcatcgagctagatcctacattctccaagggatacaccaggaagggcgcgatccagtttttcatgaaagaatacgacaaagcgatggaaacttatcaggaaggcctaaagcatgatccgagt

SEQ ID NO: 42337 - DNA, 447 bp, Triticum aestivum
  Clone ID: PAT_TA_42337
acaccctctgtcaactccaatgcgactttgtttatctcaacttcaaaacatgttcaggtcagaacttgacatggagggtgtactgatgatacccagccgaatgaagctctaagctatctcctcagttctcaggttagaaaacgattagttccatgtgtatttaacagcatgtccatgtatatttaacaccaagtccatgtattactacatgagaagtactgctagtgagacttcactactccattccaacaaacgtgtatatgcaatcctggtttgacaaagtactctgctactgctggtttcagttccctcactggatttgcaggctcacgaccatcctctaacaccccgtcagtgccaccgatttgaaggagctccatgactagtatctctgagttctaatgctcctaacgatcgtgtggaatcttatattcaatatcttgctga

SEQ ID NO: 42338 - DNA, 306 bp, Triticum aestivum
  Clone ID: PAT_TA_42338
cccccatcatggaccaagcaagggggattgactgcagcaaggcgaagaatgttgcggctaataagttcggcgggccaaggaagaaatccgtgaccaagtccatcaaggctgggctccagttccccgtcggccgcatcgggcgctacctcaagaagggccgctacgcccagcgcgtcggctccggcgcccccgtctacctcgccgccgtcctcgagtacctctcagccgaggtgctggatctggccgggaacgcctccaaggacaacaagaagacccggatcgtgcccaggcacctgctgctggcca

SEQ ID NO: 42339 - DNA, 238 bp, Triticum aestivum
  Clone ID: PAT_TA_42339
cccactcgttcgtccattctcttctagttgcttcgaatgctgctcatagtcccttgcatggggctctgctagttggtgagcggggtcctactccacgtacaagcccaggtacacgtcgcgtcgtgctgtatttgtcgctgaattgctcacctagcgatggacgtccccttttgtttgccctattctacgtcctagtccgggtgcttctcggcgtccctgaccgcgtagtcctagttcg

SEQ ID NO: 42340 - DNA, 380 bp, Triticum aestivum
  unsure (1)..(380): unsure at all n locations
  Clone ID: PAT_TA_42340
tcccttccgacccagcgtctaattaatcactttcttctcttacaaaaacttttttttttacataaatactcaatcataggtagagcatatcttattgcgtgggctgcactncaccttattcttcctattaactcaatattaatttaactccttgttatattcctccatcattttgattatcattacatatccatttttaattacaaaatcttgactgaatttactcttccactaaccttactctaataaaactcctttttaccctctcataccatctactatttttaaatcacctatttaaaattaattcttacttctcttcattatacttttactcttatcacatatcttactacatatcactaattatattttataac

SEQ ID NO: 42341 - DNA, 132 bp, Triticum aestivum
  Clone ID: PAT_TA_42341
cccccttggaccttcttgggagggtacgcgccgctggcgccaaggggcgtggcctggtcggcattgcaacggcgggccggaggcgggtgaccgccttcgtcgcgccaccccgcgcgttgtccggagagggcg

SEQ ID NO: 42342 - DNA, 250 bp, Triticum aestivum
  Clone ID: PAT_TA_42342
ccaacccttccgccaacccttccgccaacccttccttccactcatccgtccatgcatgcgggcgggtgaaccctttgtcgaggcggagagtcatcttcaccaacttagaaatgtataatacggacgaactcagaaatctatatatcgacagaaaaccggccactataactttacaaaacacctcactatcttgtggtacgagcattctaacaaatgttcatttaagctgttaaataaaaaaatcaaccaa

SEQ ID NO: 42343 - DNA, 255 bp, Triticum aestivum
  Clone ID: PAT_TA_42343
aaaggagagcgagaacggcaaacccgggcaccaacggaggcggcagcccaacccccgcgggaaaggcacaccgcaacccaccaagggacggccacaagcccaaccgaaaacaaaaaacgaaagcagcaacagcaaggcggaaccccaaaacaggcagcaagagggcaaaaaagagaaaagacaccagagcaagcaccgccgaacaaggacagacacagacaccccaaaccgaaaagcaacaagcaaaagggcaaa

SEQ ID NO: 42344 - DNA, 223 bp, Triticum aestivum
  unsure (1)..(223): unsure at all n locations
  Clone ID: PAT_TA_42344
cgtactcgtgttcgttactcatgcattcttactttaccccctactactaccatcgaggtgacctttnttcctggattgggggtggacctaattcattttcttccctttcaccaatcattccaatttgccaaaataccctccatttcaaattgcccaattaatctttaaatcaacacctttagattccacggccacttttttttatattcacaaatcacttacc

SEQ ID NO: 42345 - DNA, 382 bp, Triticum aestivum
  unsure (1)..(382): unsure at all n locations
  Clone ID: PAT_TA_42345
cagcactctcctcagatgaataatggattgaatgagatgtcatcatcagaggatgagcaagttgaacagggcactggggaacgtgaattgttttccatgccatctgataccatggagcatggattagttgttgacaaatctgaatgaaatactgaagaggtgctggttcaacaagctggcataaaggatgagtgtgacgctatgccaatggaaggtgggccacatgacgcagaggtttcgaacgagaacactgaggagaaccaggttcaacaagctgagctgagccaggaattggattcggtgatgatacatcccanggagcatgtccatgaacaatgtgtagaggagaaaatatcacttgccgagttgaaacaagaattgg

SEQ ID NO: 42346 - DNA, 465 bp, Triticum aestivum
  Clone ID: PAT_TA_42346
gtgagggacagggaggctgcaatactggacactggcatctttgtgctaaggatgaccgaccgttcaaaaatcatatgggagagcttggcctctcctactgatacatggcttccaggaatgaatattacacttggaaatttgctgaaatcatggaagagctatgatgacccagcaacaggagattacacttttggttttggaccgagcatatctaatccgtcagcatcacaattcattattatgtggaatcggatttcattttggacaagtgaatcctggaatggtgacacgaattctctcattccagtactgaaatctatgggtatcatccctgtttcatttcagtgtgacaaccttacatgcatgtacactcccaaccctgctgacataatgactaagattgttttggatcaaagtggttcactgaacataacacagttcaattcggaagccaaattgtggaca

SEQ ID NO: 42347 - DNA, 467 bp, Triticum aestivum
  unsure (1)..(467): unsure at all n locations
  Clone ID: PAT_TA_42347
cggacgcgtgggggagaagctctccagccattgacaacagccatcagatcccgcttgatgatgtcccaacattccttgaaaagaataccggtgaagtcatccggtcccggtgccttgtcacttggtaaggagaaaatagccgctttagtttcctcttcaatgaatggtaggtccagatccgtaagatcacatggctgggtttgaatggcctcccaggtgaaatcttttgaccgtgccggccccttacgaatgaccgtggagaagtgctcatggacaatggctttcttgtcatcatgattggtaacccatccttggttgtgccggagacgatggataaagtttttccgtctctgccgattgattcggagatggaaaaaacgcgtataggcatccccctctttaagcaaggttatccttgaggattgctnttttctagctcgctctaggacagccagagcgacaacctt

SEQ ID NO: 42348 - DNA, 441 bp, Triticum aestivum
  unsure (1)..(441): unsure at all n locations
  Clone ID: PAT_TA_42348
ctcggcctcgattacttgcacaatccagctgatgacgctcaggcgttgggtcctggcgttgagctgtgggggcggcatttggaatttgtggtgcgccgcctcctcgagtctgagcgtcagctttgcgccaaggtgtttgggcagcacaaggatgatgcatcagtgtgcttcgccgagatagcgtcacgagctagtgttcttgattttttgaggtttggccgtgccgctgcagatgctaagaaagacccaatcaaactcctgcgtttgctggaggtctttgattctttgaataagctgaggttggatttcaaccggttgttcggcggaaaggtgtgtgcagatattcagtgccagacaagggaccttgtgaagttattggtggatggctctgttgagatctttgaggagtngatcgtgcaggtggagctgcagcgacacatg

SEQ ID NO: 42349 - DNA, 200 bp, Triticum aestivum
  Clone ID: PAT_TA_42349
aggggtgcgtggatagtcatgtaggttcctcagatggcggcactgccagtgctgggttggggttcttgggctttacaaagatgccactttagggcctcttcgattcaaacttattttttttcgtatgcaactctttcgtaaggatacattctgtataagtatttcagctgagttaaaattatgagaaaggttttccctgc

SEQ ID NO: 42350 - DNA, 425 bp, Triticum aestivum
  Clone ID: PAT_TA_42350
taacaggcaacatcacgttacgggagctcctggagtggctcaaggagaaggggttgaacgcgtacagcatatcatgcggcacgtcggtgctgtacaactccatgttccccaggcacaaggagcggctggacaggaaggtggccgacgttgccagggaggtggccaagatggaggtgccatcgtatcggcgccatctggatgttgtggtggcctgtgaggatgacgatgacaatgacgttgacatcccactcgtatctgtctacttccgttgaagggctcccctctgaattgacatcatctcgtgtcccatctttccagtgagttcctttatatagttactgtaaattgggctggggtttaaagcaatatactaattttcgtatgcaccgctccttgataattgatgcatgacaccgttgaactgg

SEQ ID NO: 42351 - DNA, 452 bp, Triticum aestivum
  unsure (1)..(452): unsure at all n locations
  Clone ID: PAT_TA_42351
tcgcccacgcgtctgatgcaacctctattacagaaatgatgcaggtctacataattagagcaaattccnacnacnaaaaggacagtgtgttgattcctttagcttcaactattgcgacaacagcatgtaagttgttcttacggttttctgcattggttctcaacaattcaagttttcaaaaaactaaatccttttttttctgctatataaccaattccttctactatgaggctttgtgccccaaacttaatgattcttttctgcatttaaatttccaacatgtttttgaacagcacagtttactatatagtagatttgaagaggaaattctggcttactatccttctttatccctagatgatccttctcttgctgatgtgcacaatagttaaaccatttccagttaaacatcatatttgaggttaaacagtcgacttctataaagaactgac

SEQ ID NO: 42352 - DNA, 365 bp, Triticum aestivum
  Clone ID: PAT_TA_42352
gagccacgcgccacgcgtacccgtgggtgctgatgtggctgccgcagcggcgggtaacgccccaccacagatcccagatctggacgctgctgagggcgacagtgaggagcagcttgcgaacaacgaagaagctgcgaacaacgaggcagaagctttgcccaacgatgcagaagctggggccaatgaagaagctgtgaaccaagaccaagacatgggcgacgaagcggaggaggaggatttgatcgaggaagaagcgggcgcgagtcacgcgcaaggtccggtcagggacgtggcgatggagaacgagctcgccaacgagctgacgggcgatgccctggacgactatgacatcgacgtcgcgaacg

SEQ ID NO: 42353 - DNA, 363 bp, Triticum aestivum
  Clone ID: PAT_TA_42353
cggacgcgtgggcccaaacaatccaccaagcaaacccgatggcccgcacgaagcaggcggggaggaagtccactggcggcagggcgcctcggaagcagctggccaccaaggcggcgcgcaagtcggccccggccaccggcggcgtgaagaagccgcaccgcttccgccccggcaccgtggcgctccgggagatccgcaagtaccagaagagcacggagctgctcatccgcaagctgcccttccagcgcctcgtcagggagatcgcgcaggacttcaagaccgacctgaggttccagtcctccgctgtgtcggcgctgcaggaggccgccgaggcatacctggtggggctgttcgaggacacca

SEQ ID NO: 42354 - DNA, 279 bp, Triticum aestivum
  Clone ID: PAT_TA_42354
aaaccccccgcggcccacgcatccaaaatcatctaatcatcgatcatagcccgttatagtcttttatctaataaattctccccggccatatattaaagtatgggggacaaaataaaactacaatattcactactttccattatagcataaatcctcaaatcatctcatcccctctcaccaccaccatccttactgcacattttcttcctccactcacccttactttaccatatccccttaataaatctaaccaaatcccacacctttactttccctttt

SEQ ID NO: 42355 - DNA, 580 bp, Triticum aestivum
  Clone ID: PAT_TA_42355
tccgaaggtaatggagcttgtccgtctaggatgcacgtgcggacgcatacgaccaggtgggtgcattgttcatggccagtgttctggagatgcaaatcttcgctgagttgagagatgggctaggattgcatctatttttaggtcctttcaggtgaaaatctgagctactattttgttttcttgaagagcatcaagtttatgatcaagaacgccctcaatctggtcggtccatttcttggattgcatctatttttaggtccatcacttcaatctgccaggttttattgcaaccgaacagatgttgttcctcctaactgaacttaaatttacgtgtgctttaagagcagatattagttagtttctgatactcatgattaatggaaaattccatctagtgatgcgtccattttatgtgtgctttaagcgaattatcttgatagcacatggattgcctggaatgccaaccatgtcttgattgaaagctatttcttgtactgcaaacatttacacattgtcgtaccaaccctgcgagttttatggataggcatgtctttgagaacaataatatcatcacaggtct

SEQ ID NO: 42356 - DNA, 558 bp, Triticum aestivum
  Clone ID: PAT_TA_42356
aatgggtcttaatctgaacatttctagaattattttctctacactgaagaagtttgatgggatctgcaccagggaactgactgtccctgagatcaaacagattgctggcagagctgggagatatgggtctaaattcccagttggcgaagtgacctgtttagacgctgaagatctcccgttactgcactcatccctgaagtcaccttctcccattatagagcgtgctggactttttcccacatttgatttattgtctgtgtattcacgattacatggaactgactttcttcaccctatattggaacgtttcttggacaaggctaaactgtctccggactattttattgccgattgcgaagatatgctgaaagttgctgctattgttgatgagttgcctcttgtgttgcatgataagtacgtcttttgtcaaagtccagtggatgtgagggatgatatatctattcagggattaacacagtttgcaaaaaactatgcaaagaaaggcacagttcggcttaaagaaaaatttacacctggaacactgggggtgcctacaac

SEQ ID NO: 42357 - DNA, 397 bp, Triticum aestivum
  Clone ID: PAT_TA_42357
cgggccacgcgtcctgcattctgccatatccttgagagctccattatcatcttccccatccggccttccttcgcgtcaccatcagcgggcatgggggcctgcactacgttgaatctacctctggatcctacgtctagtagtgtgaaagtgtctttctctggcaaataaagtggggctgcattttggatcttctctacgtggttgataaacttctccttaccgccacgctggttggtaaaatgcggaggcaaggattatttctggcaccctatccttcctgaacttacctcatccggatccatcccgatttttaggccccttctttttatctcaactttctcccgaaatccttgctgtaataaattccaatatccggggcgacaggcttttatttctc

SEQ ID NO: 42358 - DNA, 600 bp, Triticum aestivum
  Clone ID: PAT_TA_42358
cccacgcgtccgcccacgcgtccgcggacgcgtttttcgggtagtttgttgcaactcaccgctcctggtgcagatgagggcgtgctccctgcctatgatgggtctcatcttgttagtgcttccgctccacctatggcgctcattctgcggctggggacttcatcgacatcaagtgaagctttgttgtccattatgttgtagtgcttggtgttgttgaggtttgtaagttgtctagtagcaccatgtatctgccgtctttttctttttcctcttgttaggtgctgtccgatgtaactcctggccggttgatggctttgttaattcaaagccgggctctctctcgagccttcgttctaaaattaaaaaaaaaaatctatatagggaatagctcgcctcctgattcgtccactcgtcaaccgtcagttgatcctggagtagctctgaggctcaggttttctgatccgcggttgcttcatctgtataggtcttttgtgctgtgattgggtttactgatccaaacccttattcataacttttccccgatttgaaccaaaccttcatgtttcctttcttttctttttgagcccacaaaatttttta

SEQ ID NO: 42359 - DNA, 189 bp, Triticum aestivum
  Clone ID: PAT_TA_42359
gactaaacaggaagccatgttactgaacttcagtttcatcttctgctcatagattcatgcgtatgaataatccttctgtctctttatgaactgctccacatgttaaaagcttgacgtgctgttgttctcacagcattgtactccctctgtaaacaaatgtaagacgttttaggtcactattacattata

SEQ ID NO: 42360 - DNA, 581 bp, Triticum aestivum
  Clone ID: PAT_TA_42360
ccggttcttaatacccggttcgacgcgcacgcgtccgcggacgcgtgggccgacgaacgccgaggaagtttttgtgagaggaggattgaagaggagggggcagatctatgggcaacggcgggagttcatctcgtgcacgcctaggaaaggcccatgtcgttccggattcagaatggaggatgcaggactttggaaagacccatgttcctgatttagaatggaggattaatgacttctcatcgctgcttgagacaggagctaagtcagcaaaatctgacgcttttcactgctctgggtataactggtacctgcaagtgagtccaatgcataaggaaattggttctgaaacgccatatgttgctctttgtctgaagatatcccaagcaagtatggtgccaggtcacacggtgcatgtggtttttgagttgtcaatatacaaccatacaaaaggaatgtactgcggatgcaaagatacctacaacttccatttcaagaatacctactcaaaggagcaatgcttgattcctcttcaggagctactgaaatcatctgctattctagttgatgatagttgtgtgttt

SEQ ID NO: 42361 - DNA, 537 bp, Triticum aestivum
  unsure (1)..(537): unsure at all n locations
  Clone ID: PAT_TA_42361
ccgatccaaagattggatctgaccgctggatctgcgaccgttccgtcacgtcncggagctcgaatttatttgggcgcgtgtagtttgtgcttctactatctatacgactttcgtgtgatatatccgactcgtggggttagatttgcgcatgaggatgtgtgttgagccgtttgttttttgggctggatcccgtaatggagatctgagcgagtaatggtcgcgaattgcaggtgttcggaagaggggtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatagggttcaatgttgaaactgtcgagtacaagaacattagcttcactgtttgggatgttgggggtcaggacaagatcaaacctctctggaggcattacttccagaacacgcagggtcttatctttgttgtggacagc

SEQ ID NO: 42362 - DNA, 469 bp, Triticum aestivum
  unsure (1)..(469): unsure at all n locations
  Clone ID: PAT_TA_42362
gcgtccggtctcattgacttatacaccagttcttcttatatgaaaccagaacacatcattatgtggcgacatgctattagcgacaggcacttataatcaattcacacaacattaaattgaataaaatacttgaagcctacaagttcttggatgaaaactgtaacctaaagatcacacttatttttactcacaaaaatcaccacaccaagttatttatacctggatcttctgacaatttccttcctngcactgttgtatataatacagtctgccatccaatgaataatgacttctacatgtgctctcattctgcaatcattactactacaacgccaactcactaccatatactgcatgataacatacactatgacgaagattacctgcaagatcttgtgcactccctctcatatttgtattaaaggagcactacacacatatcatttctttctccaatctgctatgcaca

SEQ ID NO: 42363 - DNA, 375 bp, Triticum aestivum
  unsure (1)..(375): unsure at all n locations
  Clone ID: PAT_TA_42363
cggacgcgtgggttcaccgccgccagcgccatagtctccaaaccctcgatctcccgcagcngagctccctggcgcgagggggccacccacacccaaccatggcggaccgcggcggcgagcgtggtggcgaccgcggaggccagcgcggcgggttcggccgcggcttcgggcgcggcggccgcggcgaccgtggcgggcgccacaggacccgtcttggccctcgtcaggaggaggagaagagggtgctcctcaccaaactgggccgcctcgataaggagagcctgtataacactagggaggagctctacctgcactcgctacccatcaacgagtacctgatcggggaccatctctatcttgggctcaaggccgagg

SEQ ID NO: 42364 - DNA, 536 bp, Triticum aestivum
  Clone ID: PAT_TA_42364
ctcgcatcgctccgaccagatccgataggcgccttactggcctcggatcaggcatgcatggcgcggtaccgccaccgtcaggcgccgtcgctgagatccatggcgttggcccgtggctggtgccgggaggcttggattcatgcgtgccccggttgtgggtcctggccgtcctcggcgtcgtgtcctaaaggtgcacaagagacctcgtctccactccaaggccatttgtactggcatggaggttgcttgccggccatccatgatggtaaagaccaccagcggcagcagggccagcaagacggcggccaccatcaaccgcttcttcctgtccccatcaccttccttcagccttctcccaccgtcgccaatcaagatttggtgtgcaaaggcacaatttccttctagggcttcatctgcaaatccacaaaagtatgaaaggatcaacttgtcgaagtggtagaagaagctagggtgaaaagagcaaagcagatctcacctgtggggagcgaggactcccgcagcccaccagttgccat

SEQ ID NO: 42365 - DNA, 540 bp, Triticum aestivum
  Clone ID: PAT_TA_42365
cccacgcgtacgctgaaatcgatgcaacttaacttcacacacacaggccctgagactgcgggcaagcgggccgacaacttggtaatccaacctaccacgtggcctggagcaacgctccggattacaaacctcagcatcacactcaccatgcttgagggcgcgtgccagatgagccgacaactctaccagccaagtgacgagactcacaccctggaacacaaaggtgctctatagagctgccgatcgggcttccacacctgccccgaggccgggcactagacaagccaatggcccgaccacccaagtgaccaaaaccgacacccagcatcacagaggcgctctgtggaggccgctgctttggcttccgcaacggacttgaggccggacacctgcctagccaacgacagaactgcgggacaacacatgcctttggcgcttgatagaggacaaagcccgcaaggcgacacctgggggggggggtgtgcgacgactgttacgactcctctccgggtattggccggagaactcacgatccacatg

SEQ ID NO: 42366 - DNA, 582 bp, Triticum aestivum
  Clone ID: PAT_TA_42366
cggacgcgtggggagccctcgagcgagaacccttctgtcgtctccctcagaagcagccgcgggccgaatcaaatcgcgctggcagcctcgtccgcctcgccgtgcctgcgtccctccccggacggcggcgacgatggagggatccactggcgctggccaggcccccggccgatggacgcgccggatcgtcgctcctctgggccagcccctcccgccgcgctggatttcgtggcagcctagcttgtcagagatggcaaagctgttatatacagggtacggctccgagctagccgatgcctactgtatccagtgttctgttgcatccggtgcgacctcaaagaataccttcttctagctgggcgttgagcgccctcaggacgacgaggtgcatcgcctggggtggaagcagttcaactacacgatgaagaagtgagtgaaggggttaagaccgttgcgttgtgcgtgcgctgcttgcttgctgctgttgcatatagcttgtggctgtggttggccaacccggttatctctggctgcagaatcatcaaagaaaggatccactgctggtcttattggccttggtct

SEQ ID NO: 42367 - DNA, 566 bp, Triticum aestivum
  Clone ID: PAT_TA_42367
ggtggttgttctcattcggatgctattagagcattttcgtttagtgctgatggcgccctgtgcgcatctgccgggatggtgggcttgtgaagatctggaagactgactcatggcgctgcatccagactataacttctgaaaagagggttagcgcagttgctattagcaaagatggcctgtatgtgacatttgcagataaatttggtgtcatttggttagttacggtggggggacatggcgaagggcaggtgtcatccgataacaaacctgtctcaatttatggtcactactgcagtattattactagcatgaaattctcaccagatggacggttcattgccactgctgaccgggacttcaaaatccgagttacatcattcccaaaggatcctgtaaaaggggctccccaaatacagagcttttgccttggacatacagaatttgtttcttccattgccttcacaagcctttcaggaggatcaagctttctattatctggaggcggtgattctactgttcggttatgggactacataaatggctgcctccttgatacatatgaagtc

SEQ ID NO: 42368 - DNA, 437 bp, Triticum aestivum
  unsure (1)..(437): unsure at all n locations
  Clone ID: PAT_TA_42368
cccacgcgtccgcccacgcttnctctgactttttttgccgcccttttttttttaaatgtgaaaaaaaaaacgaattggggcaaattaaaaaaactaatcttttcaaattaaacctattaaacaaaacccaccaatacaatacatacagaacaaactttacaacacattgggtccaaaataaataaacgtttttattacacattaattaaccatatatattccacatgaaataaccatccacaggcctcttcaaataataaatcacccctcttctcacttaataaaaaaatccagatcttactaaaatataaaaaacagttatggataacatatccaaacattctaccttttatttttacaaatcattaaccaaaattttcctattgccacttaccaaaatttttttttttttacttatgcaaaaaattttttttttt

SEQ ID NO: 42369 - DNA, 528 bp, Triticum aestivum
  Clone ID: PAT_TA_42369
atctaggagaaacttttcttagctggtaagtcacaaaacagaactacatggaaattttaaacctcatgacagggcaccatttacatgggtgctagacattactgcccttcagggctgcgcaatttaaaaatcggattgaacaaaaaaacaacacacctgagaatccaatgacgttggtttgcatcatcactggcgaagcatcctacttcttggttgtcaacactcaatgatacaggctctcacagaatttatttaaaatacctcggccgaatgctgattagtgctaagtcactgatcaaccagacattgctacctcttgcactaccattgagccattttcttcctcctcttcttatcggccttcggctgctttggcttccgagcttttatatgtgcttcttgcactgtctttttctactccttccgagcagacttgctgtgctaaggtcccatcttgggatcagcctcataccttaaatctttaccagaactagagcatgatccactacttagcaatgagcatttatt

SEQ ID NO: 42370 - DNA, 361 bp, Triticum aestivum
  Clone ID: PAT_TA_42370
cacacgcacaaggcgcacctaccggccaactttctcatgatcatgctcacccacatcaggaggctcgttgccggcggggggctgaccaaggtcaaggcctcctacaagctcgccaaggcccccgcagcgcccaagaagcccaagaccaaggcgccagccaagaagaagccggcggctaagaaggccccggccaagaagcccgcggccaagtccccagccaagaagaaggcctccgccaagcccaaggccaaggccccagccaagaccaaggccgccgtcaagcccaaggcggctaagaagcccaaggcagccgccaagaccaaggctccagccaagaccaccaatgccgccgcaaagccca

SEQ ID NO: 42371 - DNA, 388 bp, Triticum aestivum
  Clone ID: PAT_TA_42371
gggccgacagctcgacgaagggagcggcgaggcagcgggcagctgcgtggcacgcatgctgtgctcgccgtcgagcagctggttgcctgtgctggtgagtgcaagcagctcgctggcacaggaggtgggctgggccagtaggttggccggctgatgggcttctaggtaagactctggtcctttttgttttttcttttatttatttcctgctctgggtattgaaatagaataaatactatttcatttccaaaaactctggaaatattcagaggcacatttgagaatattctcaactgcccgaaaatgcttccaagattatttgagcactttagaatatttatagcacttaaaatgcccaaattcaaatacttatgggttgttcaaaaat

SEQ ID NO: 42372 - DNA, 173 bp, Triticum aestivum
  Clone ID: PAT_TA_42372
catcatctcatcgaaagacgggacacctttgcctctatcaagtggtataagatttccaggttgctcggtgagattttacattttttcatatcttagatcaattggggtcgtcatacctaactcgagttgcagctctatacgatcgatgcttattgtacacgtgcatgcgacgt

SEQ ID NO: 42373 - DNA, 359 bp, Triticum aestivum
  Clone ID: PAT_TA_42373
ttcccgggtccaccctttcctcgaacgagttgaggaggttggcaggcaatcggcgggggaaggcgcctctgcccccgatccatctgctgctgtcacaacaaaaaccacaccgagagccagcgcaatgagcaagaagtcgagggctaggaaaaggacatgagctgtgcttcttgccagtgcatggatggaatacccagtactcccttggtctcggtgcataggacatgcgcgtagttctagggtgaatttgactaactaaaaatgtgatatatctcatcaaaagcagatcattggatacatatatgaatgtagtttctaaatattttttgttaaatataatacatattagctagttaaat

SEQ ID NO: 42374 - DNA, 440 bp, Triticum aestivum
  Clone ID: PAT_TA_42374
gggtcaacctcatgtgtcaggatatctagtggacgtgtaatttggactttcgtctgagtgttccttgttgtgatttgcgtgttcctcttgatttcccctccaagttgtgaaagaccaggccacctagggttcctaccctacatcactgcttgcataccatcattccaaataagcacaggggtatttctgtctttgatgaaatacaactaaccatacaggaactttttactgaaattgatatggacatcatcataatgggaggttggagtacacagacacaaaggattgatatatcttcagaaatgcaactcacaatatcagtagttgcatgtattgcctcaaagaaggtctgaacttatcttgtcttagaatgaaacaacccgaggcaaccatattcacacttggagtactaacagcttcaattagccttgattatatac

SEQ ID NO: 42375 - DNA, 347 bp, Triticum aestivum
  Clone ID: PAT_TA_42375
cccacgcgtcagatgagttcctgcaacttcgaaaaatttaaaaccatgaaacatctattactgctacttttctgtgcttttatagttcaggcccaatttcctactgactatgacgagggacaagatgacagacctaaggtaagtttgggtgcccgcggtcatcggccctatgacaagaagaaggaagaggcccccagcctgacacctgtgccccctcccatcaaccgacgtggctatcgggctcgtcccgccacagcaactgtgggccataagaaagtggagagaaagccccctgacgctgatggctgcctgcacgcggacccggatctgggtgtgttgtgtcctac

SEQ ID NO: 42376 - DNA, 377 bp, Triticum aestivum
  Clone ID: PAT_TA_42376
tcgttgttcaacactacacgctatagtgagtcgtattatatgattcacaagatgacagatcaaccactgctctcaacataaacgaccctgggcttaattctggcctttagattatgatttggttttcgtctcaagtatagtatgtttatgaatagatcacgtactgcttacatgtgtgtccagttgtcccaacttgtttctctattgaagattggaactgtttttttattagaacgaacagacatgcccgtacgttgcaccatgagaactaaatattatgtgctcgtctatcaccaatctcataatgcgaccgtcacttgtgtgcaaacaattagaagtgctgttttatacttgcgcttgtccctaatgggcaatgt

SEQ ID NO: 42377 - DNA, 201 bp, Triticum aestivum
  Clone ID: PAT_TA_42377
cactactccctatagctgagtcgtattatagcaacctcaaaatccaatctagagccctattctgacatcttgttggatgggaacacgaccatggaagggttcatcatcctcattggggctcctgggatgaggcactactagttcaccacataactatctgtccgtacgcactcatcccaattcctgattccctctctttat

SEQ ID NO: 42378 - DNA, 461 bp, Triticum aestivum
  Clone ID: PAT_TA_42378
actcgtgggacgacgtcatacactatagtgagtcgtattaagaagattcgttaggatttcgtaaccaaatcccttcccccttactcccgctcctaaatctcgggacgagatttcttgtagtggaggagaattgtgacgcccgggtaattaagctacattgaccctctgctaatgacgccacgtcacctcgtttatagttgctaatctcgagttagttcgaaaccaattcaaattcaaattaagaaaaataggcaaacaataaaagctttcaaatattaaaactaaaatgttcggagtgaaccaaatattgcatagataattatgggggaaaaaccacacatgcataaaatgtttaaataatatgagatgggtaaaacagcagcaaaacaattattttaaatgtttttaaatactaaacaaatgttaatctagtttatataatcaccaaactttttagagta

SEQ ID NO: 42379 - DNA, 446 bp, Triticum aestivum
  Clone ID: PAT_TA_42379
taccggtccgacgattcacgggtgcacacaccacaaccaagcccgcagtaggagagattcacgcaggggcctggagccatcgcaacagaaacctagaaaaggttaaaaataaagagaggctagagaaaggagaggagttgcggctagaggagaaatgaactgcaaaggaagggtagaagttggcctaaatttataggagggaatgccaaaaggtcaaaactgaaaattaaagaggagttaatgaaaattacgttaccaagaatgaaggacaatcaataaaagtttatgttaccaaaacaaaaaagtcttaccaggaagttctacaacgactttgactgcacaaattcatgacgaatttgtacacctgaagcacaagaccatgacgaatgcagtgcatagacgcaacaaagtagtgcatacccctaccaatgcagtgcacaaaaatg

SEQ ID NO: 42380 - DNA, 196 bp, Triticum aestivum
  Clone ID: PAT_TA_42380
ccacgcgtccgaaagaagttagtcgcctttgctgtcactcagagatcggtatcattaccatctattcgtgattccatagatacgccttcgcagactgtactggtgtgattccatcgtgcacatggcagaccattttctaggctgcaatttcagcaacctcagcagaattgaatcaaatctattctttataatggct

SEQ ID NO: 42381 - DNA, 445 bp, Triticum aestivum
  Clone ID: PAT_TA_42381
ctcactgttcaacacaacaccctatagtgagtcttattaaggaggcgggacggcctggttgctgctgctgcttggcggcggcggggacgaggcacaggagggaagaggaggcacggcctcgggcgctggttggaggaaatggatctgggaggatcccaaggggaagaggactggtggcggcggctgggaggatggaacaaggctcctaatatttacggtttggtctaaaaatggacaagggagtctatatatataaggaacaggggggtttggatcatctgatcgaaatcagacggtcgagataaatacgttaggtagcccaaataagaaaacggagatgttttatagatgtttggggatgatccggacccatcggtaacgacagcccgggtcgggtccggaaaaatttcggacacggcaagaaaggtcgtggttgtgtaaagag

SEQ ID NO: 42382 - DNA, 374 bp, Triticum aestivum
  Clone ID: PAT_TA_42382
ttcacgggtcgacgtccagacgagagatagcggacaacgcatccctgcatgtcgaggctcgccgctaacatgtgggaccatgcttccatgatgcactgtgctaatttacacatttgcgtgtgatatatccagcctcttcaacacaacgtcaatcaatgcatatgtgactgcttgttactgacggtgacttcatgatatgttccggatacagaacgattgatcgatcattttatggatgatcatcagcctatttgtcatttcatctacgcatctacatgctggactcatgattctgatacatttagtaatttcgacgttcaggatcattcagttgtcatttacatcagccgcaccatcaatcattcgcccaatct

SEQ ID NO: 42383 - DNA, 399 bp, Triticum aestivum
  Clone ID: PAT_TA_42383
tcacactctatagtgagtcgtattaagtaacgaatacattggtcagaatcaaatgccccgaaaaccaaaggtttcctccgaatggtatcacaactgacgcttattcagggcttaaaataaggctaaaaggcatatacgatggacaacaggtcaataatccggtcataccccttgttagtcacgcgggacagagaaggctacgttagcctacagatggttaagtgtttaaggacacaaggttaccctgcctcttaagggtagtaaggggttgcaaaaactcctcgagccgacgtcggaatatcaagcactgcatctctgaagtacgatatctatgccatagccccttgattgacttgacatacatttaacacaatggtgcatgtacctgacacctataca

SEQ ID NO: 42384 - DNA, 419 bp, Triticum aestivum
  Clone ID: PAT_TA_42384
tagtgagtcgtattaaacgcagcccacacttctctacaacaatgcagcccacatataaagaacaatgcagctcacttgaccataaagaagtggaaccaagcagtagactaaacataagataaagggaggataacaaagttcaataaaacaacctttatctgcaaaaaatagaagtgatgtgaaatcaaggcaacacttcctcgatgttagccaactatagagcatggcctttctgatgtagccaatgtgctccaccccaaacttagcaactcgaacaccatcccatgtctgcaagaattgaaacatatagaatccacaatcatgcctgcaataaaaagaataaaaactttagtttcacaaaaatgaacggaaaaaacttgaacagtatgccatagaacggttgtacagaacgcacccat

SEQ ID NO: 42385 - DNA, 381 bp, Triticum aestivum
  Clone ID: PAT_TA_42385
atagtgagtcgtatacacgtctaatctgattctgattttcatgttagttggggtgcattgtatcatcgctcggtcccaatgtaactctgagatcttttgacaaaaaaggtatatttgaacctaataacacgcaatatacggctgtctcagcaagagcaactcgagcgggctgagagcaggaaaaaatctattttaaaccctgaactcatagacgttcagcatatcaaaccctcaagtccaaatccacgtcgtttgcacctgaactatgcaatctcggtttaattcgaaacctggcatcttttgaggaatgaaaacgctgacgtggccatgtcaatcgggattcgtctgactggtgcaccattgagcggcatcagtgatcac

SEQ ID NO: 42386 - DNA, 414 bp, Triticum aestivum
  Clone ID: PAT_TA_42386
ccctcgccactcatatagtgagtcgtattagcacggatttgtaagcgtgctcgagcttcttgctgagatcatagtcttgcaggatgtcgatgatcccgaagaagaggatcacgtcctggaattcgcccgtgggctcgccgatgagcagggattcactttcaggatttctcactatgtgctccacccttgagggcatgctaattcctagtttttgttgtgcttatctgcagcaaccatgtcagtgtttgtcagtatcaacatgaacgcaattcaaaagttgccggcatgaagtgagcaacctaagctgagtaaacgaaaaatgtaatgcaaagcatcttatgattcttcaaagcttctaaaatgtatggtgtagataccttttttgcgcagaatcttcatccgtggtagtaagtg

SEQ ID NO: 42387 - DNA, 439 bp, Triticum aestivum
  Clone ID: PAT_TA_42387
ctcacgggtcgacatcatcctctatagtcagtcacataacacctgtcgagtccgctgtgctgtggatctcacgtacaatcgagactgggcggcctgcgtcgcgtctgttcataccacctgcacagtgcagcgactcaactgccagtctggcatcacgatcgcacacgagaggacgacgacgaagaatacggccatgggagcttgcgatactttgaaacggtccaagtcttgggcgatgctcacatgtcgtgcccactgtggcctcaatggtcagtgccatgagtgatgatgatgatgagcgccttttggtcgcaggagaagcatcacctgcaagatgttagtgagaacatctccaacaggcgtgcaacatgcggcgcgcaactcattccttctttgggagggtctacaagctgacgctctaaacgatgcacacttacgt

SEQ ID NO: 42388 - DNA, 241 bp, Triticum aestivum
  Clone ID: PAT_TA_42388
tcgacgacgccgacgtgagagaacacgtgcccttctcgcacacagatctcggcatgaggatgtctgcactgctaacctcccgcgtatgctggcggcatcggtattgatcggcagtacgacgtccgaagaattgacgtataagtcatgcgcgtaataggacaataacatatcatgcctaacatcgcgatcgacattcgtgcatgataccacatcttctgctgagtcatacgtgtcacgtcca

SEQ ID NO: 42389 - DNA, 410 bp, Triticum aestivum
  Clone ID: PAT_TA_42389
cgggtcgacccaaacaccggaccatccaaggttgcagctccggacggcccacgtcgcgtacgatctcgcgcgttgttctcgtgtaactaaaaatagtcccacctcgcccctcgcccagctcctttacttgcttaaataccttcatcgaggtgattttagcaagcgttggtcctcattgtaggatgaatatgattcttcacccttactatggttgtcatgcatattcataatcatcatgcatattcttcatttagagatcattaatgactgacgtattttttaaataagcggggcccagtagggtgtgcttggaaatatttgagaaaccaccatgcacgttcatctttgctgcatgcaaatcgggcgggagccgcagtgccagcagctgtcaacgccttaatgaatccacc

SEQ ID NO: 42390 - DNA, 414 bp, Triticum aestivum
  Clone ID: PAT_TA_42390
cgcctgtcggtaccgcgtcctaaattccagggtccacctcttcgagaaaagcaaccaagactgagaagattcgttaggatttcgtaaccagaccttcccccttataccccctcttaaatctcgggacgagatttcttgtagtggaggagaattgtgacgcccgggtaattaagctacagtaatccaacgataatcatgccacgtcaccccggttactattgataatctaccgttagtccaaaaccgagtcaaattcaaacattaaaataaagttaaattataaaagttttcaaaatattaaactaaaatgttcgggctatgccaaaaatggcatacgtaattatagtgcagcaaacatatttttttgaatgtctaaatgattgaaaatgaaatagaacagaacataaaatagat

SEQ ID NO: 42391 - DNA, 249 bp, Triticum aestivum
  Clone ID: PAT_TA_42391
tcccgggtcgacgagacacatatgaacaatcttcatcatcaagtgagacgaacccttgcacaagatcgccatgcaggccaacgacgccagatgaaaaccgacccatgagcttatcagccgttgcaagtttctactcattagtaaatcacacaatacacgatatcataagagagctaacagatatagacggtatcgattctaccgtaaacatgtgaatgcatcagagagtatcatccaattagtatacac

SEQ ID NO: 42392 - DNA, 132 bp, Triticum aestivum
  Clone ID: PAT_TA_42392
gcgggtccacgggataccctaaagtgagtcgtattagcatcactatgatagcacagcgccaggacatgagctggttctgctacaagcatgtgaacacaatgtccaaaacaagcatgttcatactggtaatct

SEQ ID NO: 42393 - DNA, 371 bp, Triticum aestivum
  Clone ID: PAT_TA_42393
tataatgagtcgtaatatgagaacctcctcctggatcttgcacaaattgctaatctgttgatcagacacttcatcacggaaaaccagttccctcctggctgtgtacaagagctgtatgcctcgttgacagaacctctgctgcctgctgttccagtgccttcccctcaggctatacagaaattccttaagttcatgaggaactaccctggactaaagcacccaaggagaacaagcacatttatcagcaaagtatttcaggctgccagagccatgggggcagctcagtatgccagtgtcatgacagcggtatcaagggtacaagtgccgcaagactggatgaatgtgactgaataattgggatatctactgct

SEQ ID NO: 42394 - DNA, 428 bp, Triticum aestivum
  Clone ID: PAT_TA_42394
cctagagtgagtcgtattagggtgtcctcgtgtacgagcgaaggggtatgagcctgggttgattgcgaaatcattggtatacactttttaccggaaagtgctcttctgctctcaagctcaaatgctccctgatgaacagtaaaataaaaatagtaaaaaatacaaaaaaatgtaaatgttttttgtggtaaattttgacgaatgttttatgcgcttgataaatttcagcatgaaaggacattcgtggacaccatggaaaaaaagaatcaacgctccaaaatgctttcaaaactagcatttttggagcatcgtttgttttcacgacttccatgaatgttatttcttgataaatatttgcaagcccacaagacacttgagaatgtttaccacaaaaatattcagatttttttcaatttaagtatcaattt

SEQ ID NO: 42395 - DNA, 360 bp, Triticum aestivum
  Clone ID: PAT_TA_42395
agagatacagatggagggagagggaccaacaaggtttgtgtgtgggacgcgtgcgacagaactgaagattgtcagagagagagagagagagatcgagggagacggagagggaccaacctcgtttgcgtgttagacgcgtgcgacacaactgaacattatcagagacagagagagagagatggagggagacggagatggaccaacacggtctgtgtgctggatgcctgcgacagatccgaagattatcacagacagagagagagacaccgagagagggacccacctcgtctgtgtgttggatgcgtgcgacctaaccgacgattgtcacagagatagagagagagatagacagagagagat

SEQ ID NO: 42396 - DNA, 144 bp, Triticum aestivum
  Clone ID: PAT_TA_42396
gtgagtcgtattatcgatttcttggtcatttctctccttagccagtcagagctcttgatcttttaagaatcgaaggacaagtgctcgatctacatattcaccatagctaaggttgattcttcccttgcctttgtggtagatctt

SEQ ID NO: 42397 - DNA, 462 bp, Triticum aestivum
  Clone ID: PAT_TA_42397
ttcgcgggtcgacccacgcgtccacccacgcgtccgcccacgcgtccgctcgtcaggagtcctcttaccccttcgtatcttttgaacgattatccgtataatagtaaaatttcgagagaggaaataaacggacatatgcttctcaactactcataacaggtgacataatattgacagatgacgttacacagccactttgacgataattttaaacgggattttgtgccaagtgatatctcgtttgagaggtgttgaggatacctatgcaattatactaattttgtttgggtttgagttgattttgatgagtaaatgaaataaatactaaaattttagtttcgcatttgaatctttattaatcggatgcgaaactgtaattttaatatttatttaattaattcatcgaatcaacataaacccatacaaaactacactcaccgggagaaaattcctccaccaaaa

SEQ ID NO: 42398 - DNA, 352 bp, Triticum aestivum
  Clone ID: PAT_TA_42398
cctatagtgagtcgtattaagcgtccgctcgtcaggagtcctcttaccccttcgtatcttttggacgaatatccgtataataataggatttcgagagaggaaatacacgggcatatgcttcgcaactactcataacaggtgatatactactgacagatcacgtaacatagccactttgtcgatgattttaatccggattttgtgccaagtgatatctcgtttgataggtgttgaggatatctatgcaattataccaattttgtttggatgtgaattgagtttcatgactcaatgacatacatactagaattttagtttcgcactttgaaccttattaacccgggtgcgaaac

SEQ ID NO: 42399 - DNA, 364 bp, Triticum aestivum
  Clone ID: PAT_TA_42399
ctcgcgggtcgatacacgcctctacacagagtcgaataatgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttcgttcctcagtgcagatgaagatgatgaaaattactctggaagtgactacaatggttatgtagctggtggtgtgttacctggaaaattgtcgatcgacctttgtactccgcagagtatatacacgctcacaaagaacattgagatactgactgtggtcaatgggacaaaaatc

SEQ ID NO: 42400 - DNA, 348 bp, Triticum aestivum
  Clone ID: PAT_TA_42400
acaacaccctatactgagtcgtattaaacatatccaattcaaagttctagcttacaactatacaaatttggaggaataaaagatccgccacaagattatggatttactataagagcagggaagacagactatcaaattcaagtaaaagttaccgatacttctcaagtttcgacagaggaaagcagaaacattacaacttactttcaaacaaataccgttgaagtgaatggaataaacggctggggtatatctaaatggttataccaaaatattgaataaccaacactcacattagaagcaaaacataggcaattttactattaaggaattgaataaaaaaattacttg

SEQ ID NO: 42401 - DNA, 199 bp, Triticum aestivum
  Clone ID: PAT_TA_42401
gcgtatgacattactacaccctaaagtgagtcgtattaacttcatcggaggggctatggtgatgatgtataagccctccgtgattgatgccccctccggctgagctccggatcacgccacacgatgggatctcctgagtacacaacgttgcggcggtgaaagtacgtttttggcctcgtatctgatcgtttgggggtac

SEQ ID NO: 42402 - DNA, 389 bp, Triticum aestivum
  Clone ID: PAT_TA_42402
ggtcaatgggacaccctatagtgagtcgtactagcatcgctcgaaaagcacaaggccacaggggaacgctccggacttgcgagatatattggaggataaggcaagacaatcaagatcgatctacggatcacgtggacgccccatgatacgcgacgacagccgtcgcgccggacacagtaagtctgggcgggccgaacaaaacagacaaagctcttttgagctccgtcgtgatatcgcccagtacagaggcgccgcacgcccactatgcttcacagatgaagtaatggatcatcaaatccccgaagggtttaaacctgtcaatattgaatcttatgatggcacaacagaccccgcggtttggatcgaagattatctcctccagatccaca

SEQ ID NO: 42403 - DNA, 360 bp, Triticum aestivum
  Clone ID: PAT_TA_42403
acgcgcgggccgatggggaacccgatagtcagtcgtattatctttttataagtgggggagaggaaaatgagaggtgaatggcgaataatgtaatgcaagagatgagagtttatgatgggtacttggtacgtcttgacttggcatagatctcctcggcaacgacgccagaaattcttcccgctacttcttgagcttgcgttggtttttcccttgaagaggaaagggtgatgcaacaaagtaaagataagattttccatcagtttgagaaccaaggtatcaatccagtaggagacaacgcatagatcaccgagtacacacgtaagcagacaaacttgcaccaaacgcgatagaggggttgtc

SEQ ID NO: 42404 - DNA, 107 bp, Triticum aestivum
  Clone ID: PAT_TA_42404
tgaatcgtattatgagtgacccggggtacttttctactgcaagtatgccatctttgtcgtcggcgataatgacgaccgcatatatctttgcagttcgggcattaggt

SEQ ID NO: 42405 - DNA, 392 bp, Triticum aestivum
  Clone ID: PAT_TA_42405
actccctaaattgagtcgtattaagccgacggtgccggcacctactgcttccatatcgcgactcgtgagtggagcatagctggcgactggctcatgcccttcaatggcaaggcggattatgtccccgaacttggactctggtttggcatcaaacaagccatcgtcccttgcgctgccgacctctcatgcctcctcagaggggaggagctgtcgccagacaagatgcggatctgggagcctgatgacctgccagaggagtggcagccaaagagcttgcacaattcgtgtgctgtcagccttggttctggcagattcatcatcgtggacgtcttggatctcatgaaattcgacaaggaatgcaacgacatgagtcccgtcaaggaacttgccct

SEQ ID NO: 42406 - DNA, 412 bp, Triticum aestivum
  Clone ID: PAT_TA_42406
cgcgtaggtcgatgggggtccctatagtgagtcgtatgacttgctgatgatccgcgaaacctggagactcgaagtaacaggcggcgcactccgggtattctattgcagacaaacaaacaaacatacaataagtactcatctaattcacaggtaaaactcaaatagaagatcgaaccagaaagttcaacttaagaactccggtttgcaaaaaaaaacaaaacaaatgaagctacggaagtcaaacggcgaaagaaaacagcttcgttttactaatctggatctaagtcaaattttacaaaagcaaaaacttgtttaagttggttattcggaaagagggtttcgagacgaaactccacacgcttgaattgcctgattccgataaacgagcgaaaagttatactaaaacgaaaat

SEQ ID NO: 42407 - DNA, 255 bp, Triticum aestivum
  Clone ID: PAT_TA_42407
cctatagtgagtcgtattaagttcttgatgcatactcaggatatcattacatcttcatggcagaagaagatgaggagaaaaccgcattcattactccatgtggcacatactgctttgtacggatgcctttcggactaaagaatgctggttcaccatttgcaagggtagttcacgaagcttttgaaccacagttgcacagagatgtataagcttacatggattacatactggtcaacagcacagatagaccaactc

SEQ ID NO: 42408 - DNA, 250 bp, Triticum aestivum
  Clone ID: PAT_TA_42408
atagtgagtcgtattacgttcgcgtacctgaacccggtgctccggcccttgttagtcacagcaactggcttgtatccagtgtgggtacccctgaactcatcctcggtgatatcggcaaactggttggcctctagccaaaacttgctgttcccggcgttcgtggactcgttgaaagcaacgttggccttgaaaccctccagccgcctgtgctttctcggcagcgtcaccgtacacgcggccatacttgccc

SEQ ID NO: 42409 - DNA, 327 bp, Triticum aestivum
  Clone ID: PAT_TA_42409
atagtgagtcgtattatgaaggctatgttgatttgtttcaactacatgcgtgaacatgtgccaagtcgagtcactcaattcattcaaaggaggataccatcccatcataggacatcataatcattctaatagcatgttggcacgcaaggtaaaccattataactcatagctaatcaagcatggcacaagcaactataatctctaaatgtcattgcaaatacgtttacttcataataagccgaatcagaaacgatgaactcatcatagttacaaaagcaagagacttcgagttcataccagcttttctcatcccaataagtccatcat

SEQ ID NO: 42410 - DNA, 190 bp, Triticum aestivum
  Clone ID: PAT_TA_42410
ttgctactccctaaagtgagtcgtattaaatgatggaggcttacgtgcgtaatgcatgcgacgccctagatgatctaaactgacgtatgcgttcaagctgacttcatatctcgttctagagtgtcacgaggggtgcaaatcatgggccgtccatttataacgtcgttactgggaaaagcctgtcgttacc

SEQ ID NO: 42411 - DNA, 369 bp, Triticum aestivum
  Clone ID: PAT_TA_42411
acgacaccctaaagtgagtcgtattacatgttctaagcctaacaaatatgtatgacagtatggctcatgtccacataggaccgcctcttgagtatagactagccaatgctcacaaggattactccacaaaataccgttaccgatctatctgatccaggctaacctagtcctgctatctacctgactacctcttcgtgacagtcaccgagttacacttcactggacgtcgttttacattgtcattatcgtgacaaccttgttgttaccagactatccgcacttcaacacatcgtcatttctcaaactaggcattgctctataatggcagcaccgatcacccttctcaatagttcaccagcctgaattgcc

SEQ ID NO: 42412 - DNA, 352 bp, Triticum aestivum
  Clone ID: PAT_TA_42412
actagtccctaaagtgagtcgtattaggcagggtgttactgaatttcgggagtcttgtccggactggatccggaaagggagcgtcgtcaatgtaaaaccacttcgaagtcgagttatctggtgccttcttgggagtaccggatatgtatccggtctcagcgatatgccatacttcggtctcgcccacttgacatatggattctcactggttgcaggggacaatgcagaatagcttcttccatagtccgaaatgagcctcgcagcctagaaatagctcgcaaatggcgacgtaccctgctatatgcagtaaggacgctggggtaaagttgtgcaactggaggtcgtagaactc

SEQ ID NO: 42413 - DNA, 271 bp, Triticum aestivum
  Clone ID: PAT_TA_42413
gggacacccgtatagtgagtcgtattatggagtcagtgagaacatgatacatatttctgcaaacgtctgtgagaccagttacactgcacgtgtggcaacacgcctcagtcacagccgcgcacaatcaggcaatggcttattcactgatctacgtgtgcgcgaggtagacctgctaggggcataaccatggaagcaccccctctatcaggttactgttaagcaatgattcagagttgaagttcatctcttcatagcttacgtggcttcatca

SEQ ID NO: 42414 - DNA, 275 bp, Triticum aestivum
  Clone ID: PAT_TA_42414
tacaacacccaatagtgagtcgtattaggtggtgcggatcatgaaggtgtaccgtcccatggattctcatagacacaccggtcatgggtatcgacgattactttctgcagtaggaacagcatatggctagcagtagcatcacgaacctcatcttgtgtgatctacaacttcacgactgccagcttacgtagacgaccattgtggacgagcctgcgacttctacacgtgcgccaggtactaggattcatactcctacggatcatacgtttcctcct

SEQ ID NO: 42415 - DNA, 343 bp, Triticum aestivum
  Clone ID: PAT_TA_42415
agcgccagtacggtctaggactcccgggccgacggagttggaaaagtcggcacaatcgtccctccagcataactgagacaacctcgggattatcacgctaagcagttcagaattccatgagaaatcaccacaagttagttggccgtgtgccgtgcataggcagttcaaaaataaagatcacacagtcatgtcccggtttctctccgttttcctttcctcgttggacaccgacattactgcagcaggcccttgaatgtgcaagtgctaaacaatgcgacgtccaatgtaaggtcaaccaagaatggcgaatgggacgcgccctgaaagcggccactcaacagga

SEQ ID NO: 42416 - DNA, 140 bp, Triticum aestivum
  Clone ID: PAT_TA_42416
tacaactcactaaagtgagtcgtattaacgggaactttacattccgatttccgtcatacaccggcactgtccactttccacgcaacatcttcgtgttactttacttcctctatcgcctctggggccacggcccttcctgg

SEQ ID NO: 42417 - DNA, 240 bp, Triticum aestivum
  Clone ID: PAT_TA_42417
tagtgagtcgtattactagactgacgcagatctacttactatcgacacaatgacgtggtaaatgattaagagaatcgggagtccggatttatagtttcacaaattctacaagctcgagattggcttaagcttagggtgtctgcacctccaaatcgttcttggatcaaactacgttgtgatcgagatagagtagaacgcatcaatagagaagatacggagatctagaatctatatactgac

SEQ ID NO: 42418 - DNA, 290 bp, Triticum aestivum
  Clone ID: PAT_TA_42418
gtcgtattactatttcgggtacggtgagatcgagaagctgtccgatgatctggcggacgcataccttacgaccatgactcaggccaagatgaaagagtcagcgatattaaagctctggaagtcatcactcccaaaggggatcgacgtctccaagaaggatgccacggaggcactgaagtgcagatcattcaatgtgcagctgtcgatcgggaacaattccaccatctagagcggcgttcatgatatcggcctcagctcgccgaaccttgggcaattcagctcgccagact

SEQ ID NO: 42419 - DNA, 415 bp, Triticum aestivum
  Clone ID: PAT_TA_42419
cccgggccgacccatctggcatcgtacatcctattcattttaacaaagcgcttcgtgggtagctcagtttttaggaggttttctgtaaatatttttccatgaaaaaatgtccaagaattttctagcaaacatgaactttaacagaagttcatacattttgatcatcaaaatgtgatcttaaaacatgtacaattttttttaaaagcaattcttgtaaagcttaaacttgtttcaaaattttgagaattactaaattcgaaaactgaatttgaattcaattttttcctgaatttaaacattgtttgcacattatagaagtgtatcaaactaaagtacacacatattctagttattttgctaattttgaaatattccaacactaagaaatgttcactacgttcttagaaatgttcat

SEQ ID NO: 42420 - DNA, 261 bp, Triticum aestivum
  Clone ID: PAT_TA_42420
gagtcgtattacaggcgctccggattgggacttggttctcctccacgcgggggcggtttacccttacgacgccgaccattaccctgcgcattggtattagccacagaatctgaactgttatccgccttacggcttaccgttgtttccatgacccgccgggttatgctgctgccctttggtgctgccgcccttctttccctttcctgtcttctcatcatcatactcagggtccttggtactatcggagtcggcatacttcac

SEQ ID NO: 42421 - DNA, 349 bp, Triticum aestivum
  Clone ID: PAT_TA_42421
ggcacaccctaaagtgagtcgtattaacccgtggttaaggtaccactaagaagtccgtgcacgatgaaatctgccgtgactaatctatgacacttggatctcatcgtggagctaactcacgatggggtcacgatcgtggtcggcaagttcaccggaggcaaatgagatgtcgtgcggcgcatgaccaataatcttgcgcgaacgatggacaccaatcacgtatgatagagtcccgaggactattcgatctaatatgggtatcgggtccccgttgatggcatagacgtttccattgccaatacagcacagccttctgccaagccggacactcggacagacttcatccaca

SEQ ID NO: 42422 - DNA, 330 bp, Triticum aestivum
  Clone ID: PAT_TA_42422
ggtcgacgggcgaaccaactgttcatcgccacatttttgcttgtttctaagaatagcaggtgacagacaggggtgttgctgaatttcctttctgaatctcgtgtgcaaattttgctagtataacaaatctgcagccctgttttggtttgggtttaaaaaaaaaaaaaaaaaaaaaaaaaaaaaaaaaaaaaaaaaaaaaaaaaaaaaaaaaaaaaaaaaaaggaagcacaaaaagataaaagactaaaataagcatacatgaaacatcataacacttcatatagtgtgaccaaaattcaattcaggggccgatcattttacaaggtcttg

SEQ ID NO: 42423 - DNA, 393 bp, Triticum aestivum
  Clone ID: PAT_TA_42423
gaagaagagcgtcctggctgcaggtttgcagctccaaaaacaaaaaaaaaaaaaaaaaaaaaaaaaaaaaaaaaaaaaaaaaaaaaaaaaaaaaaataaaaaaaaaaaaaaaaaaaaaaaaaaccaaaaaaaaaaaaaaaaaaaaaaaaaaaaaaggggccgcccaaaaggttcaaacctaagttacccttgaaggcaatttaaaaccccttcaaaagggtcaccaaaattaatttcacgggccgtcttttaaaaacttcttaacgggaaaaacctggggttaaccaaattaaacccctttgaaaaaaatccccctttcgcaaatgggattaaaaccaaaaaggccccaaccattagcctttccaaaaatttgccaaccctaaatggcaaatg

SEQ ID NO: 42424 - DNA, 336 bp, Triticum aestivum
  Clone ID: PAT_TA_42424
ttcaagggtccacgggcattctaatagaataaatcaatcagaaaaaaagaaaaaaaaaaaaaaaaaaaaaaaaaaaaaaaaaaaaaaaaaaaaaaaaaaaaaaaagaaataccaccaaaaaaaaaaaaaaaaaaaaaaaaaaaaaaggggccgcccaaaaggttcaaacttaagtaacccttgaaggaaacttaaaacccctccaaaagggcccccaaattcaattcaaggggccgtcttttaaaaagtcctaaacgggaaaaacctggggttaaccaaattaaacccccttgaaaaaaaccccctttcccaaagtgggctaaaaaccaaaaaggc

SEQ ID NO: 42425 - DNA, 363 bp, Triticum aestivum
  Clone ID: PAT_TA_42425
cggggtaaacccaatccaagcgggagccaactacgtgtcagcgcgtaagacgagcgggcgttccaaaggatccaagccttggtacacgtgcgcgagacggagtcgctctactttgctgacagagatggcgcctcgaggcgccgtagatagacaacataattgttgttgtatcgccaattttacgaaatataccgtctgctgttcatttttttctcgccttgttgcgcctttttttcaacatgttgtatgacttgacggctcgaaatagatagaactcttgatgtgggcctgtatttacttgtgagattcggtgttacccagccggattagtagagcatgttgccgtttatcggatcatttttc

SEQ ID NO: 42426 - DNA, 297 bp, Triticum aestivum
  Clone ID: PAT_TA_42426
ttatacgaattaaaccacatagtgtcctggacgataatgcatatatcgctggagaagcagtagatgctcgagtggatggaatcgttacataggcttctgcagggtgtgacatctcagctatgatgaccaggagatgattctattggacggtcgtttataagcttatcaattggatgcatcagtcataactcaacttacgctccttgcggcaaatggtactttccgcagttcaccttgtagcgagcaagggaggagatatagacgtacgaaatatttatgcttactaaatagctaatt

SEQ ID NO: 42427 - DNA, 414 bp, Triticum aestivum
  Clone ID: PAT_TA_42427
ccctatagtgagtcgtactagtcaaccactcgatgacctattggaatcttcggtattcctccgcattaacgaagggccgtttcccggccaggcatgtacgcactccgaatccggatgagtgtggagccaccaggggctatatattagccccactgtcaaactcctctggctaagtgaaagtgttaaagcattatagtccggttgcctagttcgatgtgctatcacctccttaaaaggaccaagacgttggattaagtgtgaatatgcatcttctgcgaacacccccgcattataggcgtgggggctgaagccgacgacttcaatctttcaggttatatacatgtatacataaacggccgcacaggaggcatcacaatactttcgggcaaaagtataaatacagccttgataaat

SEQ ID NO: 42428 - DNA, 425 bp, Triticum aestivum
  Clone ID: PAT_TA_42428
tgcccggccccccctagagtattttgttttttttttttcactcctcaaccccaataagggactcgtcacattatattgtgcaaacatgtctgtgtccgttctgatcataagatacaggcaaagactgtcatcaccggcaaattcagtgccagagcggcaggctaaccaatcagatgtgttcccagccaggaccgctaactggcatgtcaccagtcatcgcatcacatgcgtctcgtttcaccatatccggaggtgcgcaacctcgggaatctacgtggtggatccgtcgagcaacgggggatgatcgtcttgctgcgataaccttcccggggacgggtctagaggatgccctgcgactgctgaggcctggctcgtgcctaattcttgcatcccgggggatctactaattctatagcagccgccaa

SEQ ID NO: 42429 - DNA, 437 bp, Triticum aestivum
  Clone ID: PAT_TA_42429
ccccacgagtatttttttttgtctttttttgacaaaccaaacacccctccaaactagccctgtttatatttttcggcaaggtaaactgaaaacagattttactaggggtacatttattatagagtactccaacaggggccgtgcagccgtgcaggcaatggtacacagagctagactgcattactagtagtagtagcaagcatgcattattgtactggtaaaatagctaatgcttgctttaacaacctagctcgccagatatatacacaaaacacaccagctagctgttgcagtgcagtactgccctgcccccacagtcatgactcatgagccgtagatgagatcacagcatgagcgtccactgctgggtgggactcccagtggcgggcgacacgatgacttggctagcctcgtgccgaattcctgcaacccggggg

SEQ ID NO: 42430 - DNA, 225 bp, Triticum aestivum
  Clone ID: PAT_TA_42430
tgtctctctctcactctatctctcactatgtcgaaccctgtatctcgggggatctactagttctaaagcggccgccactgcggatgaactacatctatagttcccgctattgagggtcaatttcgatcttgtgctaatcaaggtcagatcagtttcaagcgtgaaattgtcatgcgcacacaagtctcctgaataaatgagacagacgcatagattgtaaaatct

SEQ ID NO: 42431 - DNA, 371 bp, Triticum aestivum
  unsure (1)..(371): unsure at all n locations
  Clone ID: PAT_TA_42431
attattccaacgtcaccggcaagggcccgctcgagaacctcgctgaccacatcgctgatccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacactaagatgaaccatgtttgtgcaatagtggtggtttttgtttcctgctggttaaaaaaaaaaaaaaaaaactcgaaactagctcgtgccgaattcctgcancccggggg

SEQ ID NO: 42432 - DNA, 387 bp, Triticum aestivum
  Clone ID: PAT_TA_42432
gggaaaccctatactgagtcgtattaatttgacacactacttttgatcgccaggatgccgatatcagctgaattgtggttacctaatgagtactttctaagaacaacttcagattcggctcaggactcctaatggccaggtttaataccttcacaatgtctgtaaacatcaaccccatctaattgtggtcagatcttacgtggatcatagcacatcgatacctgataacttcttgacgtcggtcctcatggtcggtaagatctcctagaccaaggctgttccctgtcaccaacacatgcataattcgatatttggacatgtttacacagcacttgatgagtttctcgcgagaaattgtcataacttatgatatgattaaccaagttt

SEQ ID NO: 42433 - DNA, 308 bp, Triticum aestivum
  Clone ID: PAT_TA_42433
ccgggccgacgggcaaggaagtttacattaatcaaaaaaaaaaaaaaaaaaaaaaaaaaaaaggcggcggcccaaaaggttcaaggctaacttacccgtgaaggcaacgtcaaacccctccaaaagggccaccaaatttcaattcacgggccgtcgtttaaaaacgtcgggacggggaaaacccgggggtaaccaaacttaaccgccttgcagaaaatccccctttcgcaaccgggcgtaataccaaaaaggcccgcacggttggcccttccaaaaatttgcccaccctgaatggcaaatggaacccc

SEQ ID NO: 42434 - DNA, 193 bp, Triticum aestivum
  Clone ID: PAT_TA_42434
gggtcgaccggggaggacgacaacgacgacaatgaggaatacaagcacaactacgccttcaacatagatcatcactcttctataatgacacccaatactctatgcagtttgccatcattttaatacgtcctaaatgtgaatatccctgtacttacacaacattatcttctttcatcacatttcccatttttca

SEQ ID NO: 42435 - DNA, 152 bp, Triticum aestivum
  Clone ID: PAT_TA_42435
ctatagtgagtcgtattagtcgcagcagcatgagccctcgggcctggaatgatccagtttccgagcgtactcgcggtaggctcttccaagtacagacgccaggaggctgcgataggtcgtcgcttgaggtcatcgttgcgtcgtcataatct

SEQ ID NO: 42436 - DNA, 380 bp, Triticum aestivum
  Clone ID: PAT_TA_42436
gccgtcggactccctaaagagagtcgtattagggctgatggcagggaatcgtgctcccaagagggtgaataactatgctcggatcgttggccgcatctgggcgcagatcccattcatgtgcggaagcagcatgcacatcaacaatcgactactcactggtcaccatccatacgacggcagtggggctcagcatgttcgcgtcggggacgtgcataacgcggaagtcgctgttcgtcgcgtgcggctacacgatcgcgtctgtgtctatggtgctcacgttcctgataggcctcgtggtgatgctgctcgcgtcgctcgccatctgcatgcacggtaccctgctgcacattgctgttgtacatgccgtactagccctatct

SEQ ID NO: 42437 - DNA, 228 bp, Triticum aestivum
  Clone ID: PAT_TA_42437
ttccctaaagtgagtcgtagtattccttctaatttgcttttactttttactttgcatctctatactatcatatattatttatcatctcagtcagatctcactttcgtacgttaccgatattggattgacaacccctaagcacgttggttgcgttaatctactgaactttgtgtacgtacgagggactccagcgttgcctcctactgggttgttactttggctcacaga

SEQ ID NO: 42438 - DNA, 445 bp, Triticum aestivum
  unsure (1)..(445): unsure at all n locations
  Clone ID: PAT_TA_42438
cggtcgaaattcacgggtcgacctccatctcggagttgtggttccatattcatttggttgctgggcggcaggcgaccttcgaggcacggttacttcgaccactttctcctacgacaacataactggatggattactaattgcagcgcataaattatgtttcattagcataaccatcgcataaccaggcatgaatgtcccatcattatcagggtttattctcttcaactatttttgcgctcatgtgctcataaattttattattagagcaaaatcagcatattctcttttactagcacatgcccacaattttttcccattatagccaacccgcatattgtcttttattggcacgtgcaagttatctccagcaataatttgtggagtccctcattctgctcataattctcganacaacctccttattctcaaataacctccttaatt

SEQ ID NO: 42439 - DNA, 239 bp, Triticum aestivum
  Clone ID: PAT_TA_42439
cctatagtgagtcgtattaaattatcgggtctcatgatgtaacaccgaatcatcattgtaatctccatatgtagatttctttgtactcataaatatatatgcttaagtcgttggacatcaactaatcacttagccgctcaggtgaatctattcgtagttcagagtacgggataggaggttagacgtttactgttgacgtggtgtactccatcacctcatgatttatacatgatgtcctc

SEQ ID NO: 42440 - DNA, 192 bp, Triticum aestivum
  Clone ID: PAT_TA_42440
tagtgagtcgtattaagtgccggatgatatgctgttgtgttttatatgtctatcccatcatatatgtgttgttatttgaattgaattgatttgaacacaaacaggatagagaataactagcaaatgcaaacgatgccgacggcctagccgtctgcataaggccaacgtgagctcccagtagctcgcagttaa

SEQ ID NO: 42441 - DNA, 320 bp, Triticum aestivum
  Clone ID: PAT_TA_42441
atagtgagtcgtattataggcagtcaagacttccagctccaccatctcaagctcctgttcccactcccaataatggtctgtgctacaagtgtggacaacgaggtcatcgtgccagggactgcaatcagaatcagaatcaacttgcccttgcagcatcgggccgtggtaacaaacagccccgcagcaacaacgctaagtcctaccgtcgtgctcatgctaaatacgttgatctcaaccaagctcactaccagccagctactgtgatcggtacactcctcgtaaattcagtaccaggaaccggtccgatgtgacacaggtgc

SEQ ID NO: 42442 - DNA, 342 bp, Triticum aestivum
  Clone ID: PAT_TA_42442
atagtgagtcgtattacgtgatacatcatgatcgtgccatatcaagaacatatagagagagatcgtacagataactactggtatataatctcatccccgatcggtgaattactctctcctcgtcatgcatagcgccggcatgatgaacatggccattcatgtgaacgactccctcgccggcaaggttacttcatgggctcacgagatggtttgtggtggctacagaggcgtgcggtaacggagctcccgatctatgtgatgtcctgggggtttctgtagctcttggacgctttggcatctgaagcttgtcgtgggcgtcaccgaggctaccatgaggtacgg

SEQ ID NO: 42443 - DNA, 263 bp, Triticum aestivum
  Clone ID: PAT_TA_42443
cctatagtgagtcgtattacgcggcgcattaaagattgatgcgacgctctacagtggacttgttgtatgatatacagtgcaatatttcttaatgtcaattcatcgagttaacctttccattttgagtcgctgagactgaggagtgatgtgcagtttgctctgttagacgcgtctgtcactttcacttttcatatgctttgttgtgtggatccgcagagtgctctttcctcctgagtctcggcaagaatattagcaagccatgt

SEQ ID NO: 42444 - DNA, 250 bp, Triticum aestivum
  unsure (1)..(250): unsure at all n locations
  Clone ID: PAT_TA_42444
agtgagtcgtattaaaanctataatggcacaaattttgctgtttgggtaattctcaggcttaatcccattggggtcacggcaccaaatttacagcgacttgtagataggggttatttcacatccatatgatccccaaagactatctcgagaggatgataaattctcgtaactcaatgcacaacgtccaacgcgctttctgttgctttgcacaccgtagttagacctcaactcatgtgagactgggatgct

SEQ ID NO: 42445 - DNA, 271 bp, Triticum aestivum
  Clone ID: PAT_TA_42445
tagtgagtcgtattatgggctatgcgaatatgcagtccgtcggatcaaatattggtgacggcacccaatgcaaggtctacaacggcaagtatggtgatcacattgtggccaatagagttctcaatagtgttggtaccgtcgaagaattggtaacacttgatgatcgcgtcaaccgagacctagataggatttgtcaagtcatgcatcacaagcttgtcgagttcaatgactcatgcaaagatccatgcatcgtcaatgcaactgatctgct

SEQ ID NO: 42446 - DNA, 311 bp, Triticum aestivum
  Clone ID: PAT_TA_42446
tgtaactattgttgttgttgctgttgctgttgttgttgttgttgttgttgctgctgctgctgctgtcgctgctaatgctgcagttgctgttgttgttgctgtcatcaacgttactgttgctgtgaccgttgctgttgttctcggtgtcgctgttgctattactgctagtgcagttgtatgttattgatctctgcagtcgtttatgctcgtacagttgttactgttcttctagttgttgtagatgcaatagctggtggagctagagaatgttatctttattgatcattgatgctattacagaagccttcaaa

SEQ ID NO: 42447 - DNA, 491 bp, Triticum aestivum
  unsure (1)..(491): unsure at all n locations
  Clone ID: PAT_TA_42447
cgccgggctgtaccggcccgagattcncgaggccacgggtaggactacaaaatgaaatgctcttgaagacattttctcttggtctggatttgggcatttttatatcgtgcagtccgcagtttacctgcatctttcgctttgaagagtgtacatttgctatgtcatccacgagatttgttcttgtaaaaaaaaaaaaaaaaaaaaaaaaaaaaaaaaagaaaaaaaaaagaaaaaaaaaaaaaaaaaaaaaaatgaaaaaaaaacaacttggaaaaaaaagaaataaaaaaaaaaaaaaacgggccgcccaaaaggttccaaccttagttacccttgaatggaaattcaaaacccttcaaaagggtccccaaaattcaattcacgggccgtcgtttaaaaacatcgtgacgggaaaaacccgggggttaccaaatttaacccccttggaaaaaatcccccttttccaagcggggttaaaagcgaaaaggccc

SEQ ID NO: 42448 - DNA, 471 bp, Triticum aestivum
  unsure (1)..(471): unsure at all n locations
  Clone ID: PAT_TA_42448
attcccgagtcgacccgcgaccgttgtagcgcgatgcggagggccagatactcctcatttgtcaccttcgccactgccggtgcctgacattgggatggagggggaggggaacaaacagggagcggagtggaagcggcgaagatggaagcaaagagtgaagtggagctagggtttgctccgggtggggattttagtggggatagagtgggtaggtatgggccatggtggtcaggctgacgtggcagacgcgtctaggccaccccatacccgccctagatttaggctgggtttgaggggtgcctgtcagctcgaatggccatgtttggtatanggagcccgactcggtcaaattttagtgacagtgcattgatcaggccatctacccggtcagttttggcacggaccgggccgtccaccatgacgtagttgccacggtaggggttgccgggcaccatacacgacactagagag

SEQ ID NO: 42449 - DNA, 185 bp, Triticum aestivum
  Clone ID: PAT_TA_42449
cctatagtgagtcgtattacgggtaaaacgaagacgaacaataggaacatgcaaaccaagaagacgtagagggagaaggctaactacaggaataagtaatagacgaagatatcgagcttcaggaagcgggtcacgaagacgaatatgaatgtctcgagggacatgcagacgaagaagaagatgaa

SEQ ID NO: 42450 - DNA, 236 bp, Triticum aestivum
  Clone ID: PAT_TA_42450
cgggagattcacaggagagaagcgacggagttagaagttgtaaatatgcattgttgtatcgcgacctgaatgaaataaacgaaataatgctcttgttcaatcggcaaaaaaaaaaaataaaaaaaaagaaaaaaaagaggacgcacaagatgatgaaaacagatgatactactgcatgcgacatcatagctcttccatattatcaactaaatacacatcacaggtcgtcgttaaac

SEQ ID NO: 42451 - DNA, 225 bp, Triticum aestivum
  Clone ID: PAT_TA_42451
tgggactcccagtagtgagtcgtattagatatttattacattagttagtgactagattgggcaggttagttagttggtgccattcaatgcatgtgcaagctcccgtcatcattatcatggtcatcatcagggtgtgatgatagcttagacttgatcaatggcacatattagtacttaaatgacgtgatcctggttacggttatccagtaatctgatgcctcggtt

SEQ ID NO: 42452 - DNA, 236 bp, Triticum aestivum
  Clone ID: PAT_TA_42452
cctacagtgagtcgtatgataaattccagggctatctttctcgcgaacgcgagaggctgaggcagcacgacagagccatgatgggcaagaactactgcagaccggggctcactttcgacgtgtcaccatgtgaactatacatggaacgaagtatctctatgagacatatcatacagattatcgctgccttccaatgccaccttttgcttctgccacccatcacatatcactgaccc

SEQ ID NO: 42453 - DNA, 265 bp, Triticum aestivum
  Clone ID: PAT_TA_42453
atagtgagtcgtattaaaccgacggggttagaggttgtaagtatgcattgttgtatcgcgacctgaatgacataggctaaataatgctcttgttcaatcgtcacaacgggggaaggggagagtgcaggcaaagaagaaacaaaaagggcggacgcccaacagggtgaattgtctaagcgtggatgcaatgagagttcagccatcgtcaatcttgacttgtaacttctagtccatcgaaatcgctatcaaagcttcatgactggga

SEQ ID NO: 42454 - DNA, 203 bp, Triticum aestivum
  Clone ID: PAT_TA_42454
cgcgttgtctgttgcaattcccaatagtgagtcgtattacaggatggcttattggtgtgggaacaactatggatgcaatttagactcgtgctgataagctggttgtccaggttctacgacgagggcatggggctctcggagttattcgtgtaacttgatatgcacttcttcctctctcataatgctgttgtgtcttatatcat

SEQ ID NO: 42455 - DNA, 350 bp, Triticum aestivum
  Clone ID: PAT_TA_42455
gtgagtcgtattacagtacgaatccgtacgtatggaaactcggtggactatacggtcatgtgctggtggtactccgtagatcggactggagctctcacgatgaagatggcaacttcttctgacgtgtgttatatattggtgagtgacatgatatgatatgatacaatgcagctcaggatatcagcgtgtggtttatttcaacttctatgtgagtttctctctatttgtagcagtgagattagcacgtgtactcctttttgattaaatcatttttgatgtacatttcttttccattttttctatatgatatggtaggacatattctacacaaggatctaccttgcattttc

SEQ ID NO: 42456 - DNA, 346 bp, Triticum aestivum
  Clone ID: PAT_TA_42456
gctattcactatagtgagtcgtattacacttcccctgtggtactcagtacgatagcttgtacaggaccgacaccatctttcagctgaagttcgagcgccttcgcgacagctggcaaggctgtctgcatggatatgtacgcatattgtgtatcccatgtgtcgtgtcagacacactgatcataagcggcacgttgggtcagatacttcgatctgccgttccctttgagtgtgacaggatcttcctgtgtcctcgagacttgcatagagatgcatatgcagtaacgtgacgtgcaatcaccgacttagagtagtgtcagtctgttatcattgcatacctgcctaaatc

SEQ ID NO: 42457 - DNA, 352 bp, Triticum aestivum
  Clone ID: PAT_TA_42457
ctatagtgagtcgtattactgtctgactctgcacgtatgggagctagttcaacaatatgaacatgtgccggtggttcaatgggctaggacagccgatctagcatgtcttcacaatagtctcattctttcatgctaatcgtatcacacgcttagggagcgcataagctaactgggctcaagtatctcccaatcagcataattaacgcccatcgcccttttgaaattaggacttaactactcatgccatatgcatgcattttgatagacagtgtttattgatctctctctcactcactctctctctctctctcactctataattagctcacatcgtcatagaattgacatgttt

SEQ ID NO: 42458 - DNA, 390 bp, Triticum aestivum
  Clone ID: PAT_TA_42458
cccaatagtgagtcgtagtattggttgtctgaacctgatggatatgaataaagttgtagcatacattcaaattcaaacatgcacacagtttggaaaagcagcaattaaattgcggtgaaattacgctctccaggctgtcacggcacacatggttggtaaaatacaaacatttgcgatttgcaccataatccgagacggttcacagacaggaaacgtttgcaagcatgcacacagttgccgtttgcaaagcatgtgctatgtcagacaatatcacaaacggtgcgggcaaactaaacgtttgtgttagttgccttatcgtacacgattcgcaaccatgaactgtttctgatgaagtatgcatcgtaaacgttgcaccacagaatagcgtgt

SEQ ID NO: 42459 - DNA, 269 bp, Triticum aestivum
  Clone ID: PAT_TA_42459
cctatagtgagtcgtattacacgatcaaccttcttatgaatattaccactgtgtctgtcatacgtcttgtctattaatgaacatctcatcattggcctactgctctttgcatgatcatgtagatgtcatcgtacttgtagtatggccaacttcatgattttcatacatgtcgctcttgattcattgcattgcccggtgaatcgcccgatgcattcatatatagtcatatcttgttctagctttgggttgttaatccgtaaaagtgtgtt

SEQ ID NO: 42460 - DNA, 398 bp, Triticum aestivum
  Clone ID: PAT_TA_42460
acaccctatagtaagtcgtattatgacgtacaaaacttaaactgcagctaaccgcatgcatgtttcacactaagctgattcttttgctacatagctcagtaaaagtgaattaaaccaccttctttttctgacagtcaataattagatgcaagggcctcttgctaggtttagttagacttaatgcaagtgtctcttacttttatttcaaggttggtgctatttttcgaagcaaacttccaagttctgcatactaaatagtctgatcaagtaactaaagtgtcctaaatacgtagcaaagtgggccagttcgcttctgtgacgatacaacacatcctggatactagtaaatatcattagtgccttctctttgtccagtttgtggacttatagaatttgag

SEQ ID NO: 42461 - DNA, 347 bp, Triticum aestivum
  unsure (1)..(347): unsure at all n locations
  Clone ID: PAT_TA_42461
tcgtattatattataatancntatagtgagtcgtattatacgttgagtcatttgcctcgtctctatacttgcccgttgtagccagtgtataccctcagctctgcaaacttgatgtcgaccccacacctcacgaccctctcggcatttcatagggcagctctgttcgctctgactacgctcgtacatacatccctgttgtcactaacagaacatcgttgttgccctgagattctcatgaactgtcattgtcatcacttctccatgacgcaaccgctccgacttcacgattgacaaccgtcactggatcccttactgacggactaccgacttttgacactgacccttgc

SEQ ID NO: 42462 - DNA, 244 bp, Triticum aestivum
  Clone ID: PAT_TA_42462
tatagtgagtcgtattaaaacatacgactcacggaagggagtcctcgtcacttggctgactcacgctcgcgtctccgaagaaatcgaacgcacgcacacgacgtcgcaggacggatttctgggaccattgccagggaggtcttcgctcaagtcaagacagaccaggtacccatcacataggccatctccctcgcatttacaggagttgccatttgcctctcggttgcctcacccccacttcacc

SEQ ID NO: 42463 - DNA, 338 bp, Triticum aestivum
  Clone ID: PAT_TA_42463
gtgagtcgtattagatctcacgactcacggaaagacgtagcctacactttgctgcatcaccctcgccccttcgaggaaaaccaacgcaagctcaagacgtagcaagaaagatttctggcagcattgccagagaggtcttcgcgcaagtcaagacatagcaggtacccagcagaaacccatctccctcgcatttacattatttgcgatttgcctcgcgttttcctcgcgcccacttcagcattgccgttttattgaagctctctttccgaatctccgcctctcttttcgcttcccttcttttgtgtgctcgtttgcttgtttgaccttatgggcgcgcc

SEQ ID NO: 42464 - DNA, 436 bp, Triticum aestivum
  Clone ID: PAT_TA_42464
gatgggaaaccctaaagtgagtcgtattattttataaaaattatagtattattgaaaccaaaattatataaaatttatgcaactaaaattatcaaagtattttctgttcaaaacattaaaagaaaaaagaattttcataaagaaattttttgttagaaactttaatagcagaaagaattatcataaagaattttctgttagaaactaaaataacaaaatatgtttttgaatataatgataaaacacagtaatatttaatagcatgaaaaaagaatcactcaaaaatctacttttatagtaaagctattcaaaaactagtgactcacacaaatttccaaaaattcaaatttaaactattcaaattagaaaacaaatggcactaacagaaagtttaaattttttagtacataaaagcaaaaggaatcactgaaaaact

SEQ ID NO: 42465 - DNA, 412 bp, Triticum aestivum
  Clone ID: PAT_TA_42465
cctatagtgagtcataatatgagcgagacacctttgctaaaaaaaacaagcggcacattaacataaaattctttttccttatgtttgtttcatttttcttcactttagaaaatgttccagaaatatatgtttggacaagtattctcattaagggcttgtgtattctcatcatgcatctctaataagtgttcacctatttaaaaaataatcattaactaaaaagttgtcagtattgtcaaaaggctcacatcaataaaattttcctcggacatttccaaaaaaaaaaactctaagttgaatagtttctagatgaaaccgcaaacattttcacaagtacataataacattttcaaaaaacaaacaagaataacaattttgaaatacaccacatttttctaaaacaacaacatat

SEQ ID NO: 42466 - DNA, 321 bp, Triticum aestivum
  Clone ID: PAT_TA_42466
ctcacgggtcgacgggactccatatagtgactcgtaatagcaggatcgcaagatgactgattcaaataagtcatacaacgtccttgttcaaccgtcatgctccagttcagtagagaactacactatgattttttgatctacaagagtaaacatatatgcatcatacggcggccgctcgatatgattcaaacgtaattagcatgtgctgaagatctcactcttcattagtggcagttacactccattcaatgggcgtcgtcatataacgtcttgactgggaaatccctgtagttcactcacgtaaacgccaagcatcacatc

SEQ ID NO: 42467 - DNA, 215 bp, Triticum aestivum
  Clone ID: PAT_TA_42467
atagtgagtcgtattaaggcgagacgatcatcacaggcacgaacacattagtcgcgccacgggctttgggcaagccacttgggctggaccaagaaagatgagagacgagaggttgctgcggccgagctagacatcgaaggagtgagttcagacatctggcgctgaaggagtgaggtccgtgcgcaggtgaggtcgtcggtgtgatcacgtcccac

SEQ ID NO: 42468 - DNA, 424 bp, Triticum aestivum
  Clone ID: PAT_TA_42468
cctaaagtgagtcgtattatgctctaaaagatgtgcgagaggagttgacaattcatggccccagcgagtcaccaaccaatcccatcggttccaatgagtagcggagctaggcaggaatcatgggggcagtcaaaaaatggaacaactaagagggtaaaaaataatcttttccttatctaatctccacacagtaaaatttcttcactgttttgcctaaggctgggggtcggccccctcagacatgcactagccttcgccactggttccaatatatgtgcgagaacaacagcacatcggaaattcttagtctacgccttgtgcaagcgattgcccctacttccgcggatgtggtgcacatattttggaggaaacagtaaaatgcaaccaaaaaaattaaaaattaatatcaacttcatttgtggca

SEQ ID NO: 42469 - DNA, 373 bp, Triticum aestivum
  Clone ID: PAT_TA_42469
gctatagtgagtcgtaatagatctacgggttgtgctgatacattactatagcactacatggggaacctaagctacctaatcctcgtgtactttcgacatacgttcgtccagagtaagctctacgatgaaagcttgaacccgcttgtgatggagatgttattactgtggtgacctgaaatcttgagtcacagaggctttcaagcattatgcacagccactgaagaaatactcggacacatacacccataatccatcatgcgggactttgcctcagattcgtgaattacaggatgaatgatgtgatgttcaaactgctggatatggcttactgaagacgtaccacgcgaacaacgagtactgtccgttttcagat

SEQ ID NO: 42470 - DNA, 406 bp, Triticum aestivum
  unsure (1)..(406): unsure at all n locations
  Clone ID: PAT_TA_42470
gtaggacgttgggtgacccgatagtgagtcgtaatatgaagtgttctgtcgcgtagaatattctagtgttatggaacttcacatcgaattccaccttaacaggaacaagtactagattgtagcttggaagatcagtataagacataaaggttaaattagttactcctcgtacaacaattacagaatctagactacaacgaaacagattcaaaatccaacgatgcaataaattcactcacaagagacaatatgctcccatcagccccgaaggcatgtacagaacatcagctttctgcacagcatcggatntgatcagctggactcatagactcagcacagcaccagccggcgaagttcgtagagcgtccgataagccactccacaggatcagtaacagtcgatccaa

SEQ ID NO: 42471 - DNA, 222 bp, Triticum aestivum
  Clone ID: PAT_TA_42471
gggccaccctatactgagtcgtaatatggcaggatcccggcctagtaaacgctccctgatcatgccaagactacgagacttcacacgcccgaccatgtcaatggcgactacaccgtcttcgccaacgccaggataaacagcaggaagatccataaggccacgtcctgaacatgtgacaggcttgaagcaacactgtgtgagcaattccacgccgtaggacac

SEQ ID NO: 42472 - DNA, 409 bp, Triticum aestivum
  Clone ID: PAT_TA_42472
gatgggacaccctaaagtgagtcgtattacgagaaaaagcagggtacattatcccaaaatgttccatcttcctagaaaagtggattcgttccagaaaagttccagaagatgctaatggtaagcaggaggattgtttacgaagaaacaacagaaaaaattcatattctgatacagaggagttatataggaatcgaaatagtcgttgattttctttgtgaagaaaaaaaatggatttcattgaagtaataaaactactccaattcgaatagtagttgagaaagaatcgcaataaatgcaaagatggaacatcttggatacggtattgaaggagttgaaccaggatttccaaatggataggatagggtatttctatatgtgatagataatccaaatgcaaaaatttgtcttc

SEQ ID NO: 42473 - DNA, 207 bp, Triticum aestivum
  Clone ID: PAT_TA_42473
ttaccctatattgagtcgtattagcatcgtcaggtgataaatttattcaatttttgtcagtagtccagtcatgctactcaatatacacttagtatagtgcttaccatcatatattcgttctatgtcataatgtaagcatctgtgcatccgctgtacagcatcagtctcactagtcccaatatgctcatatcgtcagtaacggatctg

SEQ ID NO: 42474 - DNA, 411 bp, Triticum aestivum
  Clone ID: PAT_TA_42474
agtgagtcgtattaatacgcagaagatgccatgactcccatatctgaaaccttctcacttgacataaatgccaagctggatgtgtatgaatcttccaatttactgtgtgtttttatcgaaatatatggtactgatgctactatttgtctcttgataggcatacggtgggtacgataatgaccagagggcacagccgtattcctatatactctggaagaccaagcaatattatcggtcttatattggtgagtaagctgacattttcaagaattaactgcattgattgagatcacatctcattagttaggttcattctgctacatatgtttttacggcctccatgttatgagctctcactggcgaacatttttggagttgcactgttcagaccggtgtcctaacaagactttg

SEQ ID NO: 42475 - DNA, 430 bp, Triticum aestivum
  Clone ID: PAT_TA_42475
gacgcgtaggtcgttggaacaccctagagtgagtcgtactacggaggcaccgtgtcacaccgtgacggacaatgcgccgcacgaaccagcacgccgcatgaaccagcagacacttcgacctatgcccccccttcaagatgtttatgaaaattaaacgagccgaaggcgagcaggaggttccctcgtgcctgaggcgccgtgtcacaccgtgacggacaatgcgccgcacgaaccagcacgccgcacgaaccaacacgccgcacgaaccagcacacacttcgaccagcacacacttcgacctatgccccccccccttgcagatgtgtatgaaaattaaatgagccgacggcgagcaggacgttccctcacgccggaggcgcggtgtcacagcgtgacggaaaatgcgccgcacgagccagcacgccgcagg

SEQ ID NO: 42476 - DNA, 329 bp, Triticum aestivum
  Clone ID: PAT_TA_42476
ctcgtgggtcgatggggaaccctagagtgagtcgtatgacgatcaatgtaacgcacgcctctacctgatcatacccaattggataaagtgtgtagagatcatgtccgtataccgtacgtgctactgaagtaaaagattgagtctgtgtctaagggtacttatataacaaatcaagttattcctaatatctacatccctcatcatgacagggtacggcataacccacaattatgaagttacctagcacatgagcaactatacatgacatcatcgcagtctcttacaccgtgtgtgggccccccctcgagagtgcactacatgatccatac

SEQ ID NO: 42477 - DNA, 309 bp, Triticum aestivum
  Clone ID: PAT_TA_42477
agtgagtcgtactatgcgatcgacgtcaaagttcttgtgcagtctacgtcatagcccgtccacgggccctcgttaatccacgtcatgggtggtagtttctcagcgtcacgcatgggaatcgcctggcgtcacatgtcggagtcgccatctggcgtattacccactcggcacctaacgatatccctatgcagcggttgctgatcgtgcttggcgacagggacgtaccctgaagcgccgcagggagctccacggttgcggtgcatgcacggagcttggtgtcgacgtgtcgccggcgcgcgagcgctcgag

SEQ ID NO: 42478 - DNA, 214 bp, Triticum aestivum
  Clone ID: PAT_TA_42478
atagtgagtcgtattaggaagtggtggttgtctgcacgggtgaagtcgccagccactttcacttcgaagatacagaccttggggcgatcagcatggagagaatgcgaggccacctcggctagtagattactactatagacgagtacgacacggacgcagacttcagtgaattagtgcaactgcctcagggtgtatcacggtgagttgttcaggg

SEQ ID NO: 42479 - DNA, 391 bp, Triticum aestivum
  Clone ID: PAT_TA_42479
atagtgagtcgtattaagatcaacggactcacgcttaaaggatatcttcattttccagcatgcttcggattcctggagcgttgcaagatcacgctcaagtccgtggagaggaacccgtcttgggaggttgacggtgtcaccgaccatccaggcaccagcaggtcttagcactggcttacgagaggctggaaggccttctgtagggagaacgagctcaaggcatgagagatcagcaccttcaaagtcatcagcatcacgcagtggcatgtagtcatcgaccgcggctacaaatacggttcacagatgatcttggctgatggcggacctgctggttttgcgaacctaactagtatcatgatgaatagtgtggtgacctgataagccagctgcc

SEQ ID NO: 42480 - DNA, 366 bp, Triticum aestivum
  Clone ID: PAT_TA_42480
tagtgagtcgtattaagggagatgacacttgaggatttcctggtgaaagctggagttgtcgctgacgggcatttgacggatccgattgacttgccagctaacatgggtgcggttgggagcagtgtaattgaggctgctgcgcccagtttgaaccccggagcgcattggttacagcagtacctggagccccagcatccacgcatggcaggtcctttcatggcaagtcatttgggtcctcagccattgtctgttgctacaggtgctatcatggaaccaatttacccggatggccaaattacgtcaccaatgctcgatgcgctttctgatcctcagacacctaggcgcaagcgtggtgcctcaaatggt

SEQ ID NO: 42481 - DNA, 203 bp, Triticum aestivum
  Clone ID: PAT_TA_42481
gtgagtcgtactacacgatccacgcttacgaacacacgaatgacgagctagcacactcatcgcatgtgtcaccaagatcacagttcacatcacctcctactgcaacagggacactggcgacaacgctaacgatggacaacattaatcaccatgccacacatcaccgctacggcaacacgggccacaactgccatgccaccacc

SEQ ID NO: 42482 - DNA, 327 bp, Triticum aestivum
  Clone ID: PAT_TA_42482
gagtcgtattactgtgcattactatggcaaggtagtgtggtgaagcctgcctttcccaggtggttcggtgtgcgtaagtgccagactgaggctgctgccaagaaggtgtttttagataccaaagttgcagactactgggacatggctgtcaacttcacggaagatttgtcctgagctaaaatttctgttgatgacagtgagagcgatcgctgcggatcactatactttgtaatgtcaccaacatgccatttttagacatgtggtgaattgaacgcataaaacggctgtcggatttttgcaatatgctttcaaaaaatagctacaaag

SEQ ID NO: 42483 - DNA, 365 bp, Triticum aestivum
  Clone ID: PAT_TA_42483
acgggccaaaaaaaacaaaaaaaaaaaaaaaaaacaaaaaaaaaaaaaaaaaaaaaaaaaaaaaaacatcaataggatgataaaaatataaagcctaagtaaaaataatatggaacagaataccccgaaattcccctgaaaaaatggggccccccaaaagtttccagccttggtttcccttattggaaggccaaatcccttaaaaagggtccccaaacttaatttcaggggcggttatttaaaaattccgtgatgggaaaaacctaggctttacacaatttaacccccttggacaaaaaccccctttcgccaattgggctaaaaacaaaggggcccccaccgttgccccttccaaaaattttccc

SEQ ID NO: 42484 - DNA, 122 bp, Triticum aestivum
  Clone ID: PAT_TA_42484
agtgagtcgtattaggacagctgcacggacggagcggtcagggtgtcaaggcatcggcgagtcgaagtcatacagaattgcagcaccacagttgaacagcgaccgcgggaacgacgtgcgag

SEQ ID NO: 42485 - DNA, 138 bp, Triticum aestivum
  Clone ID: PAT_TA_42485
tagtgagtcgtattagatgctccaggcatctgtgggcgggttcgtctcttccagctgcgtctcttgcgttgattgacttgcattcctgagtctgtgtgctctgtggtcgggctagggagatacccggcgttcccgctc

SEQ ID NO: 42486 - DNA, 359 bp, Triticum aestivum
  Clone ID: PAT_TA_42486
gcaaagtcctggtgctgcatgaaccgtctaacattgaggttagcagggaaaaatttcggtgtttgagaccacatggttggttaaatgatgaggtcattaatttgtaccttgaattgttaaaggagaggggaataagagaaccaaaaaggttcttgaaatgccatttcttcaatacatttttttataagaagcttgcttgtggaaaaactggatatgactacaaatctgtaaaaagatggactaccttcaggaagttgggttatgagctcattgaatgtgataaaatctttggtcccgtacatcaaaatgtgcattggtgtttggcaagtataaacataaaaggcgaagacagttcaata

SEQ ID NO: 42487 - DNA, 381 bp, Triticum aestivum
  Clone ID: PAT_TA_42487
ataaactccagatccataggagacggcgcgctgctgctcgtccgccgccggcagccctccccaccgccgcaacctgccttgccccgccttgaatcgccttttaaccgcccggctcccccttgtctgccgccgggcccctccttgtctgccgccgtccgtcgtcgaccacctcggccgccgtctccgaccgccggactccctccgccgcgctccctccctcctccgccgccgtccccgaccatcggaccgcgtaggctgtgtgccttctctgcctccccgaccacctcgcatctcaactgaatcacaatcttagtgcccctagagatggaaggaagaaagacaggtttctggtaaaccctggtaaatattcgtgggaggtca

SEQ ID NO: 42488 - DNA, 436 bp, Triticum aestivum
  Clone ID: PAT_TA_42488
caggctgctcgttggtgccgagccccagcgtagcacccatcgtctccatctcctgcgtcaggacgctgttcccacggccctccgacaggttcgtggctaagtcacggcgccgcgatggcaagtactccatgcgccctcggtcggtcgctgccgtcgccgagcagtcctcctatgatttcgcatcttagttcgctactggagatgaacaggaccaagagctgcagagatggcaagtacttgacaagaaagaattacaggcagttccacctggaggtgggacaggctgtggaaattgaatgtattgtaaagatttaggatgtaaaccaggaggtgatcaaagtattggaggggctgggatttcgtgaaggccataccattgcaggaaacttggcttacttgggagtatgatccatgctttatgatgttgggagtgact

SEQ ID NO: 42489 - DNA, 375 bp, Triticum aestivum
  Clone ID: PAT_TA_42489
ccctctctctccctttctggacctctcacgagcaggggcgcctttcctccctcccatcctcctcctcctccggtcgatggaggagccgccggaccacgccacggccacgagatattcttaacatatggattaaggaatttatacaagagggaagcctgttcttgtttcagccggatctcagactcataattgattgagttggaaataaggaaagaacacttcttggaggagcagcatgtgcagtagctttgcaaacttgcagtaacaagaaatgtctggagtgcttgatagtaacagttccttgctgcgtaagtcggccagcggggccgaagccagagagacggcgctgcagctggaccaatcagcgcgcggcgg

SEQ ID NO: 42490 - DNA, 250 bp, Triticum aestivum
  Clone ID: PAT_TA_42490
cccacgcgtccggtgctaggtcacggtccaacgagcgcgttggtgacctcaccgtctctggcgaagcagcaccggcacccagggagctcgcctgcatatccggcaccggctacgtgggcgagctcaagaacccgctcctaggcgcgaggcgcgcgctcgctcatgccgtctacctcgaagccgccaagctcgagacgcaccgggaggaggctgtacccgcggtcgaagcaagaaaatcctgtatccccgc

SEQ ID NO: 42491 - DNA, 437 bp, Triticum aestivum
  Clone ID: PAT_TA_42491
ctgggacaaaaatttggataatgttctttttttgcacctgcttctcgcctcctatgtttgccatatatttgtgcattttttgtcaataacaatgatgctaagccctaagcaaatgtttctttcatttggggtggttctttttgcacgattatcattttctcctgcttgtgaaacagcctcggtgcccgatgcggtgaaggcggagctgctgcaacgcatccgatcctttctgatgtcttcctcgctttggtagcccatgtagcataccaatcggaagtcgcgtgtaggaagcttgaagcatcgatcttgaacgtgtcacacttcagggaagcagcaaatatcaacataaaacggatctggtgctgtggacgtgtttcctggtcaggcatgtgagtgggccttgtttgtgactgcaccatcaccacactgtatttgta

SEQ ID NO: 42492 - DNA, 376 bp, Triticum aestivum
  Clone ID: PAT_TA_42492
cggacgcggggctctccacccatctcagcaaaaaagaagctagcacagcctcctcaagacctccttctccggcgtccgcctcccggcggcggcccgcaccccgtcctgcgtcgccaccccgcgcgccggcgccatctgcaactccatctcctcctccaccccaccctacgacctcaacgccttcaagttcagccccatcaaggagtccatcgtctcccgcgagatgacccgccgctacatgaccgacatgatcacctacgccgacaccgacgtcgtcatcgtcggcgccggatccgcggggctgtcctgcgcgtacgagctctccaaggacccctccatcagcatcgtcatcatcgagcagtccgtgtcccccggc

SEQ ID NO: 42493 - DNA, 453 bp, Triticum aestivum
  Clone ID: PAT_TA_42493
gacgctcttgattgcagaggaatgcggcctgactggccaaaggcctactaccggcagggtgcagctctgatgtcactgaaggactacacgaacgcgtgtgtggcgcttcttgatggattcaagttggacctggagaatgccgagatggaatctgcattacgggaagctatggaatctttgaagatatcgaaaggcggcgccaaggcaacatgacatgagcttgagctttgcactagtgctgaagatagatgcatgcagtcacctctcgtgaaaaaaagacatcctcttttcaagtccttttttttcctgcaaagtttatttcgtgcactagtgtggagctgtgccctctagatgttcaagtaataactcccttagtcatggaagtgcagtttgttatctttactgagaccggtcatgtgggtagcaattgactcaaattttttgcttgctctt

SEQ ID NO: 42494 - DNA, 431 bp, Triticum aestivum
  Clone ID: PAT_TA_42494
cggacgcgtgggcggacgcgtgggcggacgcgtgggcggacgcgtgggcggacgcgtgggctggaggaacatgtggttgttccccctcctccctcccgcatcgcccccccgcgtggcgaccgggaggggaaccctagatcgtgccgccggtctccccttccttcctccctcctcctacctcgccgccgccagggcccggccgggcaaaggcctgtcggcgccggcggaggcaaagcatcctcgtctgcccgcgcggtggggttggcgcaggtcaacacccaggggcggggcgtggcgctaaagccgggcgccacagcggttcgtctgcggcgacgatgtgacgggcggcgcggtgcggtggtagtgtgtgcctggggcggccgcggcgttcggctgtcttctcctccggcggcaagggctgcggtcggcat

SEQ ID NO: 42495 - DNA, 445 bp, Triticum aestivum
  Clone ID: PAT_TA_42495
cccacgcgtccgctttctcgctcctccccctccgatctcccgacgagattgtactcgctcccggatcgtcgccggagcgtctcctcgatcaggcaagatgaacaggaagccaggcgactgggactgcaggtcgtgccagcacctcaacttcagtcgccgggacctatgccagcgctgcggcgagccacgcagtgccgctgaccgtggcagcgtcggtaggcgctcttggtggtgactacgccaactttggcggccgtggcgggggtggttcctcctttggtaccggctttggtgccggctctgacgtccgcccgggcgactggtactgcacctgcggagcgcacaacttcgccagccgctccagctgcttcaagtgtgctgtcttcaaggaggaagctgccgtcaatggtggcgctggtggctttgatggtgacatgtcacgctc

SEQ ID NO: 42496 - DNA, 430 bp, Triticum aestivum
  Clone ID: PAT_TA_42496
agcagcagcactggcacgggcttatatattgttggcttgtagcataaattgttggcacgacagcataaatcgttcagcgtcttgacgcactaatgcaatcgtactgacaattggtagtaaccaaaatcatataaaggcagtctgctctcctttaaattatatttcataaactatattgaaccactgcagctgctatagatttgagattcacatctttttttacattgcctgctctaggaagttactgttgcgtagttagtctttttgcactgcatttgtacaattgtatattcttgccattactaggtgattccttaaattattcagttcgttgtagcataccagtttgatggaatgcctaaggcctaaggagataaacattggtatccataatagatctacctaaaccaacaggcacaaaacatgcata

SEQ ID NO: 42497 - DNA, 460 bp, Triticum aestivum
  Clone ID: PAT_TA_42497
cccacgcgttcgaattggtgagaaaccatatgtagatcttttctagaatatgtagaatttatagaaataaggaatataaattctaaaacgagtacatcattatgtagtgctacagtaaagagcaaatgcttaatgatgtgctccacccaatccatattaattctctcaaactaatattgttcggaggaagtacttgaattcaccattagaggagagaaatgcacatggttcatatttgaaatatattcaatcaactaaaaggaagtcgagttatacttgacgcaataatcaaacaagaggttaatttattactctgaacatttagaatagcaaactagcacgagaaaatctaccaaatattaagtccagccacacaatgaaaataaatatgaacgtgaagaaatagtcgaaagtgtgcctttactgaaaccatgaaatatatcttacctagaacacattt

SEQ ID NO: 42498 - DNA, 271 bp, Triticum aestivum
  Clone ID: PAT_TA_42498
gcagaacaggcgatcgatctttagctgttgcgagtcgcgaacctcccccttcgtcaagatgcagatctttgtgaagaccttgaccggcaagaccatcaccctcgaggttgagtcttctgacacaattgacaatgtgaaggccaagatccaggataaggagggcattccaccggaccagcagcgcctgatctttgcaggcaaacagcttgaggatggacgcaccctagctgattacaatatccagaaagaatccaccttgcacctggtgctt

SEQ ID NO: 42499 - DNA, 363 bp, Triticum aestivum
  Clone ID: PAT_TA_42499
cattccgtcgcggcgatcgctgacctccctccatcgccgcaactgcaaaaccctcctcgccggtaacttacccctgcgaccatccatggccaccttcaccggagcaccgctcccgccggccggcgccggaaaggagaagccgctcgcgcgccccgcaccggcaaccgctcccgcggacctcgcgaatccagggaagaagacgcgccgccgggtgccgatgacggacgaggatcggtggaggatcgaccgcctgaaggagctgcacgcgtcagggaccgaggagctgcacgagctgatggacatacacaaggagctgcgcgactaccacgacgagcttctgttccagcagaggtgcctggccgc

SEQ ID NO: 42500 - DNA, 276 bp, Triticum aestivum
  Clone ID: PAT_TA_42500
cacgaccgtcctcacgagagcgattctaagcgcggactcaagctcctacttccacgcagatctggaggagcacgcggagtagcccgcaccgtggacacctgcacgcctacctctacgccttggaggagagatgggacgtaagatgacgatgatgttcacccagctgttcacccagctggagatgaagatggtgatgaggggtctcaaggccggtgttaagaccactattctgaacacgctcatgctcaagcagatcgtcagcaagatcgtaaccat

SEQ ID NO: 42501 - DNA, 424 bp, Triticum aestivum
  Clone ID: PAT_TA_42501
gctgcttccgcgtagataggaaacctcttcgacctctttcatcttgattggatccccttggtcactgctacttctagctctgatagattgagggcaggcctgatcgaggagtgcaagaaaacaacaaaaaggttgaagggaaggagacgaagggcatgggtacttgaaaaataagcaatcacgttgcctccatcttctacagaccgagttcttccatgaatttgaccctagacgatctggtgacgctacagacggcagagagacaaggacagctcccctcgctgcatgttcgtgcccactgcgacttttctgtttatcaggatgaggcagataactctaagcaggagatagagaagcatttggttgctgccttctctgttttggaactaaatctcacgacagaggggcatgttttttggtcatt

SEQ ID NO: 42502 - DNA, 454 bp, Triticum aestivum
  Clone ID: PAT_TA_42502
cacaggtgttggcttattcacaatcaagctagattctgggctggttaagaaggttgccgagtctggggtctacttcagcgtcctaccctacatgagcttctatactccagatcgtggtagatttccatccctggcggagctcactgatgcatgatatgcgccgctcaagagcaagagtgcaaggccttgcgaaatggatgaagccattatcataaatgtactggtaggggcttcttgcaaaactaccgctatcaaatcctttttttattttctggtggggaggcaaaggacgactggtgcgaggtattatgaccgaaaccaaggacgcataatttgaatgatctgggccattcggtttgtccgaagttcattcaaatgtactaattcggattccaaagcgacaaaagtggaacaaagaccacatatgctgccatatgaagctgcttcttttttt

SEQ ID NO: 42503 - DNA, 335 bp, Triticum aestivum
  Clone ID: PAT_TA_42503
cccacgcgttcgggggttggattctcctctcgactcagggctcggttccaggtccgtctcggttccagtcggttctttcgggtttagaagcggcgtagaggacggcatggcccacgtctactaccgctgcttcgagggcggcctcgactacgacaccgtctaccagtccttctagaacgccttctacaacttcggctacaacatcatcactgacatgatgactgaccgggagacgggctcttcccgcgggatctggttcttcacctaggcgttgcacgaggcgatgcacgccgtgatcgaggtcatgaacgaccagcacctggacagccgtaaca

SEQ ID NO: 42504 - DNA, 249 bp, Triticum aestivum
  Clone ID: PAT_TA_42504
atcccgcagcgcaagtcgaggaggaaccgaagaagaagaagatggcgcgtaccaagcagaccgcccgcaagtccaccggcggcaaggccccccgcaagcagctcgccaccaccatcgcggcgaggaagtcggccccgaccaccggcggcgtgaagaagccccaccgctacaggcccgggacggtggcgctgagggagatccgcaagtcccagaaaagcacggttctgttcatccgaaagtggccgttcc

SEQ ID NO: 42505 - DNA, 456 bp, Triticum aestivum
  Clone ID: PAT_TA_42505
ggaagaacttctttcttatcttaatgttttgtagaacccccagattgaccatatattgcatgctatcattcacaatacatgttctgtctttcctatcatgtgttccgagggttcaatctgcaagaaaacccatcagacctgtatatgtcatctgatttagatcacttaatttcatacatggattgctgaggttttttgatcttgcaggtcgcggcgaccaccaagaagacacccaactcctgcaccccgaactaccctacccgagcctgccgtcgcagctgctgtgtcaagtccacaacatcaccatgcatgctgacaaggacaatgacaggtctacgcacagatgactctgcaaccaataaactctaagtactgtcggaaagggagcttggtgaagatattcatgacatgctgaactgcgttttctctacatgtgcttttatcggtttgcatgct

SEQ ID NO: 42506 - DNA, 420 bp, Triticum aestivum
  Clone ID: PAT_TA_42506
ctacaaagagcatgatctttttggcgcataacgacaatgacattctccgcccaggggatattgaatcggtaccttttttattgaagcattaggtcaatttcaaaccataaagattagtaaagagcaactattccctgagtccccttttggggccttgccttctttttgtatatccatttctttagcatgatattttagcatgttcatctaacagacccttctttcattcctttatagcgccgtgcggttcattctcctttggtgatgggactcatggtcctatatgtgcatttggcaaccactggaagaacatgcgacgactgggctctcaagttcagttatcataattaacttcgatgctttggagtgttgtttctagctggtgtaaaattggcaatgacctatgttggagatctcacg

SEQ ID NO: 42507 - DNA, 447 bp, Triticum aestivum
  Clone ID: PAT_TA_42507
aagatcactcatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcctgctgatgacaagaagaagatcgaggacgccgttgacgccgcgatccagtggcttgacgccaaccagctcggtgaggttgacgagtttgaggacaagatgaaggagctggagggcctctgcaaccccatcatcgccaagatgtaccagggcgccggtgctgacatgcccggaggcatggacgaagacgcgccggctgcgagcggcggtgctggccccaagatcgaggaggtcgactaaattaggcgcttttatat

SEQ ID NO: 42508 - DNA, 194 bp, Triticum aestivum
  Clone ID: PAT_TA_42508
cccctccacccctcgttctgttcttcatcacaattagctgccttttttttatgctagagagtggactacggggtcgatgtttagtttcatggatccagcctacccgttctggcttaaataaatcccctgtccctctcttcccattgtctttacctatgtccttattaattattcatatttttaaactattaatg

SEQ ID NO: 42509 - DNA, 295 bp, Triticum aestivum
  Clone ID: PAT_TA_42509
attcccgctcgacccactcgtcctccttttgcggattgaccaccaaccacctccgtctatactgaccactccccccggcgcagatggagatactccgtgggtgcttctgtgccgacctcaacttgcttgagcccgggttggctaccgtcggaacggccgccgaatgttctccagaaaagttcaaaaatggctaggaaagcccagaggtcaagccttggtggaaaaaggacgagaacatggccgagtatggaaccacatcattcagaaaatggcacggtgatgcaaaggacaaaaa

SEQ ID NO: 42510 - DNA, 271 bp, Triticum aestivum
  Clone ID: PAT_TA_42510
tatacgcttacgctttatccgactccttccccacgaaagcgtgtactaaatgtgatgagggattacttgttttatgactgcctaactcacgcccgagccaaagattctctcacacatcctctagttaggaaccgagatcgaaatccgtggccacctccatggtcgccgctatgttggggtgtctgatcagggggcttaccatgaccgtgctcatgaagtgctctacgaggtcttctacaataccttgtttttcgccgagattcatgcaatg

SEQ ID NO: 42511 - DNA, 121 bp, Triticum aestivum
  Clone ID: PAT_TA_42511
tccactccaatccacttctcactcttactctcactacatggatgggaaactctcaccagcagcgttccgtatcctatataaagcatgacccggtcatgaacatgcgttaaagttaacatag

SEQ ID NO: 42512 - DNA, 224 bp, Triticum aestivum
  Clone ID: PAT_TA_42512
acggtcaccactactagtagtgtaggatttctacaccattccggcggtcggcatggaggaggagctgacgctggtggggtactggtcgagcccgttcgctttgcgcgcagcgcttcgccctcaacctgaagggcctcccctacgcgtacgtggaggaggtgggcctcttcgacgagaagagcccgttcctccttgcctccaacccggtgcacaagagggtgccg

SEQ ID NO: 42513 - DNA, 174 bp, Triticum aestivum
  Clone ID: PAT_TA_42513
cccactcgtccgtctctctctcggtcggccatagtgacttactcttcgcggtggatggtggagagggggttgttctcgccttctattctaggtgataggacgccttaggagaggtgcttccacccctataaaaccgtgccctatcggccgtatgtcccctccatcttccgccag

SEQ ID NO: 42514 - DNA, 364 bp, Triticum aestivum
  Clone ID: PAT_TA_42514
ctcctttcctctcctccttcttcggcctcgccgccaatgccactgccacttgttgactgattcacccccacgccggccatttcgctttcgcacaagaggaccagagttcccatggaggaggagatgcgggtggcggtggtgggcgccggcgtgagcggcctggcggcggcgcacgagctggcccgggccggcggggctgcgcgcgtgacggtgttcgaggccgagggagcctcggcggccacgccaggaccgccgacgtctacggcgtccacctcgacctatgcttaatggtcttcaaccgggtgacatacccaaacatgctggaatggttcgaagagcttggcgtggagatggagatatccta

SEQ ID NO: 42515 - DNA, 265 bp, Triticum aestivum
  Clone ID: PAT_TA_42515
gccgccttcttcctattctcctcatccgcttcatgggcgcgctcatgttcgagtgggagctatggaggaggaagcagtcctacttgatgaggttcgtgcagctcgtgcgatgttggtagtacatagcagcatccctccatcgaacgtatcaccagtcccacccgccccgacagggcacgccgtcttggcttcaaagtcaaactaggttatgtgatctacgtatccgtgtgagacttgtgggaaggaagcgccccgtgcccaaggg

SEQ ID NO: 42516 - DNA, 327 bp, Triticum aestivum
  Clone ID: PAT_TA_42516
actcaggtggccagtactctgatagcactacccacagggctgagaagtcactagatatgcatggggatgaaatattatatgtaggggaccatatttttacagatgtgagccaatcaaatggttcatttacgatggaggacagcattaatatgccgagaactggaagatgagtttgacgcactaatcaaaagccatgcttagaaagaaaagcttgtcacacttataaacaaaaggaaattgttggagacctttttaaccaactgtggctggctcttgtagagacgcacaaattttaagttcttgcacaggaacgcttggttgcatact

SEQ ID NO: 42517 - DNA, 151 bp, Triticum aestivum
  Clone ID: PAT_TA_42517
tcgattttgattgcataacataataattcaatcgcgtctaaagttttgattcacatgaggacagcttattcccagctgccatgattctacaaaccattgcgctacctaaaagattgtttctagctccaacaattttgtggggaaattgcaa

SEQ ID NO: 42518 - DNA, 168 bp, Triticum aestivum
  Clone ID: PAT_TA_42518
cttcggctacctacaaacacatacgctctcgcttggaagttcggatatgttctaactcttcttcggcaacgattagctagataaataataactaggcctcagtccggcatggctctaactatcataacgaggaccatgtatagatcttaggaatctgtcagtgaagtg

SEQ ID NO: 42519 - DNA, 446 bp, Triticum aestivum
  Clone ID: PAT_TA_42519
cttggtctctctagctccttagagttccctaaccagaagcttctaggctatagcctctatgccctagctaacttatcttttagttaaccaaggctttgcagtcagcaagaagtaccatatattttcattaccatgggtggctacggcgacttgttcgagaaggccaagccctacattcgtcatgattctggttgcagatcggctatgccggtatgaacgtcatcccaaggtctcgctcaacggtggcatgagccactacgtgctcgttgtgtgccgacacgccttctgcaccgtttacatggggccatttgccctaattttcgaaagaaaggtgaggccgaagatgacgtgggcgtccttccttcagatcttcgtgctggcactgttcgggcctgtgactgaccagaacttctacttatgtgggtctcaagaccaccggtccaacc

SEQ ID NO: 42520 - DNA, 329 bp, Triticum aestivum
  Clone ID: PAT_TA_42520
ctgactcgtgttatctaatcaagctctcttctcctttcgagctccacggtttccagcaaggaagccgaagcactagatcctagatggttcgcgtggtactggtcgccgtgttcgccgtgctcgcggcactggcggtggcggacatggcgtccggggcggtgacctgctgcgacgtgacgtccgccgtctcgccgtgcatgtcctactcgtcggggaaggcgttggccccttgggtgcgtgctgcagtggtgtgaggaccctgaacgccaatgcgttcacctccggcgaccggaaggcggtgtgcaactgtcgtaagaacctggcggggt

SEQ ID NO: 42521 - DNA, 381 bp, Triticum aestivum
  Clone ID: PAT_TA_42521
tctttcgcgtacccgttcgacgagggaggattaaataattcttcgccacgccgtccgccgactcgtctaccgcgccgccgttgtctgtagtggcttcatgagccgcagggccctcgcgacggcgcaggcgcccgcggaggcggtcgaggaccccgccttcctggaggcgtggaagaaggtgacaacattcatcgagcccccccatacgcccatgtcggccatgaatccccgccgcccacgccggtctccatcccctccaagcttaccgtcaacttcgacctcccctacaagtccgtgatcaccgactaggatgttgacatggtaatgggaccggtttcatttggcctgatggtgtttatgccaggccatgtcttccaaatt

SEQ ID NO: 42522 - DNA, 322 bp, Triticum aestivum
  Clone ID: PAT_TA_42522
tcgtccctctttctcaaagctccgaacttctgctccttactcttctcatcccccactctctgaaccaatatcgtgagccaggggctcgccgattcccaatggcgcgcgtccacctccggtccctccacgccctcctcggcggcggcgcaagtacgcacgcacgcacccccctccctattccgccgatctgcgggactgactgactgaccctgccccgccgctggtcgcccagtcgccgacctgtcctctggaggcggaagaacgcctccgcggtggccgtcgcaggcgccacgcttgtctggtttcttttcgagcgcgccgg

SEQ ID NO: 42523 - DNA, 132 bp, Triticum aestivum
  Clone ID: PAT_TA_42523
tccactcgttcgcatgaatcatccctcaaccacttttttaggttcgatggccaagatcacgagcatctcatttgcgctattccttgtgcggcggtgtgcattcatgtacgaacggggtgcttctcatgcttt

SEQ ID NO: 42524 - DNA, 336 bp, Triticum aestivum
  Clone ID: PAT_TA_42524
tcgcattctcgcctattgccgcacactccctcggatccgctgtttcacccccctattacgttggcgcacgcccttgcacaagcaagcgatcaaccatgtcgacggcggtgcagacgctatactagagcgtttacatggccaagcttgctgagcaggcctagcgctacgaggagatggtggagttcatggagcgcgtcgcgaacgccaccgtcggggcacggcccggggggagctataacttcaggaacgcatccggctctttttggctgacaagaatttcattcgcgcccggggctcgtcctggaagatcatcttctccattttgcatatggttga

SEQ ID NO: 42525 - DNA, 144 bp, Triticum aestivum
  Clone ID: PAT_TA_42525
tcggttggaacaaatatgtatgactctcattcatgcggtgagcgtgagattcacagaaccatgttggatttgttaaatcaacttgatgacttttattcaagaggcgtattaattggttattctttcgacaaaccgcattgagag

SEQ ID NO: 42526 - DNA, 307 bp, Triticum aestivum
  Clone ID: PAT_TA_42526
tttctcatcatgatcaaaaaatggcgtcgggtctctgacgcttcttatgggaaaaggtcggcgttggcttccacacgaacgcggcggcgtactctaacacatatcattatccaaggcaggtctacagctatgaacaaaagcaccctcgtcctacgcgccattataacccacttacagctcgtagagcctccttggcacgcccaccaggcatacaaaccctagcaccaacaggggacgatgtgctactgctgccgacacacatccctgactagacaggcagacgcgactcaccgcccattctccagtg

SEQ ID NO: 42527 - DNA, 225 bp, Triticum aestivum
  Clone ID: PAT_TA_42527
tcccccacgccttcgcctaggcgtgcacccacgcgcgctgctcaatgtcaataagggagtctgaccaaatcataagccgctgatcgtacgagggccttgcattccatcgggttatcacagacacattgtgccagtacagtctctatcctaggagcggcggaacctacatcaagatcatctgctgctcgaagacaaccgaaatggatgtccagaaccttctcacaa

SEQ ID NO: 42528 - DNA, 141 bp, Triticum aestivum
  Clone ID: PAT_TA_42528
ccacagttccgtctcgaattccagtcgcgcaccgtcggttgtcggtggttgcaccagaacttctgactcacagctgctgaggaattagaaagggtaaggagcgttgaagagcattatccctgctgaattggtgcctacgga

SEQ ID NO: 42529 - DNA, 303 bp, Triticum aestivum
  Clone ID: PAT_TA_42529
ggcggggcaaacggtggtgctaatgttgggcttgaaaagggtatcggtgctaatattgggcttcaaaagtctatcggtgctaatgttggtgttggtgcgaatggaggcgctggtgcgaatggaggcgctggtgttggcgccggccttggagcaaatgtaggtgttggagcaaatgtaggtgccaatgctggtcttggtgccggtgcaaatgcaaacggtggtgccgggctggtgtgaatggaggcgctaacgttggagctggtcttgagacaaatgtaggtggcaatgctggtattggtgtca

SEQ ID NO: 42530 - DNA, 288 bp, Triticum aestivum
  Clone ID: PAT_TA_42530
tcgcggacgcgtgggcggactcttggtttttttccctctcacatgcccctcaccaccaaatgaagcaaacgcggacttcgttcttgagacgcacgcaccgtaccgcaccgtcctgtgtggtgagatctaaaattcccgatccgaccccaccggtggcgatggccggcaaggagctgatcgaggagcaaattgcgttgatgcgggaggcctttttccttttcagactgacggctacagtcgcatcgccccctcggagcttgtggtacttatgcacttcctgggggggaa

SEQ ID NO: 42531 - DNA, 150 bp, Triticum aestivum
  Clone ID: PAT_TA_42531
gcaaaactttccgcttgatatttaagaaaactgttagaaaactgtaagagtaagcgaattgacatttgtcccacgatggtcgatatcatttatgaatctctactgaaatttggtaggcacaggaacaaattatggcacttatttcgatgt

SEQ ID NO: 42532 - DNA, 164 bp, Triticum aestivum
  Clone ID: PAT_TA_42532
tgtcgttcttatgttgaatcaccgccttcggctgcatctccttctccgacgacatcgacctgctgaaaggatcttgcggcaagttactggcgccttctccgcaaggttgcttctactggaacgctgttggaggcctgaagccgtacgagaattcctagaacaag

SEQ ID NO: 42533 - DNA, 280 bp, Triticum aestivum
  Clone ID: PAT_TA_42533
caagctctcacctacattctagctccacggttaccagcaagcatgcctaatcacgagatcctctatggctcgcgtggcactggtcgccgcgttcgccagtgctcgcggcactggctgtggcggacatggcgtccggggcggtgacctgcggcgacgtgacgtccagcgtcgcgccgtgcatgttccacgctgtggagtaggcgtcggatccctcgggtgcgtgctcgatcggggtgtggaccctggacgccaatgcgttcaccccgtccgtccggtaggc

SEQ ID NO: 42534 - DNA, 291 bp, Triticum aestivum
  Clone ID: PAT_TA_42534
cccacgcgttcggagttataaggtgttgttgactccgtcccggccgttggaacgcatgatcaccgcccccgttccaaagtaaacaatcatacatcgtcaagtagcgctgcacccgggatcaatgcaacctgccaaaccaagccaaaccaacacatcatgcccggccgtgtttaaatgcgaccctttttggtggggtttaggggggggccattcgcgctccaagggcaagaagtaggccgagaagaaaggcatagcgccggcgcccttcggcagcgcgcccggcgacgcgcc

SEQ ID NO: 42535 - DNA, 343 bp, Triticum aestivum
  Clone ID: PAT_TA_42535
tcttgcaccctatctgcatacgtttcacttagatatgatatatacatacttaaaagcttcagcgcctgattaggcgccggaggaggaatgcccccacatgcatcggcatgatcattctaagactgtccacattagcgggttgcggtgctacaaggctcaggttgaactggcgtgtggtattctggaaaatgcccgtgtacttgaccacatggatgttcaacaagggtcggggtcgcaatatagtggatatgctgacctgaaaaatgttgatggtgaaagaagatttttacccggggttttagagtgggcacggcttacttcagatcgctgtggtaaggcgatc

SEQ ID NO: 42536 - DNA, 157 bp, Triticum aestivum
  Clone ID: PAT_TA_42536
tccccgcccgccccacgcttacgcttgtatgatgttggtgactcaacttttggacatattattattcaaagtaagagggatcgggtggtgttaacaatcactggaagggtaaggatggccgtttgacaataccagataccaatatttttggggaaac

SEQ ID NO: 42537 - DNA, 373 bp, Triticum aestivum
  unsure (1)..(373): unsure at all n locations
  Clone ID: PAT_TA_42537
ggcatccccatctgattttgtcactccgtcggaggtgagatccgggcgtcgatggaggggagctcggggcctcgctggcctcgccggagttccacccaagaggtaggcagccctggcggcggagcggacctcatcagcgccctccccgacgaggtgctcctcctattcctcgcccgcctcccctgcgccagcgccgccgcgcgcaccagcgtnctctcccgccggtggcgcggcctctgggcgctcctccgccagatcgtcttccgcgacgtgcccttcccctcgctcgaggcggcgctcggccgcgtnctgcctcccccgcacgcggtttccctgctcgaaatctgcgctcccgaggagcagtggacagaca

SEQ ID NO: 42538 - DNA, 420 bp, Triticum aestivum
  Clone ID: PAT_TA_42538
cggacgcgtgggacaaacccccctgacctatatgcaaggttcataaaggcactctacaacttgcttgatggcacttctgataataccaagtttgaggatgactgccgtgctattatcgggacccaggcatacgttctctttactttggataaactgatatacaaagttgtgaagcagcttcaagctatagcaacagatgaaatggacagcaagcttctccaactttatttatatgagaagtcaagatcccctgggaggctctttgatctggtctatcatgaaaacgcccgtgtcctactccatgatgagagcatgtatcggatcgaatgttgctcaagtccaatgaggttgtctattcagctgatggagtatggtcatgaaaagcctgaggtgactgctgtatccattgagccaaatttt

SEQ ID NO: 42539 - DNA, 296 bp, Triticum aestivum
  Clone ID: PAT_TA_42539
cggacgcgtggggccgccactcaccaccaccatctgctcctcgccgccgccgcaccttcgtgtcgccgccgccgccgacaaaagggaaagatggtccgcgtactcatcttctgccatgcggacctccaagccctgcggaaccgctccgatcagctcctgtctgtacagctcgtctctctggattccgtgcgcatagcgagcgactcgtgtaagctcctcctcaacctgattgaggggagggactatcccaagaaggtcaagctgattgagcggaggtactggaactgccgccagat

SEQ ID NO: 42540 - DNA, 442 bp, Triticum aestivum
  Clone ID: PAT_TA_42540
cccacgcgtccgcggcttcttggttcccccgtcgatttcctcctccctctcccgcgttcttgatccgaaggcgcgtgtgttttctgggcaatttccggcatcagattgtcaattggatccatttcgatccgttcctggtcttcttgaaccgagcggcgggctccgtgattggttcttgtgtcgccctggagcattctcgcgcgagaccaagatgctctacttgaagcagccgcagaggagctagctgaaccacgcggagtctccgtttgcttgctctgaatttctcaggctcggattcgttctggccctcttgtctgcctgcgtgttgatctgaatttctgatccgatggaggccatgagaggcggcaaattcctccagaagttccggctctacgaaaccagatcgaaattttatcttgtcggaagagacaagagcacgact

SEQ ID NO: 42541 - DNA, 429 bp, Triticum aestivum
  Clone ID: PAT_TA_42541
cccacgcgtccggatgattcagataataacaagtgggagtacaccttgcatgatgttgtccgctcgtttgctcaatttatggctaaagaagaagcgtttgtggttcacaaggatcgagctgacattagaaatcttctaccagaaaacaaattattttgccgtctctcaataaaatcaattcattcagaactagagttgaccatcctagagaagcaagaaaaactgaggacattattgttgataggttgtaagattaaatctggtggctcattggcaaattttgctaatctacgggtactggatataagctctgagaaatctgattggttagtggattctttgagtgagctgaggcacctaagatacttgtcattctccaacacatacatatgttggcttcccggtgacatccataagatggggttcctt

SEQ ID NO: 42542 - DNA, 282 bp, Triticum aestivum
  Clone ID: PAT_TA_42542
cccacgcgtccgcgtcggtgaaatggaagtaataagtggctctgattggtagcggtggttggggagaagtctcttttgacatgttgatttcctagaaatcaggatcttgtttccgaaagcggtgagcacctccccgcaacgaccattgtttgtgcctggaagttacaattcgtattatagtacgttgaggattcttgttgagtggctcgatctggtccgcttgcttttggaagactgcaatagcctcttcctcttgcgatgctgatgtttaccgttgtctgt

SEQ ID NO: 42543 - DNA, 430 bp, Triticum aestivum
  unsure (1)..(430): unsure at all n locations
  Clone ID: PAT_TA_42543
cgccctgctgcctagggatggcctgcgcaagcttcaccactgcagcctcatcaagggcggctactgctatggccccttggatcctgtctcgaacatcatcctcaacaccatttggtatggcactgcattccccatgcaccaagatttcgagtttgactttcaggtggacatgatatgcacaaggacccttatgcgcatcgagtgctgctccctctatggcatcgtcgccttcctccgtgctcgcttcagttctctctcggagcatgatgctctctggcaccttcttttggccaatgtggacttacggttagccattgagatggtacaacagtctggtttccttatcggcggcactgaccttgatgcctataagaaagctgcggttgattcatggcactncgaccctgatgcactggtgaaattcacgaca

SEQ ID NO: 42544 - DNA, 400 bp, Triticum aestivum
  Clone ID: PAT_TA_42544
cccacgcgtactacaacatggaggagaagctcctgagggaactggcggacatgggcttcaggcaggttgacctgaacaaggaggtacttcggcagaatgagtatgatctgcacaagtcggtcgatgacctgtgcggcttccatgagtgggacccactccttgcggagctgaaggaactgggttttgatgattgacacagatgtagaaggagtgctcgagcaagaagcatgaagttccatgaagcgtgtggcgatggatcttctgtccagagagaaggaccggcgatggcctcctgcgctcatctgctggagcgctgctgcctagtagacctagatataaataaagtagtactagtataatggtatgcaagaataaccacaccaactgaagtggtgctgca

SEQ ID NO: 42545 - DNA, 287 bp, Triticum aestivum
  Clone ID: PAT_TA_42545
cgccccacccaccaaacgccaaccctgcggcatcggaggagcgtgacgatgtcgaccgccagcggcggtgcaagccggcgacttgccggaccagatggtgaggaaccttctggagaaggagagtcttcatcggaggcaagaccacctgcagctccttcacctccatgctcgtagccatcgtccgcttgttcgtgcttgtccatcgattccgccagtaccacatcctcgccaaggacttctccaaccttaacgccatggtaattttgtattttctcccctctctcttt

SEQ ID NO: 42546 - DNA, 260 bp, Triticum aestivum
  Clone ID: PAT_TA_42546
ctcagccctgaaatccccatctcctcccccgtatccctcctctctgcggtccctctaacctgcgcatggctcctccctagggttggggtctctgcttccacgaagccattatgcaggcaccgcccgcgaggcagccgcattccggcatgggcgcccacatgccggcacaaggcggcgggagggcagccaccacactggggcgcgaaaccgccgtcgatgcctgaataaaagccgccgcacacttaggatcagtcggcgcc

SEQ ID NO: 42547 - DNA, 291 bp, Triticum aestivum
  Clone ID: PAT_TA_42547
gccacgcgttcgaccacgcgtccgcagctgcccaacttcaactggatcaccggcgtctccctcggcggcgctgtcatgtcgctcagctactccaccatcgcctgggcggcctcgctgcacaaagccggcaagggcgggcccggccatgtggttgactacagcatgacggcgtcgacgacccccggaaagaccttcaacttcctgagcgcgctcggggacgtggccttctgctacgccggtcacaacgtggtgctggagatccaggccaccatccccttcaccccaaagaag

SEQ ID NO: 42548 - DNA, 388 bp, Triticum aestivum
  Clone ID: PAT_TA_42548
tcgcggacgcgtgggcggacgcgtggggtcaaactcttctgagatgtgaattgggcttttaaggcataaaactagattgtcactggctgtgtttattgatcatacttcgtaaatgagtgatttaggtcagaaagttgtctcctgagctaaagtgtcaagaataatacccatagcagaactctgtgaatcattcacacacaaaaaagagtgtacttctgcaacgtgctgaaccattgagaaagtcatcaaatattcaagtgctctacggtttgcctattctactttcatatatgccaatcaatatcgggttgaataaagcaaaatgatatgatgctatggaatgctcaatccatcaccatactgagaaataagattggttttttggctg

SEQ ID NO: 42549 - DNA, 411 bp, Triticum aestivum
  Clone ID: PAT_TA_42549
ggactttgtcccgtcgagccgccgccgcctaccgtatcttcctcgggatccagatccatcccttcctcgtgttcaccaccacaccaacccaagccaccttctccttcctcgttttccccttgggtcaaccatctcctctccctcgatccacccattcccgcagctcctccccacggcttccagatcgagcgagctcgatcttcagcagcagcgccttggttgcccggagctcccttcgccgtcgggcaccaccagcaggtcaccgtctcctcgcgcccttctccctttttctctggtgctcctcctctaaccatctctctctgctgctcttgaaccagcgccggtcgccgccgtcccgttcgtcttccagcgaggcgaggcatcgagctccggcgcaagtcccctacaacc

SEQ ID NO: 42550 - DNA, 400 bp, Triticum aestivum
  Clone ID: PAT_TA_42550
gtcaatcttcagaaagcccatgtgccgtatgatcctgaggagatcgcgatcgccggcgagagctttgcgtcggagcttgaagagaccgccaacttgcaggatttgtatctgaatatgaacgaatggagcagcccgaggtatctctctcatataagctccaggattcaggagtatcaggacctggtgatggacctgcaggctgacatctgcaagaaagactctgaaattggttggcttcgacccgagctggacgagctggaaaggaagaacatggaactggaggagaagattggccgtaatggatcgtgcagagaaggatgcttcacaaccaggaagggggtgtcaactgaagtgttcatggatctacatgagcgttcgtcgaagtgcatccatgattttg

SEQ ID NO: 42551 - DNA, 377 bp, Triticum aestivum
  Clone ID: PAT_TA_42551
cccacgcgtccgcccacgcgtccgcggacgcgtgggccgccaccaaccagcccttcgcacgcccgccgctctcctctgccccaaccccaaccccgccgccgcctcaatcccaccgccgccggcctcctcctcctctagcgccgccgctccagcccctcaccttctcagcctggatccgcgcgacaaggtgtggggctatggcagagaaggctccatatcgcgcgacaaggtgagggggcgcccagatccgcagtggcaccaccgcgccctcgtctacctggccctcgaggtcggccatggaggtccggcccgaccaatggatggatggggatgaaaccctagcctaacacccacccatggatggatggggatggggc

SEQ ID NO: 42552 - DNA, 394 bp, Triticum aestivum
  Clone ID: PAT_TA_42552
tctgtccacaccctagcatgcgtcgatgagccatgacacccacaccttgtagttgcttggtgtggtgatgaccgaacccacaccttgtagtggcttggtgtggtgatgaccgaacgtcacttgcgggatggcaatggcagtgtcctaacctccatgtcaggcaactacggctcggctgactaccgccttcttgaccactaccacgtctccccctgtagttgcggtggtggccgccttgtcttggttctgtaagtggctctatttagagtcaatgttgtaatccctgcctgccccagcttgtgccaacaaattgtggccctcacaccttgatgtggcatgctgggtggtgatcgaactgtcaccaccatgcacttcttgcgttggcacatggtgt

SEQ ID NO: 42553 - DNA, 198 bp, Triticum aestivum
  Clone ID: PAT_TA_42553
aaaaagagtctcatttgtttaaaatattcatcgccccaaatgaaagaaggaaagattaggggcaaggggtcactaaaactaaggaatgctggggggtcgtcctagaggatccaaccttacgtgcgggtctgtgcaaagtataagctcttatacagtgtgacttaaataaaattcaatggccggtgtatcacaaaggat

SEQ ID NO: 42554 - DNA, 414 bp, Triticum aestivum
  Clone ID: PAT_TA_42554
aatcggccaccccccacctccgccttccttcctggccagcgcggcggcttatggcctccatgaccacacctcggctccccttcctccccgcccgaacccgctccgccgtcgccgccacctcctcttcgtccccctcctccccgctaccacgccgctccatcaaatgcagcagctccaccaacgctaactcggcccccctcccttccacatcgcggcagccccgggcgcccgtggcggacggcgtaaggtccgccgacctcaacggcctccgggccccgcctatacctgtcgcggactcccctctacccgcgtaccgcgatccgcacgggctgcctcggcctctcactagtgcggatctgatggagtccagcggggaggggctcaaggtgcctaccaggggcttcctggagcgta

SEQ ID NO: 42555 - DNA, 396 bp, Triticum aestivum
  Clone ID: PAT_TA_42555
gtgtgatagtatgtctgatgattggcagcctaagtcggtagggaatacatcaggatcagtacagcaattaccgaagtacagaagactccgcaaatgtggtgacaagatcaaacgagtatccttattgtctttgaatgaaagatataatggatctgtaggagaacaatgtgatcagatggagcatgatgttggaaacagaaggaaggccaagaggcgtatggatatatatattgacgaggaagtcgaagtgtctgaagatgctgacatttcactggatgaggatgatgatcggggtgaagataaatacgaagatagctatattgatgaccagacaactcctactggtcaattcactcagagtgaacaaggcggtgaatacagtaacactaacgacat

SEQ ID NO: 42556 - DNA, 327 bp, Triticum aestivum
  unsure (1)..(327): unsure at all n locations
  Clone ID: PAT_TA_42556
gtttgtttgactcatgcgggtctcgtggccaccccgaaaacacgccacgcgaatcgacgcggccggagcctctttccaccctctccgcctccacgaatgacgtgacacgaacccgaccttggtagcgtcctagctcgatcctccatgggcggctccgcattactcggcggcggnctcgcccttcagcttcttcatgcggcccgcggcgagatcaaaacgacgccgatcgtgtcggactcgcggtcccgcattctgttggaggagttcggctttaagccccgcggcgttgcgcaggtaaacgtgttcggcgttttatggagcgtcccc

SEQ ID NO: 42557 - DNA, 405 bp, Triticum aestivum
  Clone ID: PAT_TA_42557
cccacgcgtccgcggacgcgtgggttccccaattaaaagatctctctctctctctctctctctcgtcacatccacctcactcgctcgctccctgctgccattccgcggccggacatgtcgtcgtcgggggccggcgaggagggcgccgccgcgccgcaggggccgctgcccgtggagcaccgcaagggcgccaacggcctcgacaaggtcgtcctccgcgaggcccggcgcatctcccgcgaggtgtaccttgatgggggccatgtaacatcatggaaagatgagcatggggaggagctgcttttcgttagtaataaggctattttcaaaccttcaaaagctatacgtggaggtataccaatcttgctttcttagttttccaacttcggacagctggaagctcat

SEQ ID NO: 42558 - DNA, 421 bp, Triticum aestivum
  Clone ID: PAT_TA_42558
gcattctcaggttgatgccatgcttcataaattagagaaagagattgatgatgtttatgcacgaataggcaaccgctggcaggtgcttgatagggaccgtgacggcaaggtgaccccggaagaggtagaagcagccgcaggttatctcaaggacaccatggggaaggaaggcgtccaagagcttatcagcaatctttccaaagacagagaagggaacatcctcgtggaggacatcaagaagatggcgtcgcaaacggaggaaaacagcaagccagaagaaacggcgcgctgattggtagaagaagaagcattctctatcggatctgtatatatataccgacagctcattcttttcccagtttcagttcgtggcagcgcatacgcgcgaaacggtcagtatttttctcgtgaccgtctacag

SEQ ID NO: 42559 - DNA, 413 bp, Triticum aestivum
  unsure (1)..(413): unsure at all n locations
  Clone ID: PAT_TA_42559
cccacgcgtccgggcgattttaatcgctggggtttgtcgctatccacccatgtcttcatccccaactcagcctgctcctccctaaccgccatgccatggaggcggtcgccgtcatctaccggccgacgccctcttctccccttcctctggcctcccgtgctgtaactcctgacgccttcgnctctccgaccgcccacacgctcgccgncttacacaccttttgtcgacgccatccccaagcagcgcttgatgatccctccacttggatcccgcccgtggccgcggcactagggatgtcgccacgatggttatcccgttcctgatggaaacaacgtttgagcagccgtcgccgaatctggcctcgatcctctacaagaacagtatcatgtactccctccgtatctttttagtct

SEQ ID NO: 42560 - DNA, 240 bp, Triticum aestivum
  Clone ID: PAT_TA_42560
gccactcgttcgggcgcttaatgctgctcataattggggcgatgcgactcactgtgcggccgaagttagcgacggtgttggctatcctcatagccatggccgtagggcgttaccttctgcattacgttgtttactacactggcgctatagcttgcgcgctgttcttagtgataacagacaggatgacagacagaccgctctctacggcgggggcacgggttagggaagcggcacacaata

SEQ ID NO: 42561 - DNA, 441 bp, Triticum aestivum
  Clone ID: PAT_TA_42561
cccacgcgtccgcaaaaagcagaaaccccaaacacgccacaagaaagcagagcaaccgggagatgagacttccgcacatgagctcatcggatcaagacaccggcaaaactatagtgattagcaggaggactaagagaatcaaaagctacagaggcggctcgcagcagatctgacggattagcgattaacacaagacacaaccgatggaagactgcgtgaggcaaccgaacaagaggaataaatacctaggatcaggataaatagggaatctgcacgcttgagaagatccccacaaaagcacagaaaattggatttgatctaaaccgggagacaaaaatcaatcttgacctcttcctctacgaactgtggagaggaacagagaacagatgatttttcagatctggatggaccaagaggattggagaagaaagacagagaaga

SEQ ID NO: 42562 - DNA, 183 bp, Triticum aestivum
  Clone ID: PAT_TA_42562
cccacgcgtccgctcaagcttccgatgacgctttaactgacccgatgactatggtgtaacttgactaatattacgctgcgactaagaacactttgggtgatataaatgaagcgcaagactaacgacctggtgtggcgggtacatgaatatatgatagtctatatacttggagaagagcttttg

SEQ ID NO: 42563 - DNA, 398 bp, Triticum aestivum
  unsure (1)..(398): unsure at all n locations
  Clone ID: PAT_TA_42563
gagacacccccatcgcctcgtctctcctctcctcgcagatctttcccgtctccggccaccatgaactcctactccggcgaccggtcctcctcccgtcccaccacaacctccttcgactcctaccagtttgacttcggggccaacgcctcccgctcctccacctcccgccccctccgcgaccagaggccaggtggcgccaccaacccttcaccgaggccaaccaccacaaacacatggtcacaccagccggtgaagacgtcctggactcatcagccatccccgtccgccgccgcggcgctcggatccgggcctgtgtccatggtcggcgacatctccggccggagctggtccgncactgcgccctcctncggcatcggccctcctcagtccaacaaccc

SEQ ID NO: 42564 - DNA, 364 bp, Triticum aestivum
  Clone ID: PAT_TA_42564
gcttgaagctcttaatgaagcatcatttgggacctctcgtcgtcattcagggacagagagagctctgaatgaccctttacgggataacgaaggaatgcttgtagatgaatatggaagcaatactggtttccatcttccaaatttgatctgcgtgaaactgcttgatgaggaaggaagctcctctgaggataggagctttgaagctgtcactcctgaacatgaatccactggtgctgagcaaggggagggttctcaattggatggggcgaagcatcgacttgtctttgaagaagtgaatggtgatcttgagatggaagatgtagccccatcatttgaagcggaagccacctctgcatgccaacaa

SEQ ID NO: 42565 - DNA, 291 bp, Triticum aestivum
  Clone ID: PAT_TA_42565
cccacgcgtccggggggaatggatgatgctctgcataacgatataatcacatcagctatatgacgagtaccacgagtcctttgaggagtacatccgagccgcagtgagcggatttgccactcttgctgatacgtacatgagtgttgtgtgttcagattatcctcttttttatgtgtcggcgcttgcacagatgggtttatatttgtgtgcttttgggggttcaggtggaccgtgagaccaaagaatgatatcaagaagctggaaatgttaaactgcattctggatgctttt

SEQ ID NO: 42566 - DNA, 436 bp, Triticum aestivum
  Clone ID: PAT_TA_42566
cccacgcgtccgcccacgcgtgcgcatgccatcatttctctgctacccaaatcctttgatgccatgagagtgaaagatttcaggccaataagtctcatgcactccattgccaagattctatgcaagctgctggccaaccagctggctccattcctgcacatcctggtcccccagtctcagagcgctttcatcaagacacgtagcattcacgacaattttctctatgtcaagaatgcggtcagatctcttcacaagtcaaaaactgccgccttgtttctgaaactggacattgccggtgctttcgattaagtctcctggggttacatgttcaagctcatgactgccatgggttttggacacagatggtgtgatttgatggctgtcctttggcgcacctcctcgttccgtatcatggtgaatggtgggctcggcctac

SEQ ID NO: 42567 - DNA, 403 bp, Triticum aestivum
  Clone ID: PAT_TA_42567
aagagttcagtcttcctatagaatcttcaggagtttagttaggcattctgaaaaagagaagtcttgttgatcagacggctaaacgctcatatcgctcctaaacttgatacactgttttccttttgatatgtcttgccaagcagagcgaccaatgcaaggaggaccaagatctaggacggtgagcctcgcctagctcttccacctcttccacctatcatggaggagggacgaagggggagaagattacagcatgattcaggatcagttgagggttgaatgcttcaatggttccagaaagcttcatccacaatcctgacaaatttttctttgatgtcacaaagcataccaaggattttgaagtgagtacctgttatccccactaaccctggcagctgttaccttt

SEQ ID NO: 42568 - DNA, 226 bp, Triticum aestivum
  Clone ID: PAT_TA_42568
cccacgcgtccgcccacgcgtccgggtaattggtaaagtatgccttgaggactagctatctttctagatatatagctgttgttatctgaggtttcaagcagaatagaactgcactgctacaatgcatagtcctggccctgcgctcaaatcattgcaataccggccaccgtttgggacggatagtctctacctagttattctacctcttccacctatcatcgtatag

SEQ ID NO: 42569 - DNA, 403 bp, Triticum aestivum
  Clone ID: PAT_TA_42569
aaaacttttctgaaatgaagcaaaacgttaagccttaaaaagtaaaattcaattcttgagtctcatagtaatggaaaccctttcttagaagtacaactatgtcacttgatttatttccaaatcaaatggcgaagctatacgacacttccatttgcacgtcagacatataagccatatagttgtatggtgccttctgcttatactagccaaggtagtccaaacaggcgaaaagtaataaggtgacataaattctgtggggtcaaagtacttcaattagagttacacctttaggaacatctttcatgtgtttaggtgtatgacgaaactaatatggacggtagcaaaattatcaatagtgctcattgcttggttttagttctaggaaggcatgggtaatggttac

SEQ ID NO: 42570 - DNA, 121 bp, Triticum aestivum
  Clone ID: PAT_TA_42570
cctcggtgttgcggcggcgtcgagtgcctatatcgttctaatctcctcaagccagggcctcgtgcacaccagcgcctgccccatcggtagcgacctgtccactcacatgcgcggtgagcgc

SEQ ID NO: 42571 - DNA, 274 bp, Triticum aestivum
  Clone ID: PAT_TA_42571
cccacgcgttcgccctggtcctcgccggatcaggccacaatttttggtcgcacgggccacccggtaccgggatgcggttgttcgttacatgcgatcctgccaacatccggcacattttcacgacgaactacaccaactttcccaagggcgcgaagtttgcttcattcttcgacattatgagcggcggcatttctaccatcgacggtgagccattttgttagcagcgcatgaaaatcatgagcgtgcttacatcccgctgttgggtgctaggttg

SEQ ID NO: 42572 - DNA, 376 bp, Triticum aestivum
  Clone ID: PAT_TA_42572
gtcagacgggcgcgctgatggtggcgtggtattcttcaaattataacgcatatgtgaacccacttgtattggcagggcgagtataaggccttacactagctataacaactgccaaattcccaattcataaggaacgaacgttcgctcatacgtcttgcaatgtgactgggctggacaccggcctatcgaggtgtcatccggcatgggatgggactgggacgtgactagttactaatgtggcatgcattgactgatgcatgctaagctcctggctaggatactactaagggtactaatacggggcttgattcataaatggtgttactttaggagaaactataggaaactactttgggtattccttttggtattcaaa

SEQ ID NO: 42573 - DNA, 208 bp, Triticum aestivum
  Clone ID: PAT_TA_42573
ctttccctcgcctagatcaaatccggtgaacgatcggctagggaggatgaggtgaggtgggggacctgttgagccggtagagcagaccagcctgaaagggctaccagcatcgccgccgacaacaacgtgctctttctatgatcaggagcaggggtggcccaaccgccggaaaggctagaggaaatggtcatcgctgtcctgctctccg

SEQ ID NO: 42574 - DNA, 286 bp, Triticum aestivum
  Clone ID: PAT_TA_42574
attgatggagattctacacctcgaagagatccctaagcatcatatcgtgaaacggtggacgagagatgcaagagatatactaccagatcactaggtccagtaccagagagataattcagtaaacctatcgttcacgtgtaggcatgcaacgatgtacctgaaggccatggaagtcgtgcggatgggggatgcaagtgctacatgttatgaccatgtgtatgcaggtctcggctctttgttgctgagtggagccccgttggcggagaaaagggattgtattgtcatt

SEQ ID NO: 42575 - DNA, 441 bp, Triticum aestivum
  Clone ID: PAT_TA_42575
cttctgaggccttcatctctgcaggatcaatctgttgattttggcacttaataactacatcttgagcgttggaggaggtagcccgtggactggtaaagacgtgaagggggacacgaggaggcttgcggtggttctaggcgcatctattcggcgagtagcagtgcgctgtgttggacagttaccagccaagatggccggctgcctcgcaaggacactacttgtggtcttaagagtcctggagcggtgagcatccgggctttttatggcggatctgaataacgaacacgtggagatccttggcgtcaatgctggaaacagtagcaacggtagtactcgctttaggaacttgtcaaatcttggtctgaagggaatgttatctcctgagattggacagcttactaatatgcattttcttgtactgcacaagaacttgttctatgg

SEQ ID NO: 42576 - DNA, 376 bp, Triticum aestivum
  Clone ID: PAT_TA_42576
cacacacgtactgagaaacattaacttttgagctctggcgagtagggattcattggccgagtcgtgaagaggttaacacgtgttcaccacaatgtggcgatgtgacaggggtacacgtctgtgttagatacgacgacgagccgttgatctattctaggtctgtgacacagctcagggtaggactgactgggggttggacagaataaagattattagaccctcctttggcttttggtacagatggtatatcgaatatgcagtggtgactcttaatgactacagactaggggacgactttaaataaggccagtgagggggcaccctcttgttttactgcgcctgatggaagagtcaatattggacctcacaatgggca

SEQ ID NO: 42577 - DNA, 224 bp, Triticum aestivum
  Clone ID: PAT_TA_42577
cgcggaccgaacgatacttttaccactgtgctctttcgtccgcaggcggtcggtgcatatggaatgccttctctacctgagcttttcatttgatgtagtatgacaggtggggctggcttggtaatggcgccaataaacgatgtggttttttgatgccttcagacacccgtgtctataccgatactcggattaacctatacactgattcttcgacgtgaataagg

SEQ ID NO: 42578 - DNA, 438 bp, Triticum aestivum
  Clone ID: PAT_TA_42578
cccacgcgtccgctcaccgatagatgcctgcggttgtcccctctatgacttcactgttggcctgtccctctacgaagcctggaccgtcgggcctccattttccctcccggtgctggccactccatcgcccttccgacgacgcctctcctccgcctccgctttgcgtatgagggatcacacaatcactgacaatatggccggttcctcaggtcgggcaccagatgctccgaacctgccatatcatgctcggctatggcgggaacgagacgatcgcctgggccacctcccatggtcctcggaagctccaaataagaggcaggacagacggcgtaggaaaggcgcgcgaccgagagacggccgccttcggataacaagacctcgatgttgccatggcagtcagacgcgtggtgcgtccggcaacgcgccgtcactcccaga

SEQ ID NO: 42579 - DNA, 394 bp, Triticum aestivum
  Clone ID: PAT_TA_42579
cccacgcgttcgcgctgtttctggaggcgagttcgtgcccaggggaagggctcaatttctcggcgatgaagtttctcatgcagccaattagcagaatctccttgattgaggaggttgacgagagcactacacccatggatctggtggcgtgcggcacaggaggtgtagttccacttgccgcggacgtctccgtgcctgtcatgaacgcggacgccagatccgtgagggagaagcggctggtgagatcaggcctgaagcgtcatcgcaggcatccgagctctccaccggcaagatgagcccgcagacccctggttggactaaaaggtgtgcgccgcaatcaagtaagctttttctgtgcgtaaaatgcacagtcaaaatgtatttgctaggaaaa

SEQ ID NO: 42580 - DNA, 437 bp, Triticum aestivum
  Clone ID: PAT_TA_42580
gaaagaactaaggatttgatgaagccacatgagcttgagagggtggaaaccggctgctctatcatgaccgatgcttggaccgacaagaaaagaagaagtattatgaatttatgcgttcattgcaggttagggactgcctttcttgaatcaaaggaggcgtcggctgatgcacacacaagtctatacatcttcaattatgtagttgggtgcattgagaaaattggtgctgaaaatgttgtgcaagtggtcacggacaatgcttcaaataacatgggggcaaaggatatgctcaaaggaaaatggccaaaaatcttttgacctcatgtgcaactcacaccctcaacttgatggtagaagcaattgcgaagctaaagcaatttggtcctaccatcactaaagccaggcaaatgacaatttttctttatgcacattataaa

SEQ ID NO: 42581 - DNA, 290 bp, Triticum aestivum
  Clone ID: PAT_TA_42581
atccaacccccctacgatctcgccgagaaatctcctccgatcgaagcgaagccaaggctgtctcgtccccctcctcaagatgcatatctttgtgaagaccctcaccggcaggaccatcacccttgaggtggagtcctactacaccatcgacatcgtcaaggctaagatccaggacaaggagggcatacctacggaccagcagcgcttgatcttcgttggcaagcagttagaggatggccgcaccctggcagactacaacattcagaaggagtccacccttcacctggtgc

SEQ ID NO: 42582 - DNA, 357 bp, Triticum aestivum
  Clone ID: PAT_TA_42582
cccacgcgtccgcagcaacttcgtcgtgccgcccggtgtcatcaccataccgcgcgccccgccgacgcccaagatgatgagctccgtgtcggccgtcgcgcccagccccgcgccggtgaggtccccgttcgcgttaatcttccctgtcttatgtccatcgctttctctactccgttcttattgtggttctcgtggtggtacctctcgtccctcctctttttctctttttcatcttttctgcttctttctcttctattggttgtttgttatttttaattcttttgtataagctattcttattttttgtttatcttgcttttctttgtgttgctttttttgtttctttattctcttttt

SEQ ID NO: 42583 - DNA, 364 bp, Triticum aestivum
  Clone ID: PAT_TA_42583
atccattgcattagttatatcgctttattgacatctgatggagaaggatacagatgaatcgaggaccagttcagataacatattgaaaatggagtaacataaaagtgtcgtgttcagtgagctctcaaagctattatggtctaaagatatgtacaggctgaaatccgaaagtgggatgtggcgaggtggccagtgcaatcgcgccatagatatcaaggacataataggacgtgttatgcccgtttagtggattgacaactgctgtttgatgcattgtatattggggtgtaccatcgcatggagactgcatagagactaagactataatgtggaaattttgcgtacactttgacagcggcaatgg

SEQ ID NO: 42584 - DNA, 420 bp, Triticum aestivum
  Clone ID: PAT_TA_42584
catggctccactgttccacgtggaggctcttctcccgagctcgatctcacccaagatcgactccatcctccactcccacatctacccgcaggtaggtcacgtcttccgcgccgtcgccaggttcagggccctgctcgtcgacgtgatactcagcaagaagaagacggccgccgcgagagctggcagcggcgggtacggctactacggccgctcgacgaggaggagccgcggcaagaagaggacgagcaagatcgccggcttcgtgaagatgcatttcgtcggctcctccggcccggctcgggcaagggatcggctggacgccagccgcgcgccctgctatccgtcgtactcgtactacgagtactcggcggcgtggaacgctgtggttccagcgacgccggcggccgtggaggaggaggt

SEQ ID NO: 42585 - DNA, 335 bp, Triticum aestivum
  Clone ID: PAT_TA_42585
gcagatctttgtgaagaccctgactggtatgaccatcaccctggaggtagcgtcttttgactcgatcgttcatgtcaaggcctacacccaggatggggagggcatccccgcggaccagaggcgtatgatcctgtttggctagctgatactggacgggcggacctcggccactacaagattcggaaggggttcaccctgcacctggggccgatgctccagggggggctgcagatatttgaggagacactgaccggcttgaccattgccctggagtttgagttctttgacaccattgacatggtcaaggcaaagattcaagacaaggagggctttct

SEQ ID NO: 42586 - DNA, 316 bp, Triticum aestivum
  Clone ID: PAT_TA_42586
ctggacgcacatgatggaccgcacgctcccgacattccgctaccaggcctggaaaatagaaccctagaacggcgcgccagtagtaccgcacaatgaccatttccgaagactcgtccccaaatgggagcagaaatttgtcttggaacgttgactggatgatcagaaacaccttgtacattttgctaatggtgcaccagaccttagaggcgtgctcacaaaccggaactaagaggcgttggattaagcacgaagttagtcacacttttgttataacatggaacggctgctttgtgcacagcaggatattgcgttgatt

SEQ ID NO: 42587 - DNA, 423 bp, Triticum aestivum
  Clone ID: PAT_TA_42587
cccacgcgtccgggaagagcccagcactactccacttcatttggcaaagtgggagttgcagaagaagaacttcttcatgcaggcacctgctaagttaacagcctgcgattaccaccgggatcttgacatggtggtggttgggttctctaacggggtatttgggctgtaccagatgccggactttgtgtgccactgccagctgtcaatatcaagggagaagatcactactgctattttcaacagcttggggaattggctagtttttgggtgtgccaagcttgggcaactgctggtgtgggagtggtggccagagacctacattttgtagcagttgggtcactacttttgagtgaaccgtattgcatactcaccagatttttagtttattgctacctggtgctgatgataacatagttaaggttt

SEQ ID NO: 42588 - DNA, 416 bp, Triticum aestivum
  Clone ID: PAT_TA_42588
ccctcactccaccgtcgctccttctcggcccttccccgcctcctcgcattgcagggaggagactcaatcaaggtgatgcacatcgttatctctctctctctctcgcaatcagaagcatgcatttgatttaggactgcgtgtggatgattggttgatttgattgtgccatgccgaaccttgttgatggcggaagcgtgtgctttcaccaattaattccgtttctttttggagtgtgttctacgcttcgaactaccctttcttctcatcaattgtttccctcttttgagcctagcgaatagcgagaaccggttgcgatcggcagatggtttggtcgatcggtcccctatcttgctctgctcgcgtgtaattgatgcgcctctgtttcattctctacaactcttgttctgcgaaggaag

SEQ ID NO: 42589 - DNA, 142 bp, Triticum aestivum
  Clone ID: PAT_TA_42589
gcggtcttcgtttatattttctaccaaaaggtcatacctagagcataggtgctgtttgaggtaaccaccattattactatggtagaatggcgcttattcgcactgaatatgaagactaatcataatttatccagagcgttaa

SEQ ID NO: 42590 - DNA, 415 bp, Triticum aestivum
  Clone ID: PAT_TA_42590
cccacgcgtccgatttctattgctctctccacagtgctgctacgctgtgggatgttcacaattgcgatgcttgtcaggaaacgcctatatgggatgcgtcaggagctgtttcaatacctgaagttggtaaaggattccaagggtaaaaaatcaatacaagaacttgcagatgcaggggatcctttggtcagaaaggaccttgcatgggtttctctaaattctaaatgctcgctcttgttcacacagtcttggttttctgccaatccttcaattcattgcgacgccgtatacctttgttactttttactgtgctatatcaaacatggttgagatagttccatctttaaaagggggtggagctttttggtttactgatctgacgtcttctgatgctctttgcatttttcccatgata

SEQ ID NO: 42591 - DNA, 144 bp, Triticum aestivum
  Clone ID: PAT_TA_42591
ctcacgcgtacgggccgacgaggtgctggacgcatccgagcgccgcgtgctcatcagagccctccccgtgccgccgtcggccgacagcctgctcggtcgtctcgaccagatcgacctacggttgaagcatctagaggaggagcg

SEQ ID NO: 42592 - DNA, 446 bp, Triticum aestivum
  Clone ID: PAT_TA_42592
tggaactacaacacactgctgacatgctatgtttctatctcttgggagaggcagtgaaatatattagttgactactctgttaatttacaagtatgttgcttgaggtaaccatggcactattcagactgaaattcattttattgcagatcacaggacgatatttcgggagtctaatgatcacggtgcatttggtacagcagaggaccatatttttgactgatttcatatgttctacaaaattatatattggttattccttgttattgcgaatttatcttatactatgttagagacgatgcttataactttatcaacaaataaacccttgcgcagactgttcttcaggttcagtgttcaaattgtcgaaaaggaaggtctagatctgcagagtttgggtgtttcttctcatgtgtacattccataaaatgcattcgcataatgcaata

SEQ ID NO: 42593 - DNA, 351 bp, Triticum aestivum
  Clone ID: PAT_TA_42593
tgaatggtggttggctgctatctactccactgcggaggatattactaggcagtaagctaggatcaatttgcgcctaacatacagctacaagctaaaccaagaggaccggagtcgcacgcagtcttcctttcctgcccaagcccagttcgacgtctccccctctcctgaccacttcgaccgccgtgccgtaaaccaccacgtatccgcctgccccctttgccgggggtggtgccgccctggtcgccaaggtcggcaagaagaaggccggctcccgcttgtggatgcggctggaccggtggggatcctttgagatcctggagctcagacaaggccttcatcattcgccgcgcg

SEQ ID NO: 42594 - DNA, 321 bp, Triticum aestivum
  Clone ID: PAT_TA_42594
ggagagggcatgggctggtatctactccctggggtgtgtatgacatgctacttaggcaggatttgttccctgtcaacatcaagatgtttgtcctggatgaagcgggtgtgatgctttctctctgttttaaggatcacaattttgacatcttcctgctgctcccagggaagattcaagttggtgtcatctctactaccatgccctctgaagccctagtgattaccctctagttcatgaacaagccattgatgatccttgtcaagagggatgagctcatccttgtgggtatcaagcagttctatgtcaatgtggagaatgaag

SEQ ID NO: 42595 - DNA, 435 bp, Triticum aestivum
  Clone ID: PAT_TA_42595
cctgaacttgaagtcgctgatgatgtccgggttcgaggagaaagacaaggtgacaaactacataaggctagtcatggagcgagctgtgggattgaagagaatcgagatgtatggtgtacacccatgtgagaaatgcgatgccactgacccgacgagatcccaggtgaatgaagcttgcaggcgtggggtcaaggagcgactcacacatggatcctactcaaccgtggagatattaataatgtactacatcgtctcataacgctcgctgctgttgcagtgatgattctgcatgtggtgcgcccagtaggtatttaaatttttatgtactaatagcctgaggatactcgattgatctggaccttgcagtgtagctatattgagtgtactgcggactggatgcattcttttcttttcagaacttgccttttgtatgct

SEQ ID NO: 42596 - DNA, 362 bp, Triticum aestivum
  Clone ID: PAT_TA_42596
gcgctccgctcggcctgtttgttcacctccctccccacccccaccgtagcacaatcctctcagccgcacggggggccctcgtgctctgcgcctgagatccccagcctccgcccggcgccctcgccgcattgccattcccccgagtcgacacctgctgtgtttccacataaactacgatgggtgcatctgcagctactggcatgcagatggtggcgccgcgcccttgcatcccggcttgccagcgaatgcttgggtcgagatctgtagtttctgcattcagaagggcgctcagcaccagaactggctttgcaagctgtgtttaaaccgcatcaactggaccgctcattttctgtaactcgcaa

SEQ ID NO: 42597 - DNA, 113 bp, Triticum aestivum
  Clone ID: PAT_TA_42597
gtccttgatgagacactatagatcgtaaaatatgactcttcttgaccgatcgctgtaaaggtgatccccgacattacaattgtaaaagtttatagtccactcctttgcagggt

SEQ ID NO: 42598 - DNA, 209 bp, Triticum aestivum
  Clone ID: PAT_TA_42598
gtctgccgtcacgcccttagcctgtggcttaccacttaccactcttggcctagagacgggaggccagcccaaagttaggctgtgtctgtcccccagccccagctcctctttccggcccctatctccgtaccaatcctactctcgagtctctcgctcctcataaagcaaggagcaggggtcataatatgagttcatgggctactactctg

SEQ ID NO: 42599 - DNA, 129 bp, Triticum aestivum
  Clone ID: PAT_TA_42599
cttttccttgcctgtccaggttctttgttggttctttggcagcttctaatttttttcctgaggccggttgagggatttcaccattagcataaagatcatggctgcgggcggtggccgttgaaagcatgg

SEQ ID NO: 42600 - DNA, 354 bp, Triticum aestivum
  Clone ID: PAT_TA_42600
gggtggagcgtgcactagtgcggtgactacatgatggaccctgagaaggcatggtcggctgctatcaggcacggcttcgaccctctcactaaagcttgacttgggaaatgttgctaagatggtactaccgataatttatgctaaaaccgcagtctttttttcttttctttcgggaacacgcaggatatctgttttggtcggacagctaagactgtaagatttattagtgtgaacatcgaacatcaatgccattaacttactgcttatggagtgctgtacttctgatcatggttgatgatgtttggcgtctgagttctagtaggaaataatcggaacgctctgtttgtctgatgg

SEQ ID NO: 42601 - DNA, 172 bp, Triticum aestivum
  Clone ID: PAT_TA_42601
cttcattgtgcctgaattgagcccatcaaccaatttcttatatgcttcacacaaggctgtgtctgaatacaatgaggcaaaggcgcttggtgttgacactgtaccagcgcttgtaggaccagtctgatacttgcaagcgttcaaggcagcgatgggtgtggagaaatcattc

SEQ ID NO: 42602 - DNA, 177 bp, Triticum aestivum
  Clone ID: PAT_TA_42602
cccacgcgtccgcccacgcgttcgcccacgcgtccggcttgccggacaggcagtggagagtttccgagctgcagcagcagtttgaggggaagactgtgttgctcggtgtggatgattttgacatttttaaagggatcaatctgtagcttcttgcctttgagaatatgctgaggactc

SEQ ID NO: 42603 - DNA, 178 bp, Triticum aestivum
  Clone ID: PAT_TA_42603
cggacgcgtggtcagattgctgctaggcctacagctttctgcgtatcatcacagaagctacgccttacgcgttggaggttagccccagcataatagattagttctgccatggcgaggcttaccggtctgctgtagatgagaccatgccgcgcgcggcttattttcttctatcgaacta

SEQ ID NO: 42604 - DNA, 193 bp, Triticum aestivum
  Clone ID: PAT_TA_42604
caagtgcggtgcggagtacccactccgccatggtcgccggacagccgcagctggtcgccggcgtatgctaccggtgttactaattcaacatctacgtccacccgccgccaccgtacttcgtccaagatcctactcgctgaagccgtctctgccgtccccctcgtccttcggctccaaatacgaggtgctttag

SEQ ID NO: 42605 - DNA, 380 bp, Triticum aestivum
  Clone ID: PAT_TA_42605
ggcccataggcagttgctctcgtcgtatggttctggtggagacgaaaataaacctgaaggcatggaaaatctcgggtcccagagtagccatctcccatccatggtaacgagtgagtgagcgagcatcagccattcaccatagcagcttcagttgtttccaagagacgcttgagttcttcttggactggtcctgtcggcgtctagtctggctatttatgaatgttggttggggcagtgacatttgtacagtttccgagatgatgctctaaccttaggctagtgttgcttataaagttggtgatttatagccaggtatgtgtgtctaaactaattttttacactaggtgggggaatatttaagaaggttcttgtatttaata

SEQ ID NO: 42606 - DNA, 426 bp, Triticum aestivum
  Clone ID: PAT_TA_42606
caacaatcctgagcttcacgatttctttgcgaaggtgtgcagcgagatggttggccccaacaacgtgagagagaagcagccactgatgggtgccgaggacttctccttctacaccgaggccgttcccaagacatactactactttgtggggatgctcaacgagactcgtggaccgcaggcgcctcatcactccccctacttcaccatcaacgaggatgcactgccctacggtgcagccatgcaagcatcgttggctgctcgctatctgcttgagcaccagcccgctaccgctgctaaggtggaacctcgcgacgagctgtagatggtgtccatgttgaatgaaacggtggaaggacaaggacgtgcacagcaattgttggttaaaaagggacgaggacctttgtatcgccaggtgattatgcaact

SEQ ID NO: 42607 - DNA, 160 bp, Triticum aestivum
  Clone ID: PAT_TA_42607
actcgtccgataattaaaaatgagcacgaaaggtttatgtttgtttttttgtatagtctctctggtaatctggtctcaatgaaataatgtttagtacaacaatgccaatgttttatatactagtactacatataaaaggaccaatgttattgataaattg

SEQ ID NO: 42608 - DNA, 217 bp, Triticum aestivum
  Clone ID: PAT_TA_42608
gatgtttattaggtgaagtgcttgtttgccgagtcgctaacaaacggcagctgggtgctgcaccgctggaatctttaattccttgctctagcattgatataaagctttgatatttattaggtgaagaagactttgtactcacaagaagttaactgcggcataattcttaaacacgtcgctccataatgcttgcagcattggattagctatgcagtgc

SEQ ID NO: 42609 - DNA, 158 bp, Triticum aestivum
  Clone ID: PAT_TA_42609
tccacgcgtacgtccgaggaggccgtcgccttgacctgagagcacactcacgcaccatgtggtgccgtctacaaaccctagcccccgacctccgccgtgctgccgtcgcagacggttcggtcttcttctcggacagcgctcggtcctgtttttttttt

SEQ ID NO: 42610 - DNA, 218 bp, Triticum aestivum
  Clone ID: PAT_TA_42610
agcgcatctcgtctagatggcctccgaggcggcgaaggtgccgtgtgccggagtcggtgaacttcaagaggttgaggtgagaggtctggtccttctctaagaagcatatggttgcctcctagaagaagaaggacgctgataacaccaaggacttcttcttccgtgccaaggagtacgcctgtgtgtatgaggcttaagacaaggatctgtttcaactt

SEQ ID NO: 42611 - DNA, 236 bp, Triticum aestivum
  Clone ID: PAT_TA_42611
agcaagccctctaaccgtacgccatggcgcacgccgccgccgccgccgccgtgccgctgcgccgaccgctcctactctacctccggcccgcccgccttctatcctccgtcgcgccccgctcgatgtacgggcgtgcctacacgcgcgccctacgacctcttgcccccctaccctccgacgacgaggacccggacgacggagacggagcgcccagccgtaacgagaagaagcggaag

SEQ ID NO: 42612 - DNA, 408 bp, Triticum aestivum
  Clone ID: PAT_TA_42612
cccacgcgtgcgaaatacttatgcaggggtgaacgctctcagggacacaccataagtgcacttgtaataagaagttcttacatacacagagcaaagctttacatggtgggactgcatacaaaatctcttgatgcagggagttggtggaaaccagcatatggggattgccaggaggtaaggcaggcgaaacattcagatcagtgaaaagaggcaccctgtaaccaggaaatatgtgtggcctacgctcgggttttggagggcttgtctcacctcagtactgaggatctgatttaagcagtcgcaggtgatcttgccaaccgatacatctcattcctagctcacatatatgacactgcgaacttgagaggatgatgatagtagaaggctggaacacgtgttgctaaggat

SEQ ID NO: 42613 - DNA, 417 bp, Triticum aestivum
  Clone ID: PAT_TA_42613
actatctatttcttcattatattaaactccataaccctttgtcgctccattttcgacgtcggcgacgacccccaacctctgctgctgtccgcgttagccgagggcggtggtagccatggacagtgccctagcaagcgccgaggcgatcgtcgaccagctccagaagaacgagcagtaccgtcacatcctagtctacgttatcttgtcttccccgccggacatgccccaggccatgcgctttctcaaccacatggtttcggatgaggtgccgatcgtggagttgtggcagctgttgtatacgtttgtgctggagctggggaagcttgagccagactcttagagggaggttgcccactacgcgcttacgcagatccagtctgtagtggggttcttagtggagcatgtagttgttgatta

SEQ ID NO: 42614 - DNA, 240 bp, Triticum aestivum
  Clone ID: PAT_TA_42614
tactacaccaacatcaagcggctgatgaagataggcgtgctcgtcgacgaggcggatattatggtggccgacgagcttgatgtgctttacggtgcccacacccacaagaagcgcttcatgatcgtaggcatcctttgcgtaatcttaggaaccattatgtatgactacccgctcaccatcatgggtaaggtgatcaagaccaagagtgtggagtacatgccatacaccctgtcgctggga

SEQ ID NO: 42615 - DNA, 218 bp, Triticum aestivum
  Clone ID: PAT_TA_42615
ctccaacgtcggccagccatcctgatacaacatacaacaccgagaaagagtctttcctctctgctgcttcttcttttgacatccgccggcggtcactcaacaatggcggccaccctgttcgactgcgcctgggagtggcagatctccaacttcagcaagttccagttggccaccgttatcaccttcgtcctatacgagagcgtgttcttccagcttcg

SEQ ID NO: 42616 - DNA, 251 bp, Triticum aestivum
  Clone ID: PAT_TA_42616
gccgacaattaaaacacttaaaactgtgaaaagatttttttttagattatcaatgctgcgagcgggagaagggctagggcgtgcttgtgatcgctacaatacaagtgttacgctagctcataaatgttagttgatggcctaagcttacaaaaggcggacgctcatacgggacaattgcctccatctggtgtgcttagacatgcttcagtgtgtgaacgatgccatggacgatgctctgctttcaaagtggt

SEQ ID NO: 42617 - DNA, 276 bp, Triticum aestivum
  Clone ID: PAT_TA_42617
tgattggcgccgtcatcttcaatacttgcatcaaattcagcaccaatttgttgctggtaagtctccatcttctttgaattatataacacaatcggatcctgacttcaacatttactcaactggacaccgtaattacctttgtgaaatcagtaaaaaaacaaaaacattttgcaaaattccagtcatttgctggaacgtattgatgaagattttggtattggtactctttttctataagatatcgatctgtgctgtatctatgttgtcacttggtat

SEQ ID NO: 42618 - DNA, 186 bp, Triticum aestivum
  Clone ID: PAT_TA_42618
tccacacttgcctcaaccttccatcatatatacaggcggatagctacaaggcatggggtacgaaatgtttcattaacctcccacatcccggtccgaacccgggtccaaagtcgtttttacctatgaagccgatgccaccgccaggaccttcgaagggaatgccaacgccgtcgttgccgatgccgt

SEQ ID NO: 42619 - DNA, 410 bp, Triticum aestivum
  Clone ID: PAT_TA_42619
tccggttcggttcaactgggtctggcgctagtctcgggtcctgggggatcacaccctggcctacttcctctccggccagagatggaggtccgtgctaaccacccgcttgtcatgcacaagtacgcagaacaggttcaccttgcctgcaattacttggagggtgaccgagctcacaacatactcccttttgggccatacaatgagaggcgcatcaccacaagcagctacatgactgataaccttggcatcagtgtcccaatgatgccataccttccattgtttgccaatgcacccgctgagaagaaaggtgtcaagaactttgcaatgacttactcatgggaggagtgtcagctgcaattggcaagattgatgcagctactattgagcgtgattagctgctcatccagaac

SEQ ID NO: 42620 - DNA, 256 bp, Triticum aestivum
  Clone ID: PAT_TA_42620
tttacatcttatccacgatgacaagtagatcttgaacatggtagtggtcgtcaatgacttcctgactgcagaagatgcctatgaggccatccaacactccatggattatgggtgagggaaggcatggaggaggcgtccaacatgttccggcagttagtgatcagttgtggccctcattgagacgcttgacaagatgatggtcagtgacatgcacagccacgagctcgtcatggccgttgttgtgctgtgcgacaag

SEQ ID NO: 42621 - DNA, 309 bp, Triticum aestivum
  Clone ID: PAT_TA_42621
gcgaattcataaccatgaaattaaagggcaggatattttgatccccagcctttgttactgaatcattcgccggcgatctagataaaacagactctacagcgcctgacgaagtcggacacgacggccagctccttggcggcgttgtctgtgtccgtcttgtacaagaagtatacatgcccgtcgcccttggtctggtataactcgagctcgtcgccccacaccgacgccttgacgcccgccgcgtaggcgcgcgacctttttacgaaccagctaagttccgccgtggtgaccagttcacggtcgcaccct

SEQ ID NO: 42622 - DNA, 335 bp, Triticum aestivum
  Clone ID: PAT_TA_42622
cactccctacctgccccacgttcaatccccttgcccgcactgcttcctccctcctcgatctctctccctggccagccgccattggtgggaaaccctagcccattatcccaatcaacacagccgctgttgctgttctacttttttccttgtacccctgcttccctcaccacagccgcaacctaggggcttctgcgttcgtttcgatgagattcaccaccttgcgaggttctcatctgccctaggttgcgaggatgccacgggaggaggagtgacctttttgctagattggttcggaggaggagctcaaccagcgcgtcttttggcggtggaaggaa

SEQ ID NO: 42623 - DNA, 430 bp, Triticum aestivum
  Clone ID: PAT_TA_42623
cccacgcgttcgggcgacttcaccacccacctccacaagccggaagatttcctgatcatcatcggctcccgcgcctccaaggaccgcatgaacggcgaccactacatccgctgctcgcgcttctcactgtcgcttcgcccatggtgcaaacttgcccacgccggctccggtgggttcgaataccgcgtcgagctcgagctccgcggcatccccgcccatgcctggcacttagcgacggcggatcacatcctcgggaccggtgtctggattgagcgcctccattcgcagacgcgctcccgcgccgacctggccacgttccgcctctctggtctcgcgcacgaccctgccgacatccgtcgcgctgcgacgctggaaatcgtcgaggtcactccgggacgcaccgtcttcttcgtccccatagtctccaccc

SEQ ID NO: 42624 - DNA, 343 bp, Triticum aestivum
  Clone ID: PAT_TA_42624
ctcttatgcgcatagaagcatgttaagaatgtagaactggaaaggcatttgcaagtgcctggtggaggtggtctctgaagagactgacgcgtttctctatatattaagaaatgcattgaatgcttgttaccatggctgaatgtatggcatgagcgtcaacacaagaatccgaggatgagtggactgctgctatcaagcgtctgattgaagatgataaaagttcttcgcaagatacgttacagttgcacagcacaacatgcttaagtgaaggaatacatgagtatccttcaaggaacattattatcaggacagggttgtgttttgctgtctgcttatctgcact

SEQ ID NO: 42625 - DNA, 109 bp, Triticum aestivum
  Clone ID: PAT_TA_42625
cgggtagtttggggtctgccagtataagcatatctccgcacgggggcgtagtcatcagccagagcatgaggggatggaggtcagatgcatagggtacgcctattggatg

SEQ ID NO: 42626 - DNA, 303 bp, Triticum aestivum
  Clone ID: PAT_TA_42626
aacgacctcaccctttgttaggtaggcttattattctccatgcatgaaggggggaatggatctggttacaaaataaatattcacttcatgttgcatcttcgataaaatcgggcatgaatgaactgccgatgtgtttcaaactggccttcaaattcggagtatggtgcctgaaaacaagagctccatctttgatcaatggtttatattggaagtctaacataacaagatttcgctctaaattaaagctctgcattttctattccagtctgtcatggttccctgtgctaacttatcttaattaaa

SEQ ID NO: 42627 - DNA, 151 bp, Triticum aestivum
  Clone ID: PAT_TA_42627
tttcggggaagtgtcaatggttaatggtgttatagacattatcggcatagcactcgatgtggggtcatcattccattgtgtcggttctaggctgtagtcttcattttttattgctggatgggctagaaaatgttttaattcatatgttgat

SEQ ID NO: 42628 - DNA, 353 bp, Triticum aestivum
  Clone ID: PAT_TA_42628
cccacgcgttcggcaaccaggagctcaagagcgacctcaaggacctgtacattaacactgcaatccagatggatgttgttggcaacaggaaggccgtggtgatccatgtgccgtaccgtttgcgcaagccctttatgaagatccatgttaggctcgttagggagctggagaagaagtttagcggcttggatgttgtctttgttgtaacatgaaggattgtgaggccacttaagaagggttctgttgtttagcgccctttcaccaggaccctgacagctgttcatgatggtatcttggaggatgttgtgttcccagttgagattgtggggaagcgttgcagattccttttggat

SEQ ID NO: 42629 - DNA, 210 bp, Triticum aestivum
  Clone ID: PAT_TA_42629
attacacccacacagcccgaccctctcctcagctcacctcacgccgcaacctatgctagggtttcctcctccatctccaccggcatgacatagcacgcgcggtggcgagcaggcgatggcaagagtggcgcaggcggtctttggactaacacgcatcggtatgctagtaggggcgggctggggcggatcacgcgtatctacgaaacggac

SEQ ID NO: 42630 - DNA, 246 bp, Triticum aestivum
  Clone ID: PAT_TA_42630
atctcctatttaaattatttcaccacataagcgtcttgggcgctagttaaacatgtttgtcttctgttgctcgtacacacacaatgatgttctaatagggaagatgattgtattcgtgtttgcggacgcagagacttataacttagagtccgaactaaagcctggaattgatctacttggttcagtagatgaattgatttttgttattgtatgactgatatgtactcatcaatgaactctctattg

SEQ ID NO: 42631 - DNA, 380 bp, Triticum aestivum
  Clone ID: PAT_TA_42631
taccctcccttctcccacttatccacccctctttcttggcaagaaaagccgctctcggggtgttctcatcagccgtattctcatcatgctagcgagatggtgtttgtgaagaactagtatgaccagggcctactccaagcggatctcaagtgaagtttaagtgttggaatactggcgaagtccgtttactgggtctggtttaggctcactatccaagactagttacttaggtcaatctcgtctaagtactggtttgttgtttaagttattaacaaatatgttattgtccaaattgaggactcttccattgctggtgatttcgttgtggctgcttcttatatccatgagctatctcgggttgtgtcttgaatttggctttc

SEQ ID NO: 42632 - DNA, 199 bp, Triticum aestivum
  Clone ID: PAT_TA_42632
ttaactctttcttgaaattttaatcgaactcttatgtgaggaaactacgtatgttgcagagtcagatttagttttagtgctgcttttatgtctgtcgtcgtaatggtcgttgtcatgccggttaaacttccagcctagcttgcctacatgtattcgtatacctacaactccaaggtgatatgactaatggagctgttga

SEQ ID NO: 42633 - DNA, 378 bp, Triticum aestivum
  Clone ID: PAT_TA_42633
ccaaaatctgaaccccgtcgtgatgggcgacgccgtcgacgccccccgacggcaacggctggcctcaattctccttgcccggaaaccgcgcctcactgacagcaggaacgagaccacggccacagccgtatccatggatggcttcaccatggcggactgcttctggatggccgccccgccggagctgggcatgttatacatatactgctgcacaccccctgatctgcaagccgggccgtactgcaattccaaagatttgccacgcgtggtcagcgtccgttcggcgggacggtttgaactctatcgcgcctgattataccgacggtacacattcgaatattgactgtgcaacgcctgtgagccggcttgcgcgtcgag

SEQ ID NO: 42634 - DNA, 404 bp, Triticum aestivum
  Clone ID: PAT_TA_42634
cccacgcgtccggttcggagggagaaggcagagagcgatggtgagtcctgcacctctgggtggaagcagcagggttggtcgagcagtgaatgtggtcggggtcagcagttgaaggaggctcgccagccggagcagcaggaggagcgcctcgaggagtggaagggggaggtcgtgcaggacatgccaacaagagcattatagcaaggaggatagaatattcgatcagccatatatcttcttctcgatgcagccccgcatgaggagtcattctaggcatcctggggtgattcaagatgctcaggtgtatcacactgcattctacacagaccagctcatggtgtgagaagcatctcatattgttcaccgaattaattgatgaatttgaagcgattcaagagggggag

SEQ ID NO: 42635 - DNA, 122 bp, Triticum aestivum
  Clone ID: PAT_TA_42635
ggacaacccacagagcatcagccggagcactttatccttctctgcgttcttgtccggatccggtgctttagtactgcgcgttcgttcgataccaccaccttgtcgaccaagaagagatggag

SEQ ID NO: 42636 - DNA, 402 bp, Triticum aestivum
  Clone ID: PAT_TA_42636
actgcgaccacacatccaagcggatactgaagagtggcaccatctagcaactactccacactactcaacagccttgagcgcctccggaaccagagggaacaggttccgtcctcgcgccaccaggttttgccgtcctggtgctggttggagagccggtacttcccatcggccttgttggtatcgtaaacgccggagaagagctacgccgcaagcatgaagtcctttctggtgaccaggtattcgtaggggactcagaacgtcgaccatatgactgtgtcgtcagtgcggaacaacacaaagttgttgttatcgtgcagggcgcccgcgactcaggcagatctgattgagcgaccacgttaaaggaggagcggccacccactctaggtgcggtgcaaggtggca

SEQ ID NO: 42637 - DNA, 424 bp, Triticum aestivum
  Clone ID: PAT_TA_42637
taacaaataagcaaccaaccatcaatctaacttggacagatgctcagtcctcacaatagtgtgtgctcttgatcaacacccaactcacagaaactcagccgtcagaaatttagaatcctcctaatccacaagcagtttgataaggtgttcttgtggtacccgcaatcccctcatttctattgaactaactttgagatttgcccacctcttttttgttgttctacacgaccaatcagtcaaataattagggggaatcgattgattgttcttgcccacctcaacctggtatgcttatatagtggatgcttaggcccttgacctttctaatacacttggattcctggtatcccacagcaacatgtgaaatgttattgtggtcttttttaatttactattttgtcttatttttggtacacctattgat

SEQ ID NO: 42638 - DNA, 361 bp, Triticum aestivum
  Clone ID: PAT_TA_42638
gccccttccacctgggctagggttccatacgcctccgtcttcgggcagaccacatacgccgacgtcgaggtccgagaggagagggccgccggaccgtctttcttctccacagacctccgaggcgccctactcgtgggaagacgccgccgccgccttgcgagaccccaaggcagggcagggcgcggtcgcgttgcgggcagcgaggagcggcgcgccggcgccggcgcatgtgtagccagttagcgagagaggaagggagtggctacgatatctttatgcgaggacaagtactttgccgttcgcgggccgcggcgaccacgaacgtggagctgctgaagcggatttggccattggtcgtgtg

SEQ ID NO: 42639 - DNA, 368 bp, Triticum aestivum
  Clone ID: PAT_TA_42639
tcgctccgcctgatctgtgctctcgagcctggcgtcttttcaccgtaccatggggctgccggcactcaatcggctcatgtctatgcagcgcgatcggcgtctccggccaactcaaggccgtaatggactggtgacttcatccctggctaaaaggaaggactcaccctgcatacatgatgaaaattctcgacttgataaaaaatcgagatattcaggaccacccctactagaggacatttggcatcatattacattctctgctttctttgcgagatgctgcacgtgttgtctgcgtgtctttattcatttagtaagttcttggagttgtcttcccaatcttaactttaactaggtaaacacttgggttt

SEQ ID NO: 42640 - DNA, 415 bp, Triticum aestivum
  Clone ID: PAT_TA_42640
cccacgcgttctacagagggagcggttccgtctagccgggaagagccaccatcccatcggctccgtttccgaagggtcagagatggcggaccgtgctaaccacccgtctgtcatgcagaagtttggtggacagttccaccttgccttcagctactctgagggtgttcgtgctcgcaacatctgcccttctgtgccatcctatgagaggcgcgttaccacaggcagctacatgactcacaaccttggcattagtgtcccaatgatgtcatcttctccattgttcgtcaatgccccctcctgtgaagaaaggtgttaagaactttgcgatttgactttctcatgggaggagtgtcagcttgagatttcaagactgatgcagcttctatttgagcgtgttgagctgcttttcctgaac

SEQ ID NO: 42641 - DNA, 194 bp, Triticum aestivum
  Clone ID: PAT_TA_42641
tcgcttgaaaccgaggtgtcatcacttctcccacaattcccttacgaatcacatgagacatgggttctactttaagtggaaacgctaagcatactcaggtaccatggagttcatcgtgaagaattaaggaaacatggagatccggatgcggaagacatgcatgaagacggagaggaaaaagctccaaggaccag

SEQ ID NO: 42642 - DNA, 157 bp, Triticum aestivum
  Clone ID: PAT_TA_42642
gcgcctgcggtaccttcccggtacgcccggatcgtcccacgcgttctaatcttctagcgatcagtcctaccctgtttccattatcttcgagctaggcatcaggggcagtggtcttctttgctcgtggctcttgttatggtcttatcgtgcttactgg

SEQ ID NO: 42643 - DNA, 262 bp, Triticum aestivum
  Clone ID: PAT_TA_42643
ccggccgagtcctcagccagcactcccgcccaggctgcgacaccgaccgatgccgttgccagcatgccctctgagggggggacacctaccgactccgccgccagcacgcccgccgaggcggcgaccccgatcgattttctcgtcagcactcccgtcgaggggggaacgcctgacaaggccgcggtgggctacagttacactacgccggccgtgcagccctccgtcgatggcactaagacggttcccggggaggggtaggcta

SEQ ID NO: 42644 - DNA, 420 bp, Triticum aestivum
  Clone ID: PAT_TA_42644
tcgctgtcctacgccatggcgcctcctcagtccgacgagcagcttgtcgacgatcctgccatggtggacattactcctcctcaccccgacgagcatttcggtggtgagccggccgtggaagacaccgcccctcctcgattctccgacgagcaacaactcgggtgcgtgccgcaaaccacgctgatgccgtacgcggccgtggactcgtcgctgcgcgccatggccggccaggccgagggcttcggccggcacgccatcggcggcctccacggcgacgtttaccacgtcaccaccctcaatgacgacgggcccggctcgctgcgggacggctgccggcgccaggagccgctgtggatcgtcttcgacgtgtccggcaccattcgcctcgcggtggggcttgcgcgtgttgtcccacaagac

SEQ ID NO: 42645 - DNA, 413 bp, Triticum aestivum
  Clone ID: PAT_TA_42645
ggaatattgccgttgtttcagtagcccacttagaaccatcttctttaacacaagaatcaatcatgaccaatagcgacttgttgcagcaacccagtagtcagaacgatatagaagacatggtggtttcttgtagctccggtaatggctacgaaagctctaaattgacccgagctacatatggacaggagaaacctgcatagccaaacctgcctatggaatctctgcaaaacagagtacacagtggagccatgcagcctgaagtcatcatagggaagattatatgaaacaatttgatccaattaaattaagaatcttttgcttatgaatgttcagccccatccatgcatacaagaaagactacatgagaggcagagctaacaacgtttctaactgaaataagctccattatcata

SEQ ID NO: 42646 - DNA, 123 bp, Triticum aestivum
  Clone ID: PAT_TA_42646
cgaccacgcgttcgttttttttttgatacccaaaaactcttagcatatcacaaaatttactaggataccatgtgaaaaagtggttaagtaatatgcatactctctcatataaagaccatttgt

SEQ ID NO: 42647 - DNA, 364 bp, Triticum aestivum
  Clone ID: PAT_TA_42647
acggctagctggggctcgtcggacctagacagtaacacatgaactggagaaccaatgatgtggggtactggacgcgctcgtttgaccagaacctgtagcgagcgtgcaaggaccatttctggagggggaatagtaggattggtttctggatgagatctaaggagggggcgcttggaccaaatttgaagcggctttacgatgagcacattgcgccgttgatcaggaagacagacaaccggttgatcctcacggactacgacgggactgtgatgccgcagagcttcatcatcatggcacggatcagggatgtcaactttgcctaagaatggtcgttgcaagaccctaagaacaatgtgtatattgt

SEQ ID NO: 42648 - DNA, 146 bp, Triticum aestivum
  Clone ID: PAT_TA_42648
tttgaaggcacaaagtattatgttaatctccaatacattttgcgtgaaaaaattgcaaaccttctcacgcaaaatgtattggagattaacataatacttcgtaggcacaatggtacttcttaaaagaagcttgcatcataacacta

SEQ ID NO: 42649 - DNA, 245 bp, Triticum aestivum
  Clone ID: PAT_TA_42649
ctcttggcaaagcaccagctggtcttctccttggttgcgtgtgtgtgtagagtggcatatgtggttttgtgtgctctcgtagagtaagaatattgctagagacatagagtgatggtgactcgatttgagagaggcacttcatgatgaagaagatgcgtcgctgcaaggagagatggctccaacaattgacatcatagccttgactatccgatgcgacaactgctgcgcgtcctactctatgttag

SEQ ID NO: 42650 - DNA, 416 bp, Triticum aestivum
  Clone ID: PAT_TA_42650
gttcaggaaacaaaatttgtgggtgcctaaattaattggggagtcagatttaatgagaactgagatgctgatatttttctagtcaacctcagcagggaggtttctttacgcttacaaggatgtggactacagggccgtactattacccttatggtgaaaacaagaaggaaaggtgcttgtagagccactaaaattcatgtggtgtggggtctgtgaaaccaagagtctgttctatcacgattacaggtgcaactgacattttagttacacttcagagaattgcaagacaaatgtttgcagcttttgcttgttgatgtgaacgatgtgcggtgtagtttgactaaaaatgtcaaagtcttggtcattcttatttaggtcgtggagcacacaaggggatattgctttaatcatggctt

SEQ ID NO: 42651 - DNA, 269 bp, Triticum aestivum
  Clone ID: PAT_TA_42651
tccacgcttccggtgcgtacggtgtgttggtgggtgccaactacctggccacgggcaagatggaggtgctctccgagcatcagctggtctactgcgaccatgagtgcgacctaacataacctgactcatgctatgctttatgcaactgtggtttgatgacttcagcctttatatatatgttgaaatcttggtgtctttgagagagaaaaggattacctttactccggttaggacgtctcttgcatatttgtgaagtccaatgattgttg

SEQ ID NO: 42652 - DNA, 331 bp, Triticum aestivum
  Clone ID: PAT_TA_42652
ggatttcagtcgcaaaactatgaagatctcagctgttacaagaacacagctgagtgtaccttttggagacactgacagagtcgtgtgcttcactatagtcagcaccactcattctgctggtttttgtgttggtgctggtctttttgatttggctgaacatagaagatttagggtggcagatcactatgtgaaggacactgttctagatgcattttatgattgcatttgatgtgcttctatgtgctggctacgactacagtgtttgtcctgaagcactaaatgactgtttcttgggtgttctaagttagagccttatgtacctcgacttggg

SEQ ID NO: 42653 - DNA, 429 bp, Triticum aestivum
  Clone ID: PAT_TA_42653
gtcgaccgtacactataccaactgcgccttctacttgaacggcaagagcatgggccacgaggaggcccccgccgtgaacggctatagcaacggccatgccgaggccgtccccgcgaacggcaacagcaacggccacggtgaggtcgtcgccgtgaactgccatgccgaggccactgcgaacggcaagagcaacgggcacggcgaggccgttgtcgcgaacggcgagagcaacggtcatgaggtggcggcggcagtggcggcgccggaggaggcggtggagtggaatttcgtgggggccaagggcggtgttctggcggcgactggggcgaacatttgcatccgggcgatacggtacaagatcagtgcgagcgtgcatgagaactggccgtggtccgtgctgtccctggcccacggggacccgttcttttt

SEQ ID NO: 42654 - DNA, 263 bp, Triticum aestivum
  Clone ID: PAT_TA_42654
cccacgcgtacttccactgttcgggcgaggcctctttgtatgcgcaacacaaggaggagcacgaggaggacggctacatggttggagtggtgaagctgttcagcgcctagggttttgagtttgtcatcgacaagaaggtagtcatggtctacaacatcctttggaacttgcttacctcacctggtggttattcgttgactcgccgatgtgaggtgaggtttcctgagattatcactgtatttctattagttttgccaatattt

SEQ ID NO: 42655 - DNA, 223 bp, Triticum aestivum
  Clone ID: PAT_TA_42655
attatcatttacattccggaatcatgtgagagagatttctttaaagaatataaaaaaaatacaccgttggtgcatgagctactaggactgactgtctgtccctccgatctgactactagctttaagtgatgagagttctacattcttgatgacagacacttactacttctatgaagtgctaattaaattgggtttagcttaagtgtccacgatcttttggcct

SEQ ID NO: 42656 - DNA, 373 bp, Triticum aestivum
  Clone ID: PAT_TA_42656
actgacgcgtggtctcatcctgaggaacagactgaaatatgctctcatctaccgggaagtgcggtctatccttatgcagcgtcttatcatggttgatggaaaggtccgctctgacaagaccttccctgttggtttcatggacatctttctcattcccaagactggtgagaactacaggtctttgtatgacaccaagggccggtttcgcttttactctgttaggggtgtggatgctaatttcaagctttgtatggtcatggtctgttcagtatggcctgaatggcatccatctacttgaacacctatgatggcctgactcatcctatcccataccctctcattaaggccaatgtcactatcaagcttgatctgg

SEQ ID NO: 42657 - DNA, 240 bp, Triticum aestivum
  Clone ID: PAT_TA_42657
tcgcctccttctcgccattccttctccaacgctcgcttgagtcggacgacctagctggccagtgggtccgttcgtggtggcgcgcgcgattgctgggtctgtggaggaggatcgtccggctagagatggggctactggaagatcgataaaaagcgttttgagaacgccaccaacaggccggtgatcatcttcaagcgccggtcggggatcatgattaatgcgtgttggcttactgagctt

SEQ ID NO: 42658 - DNA, 414 bp, Triticum aestivum
  Clone ID: PAT_TA_42658
gttatggaaaacatgtttgcggcgctttcgatcgattctagagtgacaagtactgcttccacgagatcgggaaaaggatcttttattattcttgatgacaatattcttgctggaggtaattcagattgcaccacttccactgactctagcaggccaagatcagaggtattcattgaaatggcaaatgacctgttgctgcgccatgatggaactggtgttcgagtgttcgaggtttgttttgatttgaactccactcatgctgcccaccttgacaaatgggtccagtttgcgttagaggcgggtgcacaagatgtgaaacttagcttgtgtaaaaacatgacattttgtccggagcatttggtgactgcaaatcgctaatactttcctatgcattgctttggcgatgggcgacta

SEQ ID NO: 42659 - DNA, 376 bp, Triticum aestivum
  Clone ID: PAT_TA_42659
atcgatctcattcttctcatgttttcccctagtggaaggcctaccatatgcgtcggcgacaaaagccccatagacgaagtcattgcaaagtatgcacaacaaactcctcaggaaagggctaaaaggaagctggagagtttagaagcactaaagaagacattcaagaagctagaccatgatgtcaacattcaggacttcttaggctccgggggtcagacggtcgaggaattatctagtcatcctggcgcattgcaatgtcaaatggcagatgttcaaaagcgtctcaattattggagcgatcccgagaaggttgggaatatagaccatataagagcgatggagcaatctcttaaagaatcttcttaatcgcatcggc

SEQ ID NO: 42660 - DNA, 447 bp, Triticum aestivum
  Clone ID: PAT_TA_42660
ttcctactatcttcatttttcaacctaacatgtcttctttcatctatctatcgccaagcagtgcgcctgtcctcagcttgtaagctcctactgtaccaacaaagccagccattcaacaatggtctgtgcagctgttttcatagttgcccttctcctggtcgccgtcgcggtggcgctattcgccgaagccaagggcaagaaggccaatgtcgagaagaaggcctaagcgcctgtgcccttcttcagcgcgcccgaggacgcgctcgtcgtctactctgtagccttcgagcccttcgttgttgatgcaccggagcccattagcttcagcaccttctactgaggattcacctgacagagatgagatgagatgagattggtttagagcaattattcatccgttcgttcttccgtcgtcatggtcttttttcctttatcagttgtaataat

SEQ ID NO: 42661 - DNA, 161 bp, Triticum aestivum
  Clone ID: PAT_TA_42661
gctttcttgcacaaccggcttggacaatgagcgtacttaaaatttaacacgcattatgtcgtccatggacctcgtgcacaatagatagggaggcatgcggttaccacatttgggattatatcatggtgagttcaccttgcgagccatgccggaagcctgga

SEQ ID NO: 42662 - DNA, 245 bp, Triticum aestivum
  unsure (1)..(245): unsure at all n locations
  Clone ID: PAT_TA_42662
agctgggacgcctgcaggnnacccggtccggtattgcccggcttctatccacgcgttctcccactcgttcgggcaaaggatggacggcagggaaaaatcaatggaaaaggtggttatttttataagatgggagggaagccaaatcctgaccttatagttcaacatgtgattgactagtactgtaatatagacatagacaattttctgtggatatcttgtttctttattagtattaagatatattg

SEQ ID NO: 42663 - DNA, 389 bp, Triticum aestivum
  Clone ID: PAT_TA_42663
gtggaaaccagatcgttgggaatttagcttctaccattactcaaactcaaagtgagatcataacactaatactaggtgatagcagaagaaagcagggccaaaatggccaccacaagcgcggagcttctgcaagctgaggcagagcttgtgcgccactccttaggctacctcaagtccatggcgtagcacagcgctttaaagctcggaatccccgacgctctccaccgctgcggcggcgcggcgtctttgcccgacctgctatccacccttgccctcccctgtagcaaacggccatacctggcccggctcatgaagatgctagccgtggaaggaatcttcacggctgtggctgtggatgtggatgctcctgccccctgcgagggcgaggg

SEQ ID NO: 42664 - DNA, 435 bp, Triticum aestivum
  Clone ID: PAT_TA_42664
ttgacgtcccatgcacgcttacgtacgctcacactatgtagagtggccatcctaacctttcccaaatttgcattaagacacaggaggggaagccaccgtgatggtccgtgacgaagcataccgaccgcaagttcaccggcggtaaggcgccccgcaagcagctcgccaccaaggcggagaggaagtcggcgccgaccaccggcggagtgaaaaagccccaccgctacaggcccgggaccgttgccctccgggagatccggaagtaccagaagagcacggagctgttgatccgcaagctgtctgtccagcgcctggtccgcgagatcgcgcaggacttcaagaccgacctttgttttcagatccacgccgtgctggcccttcaggaggcggccgaggcgtaccttgtcgggcttgtttaggacaccaacctgtgcg

SEQ ID NO: 42665 - DNA, 130 bp, Triticum aestivum
  Clone ID: PAT_TA_42665
agacataaagggcataggaggttttaataatgaatataagattaagttctgtaaaatactttgtagagtactgtgtgaaatatataaagcatggcacctataattacacaaactgtatggccaaaatact

SEQ ID NO: 42666 - DNA, 358 bp, Triticum aestivum
  Clone ID: PAT_TA_42666
tcgcgtcgtccccgccgagctctcggtccccgtggaggaccgcaacaataaggaagcggctgatcatctgttgttggtgaaggagagcgatctgtcatatttcgactgtagctttcacgcggccatgaagcccgtccggtccgactgtgacgtggcactggacaccttgggcgacgctgcgggggcggacacatcgccgaagctgaagcggccttgctccaacatcgagactaagcgaccaggctcgcgttccgcgcccgagatgccggcccggccgcgctcctacggcgatctggactacctggtcgtcggccttgtcctggacgcgacggcaaccccgcacggctcgccggaggcc

SEQ ID NO: 42667 - DNA, 390 bp, Triticum aestivum
  Clone ID: PAT_TA_42667
cgcccgggtgccaggtgcgcggcgcagggaggtcgtcgacggattccgggcaagtgcatgtgagatccgatggtggcggctgcagcggcggccggcggcggctgcctacgctgtatgctgaggcggaggcggaggcggagggaaggacgcgctgttcgtggagctgtggaaggcctgcgcggggccgctgtccagcgtgccgctactcggtgagaaggtttactacttcccgcagggccacatctagcaggtggaggcatcgacaaaccatcttgccgagctttagggcacgcccctctacaacctgccatggaagataccctgcaagctcatgaacatggatctgaaggcttgtccagattctaatgaagtgtacacccatctcacttt

SEQ ID NO: 42668 - DNA, 225 bp, Triticum aestivum
  Clone ID: PAT_TA_42668
cggacgcgtgggcggacgcgtggggtttccgtcttattctcatccccgacccccgcaccggagcgtataccctagtccccggcggtgaccttgcggcctccgttgcgctctgtctggtgcgcgtttagacgtggagctgcggcggccaagaccaatcgaccatggccttctccggattccagttttgagaaccatcttgtgaatttttggtggtttttctctcaa

SEQ ID NO: 42669 - DNA, 336 bp, Triticum aestivum
  Clone ID: PAT_TA_42669
acgtcggagctctcccgaccgacgctcaccatgatcattttcaagaagaaccgaaatagtgatgtggtagttcttctataaggagggcgtgctgtttgccaagaaagactatcaacctggtgaagcacccgcagatcgatgtgcccaacctccatgtgatcaatcttatgcatagctttaagttctaggagtatgtattggagactcttttcctggatctcttctactggcattttaccaacgttggcattgatcacctactcatctacctgaacctctcgtttgagatcgtgcctgccacgctcaattagtttgccaagccaccttgctttttat

SEQ ID NO: 42670 - DNA, 395 bp, Triticum aestivum
  Clone ID: PAT_TA_42670
acagccctagctgctgccctcccacccgcctgtatctcccctcttcacggagcaagctggcaggctggctgggattcccgtcgaagcagggcaggagctagggcgggtggaggatcctttgcccggtaacgaggagaggaggtggcagtggctccccgcggctagggcagctagagaggggcgaagaggaaggcggctgtcgcttccgccatggctagcgaggaagtactccacaaggtccataatcttatagagcgctgccttcagatgtacatgaacaagaaagatgtggttgatgccctctcccaccactccaggatagagccttgtttactgaacttggttgcaacaacttgagaacaaaattctttgttttcaaagcatacgattgaggt

SEQ ID NO: 42671 - DNA, 429 bp, Triticum aestivum
  Clone ID: PAT_TA_42671
ctcacgcgtacgtatgcatacactgctatcacatgcaaggatctggccgctgctgcggtgctgccggccaaccaaaactctgaggggcgtgtgaaccctctcactcgggctaactaccttgcctcgccgcctctggttgatgcctatgctcttgccggcactgttgacattggctttgaggaagagcccattggagttggaaagggtggcaaggcaattttcttgagggacatatgggcttcaaaccaagagatcgatgaggttgtggagtccagcgtgcatactcacttgttcaagaaagggtacgactccattatggaacgtaaccctaggtggaaccagctgccggttccaaaggaggcactgtaccaatgggacgacaggttcacctacattcgcaagcccacttacctggaagggatgtccatg

SEQ ID NO: 42672 - DNA, 440 bp, Triticum aestivum
  Clone ID: PAT_TA_42672
cccacgcgtccgcccacgcgtccgcgcaacatccaaatggaggaggacgaggacgtcgacggtgactgggaagatgactttgagttcaggcctgatgttcggtttaggcgaggttcaacgtattctgttcgggaccttgaccttagaaaacctgcagccgcaaagaaccctcctagacgacagtttgaaacaactacagcggaggtactgaagaaggctgattttaggaatgttagattcctctccaactttcttacggaagctggaattatcatcaagagaagccagacccgtataagtgcaaaagctcagcgtaagattgcaagagagatcaaaactgcgcgtgcgtttgggttaatgccttttacaacaatgggtagaagaccattcttctttggcagaagtgcggaggagcattattcggatgatggatattttgg

SEQ ID NO: 42673 - DNA, 265 bp, Triticum aestivum
  Clone ID: PAT_TA_42673
gacgccacgcgtccgcccacgcgtccgtccacgcgtccattcaacattttaatggaggaggacgaggacgtcgcagtgacttttaaaatgactttgacttcatgccttatgttcggtttaggcgaggttcaacttattctgttcggcaccttcaccttagaaaacctgctgccgataagaacccttcttgacatctgttttaaacacctacagtggatgaactgaataaagcttattctaggaatgttagattccttttcaactt

SEQ ID NO: 42674 - DNA, 352 bp, Triticum aestivum
  Clone ID: PAT_TA_42674
gtttttagttcgaaccggctccaagttggtatcttataaagcgggaatgacccgtttatcgaaatcgtggagaacatggaatactcctgaattgacctttgtgtcaccaattgctgttgttggtggacagaagatctccctcattcttaaaggccgcaatctatctattcctggcacacagatccattgtacaagtacaggaaagtacatatccaaagaagttctgtgctcagcatatccaggtaccatatatgatgattcaggtgtggagacttttgacttgccaggacaaccagattttattcttgggcgctgctttattgaggtggaaaacaggttcaggggtaacagc

SEQ ID NO: 42675 - DNA, 421 bp, Triticum aestivum
  unsure (1)..(421): unsure at all n locations
  Clone ID: PAT_TA_42675
cttgactttgaagagcgagatcgggtatgagggcgtcctttacaccatcaacaccgaggagtccagcatcgggctttgcaataatcttggaaatgaacactgaggattaagctgaggaggatggtgctaacattgatttaaactcacaaggaaaggaaaatgtgttgttctaaaaacctccacaagacaactatcagctaggaacttgtgagatgatattattgataaggattacaacacacatggatatgtgaacttaaggtgcgaaggttgacttggaagaaattgtggcagcaccagttcaggatggacaacaaccaaaatctcctacaaaagttgtttctaatgtgctatcgagctccagtgtgttcctatgcaatctggtcttcataccgcctncaagaaaagctccgcaatgaca

SEQ ID NO: 42676 - DNA, 339 bp, Triticum aestivum
  Clone ID: PAT_TA_42676
gcaccgtccgactttaaggtttctggtgcggaggtgatcttggaccagatctgagctcctcaatgaacttcggccatcttcagtttgtgcggcatacttcctctgcagcagccgaataaaattaaatctcttacgacccgtgtaagatgttaaagatacgatgcgccccagactgtatggcctcggcctcggtttttctggaatgaattgatcagtgttcactgtgtgcgttatttctatttgcattggcttcaattggagcaatgaactagatttacaggccggacaaagaacatcgacctgaacagcctgcctgtggattatactctttcttggtgg

SEQ ID NO: 42677 - DNA, 419 bp, Triticum aestivum
  Clone ID: PAT_TA_42677
tggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaagctcaggaagtgcacgcctccctgagggattgggtaaagatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgtgtgctga

SEQ ID NO: 42678 - DNA, 416 bp, Triticum aestivum
  Clone ID: PAT_TA_42678
cccacgcgtccgttcaatgtatttttattaacacattatcacaatttgcttactgctgctatgcaaagtcaggattttgctgcttttttgttccttgctgggttgtaaagctgctctttctttgctgattggatgtagtgccaactgcggaactgcgaaggcagtactcatgaggtgctatgctggtacattagtccatgccagctgtctcataggttgcctcatgcattggcattttgggttttaggtgatgtggaggagaggaaaggaagtgaggcaagatgctgttttctcatgatacaattaacctcgtaagctaaattagcgctataagacgactcacatacttttcttcccctgacacacaaattaaggggacatagagttgctatgcggcaactaaaaaagcaacctat

SEQ ID NO: 42679 - DNA, 279 bp, Triticum aestivum
  Clone ID: PAT_TA_42679
ctcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccgtggcgtcctgtgcgagatg

SEQ ID NO: 42680 - DNA, 321 bp, Triticum aestivum
  Clone ID: PAT_TA_42680
tcttctcgacccacgcatccgcggtcgcttgttctgttcgcgagtttcgactcgcgagtgcccgcttttgctccaatccaatcggtgccgcctcgggcgagatccgctccgcgtgccccgccgttgtcgagatagagggtgtcgtccccactccccagcatctgggtccacggagagttgttgatcttggatacctgatccgcaatttggggctgattgagtcacttgacctttatcaacatctgcctcgttcctgctgccttgctcactataagaggctggcctggttccagatatgattctattgtgagtggagatgga

SEQ ID NO: 42681 - DNA, 295 bp, Triticum aestivum
  Clone ID: PAT_TA_42681
tcgacggcacttgcacatgggtaagccgatccctgacgtgagcgactcgcacatccaggagctaggcgggtgggcgctggggcaggcgaagcaccagaagctggccgtcgacgggctgcggttccgccgcgtggtgcgcggcgagcagcatgtcgtgtccgggatgaactaccgtctttacgtcgacgccgtcgaccccgccggccgcaccgtgccctacgttgccgtcgtgtacgagcaggtctggacccgcacccgtcagcttggctttcttaacccggtgcccctcgcccac

SEQ ID NO: 42682 - DNA, 435 bp, Triticum aestivum
  Clone ID: PAT_TA_42682
cccacgcgtcctagccaggtggctaatgatgcattaagcagcataagaacagtggcctcattctcagctgaagagaaggtcatggatttgtacaagaagaaatgtgaaggtcccctaagaacaggaatcaggacagggattataagtggcatcggttttggagtttcctttttcttgctgtttggggtctatgcagctagcttctatgccggtgctcggcttgtcgaggacaggaagacaacctttcctaaagtcttcagggtaagtaccttatggtagtactgaggatttttttaacttcatctggttttcgtattaaggaagaaagaaatgcttgaagtgaagtcaaagcaacatggtttggggtatcctttcttaaaaaaggagattttggtatactaaaaatgtggtctactatatgcaatccaagttttt

SEQ ID NO: 42683 - DNA, 351 bp, Triticum aestivum
  Clone ID: PAT_TA_42683
cccacgcgtccgcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagttcgccatcaccaaggagatcctggagaagcacatgagcggcggcgccgccatgaccgtggagcaagcgctcgc

SEQ ID NO: 42684 - DNA, 199 bp, Triticum aestivum
  Clone ID: PAT_TA_42684
tctctgtcttactgggcttggctatcatggatacctaagtggatgttgacgatacatatatgggaattccatcacttgttatcggtttggatgaaaattgctctaagtttacccgctggtgtggtaatattggcagctgtcatactatgttgaacgctcgtgtttttgcttctaaaattggattctggtataaacattg

SEQ ID NO: 42685 - DNA, 287 bp, Triticum aestivum
  Clone ID: PAT_TA_42685
tcgctctcagtcaactccaagggccaagaccccaatttcccctagaggttgggattgtgtgggttcagtcatgctcgagcggcaccgctttcatcgtgacgccgacggcgatctccctgtcgttgtgaccgccccccttattgcgcactcaccgtcgtctgctgagccttggtctgtctaactctggtgcatcggatatatccgacgtggagattgtacgccgcttcgtcgactgtttgccgcatctgcctagaattcgagtccgtgcctggtgatgtgctaatatc

SEQ ID NO: 42686 - DNA, 426 bp, Triticum aestivum
  Clone ID: PAT_TA_42686
cgttcgggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgttggccaggcaggccgccaagagcatcgtggccagcggcctcgcccgccgctgccttgtgcaggtgtcgtacgccatcggcgtgccggagcccctgtccgtgtt

SEQ ID NO: 42687 - DNA, 417 bp, Triticum aestivum
  Clone ID: PAT_TA_42687
gggtgatgggaattctaagaaaaatcattcaccagacgttaagaaaaggagaaagcgtatgaagcatgtcaatacatcaacggacagagatgtcttaaacctgcaggataatgtgtcaagtgtcatggcaagacagtgccttcatatctcaagtcatagaacgtcccagagcacatcaaagcataagggaaacttgtcacacttgcttcacaatgaagttcctatccggatgggagaaaggaacaatcttactgaaaactctgaaaatgatagtttgtctgacagcttcagtgaacctcagacttcagatactctgtgtatagaagctcaaagaaaatcaagtgcaccatcatcttcacttagacaaaggaccctagattctctatatgaatttggtgaaactagtaggcatgaacc

SEQ ID NO: 42688 - DNA, 314 bp, Triticum aestivum
  Clone ID: PAT_TA_42688
tcggtcccctcgccgagcatctccgttacggcatttttttcctcgacaagccgtcgaacccgtcctcccacgaggtggtcgcctggatcaagcgcatcctccgcgtcgagaagaccggtcacagcggcacgctcgaccccaaggtgaccggcaacctcatcgtctgcatcgaccgcgcaacgcgccttgtcaagtcgcagcagggcgctggcaaggagtacgtctgcgtcgcccgctttcacgccgccgtgccggacaccgcgcgagtggcccgcgcgcttgaggcgctcactggcgcggtgttccagcgcccg

SEQ ID NO: 42689 - DNA, 414 bp, Triticum aestivum
  Clone ID: PAT_TA_42689
gttctttttccggatacctgaataccgaaagactgtacaactgtagtttctgattcctactccttgtcgctattcaatcgctaaaggatctgtccctggtggagaagaaccggcagattcaatgcaatgttcttgactgacgtcatggattttgttcttcaacctggtagctctgaagacgaattgaatagctgctagtttctgctaatcatctacagtcaggtgcagagtgttctgggagctagttctgaatatcactgtcacgctgtaatctgcacgtttctgagctcctaacttctaagcatgccactaccgtatccctttgtaatttaatcagctgtaccatccagtactctgtttacatttgtagaaacgctctgcaaagaagctattatgtgggaggttctttgctat

SEQ ID NO: 42690 - DNA, 414 bp, Triticum aestivum
  Clone ID: PAT_TA_42690
cccactcgtccgggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgaccttctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagttaagtccaccccgttgcagccctacagcgaggtg

SEQ ID NO: 42691 - DNA, 194 bp, Triticum aestivum
  Clone ID: PAT_TA_42691
cgcctgtgtgcccacccgctccacattttgatagtagttgactacaccactgtcttcatcttccgcctcctaatgtacgttgataacggtcttcctgcacgaatgggattagatctcggatggcaacacatatatgctccgttttgtggtacaattattgtcctctcagttcaagtgctacttctttaccctct

SEQ ID NO: 42692 - DNA, 394 bp, Triticum aestivum
  Clone ID: PAT_TA_42692
aacaaatacagagaggcagaggcgccatcatctcccttcttcttcacccacatgcctctaggtgcctcacaagtcctcctccgctgtcatctcccctctccactcctccctggtttgttcaagaaactttctttggacaagatgggagtgcagaggtacaggttcttctgctgcgggtgtggcgccaatgcggcggccgacggccgggaacgcgacgaggacgggggcttcggggtgtccgacggcaaggccgagaagggggtcgtggccggcccgcggtggctgtcgtgggcgcaggttgaggcgatgacgggcgtgttcacctttgccgtggtcggcgagggcggtttcagcaccaggtacctggcgcgcctatccggcgcgcttgtcgtcg

SEQ ID NO: 42693 - DNA, 448 bp, Triticum aestivum
  Clone ID: PAT_TA_42693
cacgtcgttcttgtctgacactcagcaggagcatttctccttgtcaactccttcaacatcgcgcggctacttgctactagcttcttgttttctttgatcgacgcattctacagctttgcttatcccggctagagcggctagggtatcggtagtgcgcggtgagacggcatgacaacgcggggagctaagcgcgcggtcaccttcgaccctgtcgtacccgatggcggtgttttcccatcagcaagtgatggcaggacccgctagtttagatccttggcgggcggaggctgttagcaaacatgtgagggcacttaatacccagtttgcaagctgggtgcaagtgcatgggcaaaatcatgcagcttgaactttgtgaggacggtcttaaggattacatattacatgcgtgtgaaattatggaaatattcaaggatgttgttaactggtt

SEQ ID NO: 42694 - DNA, 391 bp, Triticum aestivum
  Clone ID: PAT_TA_42694
ttatatacctaatgtagactgtccccttctttcccacgcccgcccgccgtaatccccaaccgcccttcgcaatcccctaccgtctgtcgtgatccccgccgccgtggcagccgcccgccgtaacctctgcctatataatgatagggggcgccctcctccctcgatcatccgcacttgtgtagccatcgcgccatctacaccggccaccgccacacggtggttcgcctctggccttgcggcttgcgacctcgaggtgaccgaacccgtgggctccatgactacatctgtgacgcctgaagaaaagatggcggctcatcatcaggcccccgcgttgtgctccttctcccgacctctccgtagaatccctatttccgccggacctctatttctt

SEQ ID NO: 42695 - DNA, 412 bp, Triticum aestivum
  Clone ID: PAT_TA_42695
atttgaaaggaattgggaagaaagcgctgcatatagtgttgcaagtaatgatgtggtatcactcctgaattcttcaattgtttcttcaaaagcagatgctagcaattctgtcttagagaaccctgtagtgggaagagagatgtggagaattaaaacgaaagattctaagcctgccaagtctggacgtctatctcacgaataaaagaagcttgggtagtctaatgattaaaagaagacaaaaccttttttggcaatggtatttcatatcatcaagattggcaaggttgtactttttgttacatatctgggatcaaggcttattattaatgacctaaggttgcttattgattcttaccacaatgcttatattacttggacatggatgccactattctctagattctaaatacat

SEQ ID NO: 42696 - DNA, 420 bp, Triticum aestivum
  Clone ID: PAT_TA_42696
aggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaatagtaatctagcaacatttggtttaggggctgttcaggtgattgctactggagtgacaacctggttgactgacaaagctggtcgaaggcttcttctcattatttccaccacaggaatggtcattactcttgatattgtttctgtgtcattttttgtgaaggacaacatagctgctggttcgcacttatactctgtaatgagtatgctttcactggctggacttgtggcatttgagattgcattttctcttggcttgggagcgatt

SEQ ID NO: 42697 - DNA, 431 bp, Triticum aestivum
  Clone ID: PAT_TA_42697
tccgccccacggaacaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaatggtgcaggactcaagcaccacttttacctggccttcctgatgatcttgctattgcctgccttatacgagttcctcgacttgaacagcccaaactcatgatgggttgcaaaagatggaaccgtcttttgtctgggaattacttttactccttgcgtaagaaaattggtgtggcagaagaatgggtttatgtcttttaaaggggaccgggaaggaagaattcctgggatgccttttatccactccacc

SEQ ID NO: 42698 - DNA, 300 bp, Triticum aestivum
  Clone ID: PAT_TA_42698
cccacgcgtccgtccactcgttctatggcttctacattcgctgccacttctactggcggccttatggctgctccaacagggaagaatgtgcgccttcataggagggtgaacttcagagttagagcagctaaggagctgtacttcaacaaggatggctcagctataaagaagctccagactggagtcaataagcttgcagacctagtcggagtttacactcggaccaaagggaaggaatgttgttttggagagcaagtatttttctcctaaaatcgttaacgatggtgttacagttgccaa

SEQ ID NO: 42699 - DNA, 302 bp, Triticum aestivum
  Clone ID: PAT_TA_42699
tcgcagtcgttctaccgagacacctgtttcgaaccatgctgaccacatctagatgaagcgttgtcgtcgtcggatggaaaggtgcggatcatgatgtcttgggaggcgtacgtttacgagctcctgatgtgtgagatctaaggacagtatctcagcgccggtgtcatcgtttgtcacgacggctgcgtttgttcgcatttcgagagctttcccgagttatagcctgtggagggtgctggtttcataaaggactttgatgaacctggtatcttttgtccaactgttttttttgttggtggtac

SEQ ID NO: 42700 - DNA, 197 bp, Triticum aestivum
  Clone ID: PAT_TA_42700
cagttgctacctttctcttctgctgctcgccctcggtatctgatcgcgaccatgggaccccgcggcgtctccctagcgctccttgcggcggcgctcctacaggccctcgcccccgcgttggttgcggcggcggtagtgctgcggcatggggcctggtgcgggtcagcgctgaaaaatcatcccgttgtccagaacgc

SEQ ID NO: 42701 - DNA, 424 bp, Triticum aestivum
  Clone ID: PAT_TA_42701
tcgcggacgcgtgggcaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattattatttcttgccttgtggacaaggaggggaatgcagcttgcaaatggcttcctgctggtggattc

SEQ ID NO: 42702 - DNA, 413 bp, Triticum aestivum
  Clone ID: PAT_TA_42702
cccacgcgtccgcccacgcgtccgggagcggccctccacctttatcgccgccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggggcaccccgtccatcaccgagtccaagtccaagaatgatgtcaggacctcctgcttctggatatgaccggtcacctctattttacggaggaggtgggggcgccccaccttcaattccgcttggaactgggagctttggggctccatatccacaccctgggatgcga

SEQ ID NO: 42703 - DNA, 320 bp, Triticum aestivum
  Clone ID: PAT_TA_42703
aacacaaattccagaaacaggtcctgtaaatccacatagtacttttttctaattctacaatgacagcaaatttttttgaaattagccggcaccatccttaaaacatttgagccacatgccgcactaccacacttggggaacattacacacaattccttgccttacaaacagaatcttttatttttggcattatgcgggggttaggcatgggctgagaaacgtatcatctcaattttttttacggaagaaccttttatgctttaggagccttttttgaaggggtggtttcacccttttgccccatttttgactttttgggt

SEQ ID NO: 42704 - DNA, 410 bp, Triticum aestivum
  Clone ID: PAT_TA_42704
cccacgctttcggagaaagataaggtcctccataacttgtaaacatctgagcttcagaaaggtggcgctacttaccctgacttttttgtctggtttaccacattgatgttagaggagatgttattggtggtgtccctggtgtttctaaagctcaatttgcaaagcttttaaaactggttggttctaaattttggcttgaccactcaggccctgttcgttttttgtcaaacaatggggatttgatggggaacaattccccttttagtcaaattccttctaattgcctttcaatgccccctccccaaattcccatgatttttgggatgaaacgaacatggtctttatggggtgatgatattcaatgatgtttgtcattgtatggagctgatatactggtagtcccttttttt

SEQ ID NO: 42705 - DNA, 291 bp, Triticum aestivum
  Clone ID: PAT_TA_42705
tcgacccatccttcctacatcagttgccagctcatgatccgtgccttttctgggtagccaatcccataccggtcctctcccggctgtttctccctccgcaccgtggctccggctatggcggtcgtaggcttcgctctgtgtaggtctaccttttcgttacaactgggtatttttttcggtgggcgcatgtgctgactactcggtcctgacgctgagtttgagcggcacaaggccgttatgccgacgtgagaggtcggtgcatttgcgcagactgtcgtcatcatggagatt

SEQ ID NO: 42706 - DNA, 139 bp, Triticum aestivum
  Clone ID: PAT_TA_42706
gctgcgggcatattgctgccaacactatgacaggccgacgctttatcagcataaccgatgctaccattggtggacaaattccggtcgacaggacctatacaagatgcgtagagtactattccctgccattcaatccgat

SEQ ID NO: 42707 - DNA, 480 bp, Triticum aestivum
  unsure (1)..(480): unsure at all n locations
  Clone ID: PAT_TA_42707
aacccccncntcgacccacgcgtccggtctaaaacatatctgctactacacttcagtatttcaattgatcacacacaagaagttcagatcagaaagcaggctgtcgctactcccgtcaggttctcggatggttcccgtcaagggctgaccatggagaagagcacagtggtggtcagtgtccctgttgttgtcatggccgagactgctgagaccgactacagctcgagcttctcgcacctttgcaggatgcagagtcccagaaagatgttgggaagggtgataaatcaagggataagggaactgctgagaagtttgcaatatatcagaagcatcgttcttcgttggcagacactgttcaattcatgaggccagctgctccaacttccagtgtgaatgctgatattgtgggaacatccactctgcagtctgcatctctaccgaaacaagaaccctcaacagctacatccaagagctatactt

SEQ ID NO: 42708 - DNA, 443 bp, Triticum aestivum
  Clone ID: PAT_TA_42708
ggcaacacggcgtacttgtatatttccgtggccttcattcagatgctcaaggccttgatgcctgtagcaacatttataatggctgttttctgtggtactgacaaattaagatgggacctcttcttgaacatggtattggtcagtgttggtgttagagtttcatcttatggtgagatccactttaatgtgattggaaccttgtaccaagtcactggtatctttgcggaagccctcaggctggtcctaactcaggtccttctccaaaagaagggcttaaccctgaatcccattacaagcttgtattacatagccccttgcagttattggaagaactggagctgtcaccattcgagttgctggtgttctgaaggactggatacttattgctctcttaactattatcttccctgaatccgttttacaagtcttaacataattggata

SEQ ID NO: 42709 - DNA, 223 bp, Triticum aestivum
  Clone ID: PAT_TA_42709
tgtgcttaggcttcgaacagaacactatgtgtatgagcttccagatgcacatccacttctacaacagctaggacttgacctacgggaacatgatgatcctaccccatacttattggccatatggacaccagatggaataaaggaaattactaagacaccaaaaccatgctgtgaccctcaaatgggaggcgatttatgcaataatgaaatgtgccacaattgt

SEQ ID NO: 42710 - DNA, 446 bp, Triticum aestivum
  Clone ID: PAT_TA_42710
cgcgtccgcccgatagggatcatcacagcgacgacgaaccagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaagtggtggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatctttggcgacctcggcacctactcggcgggcaactggttctt

SEQ ID NO: 42711 - DNA, 165 bp, Triticum aestivum
  Clone ID: PAT_TA_42711
acgcttgcatactccagaccggccgccctatttttctttttcatggcagagacacagcttcttggtgcaaatgtactcatgatactgtcagtccgtttatccccctcgattccatgtccaaacctttccataccatcactgtgtctgatggcccttccgcatttg

SEQ ID NO: 42712 - DNA, 409 bp, Triticum aestivum
  Clone ID: PAT_TA_42712
gctgcagccgccactacgccggtcgcagagtcgccagctgcctagacgcccggaggcccgggggcgctccctcctgggctgctggcctccttcacattattggagccagaggagcgggcggcggcttgcactccatcccatcgcttgggtgcgtcgccccgaatccaatcgcctggtcaagtctgttgctgccggaggtagacggacgccttatcgtgctcgtggccgcagctagcgcgccggagccacagctggagcgctcgccggcgacgagtcgccgccccgcatggagcctacgcaggcacgcaccgccacgtctaggcgccaggcggagacgttattaccacaacattaaagggagtgccttcactccaaaaagcatagcctcataacttgctgatatgtgctc

SEQ ID NO: 42713 - DNA, 349 bp, Triticum aestivum
  Clone ID: PAT_TA_42713
gaaccaacgaagcactggttgttggtaggtgcactcaccccatccccccacccaatccctcgcggcggtcggacgagagagcgagcggcgatggcggcactggaggcggtgaggtcgtgggcggtgtccgtcatcccgccggagctcgccgccgccgcggggggagacccgctcgccgcgctggcagcctccgccgcggcccttgtcgcggggctgcttatcctcgccgtctggttccgatccggaggcggggcgccgtccaagccggtcgccacgccattacggccgccgccggtgaaggtggacgccgtcgccgacgtggacgacgggcggaagcgcgtcaccatct

SEQ ID NO: 42714 - DNA, 458 bp, Triticum aestivum
  unsure (1)..(458): unsure at all n locations
  Clone ID: PAT_TA_42714
ttcccgnncgaccccgcttccggtgagggttggcagcactcaaccgctgacagcggcagttgcgcgtctagggttgctgtgctcgtgtgcgggagcgggagtcaccaagtatagcgaatgccatacaggtaagttgtccgctcttcaaagtatactacttatccccaggtaacccgtgtatccgctttttaaattaaatttctacttattccgatatgtataggatatgtatccgagctgtttcgctatccgatacagatacgagctctttgggaatgatcctggtattcataggcattattgtagcgacttttctgatttgttgcacttcccttttttgctccatacacctctaacaatacttttttcttgatatgttttaatgaatagttttttcacattaatcaatcttttggttctccatgtaacttttataaccatcatagtactttcaagac

SEQ ID NO: 42715 - DNA, 425 bp, Triticum aestivum
  Clone ID: PAT_TA_42715
tcggtcccttgctggtggcatcattgggaagggtggtgctaacattaagcaaatatcttccgtgacaggggccaaggtggtcattcaggaggaccgccatgaatcagacaccagcttgaaaaacattgagtttgagggcacctttgatcagatcaggaacgctagtgctatggtcatcgagctgtttgttagcatcagtggcataggaagcaacttcaagaccaagatgtgtgagaacttcgtaaaagggtcatgcttttatggcggcaaatgccactttgcccatggtgagagtgagctgcgcaagcctgccgcttgttgagatccatgccctgtttcttacctcatagtcattagtcaatgtaactcaaaatctggcctttgatgatggatatgtaggcttctttaggtctacgctatatgaa

SEQ ID NO: 42716 - DNA, 434 bp, Triticum aestivum
  Clone ID: PAT_TA_42716
tcgagcgagcgagcgatgagcggtgagcccggccaccatcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccgtggccggtctacttctcggcgctggccatcctcatcgtgctcaccaacgcgcatttcttcgggctggtgggcgttggcgtggctccgcgcaccgcgaagctggccttctcggcgcccgtggtcatgcgtatgaattactgcgacatcttccgtggcgagtgggtgccggacactgttgcgcccttctacaaccaca

SEQ ID NO: 42717 - DNA, 420 bp, Triticum aestivum
  Clone ID: PAT_TA_42717
cggacgcgtgggggaaagctagcttctgctctggcagtttgatcgatggccacacatccagtcgagagttagttgctttgcctggttcattgtaatctgttgccgtattattattgcttgcatgcacggctggttggattggatccatctgcgctcctagctggacggtggttggcagatgtgatgagacgagaacgagactacgacagtgagaagagagatcctagccaaatgcaaatgttacaactgccgccgccgccggataggcttccaatttcatccgttgcatacatacgagtgctctcatccgcctattattttaaaatggagatgaagaatcgagatcgtccatgatccgtattcctccctcctcgttgactgccgcggccagcgatctggtcgtcaccttcctggaccgac

SEQ ID NO: 42718 - DNA, 271 bp, Triticum aestivum
  Clone ID: PAT_TA_42718
ttctcctcttcgtcttcggttgcaagaaagaaaaagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtggggaacgc

SEQ ID NO: 42719 - DNA, 443 bp, Triticum aestivum
  Clone ID: PAT_TA_42719
cggacgcgtgggcggacgcgtggggttatagtgccatgtctccaaaaaaaaaaaaaaaaaaaaaaaaaaaaaaaaaaaaaaaaaataaaaaaaaaaaaaaaaatttaaaaaaaaaataaaaaataaataatattaattttgtgtatcaaaatatttagttttacaaattaatatatattgggggggccctttattagtatctatggttgtttgcgcttatgtcttcgagtttcattttttttttagggctcttattttaatttcctgggggggtgtttccataaatggtgatggaaaatatctcgttcttcccatatttatttgtttgggataatttctctttttttctactctttttttaatttactaaattttttctcattttgtgttttatatatgtttacctccctcttatctctttaatggttccctctctttttttg

SEQ ID NO: 42720 - DNA, 219 bp, Triticum aestivum
  Clone ID: PAT_TA_42720
ctcccctctctcccgcgtccttggagagtcgcggaggatcacctttctttattgtggccatctcgatagcacattcctgggcacccgtctggcgaccctgctccacaaacgggcgcattgtggttcggttcgggttcgggtgagcggcaaggctaatcctgctccgaagaaggtggcgttgacatcgtcctcctcttaccggccgttgtggttccccgg

SEQ ID NO: 42721 - DNA, 429 bp, Triticum aestivum
  Clone ID: PAT_TA_42721
tcgcccacgcgtccgcccacgcgtccggagcagtgaaaaaaaatgatattttaccgtagctaggctttaacttctcttagtcttctggctttgctctgttcacgtttagcacaacagtgcctactctttcgtgtgatatcatgtttgtaattgctctccgcagagagcaatacgggagcaaaagaacattcttttggattctgagaagctagactcagctaggaagaggcttcaggaaaactaccaggaagcgcaaaacggtaagatttcaatggcgcgctccgtgtacttagcactgacttagagctttacatacaaagttaaatagtctctcactaggaataattcgttgtctgatctcccagtgaacttgtcaaaatgacgtgctaaattcaggccaatgctatgccagtgagatccaacagcagt

SEQ ID NO: 42722 - DNA, 444 bp, Triticum aestivum
  Clone ID: PAT_TA_42722
cccacgcgtccgccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagaggaggtattgtggttactaatgatggtaatgccattttgagggaaatagacattgcacaccctgctgccaagtctatgatcgaactaagtcgtacacaggatgaagaagttggtgatggcactacatctgtcattgttctagctggagagatgctacatgttgcacaaggcattcatcgacaagaactaccatccaactgttatttgccgagcat

SEQ ID NO: 42723 - DNA, 283 bp, Triticum aestivum
  Clone ID: PAT_TA_42723
cccctatcagactgcgacggaacatgagcatagttttctaggcttgcagcttaggtaggacgagtagaatttcttcttttgttttttggcttcaaaaatattcttttcatccgttgggcagagactacaggtggtgtggggcacttctttcactggtctttctcctagttaggtcgtatgcatcgggaggatctgctggaaccccaaaagcgattcttggttgattgattcgcttggggggatattcaaaagcttaagcttctttcttctccttccacaaaaa

SEQ ID NO: 42724 - DNA, 407 bp, Triticum aestivum
  Clone ID: PAT_TA_42724
ttcccggattgccggccccatcctgggcgcgtcgctgccgtctccggcgggcggtgaggatgcgcaccgccgccgcgtcagctatttctacgagccgtctatcggagactactactacgggcaaggtcacccgatgaagccccaccgcatccgaatggcgcactcgctggtggtccactacggcctccaccgtctcctcgagctctcccgcccctacccggcctctgaggccgacattcgccgcttccactccgacgactacgtcgctttcctcgcgtccgccaccggaaacccgggtgtcctcgacccgcgcgccattaagcgctttaacgtcagtgaggactgccccgtgttcaacggtctttttcccttctgccaggccttcgttggggggaagcattgggtgc

SEQ ID NO: 42725 - DNA, 473 bp, Triticum aestivum
  Clone ID: PAT_TA_42725
tccgcgcgtgcgtgcatgaatcaatcccacggtcttcctgccgcttcctagggtgcccccatcctccgaatgctgcctcgcctcgatctgcccgttcctcgtgttccgacggagggtggcgggcgactaatggggacgggggcggggagcgcgcgggctctggccgtggcgttcgccgtctcgcttctcgcctgctctggcgccgtcgctgtcgccagggcgcaagacaccgagcggatcgaaggaagtgctggtgatgtgctcgaagacgatcccgttgggaggctcaaggtgtatgtctacgagttgccgaccaagtacaacaagaagatggtggctaaagactctaggtgtctcagccacatgtttgccgcggagatcttcatgcaccgcttcctactgtctagcgcgatccggactttaaatccagaagtagccgattggttctatactccggtatacaccacgtgtgg

SEQ ID NO: 42726 - DNA, 457 bp, Triticum aestivum
  Clone ID: PAT_TA_42726
cgtgcgcgcaaacatccatctgaggctaccacagatgggaatagagctaatggacaaccgttgcttgtcaatgagcagaacaagtataaatcaatgcttatccgtacatattctacagtatggatgattggaggctttgcctttattatttatgcgggtcatctatatatctgggctctggaggtagggattcaaatattcatggcaagagaacgtttcaacctactcacaaaatggagcgtagagaaacacccccctgggttcaggctactgaattggttctgtatggtttatttagactctcaagaaaaagacatataattaccagttcaaacagtatgcctggacgcacatgatacttgtaacggtttttgcacagtctgctttcactgtggcaaacatatttggagggatattctggtttcttttgcctgcttcacttattgtgatcaacgat

SEQ ID NO: 42727 - DNA, 460 bp, Triticum aestivum
  Clone ID: PAT_TA_42727
cttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctacttctggaggcccttcattcggttggatattccggggcactggcaaaacctttgatggcttcagaatctgctgtaaaccggttggatgttagcagcttggaggaatttgttgctgaacattacactgctcccaggatggttcttgcagcatcaggagttgatcatga

SEQ ID NO: 42728 - DNA, 315 bp, Triticum aestivum
  unsure (1)..(315): unsure at all n locations
  Clone ID: PAT_TA_42728
cctgcattnnccnnncccccattcccccnttcctcccacccttttcnctttttgcttatccatatctgttatccctgtcacttagctcctattccgttttcttcttactagccgtctctcttattttatcatgaattgcttgccttgctttcgagatttttcttttttttcatctttgctcagttttttgattttattctctttgtctgcctttcttttcgttatcttcttatttctctttgtattaatactttttcactgtctttgatcattttccttgtttatgtccattttccctgttctctacttttttct

SEQ ID NO: 42729 - DNA, 233 bp, Triticum aestivum
  Clone ID: PAT_TA_42729
cagggagcttcacagtgatggatctgaagagaagtgggaaatggcagaaaagacccggcgggtatgtattgtgcacgtctctgtgtccgtccgtcgtcggatctggtcgtagtggagacttattgtttgatcaggcagctacaacagcgactctgccaatgatctatttgccgtaggggtgctgtggctagggcatgtttgtgttggacttacgacgcggtgcccattgccgt

SEQ ID NO: 42730 - DNA, 449 bp, Triticum aestivum
  Clone ID: PAT_TA_42730
acccacgcgtactgatattttggtatccttgcgcggtcaggcttcacggtatctaaagccctattcttcaatttcctctctgcgttggatgctcttgctggaacagcactagcattgtctttgggtaaagatccgggacattcctccctgattgagggtttcaccgccggtggtttcatttacattgctgtcgcgggagtcctaccacagatgaacgaccagataacaaccatgaagagctcattagctcagctgatctccctggctatggggatgctggtcgctctaggcatttctctggtaataataatttgaaaccccatttctcacacttggtgcattaggttcaacccagttaccccaagttgatataatgctctagcagctccaaactagaaacagggttttctgatcctctcaatatatagaaccaaaaagtattttttttt

SEQ ID NO: 42731 - DNA, 254 bp, Triticum aestivum
  Clone ID: PAT_TA_42731
aggcatagcactggtcagcggtatgggcaccagccccgacatccctgcgacgatgctgtgcgttgctctttttgtcgctggctgcttcggcgccaccgtctgcaggtacagccacgcccgccacaccgacgccgacttcgcgattctgttccccagcagctttggctcttgtggccgaccgaggaattgctgcgactccggtataaaggacgcctccctgtcggtgtggcactttaacaatcgtggtggacaag

SEQ ID NO: 42732 - DNA, 402 bp, Triticum aestivum
  Clone ID: PAT_TA_42732
cgacccacaccttcttcctacgcgttgcccacgcgttcggtatcgcaggagtgcccccaaccccatgtcggttgaccctgacatgctcaacgagagcgggcaccatcacgccatagcgttcgtggagggggacaagtactacggcgccaaggctaccatcaatgtgtggcttccgaagatcgagcaggccaatgagttcatcctgtcccagctctggatcctgggaggctccttctgtcaggacctcttcagcatcgttacatgatgtgaggttagtccagaccttgttgtgtacaacaacattatggtttttacctacttgcctagcgattcctatcatgctacatgttgcttcaacctgttgtgctcgggggtcattctaattaacatccatgattgtta

SEQ ID NO: 42733 - DNA, 240 bp, Triticum aestivum
  Clone ID: PAT_TA_42733
tccggtactggttcgccggctcctgcgccgtccctgccgcgggcaccggctggttcgcctgcccccacagcgtggagagcgagcagttcatcacagtcctagtgccgagctccgacggcggtcacgagatgaactaccacggcatattccacgtttgcggcgagggctcctccgacgggacgttccctttgttccctttctcgtggcagtatcttaccgttgtagcggtcagtggtatga

SEQ ID NO: 42734 - DNA, 264 bp, Triticum aestivum
  Clone ID: PAT_TA_42734
ttcaccagcttgctctagcatagcactcgccatctaccgaccgccgcatttcaatcagcccgacgagctagcagagcggctggcaccttcctcctcaaggaacatggcccgcatgcagaatgttggcagtggctacggcggccgtggtggccttgttgctgctggctggcggcggcgacctctgatgctgacatctgctgctggctggtggcgtttgccattgtgccctgcatctcctacttgcgcggacagtgctaggggccc

SEQ ID NO: 42735 - DNA, 290 bp, Triticum aestivum
  Clone ID: PAT_TA_42735
tttcgaaaaggtaaagggcagagttgctgcacgaactgctcaagaccggagctggcttcgaccccctcccggttcttacccaggaaacactgatcatctggggcgacaaagaccaggtgttccccgtcgacctcggccacaggctgcacaggcttctgggcgagaggtccaggctagagatctgtagggacgcagggcacgcgcttgcagctggagggcgccgaccacgtcatccgctccatcaagtcgttccttctggactatgcggtcggtccgggagccggcgcggt

SEQ ID NO: 42736 - DNA, 251 bp, Triticum aestivum
  Clone ID: PAT_TA_42736
caagcccccaacctgcgagctgcgacaagttcgtctctctcgtggccacgactggccggcgtccccgcctccgtcccctcgcagattcccaggtcttcgccgctcccttcgccgccaaagagcacccacttggttaaatccgcctgggggaaatcttcatcaagcgtgtcgtgctaattatgcgatcttcatgggctgactcagttgcgaacgccgatgaattggtgcccgcgacttgctgctgcttatgg

SEQ ID NO: 42737 - DNA, 410 bp, Triticum aestivum
  Clone ID: PAT_TA_42737
cggacgcgtgggcgcgaatcacagacgcgtctatctcagcttgctgcactgcactaccctgccctgccatcatattgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgcttgatgccgtgcctgccgttcgtccagatgggcggggccatgccgccccagccgtgctgcggcggcttccgcagcctgctgcagcttgccaacaacacccccgaccgtcgaaccatttgcgggtggctcaagaacgtcgccaacggcgccaacgggtgcgggacctacattagtcgggccgg

SEQ ID NO: 42738 - DNA, 163 bp, Triticum aestivum
  Clone ID: PAT_TA_42738
aaactgtagtcttctttatgtccgactattaacaagaagatggcagcggcttgggggcagatgttgccctgggcatcgatccttgctccgatgacaaggagctgattgttgcagtttgctgaggaaatacagggggtgtttgggcaacctgagaaaggtgctg

SEQ ID NO: 42739 - DNA, 273 bp, Triticum aestivum
  Clone ID: PAT_TA_42739
taatcctgtggcgactccttgttcgggggctgtgctgctcacgggagctatgcagctccttgccccggggctccggcggctcgttctgggcaccggcgccgcctgtcaggtgggcccggccgccgcggcggcggggatgagggcgtaccacgagcgggtggtggaccacttcaacaacccgtggaactgttgttcctttgacaaggatgaccccaacgtctgttctgggctggattgagcgccggccctgtgcgacttcatgaagttgcaaat

SEQ ID NO: 42740 - DNA, 439 bp, Triticum aestivum
  Clone ID: PAT_TA_42740
cgtccgcggacgcgtgggcgggagcgctccctattcgcgggagcgagagaaatagagtgccccccgctctccgctctccgccgcggatcagcgccgtcgccgatcggaggccctcgcttccgccggcgggcggcgcgagccgggagatggacggcggcgcgggtgccggtcggtggagcgtcccctcctcctccggattcaggaggagggtcccgcccgccgtgaacgggcacggtcatgacgccccgccgccctccaggcggtccttcggctccctctcccgtggccactccacgccgctgactggcgagaggaccgtgaaaaggctgaggttgtacaatgcacttgctataccgtatcacacgaccgtgcactaggcttgtcagaggttggcatttcgcatggtatatgccgtgttactgaccgtattccatgcttt

SEQ ID NO: 42741 - DNA, 472 bp, Triticum aestivum
  Clone ID: PAT_TA_42741
ccacgcgtccggcaggtatgatcttatacgagtggagattggcaacaaagatataaagcttgaatacttagtggaggcatttacaacttcaaatgagtaacattccttgatctgaaatgtgtacaataatcctgatgaactactaaaacacttgccttaatctgaaatgagtacaataaaacatatataaggaaactcaaataagtaaagtcttgcttggccctcacaccataacatgactgatgatctactaaaacacctgcgaggtcttgtagcgtagcctcctcaacaccttctgcttatgctaactccggtgcaaggtacgccgctgccatcccaatccctacccccaggcaagctttgttgattgcttttctggtagttgatttcgtagctagctttttataagtcaaaaattgggtgaaatctgattaaccaaactaccgtgggtagaaataaaattggatgaatc

SEQ ID NO: 42742 - DNA, 330 bp, Triticum aestivum
  Clone ID: PAT_TA_42742
cccacgcgtccacccacgcgtccgcccactcgtccgcccacgcgttcggccgttgtcgctctcgtcccacccctcaccggccgccggtcgccgccggcttctcgcgtaccgcagatttgccgcagaagaatcagatccaaaccccgtatcttctcttcttgcccctccttccccattgtccccggcgctgccatggcctccggcggtgccgcccccaccggctcctatgccgggtccatgaagaagttgctcatcttcgactccgaggtaggatcttcgaggttttctctttgcggaagtacctctggaggaggctggtcggagaaagtt

SEQ ID NO: 42743 - DNA, 278 bp, Triticum aestivum
  Clone ID: PAT_TA_42743
cttcctgcctctaaccaccagcccctcgagtccgtcccttccccttgttcttcttgcaaccgagcagcgaccaaccaagcatgcgacaccgatcgagagctccaccgatctggcgaccgtcatgcccggaaagcaccagcagcacatgacggcaacggcaacggcggcggcggcggctgcaacacccaaggggtgcgtgacggagcgcgtggtcctggagggagtggagcagctccgtttctatgtgccgtttgggcatccttaagcactcgcttctt

SEQ ID NO: 42744 - DNA, 281 bp, Triticum aestivum
  Clone ID: PAT_TA_42744
gccgggaaccccaacctagcatcagaccgtcttcaagtcaggcactattctgtgcccgcgtcatcttcttggattcgcggcgatcaccaccgtcgtatttctgacaactgctgccgttgccgcgctcctcaccgtctccacgtcgtctctcgtcgctgccggagctggctcgaggccctcttcctacatgatctcggagccatcaagaaatgtgctgaggatggcgtgccacatccaaatcttttgctctgtcaagatggctgtcggccaacctgccgatc

SEQ ID NO: 42745 - DNA, 255 bp, Triticum aestivum
  Clone ID: PAT_TA_42745
aagtgagacgacggcggcggcgatgacgctgcttggtctgcaggccctgatggggtcggaaggactctttatctttctagctaattaataagctctagctagtatataatattctagcagagtcgtttgctgtgtgttgttcgagtcaatgagacagtcagtcgcgtgccatgggccatgcccatggtataacaagccgtgctctatctgttccatcgacttgttctagtggtggtactgatgggggaacaaata

SEQ ID NO: 42746 - DNA, 360 bp, Triticum aestivum
  unsure (1)..(360): unsure at all n locations
  Clone ID: PAT_TA_42746
gtatttctcaaatttgcgcaggacattgggtcctggaattgatggctgggaagtatctttgaaaggaatgatgagcatagtggttctccttggacttgtcataacttccatctattggggagtgaacaagtatgttttgaatgatccttcactttcaaaggctgatcgtaagatgaaaaaggaattgcctaaacttggcatgaaagagagtctgaaggttctgctctcctcgaggtatgtgagggatcctatctaccctagtggttgcttatggcattagnnnnaatcttgtcgaattcacgtggaaatcaattctaaggcacagttccctttgtccaaaagaatttttattctttcatg

SEQ ID NO: 42747 - DNA, 295 bp, Triticum aestivum
  Clone ID: PAT_TA_42747
cggccccacccacgcctccgctcacaaccagggtgcggaggatgatgctcgccgtgattttgaggaacgatgttgggtggttcgatcaggaggaaaacaactcgaaccttgtcgtctctcgcctctccacagacgccgtcgatgtgaaatcggcctttgccgagcggatatgtttgatcctgcagaacatgacgtccctgctcgtgtccttcgtggtgggctttatcattgaatggtgggttgccctccttattctcgttacctttccttttctcgtgctctccaactttgccca

SEQ ID NO: 42748 - DNA, 267 bp, Triticum aestivum
  Clone ID: PAT_TA_42748
gtcttaatttagcttcctcctcctcacctactagcaggcacagcgggcagcagcatcgatcggatcggagcagcacagggcgcgtcaccggaagctcaagtgtcttcttccctgcttggttggctgctgcttacctctcaggtccccactcacgtgccttggcgtacgtacgtgcgttcaacacaccaggtgaaattgggctcggagacggtgacggtctacgtggaaggcattccgttcccggcggagatcaccgtcgggaaccct

SEQ ID NO: 42749 - DNA, 454 bp, Triticum aestivum
  Clone ID: PAT_TA_42749
cgcgtccgcaacggctacgcccccgcttccgccgcccatgtccgcctacgcccatcctccaccgaccgccgcgtacccgcctccttcaggcaaggctgacgcctacgcgcctcccgccgcgtacccgcctccttcgggcaaggccgacgcgtacgcgccccctgccaccgcatacccgccggcagccaaggccgacgcgtacccacctccatacggcgcctacccgcccgccggcggcaaggccgacgctgcttacccgccctcatccggctacccacccgcggcaggcaagccagccaaggggggcgaaccggtgacggcctacccttcgggcggtcccagcacggcggcgccctacgctgctcctccgccgcagtacggcggctacgggtacccgccgcagcatgccgccgggtacggctacccgcccccgcagcaagccgggtacgggtac

SEQ ID NO: 42750 - DNA, 425 bp, Triticum aestivum
  Clone ID: PAT_TA_42750
ttcaaattcttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcatgtaccagaagagcacggagctgctcattcggaagctgcccttccagcggctggtgcgtgagatcgcgcaagacttcaagaccgaccttcggtttcagtcctccgctgtcgccgcgctgcatgaggccgccgaggcgtatctggcgggtctttttgaggacactcattccttgcgccatccacgccaagagggtcaccattatgcccaaagaca

SEQ ID NO: 42751 - DNA, 288 bp, Triticum aestivum
  Clone ID: PAT_TA_42751
cgcgtccgtccacgcgtccgcgacgttcctggggcatgtgcgagcgctgcgccagctgcgcgtcggagcacagcaacgtgtgcgacgcggtgccgttcgtcatcggccccggtatgcggcgcgactgcaccacccggttccgggacgcgcggtggagcccgctgcacgacctcctcgccgtcttcagcttcatgcgagtacaccgtcgtggacgtgaaccaggtggtcaaggtcgaccccgccgtgccgaccaagctcgcctgccttcttagctgcggtgccggcacc

SEQ ID NO: 42752 - DNA, 391 bp, Triticum aestivum
  unsure (1)..(391): unsure at all n locations
  Clone ID: PAT_TA_42752
cgcgtccgtccgatccctcctccaccaccgcttcctccgcgtcacccatctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaatttgttgtctctnnttaataccgctatttctcaaaagatgctgttcagatcataacaaaaatggctgctggcaatggaattaagacgtgtttggggtggacaaaaacagctcatgtcta

SEQ ID NO: 42753 - DNA, 337 bp, Triticum aestivum
  Clone ID: PAT_TA_42753
atcaaccaccattcgctgcctttctcacccaagtgcacacgtgcgcgcactcagcatgtgtgtcctccgcgacatcctgagcaacggatccgtgaaccccaacaagacaatccaaggggaacagctgcggtacggcatccagagcccgtcctaccggtgcctggccgcaggcatcatcaactggcaagcggacgtcgagaggtgcatagagtgggaagcccacagccgccgcgccactgggctgacgctcgcctttctcagtgccgtagcgaaggagctcggctgccctctcccgtcatgacatggccattcctggatctgacatcggctttcaaat

SEQ ID NO: 42754 - DNA, 339 bp, Triticum aestivum
  Clone ID: PAT_TA_42754
tttctcttcatatccatgcatggatgaacaagatacggtttgtgacagatgcaaacatcgagactggggttgttatctgtctttgtagcagaagaaacagtcctaataaagaatggagagctccttatataggagcaacgttttttaggggaaccacctgggttttgcgagaagcacatccatggattccactggtcctcagttagctggtaggtctagctcaatgttgagtaggagaagtttcagacagggcttaaggggatccattagctctttcaagggagatgggggactccatactgaacgaaatgaggcattctcttcagtcggcggttcaat

SEQ ID NO: 42755 - DNA, 334 bp, Triticum aestivum
  unsure (1)..(334): unsure at all n locations
  Clone ID: PAT_TA_42755
tcccnncccttcccacccgtcctcattatcccttcctaagaattctattaattccaagatagggagcaacctaaacttgaggaggtctgctggatgtggatcatgtcttcatgatgtggtggagctgatggggaagatctcacaagtgtgtgaagactacacagtctcgcgcactctctaacccagtgcgcgctgcggtctttcttttttcccaccttcttggatcggggaggttggccatgatgaggttgtggcctgctgtcctgctggtctgcgcattggctgtgtcctttctggtggccaccgtggaatgctctgtgacttactacaagaa

SEQ ID NO: 42756 - DNA, 457 bp, Triticum aestivum
  Clone ID: PAT_TA_42756
ccacgcgtccgtgacatgattgatgacactgccgattcaattgtttctgatatgctcttgtggccacacaggcatgttgttaaacttggtgtcaatgttgatacgagtgacttggagcttaaacctcagggaagactttctgttactgtggtaaaagcaacttctttgagaaataaggagatgatcggtaaatcagacccttatgtgaaactgtttgtgcggccaatgtttaaggtcaaaacaaaattcatagatgatgacctgaatccggaattggtatgaaacatttgacttgattgtctgaagacaaagaaacccaatctgtgttttttgaggtttacgacgtagacatacttcaacttgacaagagactaggtgtggcataactagcattaaacactcttgaatctgagattacccaagacgccacttttaagctgttcattcactggattcc

SEQ ID NO: 42757 - DNA, 435 bp, Triticum aestivum
  Clone ID: PAT_TA_42757
cacaactgcgactaataaccatctttggggcccttcgccgcgattagcttcgcttctcggactaggttaagttgccttttcgattctcagaaaaagactggctctgcactcggataattttaaaatggatagtgcacagcaccccactggggaattgatcaattcgtacgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggtggggggttgcaaatctttcactattatggagccaggaccgcatgaatgacttggtgatatcactggctcacaaattcac

SEQ ID NO: 42758 - DNA, 350 bp, Triticum aestivum
  Clone ID: PAT_TA_42758
tcctccttccacgacttgctcctacagtcctacctagactttagccggcgccgccatggtgatctcggggcccgcggcccggtgctccaccttcgtacgcgacgccgtgctgggcggcggcgggcggcagctggtccagccctttcgttgcgccttctacaacggcctggccgccgcgctgtccgagtccgaggagccctccgactcggacgccgccgcccgcgtccccgctggctgcaagcggcaggcggtgaggaacgtgctgatcctgttgagcgacaccggcggtggccacctcaccttcgccgaggccctgcgcgacgccttttcgattcgtgtttggcgacgcc

SEQ ID NO: 42759 - DNA, 372 bp, Triticum aestivum
  Clone ID: PAT_TA_42759
ctccctccgagtccagggggcaggggcaccattaccgagttgtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtgtgctatcgatttcgatatagtactactgctctgttataatcagcgggaaggaggaagatgacggtgacgccacggatcacggtgagcgacgggcgggtgacggtgcgcggccgtacggtgctcaccggcgtgccggaca

SEQ ID NO: 42760 - DNA, 460 bp, Triticum aestivum
  Clone ID: PAT_TA_42760
gtcccacgcctcctcccactcgttcgcccacgcgtcctcagcacattagttgctgtttcatttggttatcttgcacctgagtacgccatgagaggtcatatgaccgtgaaagttgatgtgtttgcatttggcatggtcatattggagaccttagccggaagaccaaattttgacaatatgctagatgaaattaaggtttatatattagaatgggtctggcaactgtacgaagataagcaccctctggacatggtcgaccccaagctcgaagaattcaacagtggcgaggtgatccgtgccatccacgtggcccttctttgcacccagggctcgccacaccagcgttcttccatgtcacgagcggtgtcgatgctggcgggagacgtggaggtgggcgtggtggtgaacaaacccagttacatcacggagtggcagatcaagggtggcaacaccagcagtt

SEQ ID NO: 42761 - DNA, 261 bp, Triticum aestivum
  Clone ID: PAT_TA_42761
acccacgcgaccgagcaagggctagatgccactacaggcccaaatttagcccatacccactctgccatccacgagaccacaagccacaccaaacccgcgttcatcgacggacgagctcgccggcgagagagcaactgagatggaaggccgcagcagcggcggccggtgtggagctgggctcctcgaagccccagatcgcgacgcaggcggagatggcggaggcccggatgccgctcgcctaccgcgatcagagcgcgcacc

SEQ ID NO: 42762 - DNA, 443 bp, Triticum aestivum
  Clone ID: PAT_TA_42762
tagagaatcctgctgaattggaagattggcttggcgatcttaacccacactcgaaagaggtgataaaggatgcttatgctgtaccatcacttgccactgcggttctgggtgacatgttccagtttgagcggcttggttacttcgccgtggatactgactccacacctgataaactcgtgttcaacagaactgttacccttcgagatttgttctgtaaagctggacccaagtgactgttcagtgtaattaaaggagggctcttgttttgatcggttgcagaggcgcacctgtactatactgtttgtgaagaaaatggttgtctaattcagaacaatttaaaggcctttctctttataaaatctaaggtgttttaaatgttgtgccctcatttatgggtgatgtttttatttgttccccttggtgactttgattaatattttgta

SEQ ID NO: 42763 - DNA, 229 bp, Triticum aestivum
  Clone ID: PAT_TA_42763
cggtcgcgtggttctgcaccccagaaagctagtacgatcttggggggacatggagcgcctgctgtgcttcatgcagagcatttgcggctgtaatggtggcggtccggggaagcgcctggagcgtcggcttgtgctgggcgagtacaaaaaggcatgtgttgtggtccaagtaccttgtagcgccgccgggggcttggatccggtgcgggggggaggagctgtggagcgc

SEQ ID NO: 42764 - DNA, 417 bp, Triticum aestivum
  Clone ID: PAT_TA_42764
gcatgggaagaaggcataggaggggagaagatgtatctcacccacttaaagtttctctggatgatctttacaatggcaccttaaagaagctctctctttcgcgcaatgtcatctgctccaagtgcaagggcaagggctcgaagtctggtgcctcaatgaggtgccctggttgccagggctcatgcatgaaagtcactattcgtcagctgggcccttccatgatacagcagatgcagcagccttgcaatgagtgcaaggggactggagagagcatcaatgagaaggaccgctgtccagggtgcaagggtgagaaggtcattcaagagaagaaggttcttgaggttcatgttgagaaaggggttccacacaaccagaagattacctttcctggtgaaatctgatgaaacgcctgatact

SEQ ID NO: 42765 - DNA, 302 bp, Triticum aestivum
  Clone ID: PAT_TA_42765
tcgggctcgattaccctggcgttggacccgagcacagtttcttgaaggacattggacgtgccgaattcgatagtgtgactgaccaggaggcactggatggtatgtctcgctctctttccattgtctgttatgggttgaactatttttctttttgacgaagttgatttccaatgaacctacaaattgctggttggtgtgatatcagctttcaacatcttgacttatcttttaatgactgggtgttatatatattcagttgatgtagcttgtcatgatattgagatgccaataatgtttttcta

SEQ ID NO: 42766 - DNA, 446 bp, Triticum aestivum
  Clone ID: PAT_TA_42766
cggacgcgtgggcgcgccgctgacgttccgtggcttccagcagtaccgggccctcacagtccccgagctcacgcagcatatgtgggatgccaagaacatgttgtgtgccgctgaccctcgtcatgggcgttacctcaccgtctaggccatgttccgcgggaagatgatctccaaggagggtgacgagcagatgatcatcgtccagatcaagaacttgttctactgtgtggagtggaaccccaacaacgttaagttcagcgggtgcgacatcccgcccaggggcctgttcatggcgttcaccttcatcggcaactggaccttcatccaggagatgttcctgagggtgagagatctgttcactgtcatgttcaggagagatgggtatcttgcactgggacactggcgagggcatgggacgagatggagtttaccgaggccgtatatgc

SEQ ID NO: 42767 - DNA, 281 bp, Triticum aestivum
  Clone ID: PAT_TA_42767
gttgaccaatgtcgttgcaatgcatccttgaactttgccggccactgtcgatccaataggataccatacataggcttgatcgaaggggtttgttaagcccaaagtgccttctagagcataaagctttctcctctattcagcatgtcacaatgttattgccccttcaatgaggtcaatcagtcaacgaataatacgcagctttaactctataaggctggtttatggcccacaaggaaagtgaaggcctagcttatggatttgatagagaacattcttgcatg

SEQ ID NO: 42768 - DNA, 351 bp, Triticum aestivum
  Clone ID: PAT_TA_42768
cgacccagcctcctccgttcggactttctggagcactcccgcgtgtggtcggtcttcgaaagcgcagcgttcggtcatgactcgcctgctggagcggtcggggctcggggaggagacgtgcctgccgtacgcgcagcactacatcccgccgtctcgcgacctggtatcctcccgcgccgaggccgagctcgtcatcttcttggccatcgacgacctgctcgccaagaccggggtctcccctcgggacattgacatcctggtggtgaactgcagtctgttcgcgccgacgccttccttcgcgtacatggtcgcgctcctggtcatgcttcgcggtgacttgcgcaacgtgca

SEQ ID NO: 42769 - DNA, 451 bp, Triticum aestivum
  Clone ID: PAT_TA_42769
tgtcggcccgccttttttcgttgtcctttctttctgatccaatggctctgtcccttggggcgctattctccctatcgtgtattcttttctttctttttgcattatcgccgtgtgctagcttggtttttgacttattgtgcgttattcataatccggctcactgttttttcattcctctgtcttttcatcctttctcgatgtctcttttgtgtgtattaactgtttctttttttctaggttgtttttctttttcggttgcgtcttcatttttggttttactttcctgtcttatgtcgttcttatcccttttccgtttccttttgttggctgatcattccctcattttgttgtattctgctttcctttgatttgttgttgccttttttctattttttcaaatttcttctctattttgttacactttgttttcatcatctcttttttctttttg

SEQ ID NO: 42770 - DNA, 230 bp, Triticum aestivum
  Clone ID: PAT_TA_42770
tcgcccacgcgttctgtgacgcgtgggttctaaaaagactttttcattccctcggcgcccgccgtccgccgcgattcacccccggcaggtcgccacgcccgcattccggcgacgcaaagccgcgcgcgagggctctcccctgcgttcgcggtgatgaagatcgtgcaccgggaccctgtttgcgacgggcccggcttcgccaagttggtgccggaggaggaggaccactt

SEQ ID NO: 42771 - DNA, 438 bp, Triticum aestivum
  Clone ID: PAT_TA_42771
cccactcgtcctctttcaatagcattgctacaacaatattttgtccgtgaagtgacaatacttttcaacctgtgcaacgagccatggttaaaatatagtataagcattgcggcagacaatggattgaaaatgttactttatacttctgctagactgaagaaaggagaagtaatatttttggagacacatttttattggtactagctgtgcttcagtggagagaagcctcggggtattggatctgagctctaatgcatttgatgcagaacctgagaaacaccagagcattagtcaccattcacaatacggctctgtggagcatgaactccgggatgtgtttcgatggtcccggtgtaagaaggccatgcctttatgagccatgctcttcactgctttcccactaccagcagatcagctcgagggtgtgcatgattacct

SEQ ID NO: 42772 - DNA, 386 bp, Triticum aestivum
  unsure (1)..(386): unsure at all n locations
  Clone ID: PAT_TA_42772
cctccgtgcagtgcacggaccctgccgggcatcttccgtgccctctggtgtcgccgacggaccccgtggacttcaagccggaaagcaaggtgactcgcatccggcagccggtgcatcttctgagccgggagtaccatgagaagtacaaggaggccgtcgcgaaaatgaaggcgctaccggaagagaacccgttgagcttcgcggcccatgcggccattcaccaggcttactgcgacgcctactacaagtacgacccgacggccaaggacgcgccggtcgacgtgcacttttcgtggatcttcgcgccgtggcaccggatgtacatctactnttacgagcgcgcccttgggcagctcatcggcgacgacaccttctcgcttgcgttt

SEQ ID NO: 42773 - DNA, 378 bp, Triticum aestivum
  Clone ID: PAT_TA_42773
caactatatatataaaaaagcaaaaccccacatggctcgggggcggctctgcaagaatatttcagggctatctgttgacacgagggaaaacaaacaacgcctatctccgtcagaagagaggctataacacatagcctttcagcaacacactcccattgacatccttgagctccaagttcttcaacgggatcgattggctgccaccaaatgccatgttgctgagcccgtcactcgttagccaaatgggcaggaccttatcgatgaccttcttgaccaacttgtgctcctggatgtcagtgtatatacgacgcgtagcttttgccggcctttttgaattccaccagcacgctgcagaacctttgctgcgtaagaagctgg

SEQ ID NO: 42774 - DNA, 459 bp, Triticum aestivum
  Clone ID: PAT_TA_42774
tctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcatttgcaaaagattcctctttcttgtttatgggtcggctgctagaaagatttggagttggtgtaatatcgtatacagtaccggtttatattgcagaaatcgctcctcaagatcagaggggagctcttggttctgtcaatcagctctccgtcacgattggtatattgcttgcctatttgtttggcatgtttgttccctggagaattcttgctgttctaggcattttaccctgttcaatcctgaattctagactgttctttgttcctgaatcccaaggtggttggcaaaaatggggaagatggaggattttga

SEQ ID NO: 42775 - DNA, 453 bp, Triticum aestivum
  Clone ID: PAT_TA_42775
gccgaaggaaaacaatcctgaaaccaagccatgggtctgcaggaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaacttttttttttttcgaaagagcgcaggaggactg

SEQ ID NO: 42776 - DNA, 456 bp, Triticum aestivum
  Clone ID: PAT_TA_42776
aaccattaacatgctgcgcagggtggagccatatgttgcgtacggataccccaacctgaagagcgttagggagttaatctacaagagaggttacgggaagctgaacaagcagaggattccacttagcaacaacagtgtcatagaggagggcctcgggaagcacaatatcatctgcattgaggaccttgtccacgagatcatgacggtcggcccgcacttcaaggaggccaacaacttcctctggccgttcaagctgaaggcacccctcggcggcctcaagaagaagaggaaccactacgtggagggcggtgacgccggaaaccgtgagaactacatcaacgagctcatcaagaggatgaactaggctctctcttgtatcctgagagaatgcttttctgtgtcagcgtggttgtttttgctctagtaagttgacggataatgatggatatgcaattt

SEQ ID NO: 42777 - DNA, 454 bp, Triticum aestivum
  Clone ID: PAT_TA_42777
tcgcccacgcgtccgtagttatcatcgtgtattgtttataaagattaatgttaaagagttttaatagttttttccttcctacttccaatgtctgaatttatacacgttacacgtatgatgtatgcatcatgttgagagctttcatcttaatgaagccaacaccaccatgtaaaatgtagcagtcggcatcctgagactgtttctgtaatcaattacatctgttgggagattcttgtcggtcgaacttatttgtttcttaacacacattcattaccttcctttaaggattgcgcttggacattccgggcagcgtgcacccaagattgaccaagctgattcgacggtgctaggacaaagatcctgatgcgtgtctgacttttgcagagattactatagaactccaagatagtctacaccatatcgaggcacccaagggagccagccgtcgttcttg

SEQ ID NO: 42778 - DNA, 441 bp, Triticum aestivum
  Clone ID: PAT_TA_42778
ctccgcattcccccggatgaccccgccagcctcgctcgcgccgccctcgtcagtaggcactggcaccgcgtgatcaccggccccgtcttccgccgtagattccgtgagttccaccgctcgccacctttgcagggctacatctccaacatccacaattccatccagttcgtccctatatcgtcgttccgcccgcgccatgctgacctcgacgacgtgatagcgatccactcaagccctggtcgcgtccttctctgtcgccgccccgggaagggtctggatgtcttccccgggaagggtctggatgtcttcctctccgtgtgggatcccatcaccgatgagctgcgggatttgcccgcgctgccgctgccggtggtcccaggcccgtgcacatgtaactgggacgcggccgtcatctgcgccgtaggcgagggctgcaaccat

SEQ ID NO: 42779 - DNA, 461 bp, Triticum aestivum
  Clone ID: PAT_TA_42779
ggcacacgcaaaattccccatcccccaaggaagccacgccctcgcgcaccagcgcgaccggaccacaccggcaccgcccgtctgaccgacgcaacccagccgtccagacgcgccgccgaccgtccttccaccaccacgcccgcgccgtcgcacgctccctagggttccgcagggccggggatcgccggagatggactggagcgcggtgacggcggaggacttggtggacgcgctgcgggaggtggactggtccatgccgccgcggcctgtcccggagttcttctcccgcttcaccgtcccacgctcctactccaagtggaccagccgcctcaagtgcaacctctactactacaggacaaactatttcatcttgatcatgttcatccttgggatgggcttcctttggaagccagttgctatagttgctgcttttatgactggacttagcatcgcatttctca

SEQ ID NO: 42780 - DNA, 464 bp, Triticum aestivum
  Clone ID: PAT_TA_42780
cccacgcgtccgagccagtggtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagctctgctcgctccaaggactcaaactcaaaggaaagcagcgaaaggagcggaggaaaaagagacagaagcaccaagaaggtggacgaggaggagcccaaggggtacatacatgtcagggcgaggagaggacaagcaacggacaaccacagccttgcagagagggtgaggagggagagaatcagtgagaggatgagggtgttgcaggccctggtccctggctgtgataaggtcactggaaaagccctcattttggacgagatcatcaattatgtgc

SEQ ID NO: 42781 - DNA, 389 bp, Triticum aestivum
  Clone ID: PAT_TA_42781
ggattcctcatcgttagaccggcaataccaatttggtggaggtggtactactgggcgaaccccgtgtcgtggaccatctacggcgttgttgcgtctcagttcggcgagaaccaaggcgagctttcagttcccggtgggaagcccgtggtggtgaagcagttcttgaaggataatctcggcatccagcatgacttactcggctatgtcgtgctagtccatttcgcctacatcattgcgttcttcttcgttttcggttattccatcaagttcttcaacttccagaaacgttagctgcacctctactctctgctgtctcacacggacggtcatttgtaatctactttctcgtacgtcgaagcaaatgcttgtttgggaaaaaaaatattatt

SEQ ID NO: 42782 - DNA, 354 bp, Triticum aestivum
  Clone ID: PAT_TA_42782
cccacgcgtccggattctaaaaactaagaacaagaccatagtgatttagacattcagtttgaagaaccacaaggcatctgctgcatcctgctatgcatgcatacactgcatccttaccttgatatgcaacaagtgcttaatctactactgaaccgcgttaagagcaaagagctacacctacacttactatgccatgatcaagtcatatgctacctgctgagttatgcagacactacatacactaccgatgccatgaaaaagcccccaactcgctgaatgagtatggacagtcagtcgaattgactacttgatgatgtgagtcattgcgctcattcttatgatctgtgaggacat

SEQ ID NO: 42783 - DNA, 460 bp, Triticum aestivum
  Clone ID: PAT_TA_42783
cgcttcgagatccagctagctctctatcaagcatccggcggagcgagcagcggggggctcggcgagagagaagatgaagcggaagacgcggaacaagatcatcgtatggacgctggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaggtgtaccagttcgagaacctcttcgtcaagcgcaacacccccgtcgcgcacgccgtcgggttctgggactaccaggccttcatcaccgccgcggccctcttcgagccccaggggttctgcaccaccggcggcaagcagatgcagatgatggagctctgcgccttcctcgggcacgtc

SEQ ID NO: 42784 - DNA, 460 bp, Triticum aestivum
  Clone ID: PAT_TA_42784
cccacgcgtccgctcaggtgctgttggccacattccactgggccgtgggaagtaccagcttaaccgcggccgacactactattccgctttcaagaaaagtttgcgaccaacaagtacattaaagaagagcagtagctctggaatcgataaaaatttgaagtttcagatctctggcttaacatctcaaatagttgaatctgaaacatccagccttggtaagttacaggatttccaatgcttagatgttgcacaaactttattttccaagattcaaaagacaagaccccatccaagcaactttgatgttttatcggttgcccgctctgtatgctgtaagacaagtcttcttgctgcgttggaagttaaatacggacctttacctgagaacatatttgtgaaagctgcatagctttgcagtgacaatggcattcaaattgattggcatcaagagggattcata

SEQ ID NO: 42785 - DNA, 429 bp, Triticum aestivum
  Clone ID: PAT_TA_42785
gcatgctgtgtatacgtacgtacgtacgtatgtgtggacagaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgcccagtggcgcaccg

SEQ ID NO: 42786 - DNA, 454 bp, Triticum aestivum
  Clone ID: PAT_TA_42786
aaaccaacaaaatgatgaggccactgctcgggcacttcaggctgcaatgaacttgcaacaaaatctggcaaggatacaggcccatgcagttccagaacactatgaggctgaacttgagattaatgatttcccacagaatgcccgttggagaatcactcacaaagagacactggcccctattcaggactggactggtgctgctatcactacgaggggaacatatattcctcaaggaaaaattgttggtgcaaatgagcgcaagctttacctgtttatcgagggcccgacagagtcttctgtgaagaaggcgaaagcagaattaaaacgtgtccttgaggattgtgcaaaccaggctctaaatcttcctggatctgctcaaactggaaaatattctgttatttgagttgcagagtagataacaaagtggccgagtatttttttaggagcttataat

SEQ ID NO: 42787 - DNA, 422 bp, Triticum aestivum
  unsure (1)..(422): unsure at all n locations
  Clone ID: PAT_TA_42787
taccgctctcgcacgagcccacagatgcggcaagatcgaatccatggcgagagctagcagaagccgcgggcttggtgcttgaaccctcgatcattcttggaggtccccgttccttctccttgcattgctcgcgttcctcgacgcgagagcagaccagcacagagagaagaaaagaaaaaggagggttctttctcgcgtttcttctgtctattctgcggttctttcttgggagcagtaatgaggcggcatgggtggcagctcccgtaccatcctctccaggtggtggccgtgtccgtcttcttggcgctggccttcgcgttctacgtcttcttcgcacccttcggtgggaggaatgtgttccagtacgtggtcatagggctctacactcccctggntttatgtgtcttctttctatacatctg

SEQ ID NO: 42788 - DNA, 282 bp, Triticum aestivum
  unsure (1)..(282): unsure at all n locations
  Clone ID: PAT_TA_42788
atcactcgctaattaatggatgcggtggcttgtgggtttgctttgcttggccttggatgctgtctgttaaaaaaaacgcgggcactgggcacttgtcagagttgtcttgtgtctctctgacagtgctgtgtagtagtttggttggatgcgcgagaggagggaagatatcagcagcagcaggcggttggtcgatgaatggctgtaaaaggcactgtcaaaagtgttggggttataaaaaaagcggcgcttttaactttaaaaaaaagaactntttaaaaagtt

SEQ ID NO: 42789 - DNA, 354 bp, Triticum aestivum
  Clone ID: PAT_TA_42789
ctcgaaaagccttaaaccccgaccacagcctgtccgagtcacccgaccgttttccatcttcactcccaaccgtttcattcccacctaacttactttttccgatttcgactcgattcgtcattccaaacaggacaccgaatgcacgatcgatcccacaagccgcagccgccggaggctggcgagggcgccggcggcgggaacgtggatcgagtgctcttcaagaacctcgtcgagatggtgccgctcgtcgagtcgctcatggaccggagggtcaactcggcctactcgcgacgcacttcgctagtctacacgccggcgcccgccaagaaggcgagcgaattgggaagtgtcaaa

SEQ ID NO: 42790 - DNA, 441 bp, Triticum aestivum
  Clone ID: PAT_TA_42790
cccacgcgtccgaagagctgctgcatcagttccttctgttgggggtgactttgaaaagcgtactgaatctattgcagcaaaatcacggttgaagactgaggttcggtttaaggctgatattgtttccccagaacaatgggaaaggtgcatttcctttgatgtatatgcattgtgtcctatactctatatctaacttcaactagtagcaagactgtttttcacaagtacatatttttttctaacatagcacaataagtcaataacataattaaggtacatagattgtgtagcagcacagaagggaaattattagaaagatatataaacttacaatccaccctaaagtaaaggattatgatcttcccctctatagcacacaccatactttgaacttggaagccatattgctcactcaggtaaagaaatagggtttttttttgg

SEQ ID NO: 42791 - DNA, 456 bp, Triticum aestivum
  Clone ID: PAT_TA_42791
cttcatccatgcggttgagcgatctatagctgggatagagaaaaagcatgcaaaattgaagggtaatgaaaaggctgtcgttgcacggcatgaagtaggtcatgcactcgtgggaactgctgtagcgaaccttcttcctggacagccacgtgttgagaaattgagtatattgccaaggtcaggaggtgcattaggctttacatacacccctcccaccacagaggatagatatttactctttgttgatgaactacgtggccgtttagtaacacttctgggtgggagggcagcagaggaagttgttttagcaggacgggtttccactggtgcacttgatgacataagacgtgctactgacatggcctacaaagctgtagcaaaatacggtcttaatcagcgcatcgggccaatatcacttgctacactgtcaaatggtgggttagatgactctggtgg

SEQ ID NO: 42792 - DNA, 457 bp, Triticum aestivum
  Clone ID: PAT_TA_42792
cccacgcgtccgcccacgcgtccgagatattcgggcccctgctcccgatcatcacggtcaagaacatcgaggacagcatcgccttcgtgaaggccatgccgaagcctctcgccatctacgcgttcacccgggacgccgccctgcggcggcgaatcgtggacgagacgtcgtccgggagcgtcaccttcaacgacgcggtagtgcagtacgcgatagacgggctcccgttcggcggcgtcggccagagcgggttcgggcagtaccatgggaagtactcgttcgagatgttcagccacaagaaggcggtcatgaagcggggctacctcgtggagctgacactcaggtacccgccgtgggacgagagcaaagtcaccctcatgcgctacctctaccgcttcaactacttcgccttcgtcctctctttcctcgggctcaggcgatgaacttcactccagca

SEQ ID NO: 42793 - DNA, 436 bp, Triticum aestivum
  Clone ID: PAT_TA_42793
cggacttcctgggcatcagcccggagatcagcgacagcatatggtccgccggcctggccgaccacgacgtcgtcgtcggcgtgctcgacaccggcatctggcccgagagccccagctttagcgacaagggcctcggccctgtcccggccaggtggaagggcctgtgccagaccggccgcggcttcaccgtagccagctgcaaccgcaagatcatcggcgcgcgcatcttctacaacggctacgaggcctcgtcgggccccatcaacgagacggccgagctcaaatctccgcgggaccaggacggccacggcacgcacaccgcggccaccgccgcgggcgcgcccgtgccggacgccagcctcttcggctacgccagcggcgtcgcccgtggcatggcgccccgcgcccgcgtcgcggcgtacaaggtgtgctggac

SEQ ID NO: 42794 - DNA, 404 bp, Triticum aestivum
  Clone ID: PAT_TA_42794
gccggcagccgccgcaaccttctttctacgatgcctcgcaagcccaaacggaaggctccggcctcaccggcgaggcacgacccttcgccggagccctacccttcccatgcctccccctgctcggcacaatgcctggtagtccgcgacgccctcctcgcgttccacgggttccccgaagagttcgcggccttccgcgtcctccgcctcggtggcctctcgcctaaccgtgaccctcggccttcgtcccccacagtgcttgacggcctcgtcaccacgctcctctcccagaacactaccgacgccatctcccgccgcgccttcgcctcgctcaaagccgctttcccctcctgggaccaggtggtggatgaggagggaaagaggttggaggacgccattcggtgcgg

SEQ ID NO: 42795 - DNA, 110 bp, Triticum aestivum
  Clone ID: PAT_TA_42795
gcgtccgtcacgcgttcgtggactcgttgttttacgcgtcctcgcaagcccaaacagaagggggcggcctcatcggtgaggtacgacctttcgtcgtagtcttacctttc

SEQ ID NO: 42796 - DNA, 456 bp, Triticum aestivum
  Clone ID: PAT_TA_42796
cggacgcgtgggtgcactcgatgcatgtatcatccggcaaccttgtctgtcatggtgacattaagccggccaacatacttttagacgacaatctgacagcaaaattgacggattttgggatctcaaggcttctggttggtggcgtcactcgctacactaccactgtgaaaggaagcataggttacatggatcctatatacattcaagagggacgccttactccaagaagtgatgtttatagctttggattagttctatgtgaactaatggctggaaaaggggtaagaaaaggtgcaatcaacctcattctatacgccaacaaaggctgtgcaagtggtaaagggttcagagagatttgtgatgctgcaatcgcaaacgagaacaacatgaagatccttaaagagatgcagaaactggcagccgaatgcctatcgctgaccatttctaggcgtcctc

SEQ ID NO: 42797 - DNA, 449 bp, Triticum aestivum
  Clone ID: PAT_TA_42797
cggacgcgtgggatctgctgagcatgtcattgctacattgcgaggtgtgcacccagaatcaactaaatactttcttggggctgctgagaaattaacagaagaattgggacctcatgctcttgcttctgcactggcacatctgagtggattttctcagccaccttcgtcacgttctctcatcagtcatgagcagggatgggtgacgttgcaactaactagagaacagggatttggcagaggcttcttttctcctagatctgttactggttttctatctgatgtttgttcagctgctgcagatgaagttggcaaaatatacctaacagcagatgagaacgtccaaggagcagtcttcgatttacctgaggaaattgcaaaggacctgcttactatggagctccccccaagaaacacattaaccaaaatttccaagctgtctgcgttgcaag

SEQ ID NO: 42798 - DNA, 385 bp, Triticum aestivum
  Clone ID: PAT_TA_42798
tcgccccccacacctgccctccccgccgccgcggaccccctcccatggcaaagctcccgcgtctacgctgtccgtttgccgtgctcgcgctcgtgtgcatcctcccgctctttgcgccgcggcccgccctgtcctcccgcgccgcgccgaaggacggtgtctccttcgccggcgcaggcaacacgatacatcaactccttaaagatcacggccttcccggaggactgctcccgcgcggcgtggagtcgtacaccctggacgaatcaagcggtctgctgcaggcgcggctgtcggcgccgtgctacgccaagtacgacaacggcgacctggcctacttcgacaacgtggtccgcggcaacctgagcaagggtgcgctccgcggcgt

SEQ ID NO: 42799 - DNA, 438 bp, Triticum aestivum
  Clone ID: PAT_TA_42799
ctcttggatcagttactagaacttgagaagattcgtcagagagaatctgacataacaaaggagcggatcgataaaattctcaagtctggagctaatgttgtgttgaccactaaaggaattgatgatatgtccttgaagtactttgttgaggctggagctattgcagtaaggcgtgtgcgcaaggaagatttgcgccatgttgccaaagccactggtgcaactatggtgagtacatttgcagacatggaaggtgaagaaacatttgattcatcattccttggacatgctgatgaagttgtggaggaaagaattgctgatgatgatgttattctggtgaaaggcacaaagaacaccagcgcggtctctataatacttagaggcgcaaatgacttcatgcttgatgaaaatgaccgatcattgcatgatggcctgtgcatt

SEQ ID NO: 42800 - DNA, 460 bp, Triticum aestivum
  Clone ID: PAT_TA_42800
cccacgcgtccgcccacgcgtccgggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggccgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggca

SEQ ID NO: 42801 - DNA, 426 bp, Triticum aestivum
  Clone ID: PAT_TA_42801
ctggaagctgaattgagaaaactgaagaaggaactcgacaatgagaaggtaaaaatgttccagtgaaatgagcacacacataggaaggttatttgtccattacttacaagttgacaggacatatccttctgttagcaggctgctcgagaagaagcatgggcaaaggtttcagctcttgagcttgaaatagctgcaacgattagagatctatcaattgagaaacagaggtattagggagctagagaacggattattctacgggagactcagctgcgtgctttctattcaaccacagaagaaatctcttttctgtttgcgaaacagcaggaacagttgaaagctatgcagagaactttggaggatgaagagaactatgagagcaccttaatgggtgtggatcttaataaaggtcctctaaccactgat

SEQ ID NO: 42802 - DNA, 458 bp, Triticum aestivum
  Clone ID: PAT_TA_42802
cccacgcgtccgggcgaaggggccctcgagccaggccatggcgatgtggccgtaggcggtctcgttgagttgggcgcagtcccagttccggtggaggccacaacccgacgccgaaccccgacgctcagcttcgctgggaactactcgcaacacgccctcaccatctggaggccctccttcatgcagcagatccgcttcgacgcccacaccccgctccgggaggcctgggagatcgacgcgcacatgcagtccgcggtcaggggcccgggcgccttcaatgtctacggccgagcaggcgagcaccctgctccctggacggatccaccaggacctctcgatcgagctccagcagtaggcaccttccagatcgagctccagcagcaggcgcaggtgcgcagcgatcaatcagcgagcaggacgagcggcaggggagaagcactcgagtcgagagcagatca

SEQ ID NO: 42803 - DNA, 450 bp, Triticum aestivum
  Clone ID: PAT_TA_42803
aaatggtctaatttattggaagttgtttttggctgattgcgctacaggctgaccttgctttggttagcaaattcacttgctaagtttgtactatgttcactctaattacgttatggtggtgttgaccggtgagacaactaaggcaacacatattgtttactttgtttcgtagttaatttttaaattaaaaccaagtatccgttataaatggtctggtttataaatgctatctattttcccaaaaaaaatatttttgggtgactacgctacagcttgatcctgctttgattagtagattcacttgctaagtttattctatgttcactctcattacgttatggtgagatgttgacataatgacatgtgaccacaattatggcagcacatattgtttcagttactaaagtaccaactgctgatacatagggatcttaaataggaaaaaacaat

SEQ ID NO: 42804 - DNA, 449 bp, Triticum aestivum
  Clone ID: PAT_TA_42804
cccacgcgtccggagctagctccctcctcctcctcaggtagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagttcggcgccgagct

SEQ ID NO: 42805 - DNA, 448 bp, Triticum aestivum
  Clone ID: PAT_TA_42805
gccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggtgtaatcggctggggctcgcagggtcctgcgcaagctcagaacttgagagactcacttgttgaggcaaagtcagata

SEQ ID NO: 42806 - DNA, 288 bp, Triticum aestivum
  Clone ID: PAT_TA_42806
cccacgcgtccgcccacgcgtccggtttagcctagccacgctcgctctacctcctcaatcctgattagcttcaaaccgccatggccatggggctccccggcctccgctgccaccgcctcctcgctcgcgggtcactccctccactcggtcccgccctctatcgcaggcccctggagcgaacctaggctctccgctactcctccctccaagctcaagctggggacagtattggggaggaggccctgcgcatgttccttgaggacaggcaactgcacggcgatttcgtca

SEQ ID NO: 42807 - DNA, 424 bp, Triticum aestivum
  Clone ID: PAT_TA_42807
gcaccttcccaaaaaatcccccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcaccaagcccgccatccggaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctttacggcttcagaagctaggctggatgccttttctccttgctgtcgaggatgcctgttt

SEQ ID NO: 42808 - DNA, 338 bp, Triticum aestivum
  Clone ID: PAT_TA_42808
gcacgccatcttactctcacatcccctagagcggtcgcccgctctttttttatggcgcgcgtcaacttgctctttcaggtacgggggggattagccgtaaaatcctagaccctgccccctccgtaaccacagccgacacctccgttttcttgctcgccacgaagcacccatgcctgggtgtcgtctttgtggaccgtcgtcgagccgaggctaggaaagtatcgtcaccgccggtcatcggcaccgccatgcctgagctcaacttatagacctcccactacaagaaagaaaaggtgttcctgggccgccgtgaggagtatattgagtggggagggagg

SEQ ID NO: 42809 - DNA, 461 bp, Triticum aestivum
  Clone ID: PAT_TA_42809
gtgatcctgaatatgatgccacttgcaatgcaatagaagagatcaaatccagtctaaaagagtacttgaaggagcaacgaaagcttttgagacctgcatcggttaattatgttaatgttggaaaagatatgtacctaattgaagtgcctgagagtttgggaggttcagttcccagaaactatgagttgcagtctacaaaaaagggtttctatcggtactggacgccagaactgaaagagctaatattagaactttcaaaggctgagtcagagaaagaatcaaaattgaaagccattcttcagaatctgattcagctatttgttgagcatcacactgagtggaggcagctggtttctgttgttgctgagcttgatgtattgacaagtcttgctattgcaagtggttattttgagggaccaagttgctgtccaactataaaagaatcaaatggcacagacgat

SEQ ID NO: 42810 - DNA, 200 bp, Triticum aestivum
  Clone ID: PAT_TA_42810
gtcgaagcagggcaggagctagggcgggtggaggagcctttgcccgggaacgaggagaggaggtggcagtggcaccccgcggctagggcagcgagagaggggcgaagaggaaggcggcgggcgcgtccgccatggctagcgaggaagtactccacaaggtccagaatcttatagagcgctgccttcagatgtacatgaac

SEQ ID NO: 42811 - DNA, 459 bp, Triticum aestivum
  unsure (1)..(459): unsure at all n locations
  Clone ID: PAT_TA_42811
ccctagcaccgccgccaccatgtcctcatctccatcttcagtgaaccgccgtcccccgggcccgctagcgttggggctggagtccttggggaagaagatcagcatcggctggtctccgtcccgggcggcatcctctccatctcgtgtcgcacctacgcgaccccactgggccatggcttctttccccgtggtgcaggtcttttcggtcctcaggcttcatccctgtgcaagtgcagggataattgcttctaatctcccgaggctgcataacctaattcagaggcagagcaagggggcgtgagggagatgagggagatcatcagcatccatatcgcgtaggcaggcatccagtgacacctctgtcgggatcgcgagggatgcgttcaacacgttcttcagtgaaacgggcgcagggaagcacgttccaagggccctgtntgtcgacttggagcccactgg

SEQ ID NO: 42812 - DNA, 458 bp, Triticum aestivum
  Clone ID: PAT_TA_42812
ctacttcttgctgccgcattctttggctacatgcttgcactgctccaacgccgagttttagggatgtattcaaatggagatgagcaggaagacgagagtccagtgaaagctaaactatctagcatcccacctccgtaccagaagccactgaagatctttcattgatcaccgctgatcccaaatgatagactaactcgtgaaacaagaggaagaaggactcttcacgttatttgccaaactaccgggtgtagcatgatcatcagtcgcagagatcgtctgcgccacattctccagaaagaagcgagtgaacgttcaccaccaccagctgggcaggccgacctcgtggccagtgcaagagagctacgccatcccgagggacgagaccgcgccgccactggacacgagggcgccgaccccacgcaagagctacgcctttatgttaaaggagccggagaaga

SEQ ID NO: 42813 - DNA, 456 bp, Triticum aestivum
  Clone ID: PAT_TA_42813
ggaagagctcaagaactatgtatgttactggatgactattgggagaggatgggcttgaaagttcctatttatttttcagctggtttaaccattcaagctaatgtgtactacaaaatgttgattgggtggactagtcaaaagatcaaggacagccatacagtgcataatccatttgacttcaagcatgtttgccactttgaacgttccttcattaacaaccctggtccctgtgtactttttgcaacacctggtatgattactgggggattttcccttgaggcgtttaaaaaatgggcaccatcagagaagaatctggttacacttccaggatattgtgtttctggaaccattggtcataagttgatgtgtgggaaacctacaagggttgattacgaggacactcatattgatgtcagatgtcaggtcgattttcacgtcatttcatatcttgcaaat

SEQ ID NO: 42814 - DNA, 449 bp, Triticum aestivum
  Clone ID: PAT_TA_42814
cccacgcgtccgcacaattgccccaaaagtaaatgtcataataggagaaaacaactgtcttgcatcaccacgagcgtgggctctctctctcctttctcgacgacgactgggccaccgtcgctgccgcctgccgccctacgccaggtgccaagcagccaggtgttcttggggcccttcgccggcgacgagcaccaccagctgaaatatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcattttcttctttgccatgtg

SEQ ID NO: 42815 - DNA, 500 bp, Triticum aestivum
  Clone ID: PAT_TA_42815
cgcctgctgtaccagagctatgacgtccgatgcgaccacgcgtacgctggcaccctgtatagcggaacacataaaggagagagaaagagaggagaggcaacacataaacaagagaagaagaagaagaaggggagatcgagatcgatcacgcaccgggggagcagatccttcgccttgccatcagggataaagattcatgcgaaatgccacctgaacttggaatgtcttctagaactgttgctggtgctgttgtaaataggaggcctcgccgcctgtttgggagatcatcagagaggaagaacccactcaacctttagtttgagcgtcaagtagctcgcctcgaggcaaggcagcaacaacagaggtgtgttattgagacagttattcccttcaatttctgttacgacttcaaatcactatcgctcaccgagagtgcaagtgaggatccttcatctcgacctacatcttcagaagagaacccttgaacatcgttctcacca

SEQ ID NO: 42816 - DNA, 409 bp, Triticum aestivum
  Clone ID: PAT_TA_42816
attcttagtcgtagattatatgacactcaagttagtgtcttccatacctggcaaaaggcatagctgcaactgatgctgttcatgaatactaacatgctaagctttgtgatttatacgagaacgattcagttgtcgacaaatgtgagtgctgtctcagcggcgatggactccatgctgcaactggttcttatagtaatttgcttcgtgttttgggttgctctcctgaaagcgtgggggcatcaacgttggaagccagcagaaatcccatgaggcgacaggttgctgatccaacaaggcctgcacggactctgaccggtgctgtgaggagaggtggagagaacacaagcgttgactccagcggaaacttttgcgaccttctaacaaagctggttcatcttgcgtggcaccc

SEQ ID NO: 42817 - DNA, 456 bp, Triticum aestivum
  Clone ID: PAT_TA_42817
gcagcagctgcggcagccaccaaaggcagtgctgccactgcttttaatcctccaatgagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgctgtggggaggaagggacagggacgtgctagtgagtttattatattggtatttatgttattatatactgtatgtgggagcagcagcgtggaaccgcactaataatggg

SEQ ID NO: 42818 - DNA, 363 bp, Triticum aestivum
  Clone ID: PAT_TA_42818
ggatatcggagtcgctgaggcagagcctcaggtccaaggggatcaagtcactgttccccattcaggccaccactttcgatctcgtactcgatgggcagcgacttggttgggccgaccgcccccggtcaagggaaaaacttggcttttggtctggccaatatggaatctttgggtaatggggccaacaagggatttaaacggactgaacatggcaggaccccaagtgttctcgttctactaccaacaagagagctggccaatcaggtgcacgctgactttgagttttatggtgcaacatttgggctctctgcatgttgtgtgtatgggggatcaccttatcggcctcaagaaatggcattgaga

SEQ ID NO: 42819 - DNA, 272 bp, Triticum aestivum
  Clone ID: PAT_TA_42819
gtgatccataagggcgggccgtgctactacccggacaacctggtgtcgcgcgccgccgtcgccatgaacctctactatgccgccaatggcaggcacccctggaactgctacttcaacaactcggcgctcgtggtgcagtccgatcccagctatggatcctgcacctactactgatgtctgtctgatgctcttttgtagcagagatcggtcgatgaaaggaaatataatccctgtgtatgctgtgctgggttgtgtctagagatgacaatagg

SEQ ID NO: 42820 - DNA, 463 bp, Triticum aestivum
  Clone ID: PAT_TA_42820
cccacgcgtccgcccacgcgtccgcggacgcgtgggttcaagacagagtaatggaagaaacaaaggagaagaagaatgctgttgaagcttatgtgtatgacatgcgtaacaagctatatgacaagtacagtgattttgtcacgtctgaggacaaggaaggtttgattgctaagcttcaagaggttgaagactggctctatgaagatggcgaggatgaaactaagggggtttatattgctaagctagaagaacttaaaaaagttggtgatcctattgagctgcgcttcaaggaatgggagattagaagttctgctgttagccaactggtatactgcatcaatagcttcagagaagctgcacagtctaccgaccagaagtttgaacacatagacatgtcagaaaagcgaaaggtcattaatgagtgttcggaagcagagacttggctaatagagaaaaagcagca

SEQ ID NO: 42821 - DNA, 424 bp, Triticum aestivum
  Clone ID: PAT_TA_42821
attcttagtcgtgattatatgacactcaagttgtgtcgtgaagaacattttagtaatttgagtgctcattcagttggtgctccctcctcatcacgcaaataggtactgaagcccatatgactatgcagatctaggacagaatgtttgcaataaatactgacatggatatctagctttggctttgaaagatgtaaggatcttttgttaaattgatttacctaaggtcctgctacaagagcttacctagtacctcggtatatctttgtgagattacaacaaaagtattcaatttctacatattttactgctacacagatttgtctgtctgtttgggcaaagatattggtcggttttactgctggaaaaagggattaaaaaatctgcaacctgatttcaatttttattttttaattgcatcacgatg

SEQ ID NO: 42822 - DNA, 461 bp, Triticum aestivum
  Clone ID: PAT_TA_42822
ggcgcattccagcctggtgtgacagagttctatatcgagacagccgaactagttcacagattgagtgttctttggaatagtcctgtagtctgttcgatatcactgtactactcttgtatggaagcaacagacagtgatcataaacctgtcaaatgtgtgttcaatttatatattgctcatagtggacaaacaaacaatgaggcagaagtatggagaaataatgggttcaaataaggaagtgcttgactcacttcaaggcttggaggctttgcctgaagtagatatcagcacgaatgacatcattctgcaagatcaaaacccttttgttgtgaaactgcacaacagaagtacaaaagagttggcttgttttgagatcattggtcagacaccaaagtcatctggcacacctttgtcaggtttcccttcttggctgaaaagttctccggcaatcggtataattt

SEQ ID NO: 42823 - DNA, 428 bp, Triticum aestivum
  unsure (1)..(428): unsure at all n locations
  Clone ID: PAT_TA_42823
ctagactgtagcatgtaaagagtatatggtttttgtagggcatggtccagagtagttgctggaggtgtttcccatgcacgttccatgttcaattatacacaatcttatcttgcacaatccattcccacatcagcatgggcattccgcattatctccttgcgcaaactgcattctctatcgcagacagtgaagcaagagaagtttcttatttcgagaatatcataatatctgcatttagcatgagcataacattagcaatcgctctttcttttcgatggatctcctatggaaaaagaagagcagccaagtaaaccgtgggaatgtttttttagtgttgtcttgagttcgatggcaacacccangtcgtgaaagcatcgagacgcgatccccggcagtccggtgcagcggactgagtgcggctgactact

SEQ ID NO: 42824 - DNA, 435 bp, Triticum aestivum
  Clone ID: PAT_TA_42824
cccagccgcgacctgtctctgtctgttcttctgccccgatcggccgatcccacccacgcatctctctccgcgcccgcggtagtgttcgtgttcctcactcctcccgcttccttccccgacactgcctcagctcagatccgcggcggtttcccggtccctggatctaaagcggccggtgagcaggcctccttccgccgacgcggaccacctggagggaatttatcctggagccgtcttcctcctcgcctcctctcgcggcgcggcgcggaggccggaatcacttggaggtctagctgtgtgtggattgatttcttcgtttgtggtggctagaggcacctggtttgtttcttgccgaagcccgtggtacatgtgaacagcagggcctgtcttctgcttttgcttcttagcaatggcgaatgcaagcaacacttgcac

SEQ ID NO: 42825 - DNA, 454 bp, Triticum aestivum
  Clone ID: PAT_TA_42825
cccacgcgtccggcctgacccagagattgatgcaccctggtttaccaggggcacgttggataggtttgttcgatttgtcagtacaccagaggtcctggagcgggtcacaaccatagagtctgagatattgcagatcgaggatggcattgccgtccagggcagtgacagtcttgggttgagatctgtggaatactataatgggaaattggtggactgcatggaaggtagtaaggcaagttacaatcctgatgcagatagggcacttgttccatacaaggctggtacacaaccaattccaccattgcagaatcatgatgctacacaggaggagaattcaaaggatcaattgctcagagtgctagagactcgcaaaacagtcttacgtaaagaacaggctatggcctttgcacgtgctgtagcagcaggatttgacatcgacaacttggtgtatctg

SEQ ID NO: 42826 - DNA, 459 bp, Triticum aestivum
  Clone ID: PAT_TA_42826
cccacgcgtccggctccctccaccaagcccccgactccccgaggccccgacctgcgcacccacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaa

SEQ ID NO: 42827 - DNA, 425 bp, Triticum aestivum
  Clone ID: PAT_TA_42827
cagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattgagaaggctgatggctttgctggtgtttttccagaacacaagtatgagatcgtgaaacgcttgcaagcaagaaaacatatatgtggcatgactggggatggtgtaaatgatgcaccaactttgaaaaaagctgatattggtattgcagtaacaaattctactgatgcaactcgtaatgcttctgacattgtcctaactggacctggccttaatgggattattaatgctgggctgaccaatcgggcaattt

SEQ ID NO: 42828 - DNA, 455 bp, Triticum aestivum
  Clone ID: PAT_TA_42828
ctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgtggagaacccgtgccccggtcaagaacctttcagaattgtgccacaatcgtcaaagggcaacttcgtcgtggtccctggaaagacagactacccatcgaaggaatgggcggtcgcaaccctgt

SEQ ID NO: 42829 - DNA, 452 bp, Triticum aestivum
  Clone ID: PAT_TA_42829
atgctgctaacatgcacatggagattggtagacgcatatacagagagaggttggatacgagtgatcgggatgctgtcatggaacaaagacgggcatttcagaagttaatttatgtgtccaatcttgtctttggagatgcatctgtattcctacttccttggaaacgtttagttggggtgactgattctcagattgacattgctatgagggaaaatgccaagattttatactcggtgcagctcaagtctattggaagaggtcttgacataagcacactcattgaagtaaggagagcacaacttgcatataaactgtctgatgagattgctgctgagatgtttcgtgagcacgctaagcacctagttcaagaaaacatttcattatcattagacatctagaatcacgtattccggatatgtctaactcaagctgtggaagaagtgaatattgta

SEQ ID NO: 42830 - DNA, 457 bp, Triticum aestivum
  Clone ID: PAT_TA_42830
ttcacctaatctacaagctgcaattgatggccctggcaaaaggactggtcagccccttgtacaatgcacttcccacatgtgcccgataagaatccactggcatgtgaaactcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccagactttcactttcgaaaagggatgggccttcccacgccgagtttacttcaatggtgataattgtgtcatgccatct

SEQ ID NO: 42831 - DNA, 459 bp, Triticum aestivum
  Clone ID: PAT_TA_42831
cccacgcgtccgtaaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtag

SEQ ID NO: 42832 - DNA, 456 bp, Triticum aestivum
  Clone ID: PAT_TA_42832
ctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaagcctctccccacggcgcctccccctccacatggcctgggctcgccttgcctcccgctcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcatcgaccgcgtggctgctcggtgcccgctggcgccaggggcacggcaggaggtgctttgcgagcgccgtctacccggcgcaggcg

SEQ ID NO: 42833 - DNA, 449 bp, Triticum aestivum
  unsure (1)..(449): unsure at all n locations
  Clone ID: PAT_TA_42833
tgctgtgctgtgctgtgcatgcaaaggaaagagagaaagactgaaagagagactgagaggagaggcgctttgctgtcgtagtgttgctgccgcaacgccacaaaaagggtcaggggcagggaggtcatgtgaaagacaacacgacgcaggcctcctcctctctaatctttggcccttctttaaggggggctactcctgctaattccaatggggcgcatttagtggggggaggaaaagggatccttgcgaagacccagacgccagaggggagtgagggagaggggagggagaaataaataaacccgaattcagccaaacttctctctcccaccgcgcttgcattctctcatcgccaccccaccctcctcctncctgtctttctccccccctctctctccccctcttagacaaattttcctccacccattcccttcctcccctcttcttct

SEQ ID NO: 42834 - DNA, 445 bp, Triticum aestivum
  Clone ID: PAT_TA_42834
cccacgcgttcgccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgttcgacacgcccaagggcctggaggacctgaggaagaaggacctgcaagcgcttcggggcgacggccacggcgagcgcaaggcgtccgagcgcgtctacgactacgacgtgtacaacgacctgggcgacccggacaagaa

SEQ ID NO: 42835 - DNA, 405 bp, Triticum aestivum
  Clone ID: PAT_TA_42835
gcgtcgatttagtcgcgcgacgtctggggttcaagatgagtccacctgcttacctctcgttgacaccggtatcaaagtttgacctgttcacgtgccgaattggtgccaattacgcgtgtggcggatctggcattctcaacaccacgggaaacgggacactcacgctgcagaaacaaatcacgctgtttttcaaaactcaagcaagaatgtcgtgggcccgctgcaagctcaaatctatgggatcaaggtccttggtccttgtcagcgccggcggcaatgacttctccgccttcagtgaaatgggcatgggcgaacaagacgccccaggctacatcagtagcatggtctcaacctatgtccagcatatcgacgcgttgtacaaagtgggagcacggagggtgggga

SEQ ID NO: 42836 - DNA, 287 bp, Triticum aestivum
  Clone ID: PAT_TA_42836
ccgccgccgtcgtcctcctcctcctcctcctgccgcgcttctgctcaccggccggcgacaagttgacccccggggagtcgctgttgcccggtgagaccatcgtgtccgacggcggcgccttcgcgctgggcttcttcgcaccgtccaatgccacgccaggcaggcagtacgtcggcatatggtacaacaacatccccgtgcaaacggtggtgtgggtcgccaaccgggacgcgccggtcaccgtcggcgacgcgcgctccggcaactcctcgtcgtcgtcgtcgtct

SEQ ID NO: 42837 - DNA, 471 bp, Triticum aestivum
  Clone ID: PAT_TA_42837
gagctgacaaagaggatactagactcgccgcgcacagtagcgtgagtgagatagcacacagagcgtggtagcactgggctatcggtgacgccgtgtctcatgcgaactatcgccaggtgctcagatgtcgagcggaggctccatgtcgcgtgctgctaggctaggcagatccacgatgatgcatgatgtgcacaccttgctcaagtgtgagataactgacctgccattcttcgcataaagagtcaagtcgggcaacaacggtgttaactgcgtcatttttcgccacctgcacgaaatgactttttatgaggccgacgcacttgaggcgctttacgccgagttgacagcaagcatttagaatggtattgctttattgaacaaacaaagaaaagctggttcatctgtttgaggcgaatcatgttaaacagaaagaacaatcgtcttgaatggctaataaacagtgcagtctat

SEQ ID NO: 42838 - DNA, 492 bp, Triticum aestivum
  Clone ID: PAT_TA_42838
attcccgaatcgaccgatgcactccacgcaggcaatccagcgccaaccaacatggcagtagttctaaccaaaaggtaccttgatgtctcttacaagtgtgcttctcaggaccggaaattcaagctattcttcagaggctaggcacaattacactgagactcccaaagagattcaaacacaacatcataccataaacggaagcccatcgtacaattctgtacaggatcgatatgaaagagggaccgcccattgtgaatcatccactaagctggattgcagaaagagaaggctaatcttccagcaacctcaggcgatccctgttataaaccttgaaccacaaccagcaccagaaccatctgcacacgtcgccagcagagtcgctgatcacctatattttgatgatggtttctttgagaaccttaatcttgatgcaattgaagctcaagcaaccgaacagtggagacagaagaccacacaatcgacgcataaacc

SEQ ID NO: 42839 - DNA, 426 bp, Triticum aestivum
  Clone ID: PAT_TA_42839
cgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaaaggcgagatgc
